United States Patent 10,167,482 (GENES AND USES FOR PLANT ENHANCEMENT) - sequence listing, part 13

SEQ ID NO: 53477 - protein, 435 aa, Schizosaccharomyces pombe 972h-
MTDLRRNRYSISAGVGKSVLDSLGKFYGSPKRQLPNKFEAGKEYTGYNAPWIPFALDWLKQGKYSSEWIAMGSLNEEPNNMIQLLKLITGDDGNSHLEKAQAATDLEYPVTKLLWNPSSVGSNTDSQLLASTDQQLRLWKTDFEAGIDSPLLCQASLSTHVKTHNNAPLTSFDWCKTDPSYIVVSSLDTTCTVWDIVAQQSKTQLIAHDKEVYDVAFLKDSINVFVSVGADGSVRMFDLRSLDHSTIIYEGDSTFWKRNGDYTNASPPVSAPLLRLSACDSDVNLMATFHHNSSDVQMIDIRVPGTAYATLRGHKGDVNAVKWMPGSKSKLATCGDDCVVSLWDLDQPVNPSPAPTLSVSGTTPGMTGSTSEYVTPVSSVNSMRETASPLNADNQYSPLLSWKLEHEVNNLSWSVKNDGLAVVYGKSLEILKVPQ

SEQ ID NO: 53478 - protein, 279 aa, Gluconobacter oxydans 621H
MIDGHTKLAGVMGWPVEHSRSPLMHNHWCRVNGVNGAYVPLPTHPHGFDQALRGLAAAGFQGVNVTIPHKEAAMLACDELTPTAKRAGAVNTICFVAGRIIGDCTDGTGFCDNLSAHDVAIAGRAMVLGAGGAARAVAAALLDRGCEVVIANRTLERAEALVEALGGGEAVAWYEWPSLLSGCSLLVNATSMGMGGKAGLDWDAALREAAPGLCVTDIVYTPRETPLLLAAQARGLRTVDGLGMLVHQARAGFRAWFGVDPQADRTTFDLLAASLRTDA

SEQ ID NO: 53479 - protein, 503 aa, Schizosaccharomyces pombe 972h-
MSFELSAPVPLSDNSEAILEKEIGETVKIEGDLVEVYEINRTVDFIKSGNYNSVALQFPDEHLADSGKVASILTNLVEANVQILADTNYGSCCVDEVAAEHMSADAIVHYGRACLSPTSRLPVLYVFGRLPINLHKLEKCLTIPLDQNILLVSDTRWYYAQDSILKSLKTLGYQNVYESHLKERIEPNLEEASTSYTIPGRTYSLPKSLSLQDMTLLYIGPDSPTLSSILMSHYSLVNQFLSFDPLSNKIVEESSFTGAKLRRRYALVQRCRDAGVIGIVIGTLGVHRYLHVLNQLRKMILNAGKKPYMLAVGKLNPAKLANFQEIECFVLIACGENSLIDSKEFYRPIVTPFELVKALSSDMSWNNDFILSFDEVLKLSEGKQSKEPSEVLTEESAEPHFSLITGKFVNSTPMRHLDVTLETADAKNNDSSSASIEKRGMRSLAVNGVYSPAAAFLQSKSWSGLDSVDEGEGPSKLYEGQSGIAKGYVGEGSKEKIQRDFGK

SEQ ID NO: 53480 - protein, 479 aa, Streptomyces avermitilis MA-4680
MDLGVRWKLHGDGRTPAPGAVVRPDERLSWPRTVGLGAQHVVAMFGASFVAPVLMGLDPNLAIMMSGVATVIFLLATRGRVPSYLGCSLSFVGVAAVIRAQGGTSATVTGAVFVVGVALFLVGLAVQRFGARIIHAAMPPIVTGAVVMLIGFNLAPVTASTYWPQDQWTALLVMAFTGLAVVCLRGFWSRIAIFLGLVFGYGISWASDRIFGKIHSVDASGKLTDHWRLDLSGVGKADWIGLPSFHGPSFQWSAILVALPVVIALVAENAGHVKAVGEMTGDPLDDKLGTAISADGVASMLSTAVGGPPNTTYSENIGVMAATRVYSTAAYWAAAGFALLFGLSPKFGAVVAAIPGGVLGGITVILYGMIGLLGAQIWLNARVDLRNPLNLVPAAAGIIIGVGGVSLKFTDNFSLSGIALGTLVVIIGYHGLRAMAPAHLKTQEPLLDSGTSSYDEAEGDKAGVSEAGDDKAEDQRASS

SEQ ID NO: 53481 - protein, 365 aa, Glycine max
MLNNNCSSSLLFRGPGLAFSHSIATTCNKRNTCWKAPQAAVRNDFCLPMSSSAVKNRTSIGDIRSLRLITAVKTPYLPNGKFDLEAYDNLVNMQIANGVEGILVAGTTGEGQLMTWDEQIMLIAHTVNSFGNKVKVVGNAGSNCTSEAIKATERGFAVGMNAALHINPYYGKTSLDGLVAHYNSVLSIGPIIIYNIPTRTNQDIPPSVVQNLAQNPNLVGLKECVGNERIKHYTDQGIVVWTGIDKTSHDARWDFGAVGVQSVASNLIPGLMRELMFEGKNATLNSKVIPLFDWLSQEPVPIALNTALAQLGVIKPVFRLPLLPLLVEKRIEFVMLVKEIGREHFVGDKDVQVLDDDDFITVGRY

SEQ ID NO: 53482 - protein, 315 aa, Arabidopsis thaliana
MAATSLTAPPSFSGLRRISPKLDAAAVSSHQSFFHRVNSSTRLVSSSSSSHRSPRGVVAMAGSGKFFVGGNWKCNGTKDSIAKLISDLNSATLEADVDVVVSPPFVYIDQVKSSLTDRIDISGQNSWVGKGGAFTGEISVEQLKDLGCKWVILGHSERRHVIGEKDEFIGKKAAYALSEGLGVIACIGEKLEEREAGKTFDVCFAQLKAFADAVPSWDNIVVAYEPVWAIGTGKVASPQQAQEVHVAVRGWLKKNVSEEVASKTRIIYGGSVNGGNSAELAKEEDIDGFLVGGASLKGPEFATIVNSVTSKKVAA

SEQ ID NO: 53483 - protein, 294 aa, Agrobacterium tumefaciens str. C58
MFKGSIPALITPFTDNGSVDEKAFAAHVEWQIAEGSNGLVPVGTTGESPTLSHDEHKRVVELCIEVAAKRVPVIAGAGSNNTDEAIELALHAQEAGADALLVVTPYYNKPTQKGLFAHFSAVAEAVKLPIVIYNIPPRSVVDMSPETMGALVKAHKNIIGVKDATGKLDRVSEQRISCGKDFVQLSGEDGTALGFNAHGGVGCISVTANVAPRLCSEFQAAMLAGDYAKALEYQDRLMPLHRAIFMEPGVCGTKYALSKTRGGNRRVRSPLMSTLEPATEAAIDAALKHAGLMN

SEQ ID NO: 53484 - protein, 341 aa, Oryza sativa
  misc_feature (66)..(66): Xaa can be any naturally occurring amino acid
  unsure (1)..(341): unsure at all Xaa locations
MGERASAAAAVAAFGRRAARLRSWQIRPVPAWILRAVRFPPRFFLWRESDVGFKEFLASDLIPPRXDLPFVVAPLHFDCVEQEGCSIQRLLRYLAELLAERHKLSPFIPVLPNSVRLLNQEILRVSTLLENASLLNQSGLEHGSPLTTGGLYSNGAAADMNGWTSAFQSEGSPAYSWRGGSQGSSSGLIVKKTMKVDIPVDKYPTFNFVGRILGPRGNSLKRVEATTDCRVLIRGRGSIKDPAREDMMRGKPGYEHLNEPLHILVEAELPVEIIDTRLIQARDILEDLLKPVDESQDFFKKQQLRELAMLNGTLREEGMQRSGSASPFHNSLGMKRAKTRG

SEQ ID NO: 53485 - protein, 340 aa, Brassica oleracea
MKGLFKSKPRTPSDLVRQTRDLFLYAHGSISLPDSKRDEKMAELSRNIRDMKSILYGNSEAEPVAEACAQLTQEFFREDTLRLLITCLPKLNLETRKDATQVVANLQRQQVNSKLIASDYLEANLDLMDVLIEGFENTDLALHYGAMFRECIRHQIVAKYVLESEHVKKFFDYIQLPNFDIAADAAATFKELLTRHKSTVAEFLTNNEDWFFADYNSKLLESSNYITRRQAIKLLGDILLDRSNSAVMTKYVSSRDNLRILMNLLRESSKSIQIEAFHVFKLFVANQKKPADIVNILVANRSKLLRLLADLKPDKEDERFEADKSQVLREIAALEPQDLA

SEQ ID NO: 53486 - protein, 413 aa, Cryptococcus neoformans var. neoformans JEC21
MSFALRARGLRAATRSLGAKPLRSTLPQVRYVQIDADKSSPMHDLPASGSEPFKVQLHADSFHSYRCDAPPPETTVTKDELINMYRTMVQMRRMEQAADALYKQKLIRGFCHLAIGQEAVSVGMETAITGQDRVITSYRCHTFAVLRGGTIKGVIAELMGRKDGMSFGKGGSMHIFTPSFFGGNGIVGAQVPVGAGVALAQKYNKEKAATFALYGDGAANQGQVFEAFNMAKLWNLPCVFVCENNKYGMGTSAERSSMNTQFFTRGDQIPGLQVNGMDILAVREATKWAREWATSGKGPLLVEFVTYRYGGHSMSDPGTTYRTREEVQQMRSSQDAIAGLKKYILEWGATDEASLKAIDKAAKEEVDAAVEEAKQSPFPDQVEFWSDIYYKGSEPTHMRGREKEEVHYYNKSA

SEQ ID NO: 53487 - protein, 221 aa, Brassica oleracea
MAFHSEDDKSEDYLFKIVLIGDSAVGKSNLLARFARDEFYPNSKSTIGVEFQTQKMDINGKEIKAQIWDTAGQERFRAVTSAYYRGAVGALLVYDISRQQTFQSIGRWLNELHTHSDMNVVTILVGNKSDLKGIREVPTSEGKALAEAQGLFFMETSALDSSNVAAAFETVVKEIYNILSRKVMSSQELNKQDPASLSNGKKVVIPSEEQGESKKGGCCST

SEQ ID NO: 53488 - protein, 241 aa, Populus trichocarpa
MGRGRVQLKRIENKINRQVTFSKRRTGLLKKAHEISVLCDAEVALIVFSHKGKLFEYSTNACMEKILERHERYSYAERQLVATDLDSQGNWTLEYNRLKAKVELLQRNHRHYLGEDLDSVSLKELQNLEQQIDTALKLIRERKNHLMYQSISELQIKEKAIKEQNNMLVKQIKEKEKALAQPALWDQQDHGPNASSFLLPQPPLPCLNISYQEEDPEARRNYELDLTLEPIYSCHLGCFGT

SEQ ID NO: 53489 - protein, 529 aa, Anaplasma phagocytophilum HZ
MLTIAIIDFGSQVTQLIARRVRELGVYSEVFSVDTDFPALLAQGKKIAAFILSGGPNSVSELQNIPKVVSDVLEINLKTGTPIMGICYGFQLLAHSFSSTVESDKAREYGHAQLQIVGESAITKGIWSVGQTACVWMSHSDSVVDNVPQGFNVVARSMNTQAIAFISNEERKIYGLQFHPEVSHTPEGRDILNSFLTTVGCARNWTVSSFLNTQIDDIRRTVGNGVVVAAISGGVDSSVASVLLHRAIGDQLKCVFVDTGLLRKGEVETVREFFVDKLKMSVSIVSAAFLFIERLRGVVDPEEKRKIIGNTFIEVFEQEAKKLGDAQFLMQGTIYPDVIESGASGLGVKIKSHHNVGGLPENMNLSLVEPLRCLFKDEVRALGSELGLPDVILKRHPFPGPGLAVRIIGEVTEEKLQLLQEIDNIYISMLYESGLYHDIWQAFSVLIPARTVGVMGDSRTYGHVCCLRAVTSSDGMTADCFPFGEAKEKQLKFLEFLQKVSVAIVGSLPRVNRVVYDVTSKPPATIEWE

SEQ ID NO: 53490 - protein, 500 aa, Mesorhizobium sp. BNC1
MQTAHTWKADRQQSLRGHTVPTALLIAGEWIERDKSFTVTNPATNEEIARVSDGTAEDALRALEAATASQEAWAAWAPRQRANLFHRAHRLMLERATAFAEVMTLESGKPLAEAKAEFALSADFFLWYAEQIAHLHGTFASGSPGGYRIIATHRPVGPCFLVTPWNFPLLMIARKGGAALAAGCTTIVKSARETPLTAALFAQTLLEAGFPAGTVNLIHTTSSASISEALLADPRLRKVSFTGSTEVGSRLLSGAAQNIVNASMELGGDGPFVVLEDADIDLAVRQAIICKFRNAGQACVAANRIICHAAVVDEFTQKFVDETRKLRVGDGFEPGTDVGPIISSPQLERVDRMVAMLKDAGAELLTGGKRKGVTGNFYEPTVMRIKGSAPACRNEELFAPIAVIYSVDSVAEAIRFANDTIYGLAAYVFTRNVDRAIAVSEKLDFGMVGINRGIMADPAAPFGGIKSSGLGREAGHDGIYEFLEPQYLALTVNEAAGISQ

SEQ ID NO: 53491 - protein, 345 aa, Brassica oleracea
MKKEMIEEVVIVGGLVMVQFVYAGNSLLMSYLMSLGLGPFTIVIFSTFATFLILSPFAILFERKQWPKELSARLIGKLVLISFAGVTLFQSLFLEGIRLTSPAMATAMPNLAPGLIFFIAWIVRLEKMNMKCVYSKLKILGTLLCVFGALTMSLMHSASIIQDEKDNASIFVFDRDRVVGCIYLLGAVFVLSTNVVLQASTLAEFPAPISLSAITALIGVLITMLVQLLQNQSGKVLTRSLISIGNLVGFSLLGGMVSGACVSFNGWAMKKRGPVMVSMFSPFATVISVGFSVLTLGESICLGSVGGMALMFMGLYLVLWAKGKEGFSQIESFECEFDAKKPLLS

SEQ ID NO: 53492 - protein, 162 aa, Populus trichocarpa
MGRGRVQLKRIENKINRQVTFSKRRTGLLKKAHEISVLCDAEVALIFFSHKGKLFEYSTNACMEKILERHERYSYAERQLVATDLDSQGNWTLEYNRLKAKVELLQRNHRHYLGEDLDSVSLKELQNLEQQIDTALKLIRERKNHLMYQSISELQIKLYPIG

SEQ ID NO: 53493 - protein, 332 aa, Buchnera aphidicola str. Sg (Schizaphis graminum)
MTIKIGINGFGRIGRVLFRLAQERENIEVVAINDLLDPKYIAYMLKYDSTHGNFKKDIEVKNNNLIINGKKIRITSIKDPEKLMWDKLLIDVVIESTGLFLTKDTAYKHILSGAKKVVITGPSKDDIPMFVRGANFDKYKGEKIVSNASCTTNCLAPLSKVIDDHFGIIEGLMTTVHASTATQKIVDSASKKDWRGGRGALQNIIPSSTGAAVAVGKVLPNLNGKLTGIAFRVPTANVSVVDLTVRYKKTATYNEICEVVKNASEQKMKGILGYTEDEVVSTDFNGKELTSIFDAKAGLSLNKNFAKLISWYDNETGYSSKVLDLVELVALK

SEQ ID NO: 53494 - protein, 293 aa, Polaromonas sp. JS666
MFFTKPVILEWRPEIAYRLPLLPLPAAPFLTPVFTSSLSFPPDCHTMYKLVLIRHGESTWNLENRFTGWTDVDLTETGIQQAKDAGKLLKAEGYDFDLAYTSVLKRATRTLWHVLDEMDRTWLPVVNSWRLNERHYGALQGLNKAETAKKYGEDQVLIWRRSYDTPPPPLAANDERCERGDPRYAKLPPEQVPLTECLKDTVARVLPFWNESMAPAIKAGKRVVVAAHGNSIRALVKYLDNISDSDIVGLNIPNGIPLVYELDAQLRPLRHYYLGDSEAAARAVAAVSAQGKA

SEQ ID NO: 53495 - protein, 484 aa, Oryza sativa (indica cultivar-group)
MEMTTTKRQQDHQVETMTTKKIDEEDEEVDDDGRAKRRGTVWTAASHIITAVIGSGVLSLAWAIAQLGWVVGPTVMLLFAAVIYFTSNLLADCYRTGDPATGRRNYTYMEAVKANLGGAKVKVCGCIQYLNLLGVAIGYTIAASISMMAIQRSNCFHARGEQDPCHASSNVYMIMFGIVQVFFSQIPDFDQVWWLSILAAVMSFRYSAVGLALGAAQVAQNRTFAGSAMGVAVGFVTKTGDVVTPAQKVWRNLQALGDIAFAYSYSIILIEIQDTLRSPPAEARTMRKATGISVVVTSVFYLLCGCMGYAAFGDDAPGNLLTGFGFYKPYWLLDVANMAIVVHLVGAYQVYCQPLFAFVERRAERRWPNGLPGGDYDLGWIKVSVFRLAWRTCFVAVTTVVAMLLPFFNDVVGILGALGFWPLTVYFPVEMYIAHRRIRRWTTTWVGLQALSLACLLVSLAAAVGSIAGVLLDLKSYRPFRSTY

SEQ ID NO: 53496 - protein, 396 aa, Mesorhizobium loti MAFF303099
MAETSVRNFNINFGPQHPAAHGVLRLVLELDGEVVDRVDPHIGLLHRGTEKLIEAKTYLQAVPYLDRLDYCAPMNQEHAFALAAERLLGIEVPKRGQLIRVLYCEIGRIMSHILNVTTQAMDVGALTPPLWGFVEREKLMVFYERASGSRMHAAYFRPGGVHQDLPRQLVEDIGKWIDPFLKSIDDLDRLLTGNRIFKQRNVDIGIVSLADAWAWGFSGVMVRGSGAAWDLRKSQPYECYSEMDFDIPIGKNGDCYDRYLVRMEEMRQSARIMRQCVDLLLGKESTGPVSNLDGKVVPPKRAAMKRSMEALIHHFKLYTEGYRVPAGEVYAAVEAPKGEFGVYLVSDGTNKPYRCKLRAPGFAHLQAMDFLCRGHLLADVTAVLGSLDIVFGEVDR

SEQ ID NO: 53497 - protein, 201 aa, Mesorhizobium loti MAFF303099
MAASLSELSTYLGERLIGRVNDADIAYGELTMHVEPRNLIEVVTFLRDDQRCQFISIIDVCGADYPSRPKRFDVVYHLLSPKQNVRIRLKVQADEETMVPSITGVFPGADWFERETYDLYGVLFSGHPDLRRLLTDYGFEGHPLRKDFPLTGFVEVRYDDEAKRVIYEPVELKQEFRNFDFLSPWEGTDYVLPGDEKAKTN

SEQ ID NO: 53498 - protein, 329 aa, Arabidopsis thaliana
MGNKRNLGFVIFFWALVVAVVATAIEHRRNERTKGVNGLDKIIIRDRRGRSAEVYLYGGQVSSWKNENGEELLVMSSKAIFQPPTPIRGGIPVLFPQYSNTGPLPSHGFVRQRFWEVETKPPPLPSLSTAHVDLIVRSSNEDLKIWPHKFEYRLRVALGHDGDLTLTSRVKNTDTKPFNFTFALHPYFAVSNISEIHVEGLHNLDYLDQQKNRTRFTDHEKVITFNAQSITKKKHTLQKKLDRLYLSTPDQLRIVDHKKKKTIVVHKEGQVDAVVWNPWDKKVSDLGVEDYKRFVTVESAAVAKPITVNPGKEWKGILHVSVVPSNRKA

SEQ ID NO: 53499 - protein, 586 aa, Gluconobacter oxydans 621H
MCGIAGLSCLPGHHPDQDALERMSQAIFHRGPDGEGRLDLGGAALRHRRLSIVDIAGGAQPFRLGAAALIANGEIYNDPAIRRRFPKTCFQTHSDCEPPLHLWLHDGAGYTHELRGMYAIAIVENEHGRHEMVLSRDPFGIKPLYIAAYEGGIAFASEPQALLAGGFGRRSVRDGARNELMQLQFTTGQDIIFDGIRRLLPGETLRIVDGRIVESRRRHVLHEARDTVPARLSDEQALARLDTALLDSVSAHLRADVPLGLFLSGGIDSSVILAAAHRLGLPHPRTWTARFDAGKADESADAAALAASVGAEHHVLTVTEDMVWRDLPSIVACMDDPAADYAVIPTWFLAREARKDVTVILSGEGGDELFAGYGRYRRVMKPWWKGGRAPYRSGTFGKRFAEHGRQWRRGIAMTELALGVSGLEGAQALDIAEWLPNDLLLKLDRCLMAHSVEGRTPLLDPVVAKAIWPLPEHFKVRDGYGKWLLRRWLQDALPQARPFAPKQGFTVPVGPWIEKQAHRLGPLVARQPCIRAMMPAADVERLFARASQRGVARQAWTLLFFALWHRHHIEGVPVDGDTFETLARAS

SEQ ID NO: 53500 - protein, 333 aa, Zea mays
MGISHVELQFNKMHNHQMFQLSYEILVEGPQSTVQVKRRPVARRKLANFCTKEDCRLSQCWLAIKCDPVVNTGQKQQGLWNRLTEAYNHRRGNMPERSTKSLMSRWDTIKTQCSLFSGYMANVLRENSSGLSDADKTSLAASRFATMEKRPFTLLHCWSILKDEPKWMDHSSNKQVRIIEVAPIGSNIIDLDPKDSFLGSTTSKQHLGQDASKGKTKKARSSSITVSSSDEYLAKMDDLSLQRLSVYQTTMAFEQQKAERDDQFRKQQLEIEQQKLAIERERLERQKRIDEKAEEERILAIDMSICNPAQRAYYKKLQQQILSKIQADMSNIE

SEQ ID NO: 53501 - protein, 721 aa, Photorhabdus luminescens subsp. laumondii TTO1
MNKKILILPGDGIGQEVCDAALPVFQALNLPVTLEIGDIGWTCWEREGNPVPANTWEKIASVDAVLLGAITSKGKEEAQQALPPHLRVKTRNYVSPVIQLRQRLGLYANIRPVRYVEGDRKPFRCCVIRENSEGLYAGFDFKGIPATATTWLQHPNIDKYGPEEAAWTVRLQTRFGLERLFITAFEYAKENNYSRVTFADKPNVMRESGHFAKGIFDTVAAGYPEIKADIHNVDAIALWMVKKPHEFGVIVSENMFGDILSDLAAGVMGGLGLAPSANIGSDIAYFEPVHGSAPGMAGKNKANPAAMFYTIALLLEHLGFADAAQQINCAVDNVIREGRTVTYDLGGSATTQQMAQAIISTLSKKCTSYSASVITVGDELLSGKYPNTNLQDISEYLTEQGYKVKQHQVCADDINQIATAVVRRLGQDTLIVVCGGLGPTLDDKTREAIAKVAGSPLEIRDNVWVEIQKQLEKLGVYCDHSNRFQAMFPSGAKVIPNVTGTAPGFSLNVDSSKIVVLPGPPSQMRLMLSEEHSIPPVAGMRERNYHWTLIGVSESKVGTMVNAFFDGVECDIHYLWKAPYVVVQVITPADAPLSVRQLVNFGAMFENKLVSDCQMTAMEKLSEQYRINWFTDDDELNTYLHTTYAVNNPSKSLSVNITAFPSISSFLSGEEMLGQMTLTTIDDEGRQHSVDFPCNKLLLQQSIPEYAAWSVLCARASKEEM

SEQ ID NO: 53502 - protein, 442 aa, Brucella melitensis 16M
MLTKTNAPSLDNFWMPFTANRQFKAAPRLLASASGMYYTDVDGNQVLDGTAGLWCCNAGHGRKRITEAVERQISTMDFAPIFQMGHNVAFDFAEKLAAIAPGGAEAKLDRVFFTNSGSESVDTALKIAIAYQRAIGQGTRTMVLGREKGYHGVGFGGISVGGLVNNRCVFPQIPADHLRHTLDIEKNAFSKGLPANGIELADDLERLVQLHGAEKIAAVIVEPMSGSAGVILPPKGYLERIRATADKYGILLIFDEVITGFGRLGTPFAVDYFGVVPDLVTTAKGLTNGAIPMGAVFAARKVYDGLMTGPENAIELFHGYTYSGHPVASAAGLATLEIYAEEGLLTRGAGLADYWQEALHSLKGAPNVIDIRNLGLVGAVELASRKDAPGARAYDIFVECFKKGLLIRVTGDVIALSPPLIIEKEQIDTIISVLGDAIKRAA

SEQ ID NO: 53503 - protein, 385 aa, Zea mays
  misc_feature (365)..(365): Xaa can be any naturally occurring amino acid
  unsure (1)..(385): unsure at all Xaa locations
MAHAQEIQLQIRGIPDEESVDARDGPKAATGRSTRSSFRWWMTVLVDMLMVLCGTTVATLLGRLYFNSGGNSKWMATLTQSGGSPLLVVPLLLSPARSAEERRPAALKMVAIYAGIGVMIGFDNLMYSYALQYLPVSTFSLVAATQLGFNAITSRLINAQRFTALIANSVVVLTFSAAILGVGSSSDETSSNVPRGKYPLGFVLVLAASAVFALILSLFELTFEKVVRVRTARWVLRMQMHTNLVASAVSVAGLLASGDWRTIPGEMASFKDGRTRYVLTLVGTAVSWQAAAVGLVRLIMRVSSLFANVTCTLALPLVPVFAVALFGDRMTGIKIVAMLMAVWGFLSYMYQHYIDARRRAGAENXSNAECRVCATRTGSHAVLPA

SEQ ID NO: 53504 - protein, 470 aa, Gluconobacter oxydans 621H
MVGIASSSSEGPSTQQPRSTARATTLGILAALAGLMFGLDTGVVAGALPFIATDFHAGDALQGWIVSSMMAGATVGSLFAGRISVRFGRTGAMLGAAILFLLGTLLCALAPGPAIMIVGRLFLGLAVGVAAFAAPLYISEITVESVRGAMISFYQLMVSLGIFLAFVSDSLLASGGHWRWMLGVMALPASFFLGIVLILPHSPRWLMMRGEKERARRVLQSLRSDEEVAEAELVDIQSRLQKSSDAGLGLFRSNPNFRRTVFLGMLLQIMQQLSGINALLYYAPRVFQAAHFGTNASIWATTLVGLTNMALTGVAIACVDRWGRRPLLILSCGIAAFSLAGVGTLLAIGAQSFGLQLLLCGFVLLFVAGFAIGEGPLVWTLCSEVQPTRGRDFGIGCSTVTNWAANWAISNMFPLGMAMMGASSTFLMFAVFNGLFILVTVLFVPETKGVSLERLEANLFAGTRLRDLGR

SEQ ID NO: 53505 - protein, 329 aa, Streptomyces griseus
MPIPMLPAHVPTIDISPLSGGDADDKKRVAQEINKACRESGFFYASHHGIDVQLLKDVVNEFHRTMTDEEKYDLAINAYNKNNPRTRNGYYMAVKGKKAVESWCYLNPSFSEDHPQIRSGTPMHEGNIWPDEKRHQRFRPFCEQYYRDVFSLSKVLMRGFALALGKPEDFFDASLSLADTLSAVTLIHYPYLEDYPPVKTGPDGTKLSFEDHLDVSMITVLFQTEVQNLQVETADGWQDLPTSGENFLVNCGTYMGYLTNDYFPAPNHRVKFINAERLSLPFFLHAGHTTVMEPFSPEDTRGKELNPPVRYGDYLQQASNALIAKNGQT

SEQ ID NO: 53506 - protein, 212 aa, Triticum aestivum
GAPPAATSFIGNLPSLVISTSHEADGGVICPVCKDPMPIRTRAKQLPCMHLYHSSCILPWLSSRNTCPVCRYELPTDDPESERSERAATNERDVLGVEEHTHLQEIGEEGSDEPEVEETQDMFNDAVEVTNTSEHGVHVAEQSNRARNHRRWLFIAVAPAVSFVGLALVLCFANHTSSGRRRLCRGSQSASAALVDQKEVGGPCSRYPVHVY

SEQ ID NO: 53507 - protein, 251 aa, Brassica oleracea
MVKIAVGSLGDSFSVASLKAYLSEFIATLIFVFAGVGSAIAFGKITSDAALDPAGLVAIAVAHAFALFVGVSVAANISGGHLNPAVTLGLAVGGNITLITGFLYWVAQCLGSTVACLLLVFVTNGESVPTHGVGAGLGAVEAIVMEIIVTFALVYTVYATAADPKKGSLGTIAPIAIGFIVGANILAAGPFSGGSMNPARSLGPAIVSGDLSQIWIYWVGPLVGGALAGLIYGDVFIGSPYEAVETREIRV

SEQ ID NO: 53508 - protein, 129 aa, Glycine max
MWEMKSLISKCCSQIDVKHLNADSENPVTLDSGIVTTGGGSEQGVDVLVPLCQREPSRLCLSNEGHCIGMHPSTADVLTVLLLALPLHTWSGIKEEKLRVEALSLLATEDLPPLLQEEVLFLRDQLHFL

SEQ ID NO: 53509 - protein, 542 aa, Pediococcus pentosaceus ATCC 25745
MTEKAMSILNNPYLNKGTAFTKEERDQLGLNGLIPPYIQTIDEQVEQVYAQFQTKANDLEKRLFLMQIFNENRVLFYKLFSQHVVEFMPIVYDPTIADTIENYSELYVQSQNATFLSIDDPDMMEEALKNSAAGRDIRLIVVTDAEGILGIGDWGTNGVDISVGKLMVYTAAAGIDPSQVLPVVLDVGTNNQDLLKNPMYLGNRHERIKGDRYYDFVDKFVETAENLFPNMYLHFEDFGRDNAANILNKYKDRYVIFNDDIQGTGIITLAGILGALNISKQKITDQVYLSFGAGTAGAGILGRIYEEMIENGLSEEEAKKHFYMVDKQGLLFDDDETLTPEQKPFARKRSEFDNADELTDLLSVVKAVHPTIMVGTSTQPGSFTEEVVREMAAHTERPIIFPLSNPTKLAEAKAEDLLKWTDGRALIATGIPVGDIEYNGVTYQIGQANNALVYPGLGLGVIASTAKVLNDTMISKAAHSLGGIVDVDQPGAAVLPPVSKLSDFSNTVAKAIAQSAVDQGLTKEKIDNVDQAVEDTRWNPEY

SEQ ID NO: 53510 - protein, 230 aa, Buchnera aphidicola str. Sg (Schizaphis graminum)
MKTNKLVLIRHGQSKWNKLNKFTGWHDIELSDNGINEALKAGSLLKKEKFFFDYAHTSMLKRAIHTLRYILDTLDQSWLPVQKSWRLNERHYGALEGLNKDEMISKYGEEQVNLWRRSFEIIPPQIRLNDKRFPGNDIRYSNIDNNELPLGESLELTAKRVIPYWNKFILPQIKKRNRVLIVAHGNSLRALIQFLNKIDNKKILELNIPTATPIILEFNEEYNSIKWYYL

SEQ ID NO: 53511 - protein, 320 aa, Buchnera aphidicola str. Sg (Schizaphis graminum)
MIKKIGVLTSGGDAPGMNAAIRGVVRTALSEKLEVFGIYDGYLGLYENRMTLLDRYSVSDMINRGGTFLGSARFPGFYKNEIRTIAVNNLNKRNIDALVVIGGDGSYIGAQKLTKMGIPCISIPGTIDNDVAGTDYTIGYFTALETVVEAIDRLRDTSSSHQRISIVEVMGRYCGDLTLAAAIAGGCEFIVLPEIHYKKEELVSEIQAGIEKGKKHAIVAITEYICDVEKLAKYIEKKTNRETRATILGHIQRGGAPVVYDRILASRMGAYAVELLIEGYKGKCVGIQNEKMVFNDITDALKNMKRVFKKDWLITAKKLY

SEQ ID NO: 53512 - protein, 934 aa, Aspergillus fumigatus
MSLLARPAKRKLDEVERIEAPKRHLSARGSRSHGIASDAIQPSILTPELDAALPRPESCPRHEQSETSGEHHWYPNSPRTLNSNLASPTRLESPTQPQRVFSPNASIVLIGIRGTGKSSLAVILAATSGKRMIDADQYFQQVTGRSRAAFKKEYDLTEYRQQEARVMESMLAEHKEGCVIACGPGSMERSGQQLLREYAKTHPVIHIIRDPESIQSYLKAWDTVKVRRFLELSGPVYRACSNLEFFNVSEKGFTDYAGKDNHNHSPLDLELDQRSQASTPFLTLKRLQRDFLKFVAFATGDSTILSGQQASFPLSMQPVESRMYTYAVTVPISSLFERELDIEDLESTADAFELKVDIAEGASDGQGIDSALADRISQAVATIRRNIVIPLIYHVESSLTPVGSPVQHNGPLRRSDDAYLSLIKHGLRLAPEYLTVDLSYSDDILSQVIASKGTSKVIGHFAWSHPCPKGWEDAEPLAMYERARRLGCDMVRLTQPATTIEDNFAVERFRHHVRGLPWQLPVIAFNTTPLGRMSSCFNPVLTSVTPPPLLAEMQSKSLPSLTLREAQEALYASFALDPMQFFVFGANVTYSLSPAMHNAAFKACGIPHKYTIYQSPSLRGLNELVENPYFGGTSVSLPYKTEVIPLLHSMSPHARAIGAVNTLIPIRKFPDGVDTAIESSLYLEKSRAGPTKALHGDNTDWIGIGNCFRRGLSPANAIRPSSTGLVIGAGGMARAAVYSMIHLGVQNIFIYNRTKANAEKLAHHYNRQNLLAHGWGGPNSRSKVHTLQSLQDDWPAEYKPPTVICSCIPAHSIGGVPAPNFQLPSQWLGSPTGGVVVEASLQETKANIMQLAYKPLNTPLMKQMRALSHRGWVALDGLDVLPEQGFAQFELFTGRRAPRRVMRRIVLQEYKEVEGQDEQSAIQSRLENLDGQPT

SEQ ID NO: 53513 - protein, 117 aa, Cryptococcus neoformans var. neoformans JEC21
MSRPALLLASRLGLKVITITVLDSSQGKPASGVKVSLQILKAELTTDIDGRCSTLLSPNVKLSPGIYKMVFFTGDYFKATGTETFYPVITFNYADPSQHYHIPLLLSPFSYTTYRGS

SEQ ID NO: 53514 - protein, 254 aa, Buchnera aphidicola str. Sg (Schizaphis graminum)
MKKKIIAANWKLNGSIKTISYFLTFLKSQISSFLKNNIIIIAPPTVFLERVYKDINSINIHLAAQNIDVNLTGAFTGENSALMMKDIGVKYIIIGHSERRLLHNENNEIIAKKFCLVKNLNLVPILCIGETEAEKKSNKTEKILKEQLNSIFNSFGEKAFRNAVIAYEPIWSIGTGVSADPKNVQLIHKFIKNYIKKYDIVSAENLIVQYGGSVTSLNAGNFLKQPDIDGLLIGSASLKHEEFLKIIKISDSFL

SEQ ID NO: 53515 - protein, 125 aa, Triticum aestivum
  misc_feature (67)..(67): Xaa can be any naturally occurring amino acid
  unsure (1)..(125): unsure at all Xaa locations
MAMVPAASVVSFSPRPSTGTTFGPRAGSASSSVGAGRVRAAGAPEGGKWWAPMLGWSGRADYIEAAXPAPGMAVVEEEEDKAGRSFVGGLTEEKARHLRARMVETESFHEAMYHSGIASRLGRST

SEQ ID NO: 53516 - protein, 208 aa, Triticum aestivum
MVGTVAKDVTTEPELLLERSRAITVRGSDKEGRAVVRIVGEYFPARALGGRAEEALKAHLRKRVLPEVGEREFVVVYMHSLVDRGDNFPGLGAIRAAYECLPAAAKERLRAVYFVHPGIQARLFFATFGRFLFSSGLYEKLRYMSRLEYLWAHIDKGELEVPECARRHDDELERRPLMDYGIEAADRCSVFDAASMDTPASLRSLRCS

SEQ ID NO: 53517 - protein, 266 aa, Escherichia coli K12
MTEPLTETPELSAKYAWFFDLDGTLAEIKPHPDQVVVPDNILQGLQLLATASDGALALISGRSMVELDALAKPYRFPLAGVHGAERRDINGKTHIVHLPDAIARDISVQLHTVIAQYPGAELEAKGMAFALHYRQAPQHEDALMTLAQRITQIWPQMALQQGKCVVEIKPRGTSKGEAIAAFMQEAPFIGRTPVFLGDDLTDESGFAVVNRLGGMSVKIGTGATQASWRLAGVPDVWSWLEMITTALQQKRENNRSDDYESFSRSI

SEQ ID NO: 53518 - protein, 297 aa, Oryza sativa (indica cultivar-group)
MLMDQILELREKEMNLLKENMVLRDQCKALSSPWSTSVGELKNKQADDDVHRHEDYSGGGVRDDDDRRMMEDVETDLAAANQAGKVLKKGKKKQAKDELDRQKQAEKKRRRLEKALANSAAIISELEKKKQKKREEQQRLDEEGAAIAEAVALHVLIGEDSDEPCHLMLNKHRRCNHWDHSAGFDFAVDAQGADIYPPDGLIQCADHVYAPKGRCIDWGIGQPLPSWGEVKDLQLQAPCYQGMFHQSVACPGFIAAQAVSSLQIGGDSSDITSPSQGATVVNRMLGATNRLNLYREI

SEQ ID NO: 53519 - protein, 455 aa, Arabidopsis thaliana
MRGVTETDKLANGIFHLVCLADLEFDYINPYDSASRINSVVLPEFIVQGVLCVFYLLTGHWFMTLLCLPYLYYNFHLYSKRQHLVDVTEIFNLLNWEKKKRLIEMSSISGLVEDEISSFFESSPPLKNKEEIVANLNQFIELNSSCQGGMRRIVCVTSGGTTVPLEQRCVRYIDNFSSGNRGAASTENFVKAGYAVIFLYRRFSEMMLLYIGSIMSSLGELVNRIAGIFLMIHSLNVLSFQMPKTFKVFHYNLFLSSYQTYVVHGSHSGAVKMAVMDQQAAVAEGRLLKLPFSTIYEYLQMLRLIATILKDVGPCSMFYLAAAVSDFYVPWLSMARTEHKIESGSGPLDIRLAQVPKMLSILRSNWAPKAFCISFKLETDSKILLEKATKALQKYKVHAVVANELLTRKEEVVVVSSSGNVVVRRDSNKPESIVEDNLIRLLVDRHSTYIKESLT

SEQ ID NO: 53520 - protein, 323 aa, Synechococcus sp. RS9916
MTTVTELLQPVELDLETLLSDLRSLIGAGHPILQAAAEHLFSAGGKKIRPGIVLLVSRALSPEGELTARHRRLAEITEMIHTASLVHDDVVDEAATRRGVATVHSRFNHRVAVLAGDFLFAQASWHLANLDDLEVVKLLSRVIMDLADGEVKQGLFRYDTGQSFETYLEKSYCKTASLIANSARAAGVLSEQTPDRLDSLYRFGRQLGLAFQVVDDILDFTGSDQQLGKPAASDLASGYLTAPALYALEEKPALGSLIEREFSEEGDLQQALELVRASDAIQRSRALAETFAREARESLEWLPESPCRRALLDLPEFVLSRLY

SEQ ID NO: 53521 - protein, 248 aa, Streptomyces bikiniensis
MEFEGQVALVTGAGRGIGRATVVRLAEAGCDIALHYNQAKAQAEEVAERIAALGRTVELFPGDLSRPETGRQLVAAVQQKFDRIDILVNSAGITRDKLLLSMEADDIHQVIATNLVGPMFLTQAVALTMLRQRSGRIVNISSAAASRPGKGQSNYAASKAGLEAFTRAMAVELGSRGILVNAVAPGIVKTGLTEALREGAEPELLARQVIGSFAEPEAVAEAVAYLASPRNTHTTGTVLTVDGGLKMV

SEQ ID NO: 53522 - protein, 438 aa, Mycobacterium sp. MCS
MGAHHTATEQSARLFADACAVIPGGVNSPVRAFNAVGGTPRFITSANGYWLTDADDNRYVDLVCSWGPMILGHAHPAVVEAVQRVAADGLSFGAPTPSETELASEIISRVAPVERLRMVNSGTEATMSAIRLARGFTGRPKIVKFSGCYHGHSDALLADAGSGVATLGLPSSPGVTGAATADTIVLPYNDVDAVEEIFEQVGDQIAAVITEASPGNMGAVPPEPGFNAALRRITEEHGALLILDEVMTGFRVSRSGWYGLDPVDGDLFTFGKVMSGGLPAAAFGGRAEVMERLAPLGPVYQAGTLSGNPVAMAAGLATLRTADDAVYAALDKNADRLAGLLTDALTDAGVTHRVQRGGNMLSVFFTAEPVGDFATARASETWRFPPFFHALLDAGVYPPPSAFEAWFVSAALDDEAFDRIAAALPGAARAAAEASRPA

SEQ ID NO: 53523 - protein, 476 aa, Streptomyces bikiniensis
MPESRPAPEPTKTEDGTDARPDTPARPGDTHPVDQMLPPLKLFSAGLQHVAAMYAGVVAPPLVVGIGVGLSTADIAFLMSASLFTSGIATLLQTLGFWKVGARLPFVNGVSFAGVAPMLAIAKAEGPDDALPVIYGAVIVAGVFGFLLAPFFCKLIRFFPPVVTGTVITLIGVSLLPVAFNWAQGGNAQAPDYGSLTYIGLATATLLITVVLRRVLTGFLKQISILLGLVAGTLLSLPLGVADFSAVGDADVIGLPTPFHFGAPQFAAAAIISMCIVMLVSMTESTADVLALGEIVERPADEKTLAAALRADGLGTALSPLFNGFAASAFAQNVGLVAITKVRSRFVVAAAGGILLLLGLCPLLASVVALIPQPVLGGVGIALFGTVAASGIQTLAGAALERGDNVLIVAISLGAGIIPIAAPDFYHAFPEGARIVLDSGISTGCVVAVLLNLAFNHLGRRTDPAPETLPAPAAHH

SEQ ID NO: 53524 - protein, 334 aa, Sulfitobacter sp. EE-36
MTNTQIVIAELPSDSLTPAHFKQTTADMPVAGDGQVLLKVILMSIDAANRSWMKGATYRAAVNAGDAMPTYAICEVVESNSDRLAVGDIVASEATWSNFVVADARKCEKLPKVPQLSNLMSVYGIAGKTAYHGLISVGQPVAGETVLVSAAAGSVGGYVGQIAKALGCRVVGIAGGAEKCKWVTEELGFDACIDYRAPGMSKALRSACPDGVDVYFDNVGGTVLEAALFAMNEKGRIVCCGAVSQYDTETPIGPRNLPGLVVVKRLRMEGFIVMDWTQNDAKALRALQTWVEAGQIKVTEDIVDGLENAPQALIGLLAGENKGKRMVRVAADPS

SEQ ID NO: 53525 - protein, 358 aa, Persea americana
  misc_feature (94)..(94): Xaa can be any naturally occurring amino acid
  unsure (1)..(358): unsure at all Xaa locations
MSAFCGKYQDELIANAAYIGTPGKGILAADESTGTIGKRLASINVENVESNRQALRELLFCTPGALECLSGVILFEETLYQKTASGKPFVDVLXERGVLPGIKVDKGTVELAGTNGENTTQGLDGLAQRCQQYYSAGARFAKWRAVLKISPNEPSQLAINENANGLARYAIICQENGLVPIVEPEILVDGSHDIDRCADVTERVLAACYKALNDHHVLLEGTLLKPNMVTPGSDAKKVTPEVIAEYTVRALQRTTPAAVPAIVFLSGGQSEEEATLNLNAMNKLKGKKPWTLSFSFGRALQQSTLKTWAGKEENVKKAQSAFLSRCKANSEATLGTYKGDAAKGEGVSESLHVKDYKY

SEQ ID NO: 53526 - protein, 472 aa, Podospora anserina
MAPAMRLTSSALRASLKASSFATKQTAFTAARCYSSKTQTLKERFAELLPEKIEEIKALRKEHGSKVVDKVTLDQVYGGARGIKCLVWEGSVLDAEEGIRFRGKTIPECQQVLPKAPGGSEPLPEGLFWLLLTGEVPTEQQVRDLSADWAARAEIPKFVEELIDRCPSDLHPMAQFSMAVTALEQTSSFARAYAKGINKKEYWGYTFEDSMDLIAKLPTIAARIYQNVFKGGKVAPVQKDKDYSFNFANQLGFGNNADFIELMRLYLTIHTDHEGGNVSAHTTHLVGSALSSPFLSLAAGLNGLAGPLHGLANQEVLNWLTEMKKVIGDDISDESITKYLWDTLNSGRVVPGYGHAVLRKTDPRYSAQREFAQKHMSEDPMFKLVSQVYKIAPKVLTEHGKTKNPYPNVDAHSGVLLQYYGLTEANYYTVLFGVSRAIGVLPQLIIDRAVGAPIERPKSFSTEKWIEICKKL

SEQ ID NO: 53527 - protein, 620 aa, Aspergillus fumigatus
MTLAQNHYVIQLPVTPITIGAVNPRDIAQQWLTNLEIQLGTSPVPELKLKLSELFHEDSWWRDMLALDWDFHTIHTVSEIEQYISRNQPRARLTSFRLQHDGRFQPKIETPVEGLRWISSMFFFESRVGRGTGVLRLTQDEAGVWKAYSLYTSLQELRGFEESVGVRRPKGTIESMPGNTSKENWLERRRGQLEFKNEEPTALLVGQAGLNMAARLQALGISCLVVDRNERIGDNWRKRYRTLVTHDPVEFTHMAYLPFPRNWPQFTPKDKLADWFEAYASIMELNVWLKTNVKSAEYDDSTAQWTVTVVRVDTGSERVLHPRHIVWCTGHSGEPKIPTFPNQAHFKGTIYHGSQHHDASDYDVKGKKVVVVGTGNSGHDIAQNFYENGADVTMLQRRGTYVITAAKGVLMQHEGLHEENGPSTEEADIISESLPYPVKFALDVHFTKRAYEAEKDILNGLKAAGFELDFGVDGAGISRAYMTRGGGYYIDVGCSQLIADGKIKIKRSPEGIAGFNDRGLLLRDGSALDADIVVLATGYDNMRTTVRKILGNRVADRCKDVWDLDEEGEVNAMWRPSGHPGFWFMGGNLALCRIYSKFLALQIKAIEVGLASQDTVHAKL

SEQ ID NO: 53528 - protein, 321 aa, Neorickettsia sennetsu str. Miyayama
MTAYDFLNASFSEKLRSVEEVLHDSMTTFTKLKSIEYAKKMLSSGKRIRALLSLLSFALCKNADTNAEIRAAATIELIHNATLMHDDVVDENSIRRGKPNIKSIHGNKISVLTGDFLLSVAFEIILECKNLSVVLLLSKTAKQLSEGEMLQLQSIGEIVSESEYLEVIARKTAVLFSAAAEIAAILTGKQEYVVILREIGFLIGMAFQITDDVLDYGEPQEVGKSVGNDFRECKFTLPCVIAYRDAKSKAAKKFWREVFFTEEKDIQEARFFMYEVDALAKAMEVARKYLSKAEKKLSIFENGASLLTMKTFLRYAAERPY

SEQ ID NO: 53529 - protein, 319 aa, Magnaporthe grisea 70-15
MASTTSNGNGHPASATNGSNGTSNIPSFAVKAGLAQMLKGGVIMDVTNAEQARIAEEAGACAVMALERVPADIRRDGGVARMSDPAMIREIKAAVTIPVMAKARIGHFVEAQILESLEVDYVDESEVLTPADEKYHIEKSDFAVPFVCGCRNLGEALRRIAEGAAMIRTKGEAGTGDVVQAVTHMRTLKADIARAKAALNEGGMPALRAIARELECDPALLKQTVDLGRLPVVNFAAGGIATPADAALMMQLGCDGVFVGSGIFKSGDPAKRAKAIVQATTHFRDAKMLAEYSSGLGEAMVGINCDSMQQSEKLAVRGW

SEQ ID NO: 53530 - protein, 217 aa, Rhizobium leguminosarum bv. viciae 3841
MPETEKPLFGHPWIFIRGVPSLNFLPPEGPLEVAFAGRSNVGKSSLINALVGQKGLARTSNTPGRTQELNYFVPDGYSGEGGDLPPTAIVDMPGYGYAQAPKEQVDKWTKLVFDYLRGRATLKRVYVLIDSRHGIKKNDDDVLDLLDKAAVSYQIVLTKTDKIKAAGVPKLLAETAEKIRKRPAAYPGVLSTSSEKGDGLDELRQAIAETVGIARWK

SEQ ID NO: 53531 - protein, 112 aa, Brassica napus
MASSMLSSAAVVTSPAQATMVAPFTGLKSSSAFPVTRKANNDITSIVSNGGRVSCMKVWPPVGKKKFETLSYLPDLTEVELGKEVDYLLRNKWDSLVFEFELEHGFGPWTEP

SEQ ID NO: 53532 - protein, 450 aa, Bordetella pertussis Tohama I
MAFDFDLYVIGAGSGGVRAARFAAGYGARVAVAESRYLGGTCVNVGCVPKKLLVYGAHFHEDFEQAAGFGWNPGRPEFDWPTLIANKNREIERLNGIYRNLLVNSGVALHEGHARIVDPHTVEINGQRHSAQHILVATGGWPFVPDIPGKEHAITSNDAFFLPELPRRVLVVGGGYIAVEFASIFDGLGAQTVQVYRRELFLRGFDGSVREHLRDELVKKGLDLRFNTDVERIDKRADGVLAVTLSDGSVLETDCVFYATGRRAMLDDLGLENTGVRLAESGYIEVDDEYRTSEPSILAIGDVIGRVPLTPVALAEGMAVARRLFRPQEYRKVDYDLIPTAVFSLPNIGTVGLTTEQALERGFRVTRYESRFRPMKLTLTQSQEKTLMKLVVDADSQKVLGCHMVGPDAGEIVQGLAVALKAGATKQVFDDTIGIHPTAAEEFVTMRTAT

SEQ ID NO: 53533 - protein, 612 aa, Streptomyces bikiniensis
MSQGPALLPRATDHASPTPPHPVDEILPARRMLPAALQHVASMYAGLTAPPLIISSALGLTPAQLSALLAAALLIAGLGTIAQTLGVYGVGAGLPLVNGVSFAVVSPALATAATQGRDGALPAIFGATLVAGLLCLLLAPVFCRLVRFFPPVVSGCVITLVGISLLPVAGTWARGGDAEAAGFGSPADLALAATTLVITLTVHRMLSGRFLGRVAILIGMLAGTLIAIPLGKVDLDPLAQAPLFALPTPFGFGTPQFVPTVIATAAVVMIVSMMESTAALLALGAVAERPVRDRTIAGSLRALGLATVLGGVLGSFTSTSYAQNVGLVSLSRIRSRYVVTLCGAVLVLMGFVPVLGSFVALVPLPVLGGAGVVFFGSVAVTGIRTLAKAALGTGHNAVIVSVTLAFGLFPVLDPDFYARLPAPVATVLGSGITAGCLVAVLLNYLLNHLGRGTEADPDAISAEQVTALDTADTVLGPKRSSDWTPFQPSGSPSGTPDHGRHTRGTARPAPAWPYVTGPVDPTDTGRHHRPHEVPAPPHRPDEVPPPLHPSAAHEGEPPPAVTENAVFPGPLHPLHPLHPRPTGRPDRPRQRHSAEADPWQHPQTPSASGDSQ

SEQ ID NO: 53534 - protein, 308 aa, Xanthomonas campestris pv. campestris str. 8004
MSYATHADTQLPHVGMHCSGMTNTSIPADLGDWIIAQAIAGHPPEHTLQPLLEAGWSEQDAIDAVEALVRAHVQAHAQAHGLPVPVPVRVPAPLQADASSLLDLGDRQVQVLVSLMLPRVVVLGGLLADDECDALIALARPQLARSRTVDNRDGSEIVHAARTSHSMALQPGQDALCQRIEARIAQLLEWPVEHGEGLQVLRYATGAQYAPHYDYFEPDAPGTPVLLQHGGQRVASLVMYLNTPERGGATRFPDVHLDVAAVKGNAVFFSYDRPHPMTRTLHAGAPVLAGEKWVATKWLRERPLHAPT

SEQ ID NO: 53535 - protein, 457 aa, Zea mays
  misc_feature (367)..(367): Xaa can be any naturally occurring amino acid
  unsure (1)..(457): unsure at all Xaa locations
MAGLLHLQSTLLPSASALRRRAGAPVPCSSRRRCRVEAKIREIFMPALSSTMTEGKIVSWTAAEGDRLSKGDPVVVVESDKADMDVETFHDGFLAAVLVPAGESAPVGSAIALLAESEEEIPVAQSQAASFSSSSPSPPPPQETAQEASPPPPPPPPSAPVAVSAPALPSPATQGGGRVVASPYAKKLAKDLGVDLFSVTGSGPGGRIVAKDVEAALAAPKKAAPVTAARPDVPLGSTVPFTSMQGAVSKNMVESLAVPTFRVGYTITTDALDQLYKKIKSKGVTMTTLLAAATAMALVQHPVVNCSCRDGKSFTYNKSINIAVAVAIDGGLITPVLQDADKLDIYSLSRKWKELVDKARAKQLQPXEYNSGTFTLSNLGMFGVDRFDAILPPGTGAIMAVGASEPTVVGTKDGRIGIKSQMQVNVTADHRVIYGADLAAFLQTLAKIIEDPKDLTF

SEQ ID NO: 53536 - protein, 510 aa, Brucella melitensis 16M
MNTAVRKIDVKKEAADLLSKLGVDASAYTGGDLTGFSPVSGEEIASIKTHSKEDAEKIIAKADEAFRAWRTVPAPKRGELIRLLGEELRASKEDLGRLVSLEAGKIPSEGLGEVQEMIDICDFAVGLSRQLYGLTIATERAGHRMMETWHPLGVVGVISAFNFPVAVWSWNAALAIVCGNAVVWKPSEKTLLTALACDAIFKRALKRFGDAPEGISQLLLGDREIGEVLVDSPKVPVVSATGSTRMGREVGPRLAKRFARAILELGGNNAGIVCPSADLDMALRAIAFGAMGTAGQRCTTLRRLFVHESVYDALVPRLQKAYASVSVGSPLETSALVGPLIDKQAFDNMQKALKEAAAHGGKVQGGERVDTGYENAYYVRPAIVEMPRQEGPVLEETFAPILYVMKYSDFDDVLASHNAVGAGLSSSIFTLNLQEAERFLSAEGSDCGIANVNIGTSGAEIGGAFGGEKETGGGRESGSDAWKAYMRRATNTINYSKALPLAQGVSFDID

SEQ ID NO: 53537 - protein, 479 aa, Prochlorococcus marinus str. MIT 9515
MAERFSQKNLRVRPSSDEDKIVTNAKEHFEKTLIKISGELVGSVAALEHPSKNLKLNYGEIFLRDNVPVMIYLITQKRYDIVRKFLSVCLELQSTSYQTRGVFPTSFVEEKGKLIGDYGQRSIGRITSADASLWWPILCWYYVNKSGDYSFGKSQSVQRGIQLLLDLVLHPTFEGTPVLFVPDCAFMIDRPMDVWGAPLEVEVLLHGCLKSCINLMELSREDHVSRLLDQRLILTSQWVEDLRSFLLKHYWVTSQTMQILRRRPTEQYGEDQHFNEFNVQPQVVPSWLQEWLENRGGYLIGNIRTGRPDFRFYSLGNSLACMFGVLPSSEQRALFRLVLHNRQHLIAQMPMRICHPHMDVEEWQNKTGSDPKNWPWSYHNGGHWPSLLWFFGTSVLLHQKRFPTEDVILMEEMRSLIEESYWCQLNQLPKQEWAEYFDGPTGTWVGQQSRTYQTWTIVGFLLMHHFLREENNDLDMFDL

SEQ ID NO: 53538 - protein, 398 aa, Escherichia coli W3110
MTLNRYRLRHMAKQGNRSAKRVEKLLRKPDRLISLVLIGNNLVNILASALGTIVGMRLYGDAGVAIATGVLTFVVLVFAEVLPKTIAALYPEKVAYPSSFLLAPLQILMMPLVWLLNAITRMLMRMMGIKTDIVVSGSLSKEELRTIVHESRSQISRRNQDMLLSVLDLEKMTVDDIMVPRSEIIGIDINDDWKSILRQLSHSPHGRIVLYRDSLDDAISMLRVREAWRLMSEKKEFTKETMLRAADEIYFVPEGTPLSTQLVKFQRNKKKVGLVVNEYGDIQGLVTVEDILEEIVGDFTTSMSPTLAEEVTPQNDGSVIIDGTANVREINKAFNWHLPEDDARTVNGVILEALEEIPVAGTRVRIGEYDIDILDVQDNMIKQVKVFPVKPLRESVAE

SEQ ID NO: 53539 - protein, 257 aa, Triticum aestivum
  misc_feature (27)..(27): Xaa can be any naturally occurring amino acid
  misc_feature (48)..(48): Xaa can be any naturally occurring amino acid
  unsure (1)..(257): unsure at all Xaa locations
AAIPQPVEGVLLHPFPCPCILVSPGFXLLYPLFEKHGAASLPVGVKNXGISDKDAINNIPFAWAFTWAGAWSVFLPFLILQVGKDAALRARLRDEVRAALERHAGEVGFASVRGMPLVRSTVYEVLRMNPPVPLQFGRARRDFVLRSHGGEGFSVAAGEMLCGYQPLAMRDPAVFDRPDEFVADRFVGAEGEALLRYVYWSNGPETGEPAAGNKQCAAKEVVVATACMLVAELFRRYDDFECDGTAFTRLHKRPQPS

SEQ ID NO: 53540 - protein, 231 aa, Streptococcus pyogenes M1 GAS
MVKLVFARHGESEWNKANLFTGWADVDLSEKGTQQAIDAGKLIKEAGIEFDLAFTSVLTRAIKTTNLALENAGQLWVPTEKSWRLNERHYGALTGKNKAEAAEQFCDEQVHIWRRSYDVLPPAMAKDDEYSAHKDRRYADLDPALIPDAENLKVTLERAMPYWEEKIAPALLDGKNVFVGAHGNSIRALVKHIKGLSDDEIMDVEIPNFPPLVFELDEKLNIVKEYYLGGE

SEQ ID NO: 53541 - protein, 448 aa, Mycobacterium sp. MCS
MSHSRPGVLIIGGGFGGLFCARRLSRADVDVTVLDRAAGHLFQPLLYQCATGKLSIGQISRPLREEFARHRNIRTLLGEAIELDPVARSVTALRPDETTFTVDYDVLVVAAGMRQSYLGNEQFAEWAPGMKTLDDALDIRQRLFTAFEIAETLPPGPERTSWLTFAVAGGGPTGVELAGQIREVATKTLAKEFHSIDPEEARVLLFDGGDRVLKTFAPALSLKANDTLRELGVELHFGVHVTDVRRDGITVTPKQGGPDQQFGTRTVLWTAGVEAVRFARHVAEVLGAETDRAGRITVGPDLTVAGHPEIFVIGDLAGREGLPGVAENAMQGGLHAASCIRRDLAGRPRRPYRYRDLGSAAYISHGHALLQVGPLRVSGYAGWVAWGLLHIAFLTGVSNRISTVATWLASIARTGRYHRAFMLGAGDRHDQRYTYSSWDLAEPAPEGN

SEQ ID NO: 53542 - protein, 402 aa, Sulfitobacter sp. EE-36
MGHVVVIGAGQAGSSCVAKLRNSGFEGKITLIGAETVPPYQRPPLSKAYLLGDMALERLYLRPESFYADHGIDLMLGTTVDSIDPAAQTVRVNGGDMAYDDLVLTTGSFPRRLPAHIGGDLAGVHVVRDLSDVDTMGPRFTKGARVLIVGGGYIGLEAASVAAKLGLQVTLVEMGDRILQRVAAPQTSDFIRALHEAHGVTIREGVGLERLTGDTHVTGAELSDGTTLDVDFVIVGVGIGAATALADAAGIVNDNGIMTDSHGRTSAPHVWAAGDCASFPYRGGRIRLESVPNAIDQAELVAENIMGADKEYVAKPWFWSDQYDVKLQIAGLNMGYDRVITRHADADSVAFWYYRGDELLAVDAMNDPRGFMIGRRLIEAGKSPAPALIEDPNTDLKALLKS

SEQ ID NO: 53543 - protein, 909 aa, Coccidioides immitis RS
MKTDFKFSNLLGTVYRKGNLLFTPDGTCLLSPVGNKVSVFDLVHNKSYTLPFSHRSNIARIDLSPNGKLLLSVDEQGKAILTNFPRRLTIYHFSFKSPVSALSFSPSGRHFVVGVGRRVQIWRTPSTPGTGASGELEFAPFVLYRDLAGHFDVVQNIRWSGDSRFFLTASKDLTARIWSLDPEEGFEPTTLAGHREGVIDAWFSDDQESIYTVSKDGALFRWQYGDKPGEPESTSESPILHWRITKKDYFMQQNAKLTCSAFHPKTNLLVVGFSNGIFALYELPEFNQLHLLSVSQSNIDYVTVNNSGEWLALGSAKLGQLLVWEWQSESYILKQQGHLNSMNSLVYSPDGQKIITAADDGKIKVWDINSGFCVVTFTEHTAAVTACEFTKQGNVLFTASLDGSVRAWDLIRYRNFRTFTAPSRQQFSSLAVDPSGEVVCAGSLDSFDIHVWSVQTGQLLDRLAGHEGPVSSLSFAADGSHLVSGSWDRTVRLWNIFARSQTSEPLQLQSDLLCVAFRPDGQQVAASTLDGQLTFWSVKDAIQQAGIDGRRDISGGRKITDRRTAANAAGTKTFTTITYSADGSCLLAAGNSKYICLYDVGTGSLVKKFTVSVNTSIDGTMEFLNSKNMTEAGPRALIDETGEASDLEDRIDRTLPGAKRGDAGARNTRPEIRVTSARFSPTGRSFCASSTEGLLVYSLDTDLVFDPFDLDISITPDSIIATVAAAKSASSTSSTTDPSESSFLKALIMSFRLNESSLIRTVYESIPPRDIPHIVRSLPTVYITRLLRFVANAADETPHLEFNLLWIRALLSIHGRYIKDNSGSFATELRAVQRAVDGIRDDLKRVVDKNMYALDYLLEGPAISTSNSADAVQRTTNGARKAADGDDIVTMDDAGKGSDGEGEWMGIED

SEQ ID NO: 53544 - protein, 185 aa, Erwinia carotovora subsp. atroseptica SCRI1043
MTTVTAQQQAELIKNSIKSIPDYPKPGILFRDVTSLLEDPVAYAASIDMLANRYRNTGVTKVVGTEARGFLFGAPVALALGVGFVPVRKPGKLPRPTISESYELEYGSDTLEIHADAISAGDNVLVIDDLLATGGTLEATVKLIRRLGGTVNDAAFIINLFDLGGEQRLTEMGVTCYSLVDFPGH

SEQ ID NO: 53545 - protein, 533 aa, Rhodobacter sphaeroides 2.4.1
MKQIWQALKAHQQAVEHRAILDLFTDPRRAETFSTRLGDMLFDWSKTNIDHTARDLLIDLAGAAGVAEKREAMFSGAKINETEGRAVLHTALRNMDRPVRVDGVDVTPALRETHARMQAFVRDLRSGRFTGQGGPITDVVNIGIGGSDLGPAMACLALAPYADGPRCHFVSNVDGAHIHDTLQDLDPATTLVIVASKTFTTIETMTNAETAKRWMAKRVSDPAAQFAAVSTAADKTAAFGIDASRVFGFEDWVGGRYSMWGPIGLALMIAIGPEAFDAFLAGGAEMDRHFREAPFAENLPVLLALVGLWHNQICGHATRAVLPYDQRLARLPAYLQQLEMESNGKRVAMDGHELTHHSGPIVWGEPGTNGQHAFYQLIHQGSRIVPCEFLVAREGHEPDLAHQHLLLVSNCLAQSEALLRGRSVEEARAILGKKGLTGSELERQARHRVFPGNRPSTVLAYEKLTPATLGRIVALYEHRVFVEGVILGINSYDQWGVELGKELALALQPMLEGRAGTEGKDGSTAQLVAYLRR

SEQ ID NO: 53546 - protein, 702 aa, Oryza sativa (japonica cultivar-group)
MRRHRPYLDGVAAAAATFLLAVLLHAPLAAGEDEPPPWVLCGPYPPSGNYSKNGTYQVNLDLLSTTLPKNTSSSPAMYATGTVGDVPDKVYGLALCRGDANASACERCVAAALRDAPRRCPLVKDVLVFYDLCQLRYSNRDFFLDDDYFVTTYTLQRSRRVGAAAAAAFDAAVAVLVNATADYAAADSSRRYGTGEEEGVDGDSDRPKIYALAQCTPDKTPEVCRTCLSTVIGQLPKEFSGRTGGGMFGVWCNFRYEVFPFFSGRPLLQLPAFVETPPPPPSPSATSGEKTKNRIGTVLAIVMPAIAAILLMVVACFCCWKRIKKRRPEEQTFLSCKSAKNYDSVSSDDIQSIDSLILDLPTIRVATDDFADTKMIGQGGFGMVYKGVLPDGQEIAVKRLCQSSRQGIGELKSELILVAKLYHKNLVRLIGVCLEQQEKILVYEYMPNGSLDIVLFDTDKNRELDWGKRFKIINGIARGLQYLHEDSQLKIVHRDLKASNILLDFDYSPKISDFGLAKIFGGDQSEDVTNRIAGTYGYMAPEYAMRGNYSIKSDVFSFGVLVLEIITGRRNTGSYDSGQDVDLLNLVWEHWTRGNVVELIDPSMGDHPPIEQMLKCIHIGLLCVQKKPASRPTISSVNIMLSSNTVRLPSLSRPAFCIQEVSASDSSNPYSERYPRPRHSGYSDNSTVVSSNDLSITELVPR

SEQ ID NO: 53547 - protein, 643 aa, Oryza sativa (japonica cultivar-group)
MACYYLAAAAAGLALLLLHAPLTDAQTLVPLCGDSGNYTEHGTYHANIQYLATSLPSYASSSPSLFASGSSGTVPDAIYALALCRGDTNSSSCATCVAAAIQSAQELCPLVKTVIVYDDTCILRFANDAFPISPTSNSQGMVVAWKAQNVSAAVAPAFEAAVVRLINTTADYAATDSVRRFGTGEEAFDETTFPKIYSLAQCTPDMAATACRSCLEDIVGRMVSGNLIGRMGGRVLGVRCNLWFEVYPFFSGRSLLQLPGPSPSPAPPVTAAGERSKNKRSAILAISMPTIALVLATIAAWFCSTSWRRRRLARKTLRPKSSEDEMQSFASLVLDLQTLRTATDNFSEHKRLGEGGFGVVYKGDLPEGQEIAVKRLAQTSRQGIEELKTELLLVAKLNHNNLVRLIGVCLEENEKILAYEYMPNRSLDTILFDAERIKELDWGQRFKIINGIARGLQYLHEDSQLKIVHRDLKASNVLLDSAYNPKISDFGLAKIFERDQSQVITHRIAGTYGYMSPEYAMRGQYSMKLDVYSFGVLVLEIITGRRNFGSYGSDHVVDLIYVTWEHWTSDKAIELIDPSLGNHYPVDKVLKCIHIGLLCVQPKPADRPLMSAVNAMLSSTGTVRLPCLSRPSFWVQEIGATAS

SEQ ID NO: 53548 - protein, 219 aa, Arabidopsis thaliana
MTLSRVHQQLITFPAVKTSPAGYLPDPASINKLQIPTSSKFSFLTGKGKSMLRKKKNDSFTNGVRDQDKLGPKLTETVKRKLSLGARILQMGGLEKIYKRLFKVSDEEKLFKAYQCYLSTTAGPIAGLLFISSKKIAFCSERSIKVASPQGELNRVHYKVSIPLCKINGVNQSQNTTKPSQKYLEVVTVDGFDFWFMGFLSYQKAFNCLEQALSLSFKQ

SEQ ID NO: 53549 - protein, 426 aa, Neisseria gonorrhoeae FA 1090
MNRNEILFDRAKAIIPGGVNSPVRAFGSVGGVPRFIKKAEGAYVWDENGTRYTDYVGSWGPAIVGHAHPEVVEAVREAALGGLSFGAPTEGEIAIAEQIAEIMPSVERLRLVSSGTEATMTAIRLARGFTGRDKIIKFEGCYHGHSDSLLVKAGSGLLTFGNPSSAGVPADFTKHTLVLEYNNIAQLEEAFAQSGDEIACVIVEPFVGNMNLVRPTEAFVKALRGLTEKHGAVLIYDEVMTGFRVALGGAQSLHGITPDLTTMGKVIGGGMPLAAFGGRKDIMECISPLGGVYQAGTLSGNPIAVAAGLKTLEIIQREGFYENLTALTQRLANGIAAAKAHGIEFAADSVGGMFGLYFAAHVPRNYADMARSNIDAFKRFFHGMLDRGIAFGPSAYEAGFVSAAHTPELIDETVAVAVEVFKAMAA

SEQ ID NO: 53550 - protein, 262 aa, Arabidopsis thaliana
MKITTEALRWWEDGETVGGRDLVGGGTWLGCTRHGRLAFLTNFKEASSFPAAKSRGDLPLRYLQSEKSPAEFAEEIQDEISLYNGFNLVVAHVLSKSMIYITNRPPHGDKLVTQVSPGIHVLSNANLDSPWPKVNSPNCVFLSLQCLRLREGFQQLLAENGSGEFPVKTMVEEVMTNTVKDEETELPHVFTPETEYHLSSIFVDMQRPTGRYGTRSISAIIVKSHGDGGGDGEICFYERHLEEGDSWKEHTQQFVIIQNQSI

SEQ ID NO: 53551 - protein, 368 aa, Debaryomyces hansenii CBS767
KHCTTNKQHSENAYIRCTIFDSKGDIVVHGKDIRRLQFMKTHNLVPRDFRKITRHYHGSNMSSMNNINVDIVPSIVTRGNSILLNLSNIKALIKSDTVVIFDSLSKNSGSGMNKSHSHGSFLKDMNEKLKTKNEQDDLPYEFRALECISIHVMLNLTTEMNVHKTVLQNILSRLEESIERVKLRYLLIQSKKIAQFHQKTKLIRDLLDNILEQNDELNALYLTEISKGKPRLQANHAEAEMLLESYYKTIDEIVQTVENLRSQIKTSEEIINIVLDSNRNELMLLGLKFSTGLLSMGCALYIAALYGMNLENFIEETDGGFELVVGGGSILLLILLMFSVKQLKKVQRITMTGMGRENSRISINDNKR

SEQ ID NO: 53552 - protein, 389 aa, Petunia integrifolia subsp. inflata
MANDILMKLPEDLVFLVLLTFPVKSLLRFKCISKAWSILIQSTTFINRHVNRKTNTKDEFIIFKRSIKDEQEGFKDILSFFSGHDDVLNPLFPDVEVSYMTSKCNCTFNPLIGPCDGLIALTDSIITILLNPATRNFRLLPPSPFGCPKGYHRSVEGVGLGLDTISNYYKVVRISEVYCEEAGGYPGPKDSKIDVCDLGTDSWRELDHVQLPLIYWVPCSGMLYKEMVHWFATTDESMVILCFDMSTEMFRNMEMPDSCSPITHELYYGLVILCESFTLIGYSNPISSIDPVKDKMHIWVMMEYGVSESWIMKYTIKPLSIESPLAVWKKNILLLQSRSGRLISYDLNSGEAKELNLHGFPDSLSVIVYKECLTSIPKGSEYSTKVQKF

SEQ ID NO: 53553 - protein, 171 aa, Brassica napus
DSEIEKIIAERYGKKKKKKGRSTSVKKKKKRDVSESDSGDGKRVRRLKKRRTHKRRSVSESEDEGKGRSKRRGRKRGDDSNESSDEDDDRRQVKRKSRREKRRRRSRRSGSDDSDSDSSEDDGRGRRQKRRSKLAASSDSNVSGDDGTRVGRGSSKRSEKKSRKRHRRRKD

SEQ ID NO: 53554 - protein, 416 aa, Kluyveromyces lactis NRRL Y-1140
MSLSSKLTVKDLDVTGKRVFIRVDFNVPLDGKKITSNQRIVAALPTIQYVLEKKPKAIVLASHLGRPNGEVNDKYSLAPVADELSRLLQKPVTFLHDCVGEEVTNAVNNAKDGEVFLLENLRFHIEEEGSRKVDGNKVKADKAAVTKFREQLSSLADVYVNDAFGTAHRAHSSIVGFDLPNRAAGFLLSKELQYFAKALENPTRPFLAILGGAKVADKIQLIDNLLDKVDSLIIGGGMAFTFKKVLENTEIGDSIYDAAGAELVPKLVEKAKKNNVKIVLPTDFVIGDKFSADANTKVVTDKEGIPSGWQGLDNGPESRKAFAATVAEAKTIVWNGPPGVFEFAPFAKGTEALLDAVVASSQAGNTVIIGGGDTATVAKKYGVVDKISHVSTGGGASLELLEGKELPGVTFLSNKQ

SEQ ID NO: 53555 - protein, 389 aa, Petunia integrifolia subsp. inflata
MANGILKKLPEDLVFLILLTFPVKSLMRFKCISKAWSILIQSTTFINRHINRKTNTKDEFILFKRAIKDDEEEFINILSFFSGHVDVLNPLFPDMDVSYMTSKCDCTFNPLIGPCDGLIALTDTIITIVLNPATRNFRVLPASPFGCPKGYHRSVEGVGFGLDTISNYYKVVRISEVYCEEADGYPGPKDSKIDVCDLSTDSWRELDHVQLPSIYWVPCAGMLYKEMVHWFATTDMSMVILCFDMSTEMFHDMKMPDTCSRITHELYYGLVILCESFTLIGYSNPISSTDPAHDKMHIWVMMEYGVSESWIMKYTIRPLSIESPLAVWKNHILLLQCRSGLLISYDLNSGEAKELNLHGFPDSLSVKVYKECLTSIPKGSEYSTKVQKF

SEQ ID NO: 53556 - protein, 388 aa, Petunia integrifolia subsp. inflata
MANGVLKKLPEDLVCLILLTFPVKSLMRFKCISKTWSILIQSTTFINRHVNRKTNTKDEFILFKRAIKDEQEEFRDILSFLSGHDDVLNPLFADIDVSYMTSKCNCAFNPLIGPCDGLIALTDTIITIILNPATRNFRLLPPSPFGSPKGYHRSVEGVGFGLDTISNYYKVVRISEVYCEEDGGYPGPKDSKIDAFDLSTDSWRELDHVQLPLIYWLPCSGMLYKEMVHWFATTDMSTVILCFDMSTEMFRNMKMPDTCSVTHKQYYGLVILCESFTLIGYPNPVSPIDPAHDKMHIWVMMEYGVSESWIMKYTIRPLSIESPLAVWKKNILLLQSSSGLLISYDLNSGQAKELNLHGFPDSLSVIVYKECLTSIQNGSEYSTKVQNF

SEQ ID NO: 53557 - protein, 290 aa, Triticum aestivum
YRRPTRPEIGQAIALDTRIPLVSFTGSTKVGQMVQQQVSARFGKCLLELSGNNAIIVMDDADIPLAVRSVLFAAVGTAGQRCTTCRRLLLHESIYQTFLDQLVEVYKQVRIGDPMEKGTLLGPLHTTASKESFLKGIQNIRSQGGKILLGGSAIESEGNFVQPTIVEISPAAPVVREELFGPVLYAMKFQTLKEAIEINNSVPQGLSSSIFTRKPDAIFKWIGPHGSDCGIVNVNIPTNGAEIGGAFGGEKATGGGREAGSDSWKQYMRRATCTINYGSELPLAQGINFG

SEQ ID NO: 53558 - protein, 370 aa, Brucella melitensis 16M
MASRKLLLLPGDGIGPEAMAEVRKVIAFLNSDLNLGFETEEGLVGGCAYDAHGQAISDADMEKALAADAVLFGAVGGPKWDSVPYEVRPEGGLLRLRKDMQLYANLRPAICYPALAHSSSLKPEVIEGLDILILRELTGGVYFGEPKEIIDLGNGQKRGIDTQVYDTYEIERIADVAFELARTRRNKVTSMEKRNVMKSGVLWNQGVTARHKEKHADVQLEHMLADAGGMQLVRWPKQFDVILTDNLFGDLLSDVAAMLTGSLGMLPSASLGAADSKTGKRKALYEPVHGSAPDIAGKGIANPIAMIASLAMCLRYSFGLVAEADRLEAAIAGVLDDGIRTADIWSEGNTKVGTTEMGDAILAKFKALSA

SEQ ID NO: 53559 - protein, 274 aa, Zea mays
MAAATAAASTMSLLPISQLRQQHGAGAMRRRPWVARRRRYVVPTARLFGPAIFEASKLKVLFLGVDDEAGSKQHGPLPRTYTLTHSDVTARLTLAVSHTINRAQLQGWYNRLQRDEVVAEWKKVRGRMSLHVHCHISGGHFLLDLIAGLRYVIFRKELPVVLKAFVHGDGDLFSRHPELEEATVWVYFHSNLARFNRVECWGPLRDAAAPAEDDSTAPPDASNSKEAGQMMAMCEWPHRCPQQCGCCFPPHSLIPWPNEHDMAAADASGSAQQQ

SEQ ID NO: 53560 - protein, 145 aa, Pediococcus pentosaceus ATCC 25745
MSTEKSLILVKPDGVQCGHIGHVISRIENRRYEIKALKMVNATEEQLRQHYSQLVDKPYYADIEKFMTSGPIVAIIAEGNEIIDTFRKMAGPTNPSEAMAGTIRGDFARAWGPGPIKNVVHSSDSVESAEKEIKIWFPERINTEN

SEQ ID NO: 53561 - protein, 110 aa, Brassica napus
  misc_feature (2)..(2): Xaa can be any naturally occurring amino acid
  misc_feature (27)..(28): Xaa can be any naturally occurring amino acid
  misc_feature (43)..(44): Xaa can be any naturally occurring amino acid
  unsure (1)..(110): unsure at all Xaa locations
MXFFRSVAAFTRLRSRVGQQSSLGSSXXWIQMQSSTDVDLKVXXLQELIPEQQDRLKKLKLTSCVYLNAYFPPFPKPIPHPPQPIPQNLLSLSPPPPPPLTYPSYSSPPP

SEQ ID NO: 53562 - protein, 252 aa, Ustilago maydis 521
MAAQAQQLQQKVEYFIAQVCIQPISPLQFYISCFLPICVVHDLASSYFRCLAINRLTNTHDCDGCLLLNAVPNRNFPSNNFDRRNISWVYTIVDNGCSRLQIDKERQAQICIGAHSFAAYCAYSPATLHGIAWFVFFNIAAGFLTNLLGFFVPAYFSLKALESPQPQDDIQWLTYWVVFGMFTFLETFINIVLYYVPWYYTIKTLAIVWLMLPQTQGAKMVYSKVIRPAFLTTQKTVHQANASTPAAPAETH

SEQ ID NO: 53563 - protein, 503 aa, Burkholderia vietnamiensis G4
MLITDPQATASTGNQSDAHAKEIHNFINGEYVPGQRWFEKRSPLNNAVIAKVAEAGRAEVDAAVAAAQAALKGAWGRMSLAQRVEVLYAVADGINRRFDDFLAAEVEDTGKPMSLARHVDIPRGAANFKIFADVVKNVPTEFFEMPTPDGVGAINYAMRRPVGVVGVICPWNLPLLLMTWKVGPALACGNTVVVKPSEETPQTAALLGEVMNTAGVPPGVYNVVHGFGPNSTGEFLTTHRGINAITFTGETRTGAAIMKAAADGARPVSLEMGGKNAAIVFADCDLDAAIEGTLRSCFANCGQVCLGTERVYVERPIFDRFVSALKKGAEGMQLGRPEDLATGMGPLISQEHRDKVLSYYKKAVEAGATVVTGGGVPDMPEALKGGAWVQPTIWTGLGDDSVIAREEIFGPCALVMPFDSEEEVIRRANDNDYGLATAIWTTNLSRAHRVAGAIEVGIAWVNSWFLRDLRTPFGGAKQSGIGREGGAHSLEFYTELKNVCIKL

SEQ ID NO: 53564 - protein, 1071 aa, Neisseria gonorrhoeae FA 1090
MPKRTDLKSILIIGAGPIVIGQACEFDYSGAQACKALREEGYKVILVNSNPATIMTDPEMADVTYIEPIMWQTVEKIIAKERPDAILPTMGGQTALNCALDLARNGVLAKYNVELIGATEDAIDKAEDRGRFKEAMEKIGLSCPKSFVCHTMNEALAAQEQVGFPTLIRPSFTMGGSGGGIAYNKDEFLAICERGFDASPTHELLIEQSVLGWKEYEMEVVRDKADNCIIICSIENFDPMGVHTGDSITVAPAQTLTDKEYQIMRNASLAVLREIGVDTGGSNVQFAVNPENGEMIVIEMNPRVSRSSALASKATGFPIAKVAAKLAVGFTLDELRNDITGGRTPASFEPSIDYVVTKIPRFAFEKFPAADDRLTTQMKSVGEVMAMGRTIQESFQKALRGLETGLCGFNPRSEDKAEIRRELANPGPERMLFVADAFRAGFTPEEIHEICAIDPWFLAQIEDLMKEEKSVSDGQLQDLDYAALRRLKRKGFSDKRLAQLLNVSEKEVREHRYALKLHPVYKRVDTCAAEFATETAYLYSTYEEECESRPSDRKKVMILGGGPNRIGQGIEFDYCCVHAALALRESGFETIMVNCNPETVSTDFDTSDRLYFEPLTLEDVLEIVRTENPWGVIVHYGGQTPLKLANALVENGVNIIGTSADSIDAAEDRERFQKVLNDLGLRQPPNRIAHNEEEALVKAEEIGYPLVVRPSYVLGGRAMQIIHSAEQLQKYMREAVQVSEDSPVLLDFFLNNAIEVDVDCVSDGKDVVIGGIMQHVEQAGIHSGDSGCSLPPYSLSEEIQDEIRRQTKAMAYALGVVGLMNVQFAVQDGVVFVLEVNPRASRTVPFVSKATGVPLAKVGARCMAGISLKEQGVEKEVVPDFYAVKEAVFPFIKFPGVDTILGPEMRSTGEVMGVGASFGEAYYKAQLGAGERLNPTGKIFLSVREEDKERVIKTAKNFQALGYGICATRGTAQYLTEHGLIVQAINKVPEGRPHIGDALKNGEIALVVNTVSSDPQSVSDSHIIRQSALQQRVPQYTTTAGGEAMSEGAKSRDYLGVYSVQELHGRLKNRN

SEQ ID NO: 53565 - protein, 541 aa, Oenococcus oeni
MTDPVSILNDPFINKGTAFTEAEREELGLNGLLPAKVQALQEQVDQTYAQFQSKVSNLEKRLFLMEIFNTNHVLFYKLFSQHVVEFMPIVYDPTIADTIENYSELFVEPQGAAFLDINHPENIQSTLKNAANGRDIKLLVVSDAEGILGIGDWGVQGVDIAVGKLMVYTVAAGIDPSTVLAVVIDAGTNNEKLLKDPMYLGNKFNRVRGDKYYDFIDKFVNHAESLFPNLYLHWEDFGRSNASNILNSYKDKIATFNDDIQGTGIVVLAGVLGALKISGQKLTDQTYMSFGAGTAGMGIVKQLHEEMVEQGLSDEEAKKHFFLVDKQGLLFDDDPDLTPEQKPFAAKRSDFKNANQLTNLQAAVEAVHPTILVGTSTHPNSFTEEIVEDMSGYTERPIIFPISNPTKLAEAKAEDVLKWSNGKALIGTGVPVDDIEYEGNAYQIGQANNALIYPGLGFGAIAAQSKLLTPEMISAAAHSLGGIVDTTKVGAAVLPPVSKLADFSRTVAVAVAKKAVEQGLNRQPIDDVEKAVDDLRWDPKY

SEQ ID NO: 53566 - protein, 473 aa, Ralstonia metallidurans CH34
MTTESQAQCPFQTAKSPPPAGSPLPHPYGTWPPGPAAGLTGWHLLRRMSRDLLGTLGEWQQTYGDVVHLRMWPEHAVVVTDPQLVRELLVTHHDSLIRWERGTRVFSRVHGHSVLTAEGDAWSRKRQALQPGFMPKAVHGFVPGIVEIVDKGLATWPTRVADWPVESALTSLTMDVIVRMMFSDEIGEDARVAECAVRAISEAANADFYWPASLPDWVPWKRARRRALHTLRDLIERHLQARLRMRTDTWPDDLLSRLLCLHRDDATAWPLQAVRDECMTTFLAGHETTAATLTWWAWCMASNPSAQDAARAEVTHVLRGQAPTADSRQALRQVVQTITESMRLYPVAPVLISRRAVRPITLGPWRLPARTLFMLPLQLMHHDPRLFPEPERFQPDRFSTGSPQAPRGAYMPFGTGPRVCLGQHLATAEMTVIAAMLLQRYKLSVPEGAAHPRPLLNVTLRPDQPLWLAVTPI

SEQ ID NO: 53567 - protein, 540 aa, Lactococcus lactis subsp. lactis
MRAHEILNNPFLNKGTAFTMKERQELGLIGLLPPTVQTIEEQAVQTYEQYLTKPSDLEKRHFLMEIFNTNRTLFYYLFNKHIVEFNPVVYDPTIADTIENYSHLFVDPQYAAYLDINHPENITETLKKAAGDREIRLIVVTDAEGILGIGDWGTQGVDISVGKLMIYTAAAGIDPASVLPVVIDAGTNRKELLEDHLYLGNHQERIYGDQYYSFVDQFVETAESIFPKLYLHWEDFGRSNAATILNNYKTKIPTFNDDIQGTGIVVLGGIFGSLDITGEKLTDQVYLCYGGGSAGAGIAGRVHAEMVSEGLSEEEAYKHFFMIDQQGLLFDDMEDLTPAQKPFAKKSADYKDAGDMTDLLNVVKTVKPTILVGTSTNPGAFTKEVVEAMCANTERPVIFPISNPTKKMETTAEQVIEWSDGKAFVATGVPSGTISYKGVDYQIGQANNSLIYPGLGLGMLASEAKLLTDEMIGAAAHSLSGLVDPGKPGAPVLPPFEFVADVSIKVAEAVAKKAQEQGLTESKETDMAKAVRDLKWYPEY

SEQ ID NO: 53568 - protein, 573 aa, Staphylococcus carnosus
MAKQIKGIAASDGVAIAKAYLLVEPDLSFDNESVTDTDAEVAKFNGALNKSKVELTKIRNNAEKQLGADKAAIFDAHLLVLEDPELIQPIEDKIKNESVNAAQALTDVSNQFITIFESMDNEYMAERAADIRDVSKRVLAHILGVELPNPSIVDESVVIIGNDLTPSDTAQLNKEYVQGFVTNIGGRTSHSAIMSRSLEIPAVVGTKSITEEVEAGDTIVVDGMTGDVLINPSDEVIAEYQEKRENFFKDKQELQKLRDAESVTADGHHVELAANIGTPNDLPGVIENGAEGIGLYRTEFLYMGRDQMPTEEEQFEAYKAVLEAMKGKRVVVRTLDIGGDKELPYLDLPEEMNPFLGYRAIRLCLDQPEIFRPQLRALLRASVFGKLNIMFPMVATIQEFRDAKALLEEERANLKNEGYEVADDIELGIMVEIPSTAALADIFAKEVDFFSIGTNDLIQYTMAADRMSERVSYLYQPYNPAILRLVKQVIEASHAEGKWTGMCGEMAGDQTAIPLLLGLGLDEFSMSATSILKARRLIRSLNESEMKELSERAVQCATSEEVVDLVEEYTKNA

SEQ ID NO: 53569 - protein, 309 aa, Bordetella pertussis Tohama I
MNQPSSLAADLRGAWHAQAQSHPLITLGLAASAAGVVLLLVAGIVNALTGENRVHVGYAVLGGTAGFAATALGALMALGLRAISARTQDAMLGFAAGMMLAASAFSLILPGLDAAGTIVGPGPAAAAVVALGLGLGVLLMLGLDYFTPHEHERTGHQGPEAARVNRVWLFVLTIILHNLPEGMAIGVSFATGDLRIGLPLTSAIAIQDIPEGLAVALALRAVGLPIGRAVLVAVASGLMEPLGALVGVGISSGFALAYPISMGLAAGAMIFVVSHEVIPETHRNGHETIATVGLMAGFAVMMFLDTALG

SEQ ID NO: 53570 - protein, 521 aa, Ustilago maydis 521
MDSSHGTTSRSPEPVTISTPTGNQWQVPSGIFINNSFHASVSGKTFDSINPATGEKLCTLALGGAADIEAAVKAARTAFKTTWGKKSTPTQRSQLLLKFADLVDKNLDELAELESMDNGKPVWMASSFDVPDSAACLRYYGGLADKIEGKTIEQTEGEKIAYTRIEPLGICGQIIPWNYPIQMAAWKLGPALAAGNCVILKPAEQTPLTALKLAQLSVQAGFPAGVISVVNGYGAEVGEAISRHMDIQKVAFTGSTATGKRIMKAAAESNMKKVTLELGGKSPVVVFESADIQQAVRWVCLGILFNQGQDCTAGSRLFVQDRIYESFMEQLVAAFKAHKVGDPFHQLTFQGPQVSQQQQEKILDMIESGKRQGAKVEVGGQAWKSADSKFNKGFFVEPTIFSGCRKGMRIVDEEIFGPVLAVAKFSTEEEAIRLANETVYGLGAGVFSENASQIQRMVSAIDAGTVWVNNYVALSNSVPFGGMKASGFGRELGVDAIKAYCDVKAIHWNYGEKLDWPLPKL

SEQ ID NO: 53571 - protein, 124 aa, Brassica napus
MASKTLILLGVFAFLLVVSEMAAASAQKSESEDTVQPDRYGGGHGGNEGYNGRGGYNRGGGHNGGGGYNGGGGYNGGGGYNGGGGYKGGRGGGYKGGRGGRGGHGGRGGHGGHGAEAVQTQPGN

SEQ ID NO: 53572 - protein, 293 aa, Oryza sativa (japonica cultivar-group)
MAAAETSGTVAAPGRWSLHGKMALVTGGTRGIGRAVVEELAALGAAVHTCSRNEAELGERLKEWEARGFRVTISVCDLSARDQRERLIGDVADRFGGKLDILVNNVGTNIRKPTTEYSADEYSFLMATNLESAYHLCQLGHPLLKASGSGSIVFISSVAGIVALFSGTIYAMTKGAMNQLTKNLACEWAKDNIRTNCVAPGYILTSLSEGILANKEFEGSVKSRTPLRRVGEPAEISSLVAFLCMPGSTYITGQTIAVDGDAKKASPRTLQQNGVSNCPLRDAAAFCLDGHRP

SEQ ID NO: 53573 - protein, 551 aa, Kluyveromyces lactis NRRL Y-1140
MSLKNWLLLRDIQYEGTFYKKFPHVYNIYVIGFIACISGLMFGFDIASMSSMIGTDVYKDYFSNPDSLTYGGITASMAGGSFLGSLISPNFSDAFGRKVSLHICAALWIIGAILQCAAQDQAMLIVGRVISGMGIGFGSSAAPVYCSEISPPKIRGTISGLFQFSVTVGIMVLFYIGYGCHFIDGAAAFRITWGLQMVPGLILMVGVFFIPESPRWLANHDRWEETSLIVANIVANGDVNNEQVRFQLEEIKEQVIIDSAAKNFGYKDLFRKKTLPKTIVGVSAQMWQQLCGMNVMMYYIVYIFNMAGYTGNTNLVASSIQYVLNVVMTIPALFLIDKFGRRPVLIIGGIFMFTWLFSVAGILATYSVPAPGGVNGDDTVTIQIPSENTSAANGVIASSYLFVCFFAPTWGIGIWIYCSEIFNNMERAKGSALSAATNWAFNFALAMFVPSAFKNISWKTYIIFGVFSVALTIQTFFMFPETKGKTLEEIDQMWVDNIPAWRTANYIPQLPIVKDEEGNKLGLLGNPQHLEDVHSNEKGLLDRSDSASNSN

SEQ ID NO: 53574 - protein, 308 aa, Bacillus halodurans C-125
MWKQDETLEQIVLECKKYTEEGTVASYIPALAKADVSTLGIAIYRGGDEQVIAGDADEKFTLQSISKVIALALALLDVGEEAVFSKVGMEPTGDPFNSISKLETSVPSKPLNPMINAGALAVTNMIIGETTEQSLGRLLSFIHELTKNPTITYNLEVAQSEFDTAFLNRSLSYFLKQHGVIQADVEQLLDLYTKQCAIEMCCSDLARIGYVFANEGRDPDTGQRIVPLHVARIIKTFMVTCGMYNASGEFAIRVGIPAKSGVSGAILALVPNKYGIAVYSPALDEKGNSLAGIKLLETLSCREEWSIF

SEQ ID NO: 53575 - protein, 146 aa, Leptospira interrogans serovar Lai str. 56601
MYIKQILAKKDRRVLSVEPETLVMDVVKFMTKYDIGSVIILGEGKLKGIFTERDVLHLSAELGLDLFKKSVSEVMTTSITTMTPEDDVDELLSIMLKKRIRHMPILENDTLIGIISIGDAVKAKIEKTEEENKNLKQYMYSENGFI

SEQ ID NO: 53576 - protein, 323 aa, Escherichia coli K12
MNLEKINELTAQDMAGVNAAILEQLNSDVQLINQLGYYIVSGGGKRIRPMIAVLAARAVGYEGNAHVTIAALIEFIHTATLLHDDVVDESDMRRGKATANAAFGNAASVLVGDFIYTRAFQMMTSLGSLKVLEVMSEAVNVIAEGEVLQLMNVNDPDITEENYMRVIYSKTARLFEAAAQCSGILAGCTPEEEKGLQDYGRYLGTAFQLIDDLLDYNADGEQLGKNVGDDLNEGKPTLPLLHAMHHGTPEQAQMIRTAIEQGNGRHLLEPVLEAMNACGSLEWTRQRAEEEADKAIAALQVLPDTPWREALIGLAHIAVQRDR

SEQ ID NO: 53577 - protein, 772 aa, Oryza sativa
  misc_feature (174)..(174): Xaa can be any naturally occurring amino acid
  misc_feature (193)..(193): Xaa can be any naturally occurring amino acid
  unsure (1)..(772): unsure at all Xaa locations
MASHIILPKEEEAALGVAVEEDHDSPAAPGYQHQQGPPVAKALPFSATCVRISRDSYPNLRALRNASAMSLPDDDDAAYAKLEEGDYGYLLDDVPHFTDYLSDLPTFPNPLQDHPAYSTVKQYFVNADDTVPEKVVVQKDSPRGVHFRRAGPRQRVYFESEDVKACIVTCGGLXCPGLNTVIRELVCGLSHMXYNVNDIFGIQNGYKGFYSSNYLPMTPKSVNDIHKRGGTVLGTSRGGHDTKKIVDNIQDRGINQVYIIGGDGTQNGAYDIYKEIRRRGLKVAVAGVPKTIDNDIAVIDKSFGFDSAVEEAQRAIDAAHVEASSAENGIGLVKLMGRYSGFIAMYATLASRDVDCCLIPESPFYLEGEGGLFEYIEKRLKENNHMVIVVAEGAGQDLIAKSIAAADQIDASGNKLLLDVGLWLTHKIKDYCKNKKMEMTIKYIDPTYMIRAIPSNASDNVYCTLLAHSAIHGAMAGYSFTVGMVNGRHAYIPFHRVTSTRNKVKITDRMWARLLSSTNQPSFLSQKDIDAAREADKLASKSPVPVNTKEHGENVKKPANGEGSSDAVVQEPFATTPTSPAALAAGAVSNPALTPAAVSMSFYDVNAGEQPSREDEAPEEVVEAAVANGAPTAVEKHNKLYSPAETPAGSGTRPHPTADAVAETAGAAPDDVDGCTTPPPPPVHDSEGSDTQSADDHGSPQREKPRTTSTAGGVKRDVAPSWSSRLLAFRSFSRDKKAKATVDARPPAHGKARDEGDEHKEKGKERRKRFWK

SEQ ID NO: 53578 - protein, 291 aa, Sulfitobacter sp. EE-36
MLQGSLPALVTPFTDGALDLATLKKLVEWHIAEGSNGLVPVGTTGESPTLTHAEHETVVAEVVKAAAGRIPVVAGAGSNNTTESIRLAKHAESVGADAVLVVTPYYNKPTQAGLIAHFTAIHEACGLPIIIYNIPGRSVVDMLPETMAELAKLPRIIGVKDATGDLARVCDQRMLCGPDFVQLSGEDATAHGFNAQGGVGCISVTANVAPKLLSQMQAFCLAGDYAAALEIQDKLMPLHNAIFTEPGLVGVKYAMARLGLCSDEVRLPLVPLTDATKALVDHGLKHAGLLD

SEQ ID NO: 53579 - protein, 743 aa, Aspergillus fumigatus
MVGSSMFRSNMASPTVMQLTSLSRRSLSTRSPALGLRLSRPLRSATSSQQCVQRTFRRSYADAAPTPKPKKRFRFLRWAWRLTWLSGVGLTGALIYSIYEQRHPIEQIEPDPTKKTLVILGTGWGSVSLLKKLDTENYNVVVISPRNYFLFTPLLPSCTTGQVEHRSIMEPIRNILRQKKAHVKFYEAEATKIDYEKRVVYISDDSEIKGDISHTEVPFDMLVVGVGAENATFVNGVITGIKGVKEHSCFLKEVGDAQKIRKRIMDCVETAMFKDQPEEEVKRLLHMVVVGGGPTGVEFAGELQDFFNEDLKKWIPEIKDNFHVTLVEALPNVLPMFSKQLIDYTESTFKEEAITIRTKTMVKNVTDKYIEAEVTKPDGTKELETIPYGLLVWATGNAVRNVVRDLMNQIPAQKNSRRGLAVNEYLVVNGTENVWAVGDCAVTNYAPTAQVASQEGAFLARLFNTMAKTEAIEKELKRLSEAQAVAKNEEERNKIFDEIRERQKQLRRTKQIGPFQYSHQGSLAYIGKERAVADISWLSGNIASGGTVTYLFWRSAYLSMCFSSKCLLRPTNHKIVPFPFLTISIARNRRKLLFSVFVVYRFLYARSMITFQLLFPFSTLLRRHRHYASVTVDHPSGPLSPKDPLIAPNGHKSGEKYRLGTGLFFRHLDMAIILFLLYDSYTDLFLILAAVVIMSVLLKCIELGKWKYGDYVICVSLQPSYRLTILALDPITRVKIPTVDRKR

SEQ ID NO: 53580 - protein, 465 aa, Sulfitobacter sp. EE-36
MDGTFSENDISRVVEADRAHIWHHLSQHKAYETTDPRIIVEGKGMRVWDQKGKEHLDAVSGGVWTVNVGYGRESIANAVRDQLIKLNYFAGSAGSIPGSHFAEKLIDKMPGMSRLYYCNSGSEANEKAFKMIRQIAHKRYGGKKHKILYRDRDYHGTTIACLSAGGQEERNAQYGPFTDGFVRVPHCLEYRKFEQDGAPEDNYGVWAADQIEKIILAEGPDTVGGLCLEPVTAGGGVITPPDGYWERVQEICRKYDVLLHIDEVVCGIGRTGEWFGYQHFGIQPDMVTMAKGVASGYAAIACLVTTEEVFNLFKDDASDPLNYFRDISTFGGCTAGPTAAIENMAIIERENLLQNTRDMGQYMLEELEELSDKYDVIGQVRGKGLFLGAELVQDRSTRVPVIEAQIQAVVADCMAQGVIIGATNRSVPGKNNTLCFSPALIAKKDDIDQIIAAVDGAMGRVFGSK

SEQ ID NO: 53581 - protein, 639 aa, Clostridium tetani E88
MNFIEKQYIPWKDFLNVASACPITNVMDIEFNLTNIKKCINEALNKKVKYIIFPELSITSYSCGDLFLNNQLLNSSLNAIEELCSFLKDKDILVSVGSPFLYRNSLYNCAFIIHYGKILGIVPKSNICSSEQRWFSSGFKIRNEYVSTYFQENIPFGIDLIFQSGNFKFSFVLGDEFNSPIPLSSYLSLKGANIIGNLSASNELVGKSQKRRDFLKTTTQRLSCGYIYSSCGVYESTTDLVYSGHLLIGEKGNLLKENKRFKRENEIIVSSIDVDSLMLNRLRNTYLEEYSNLCPFNARTINFNFDNLQDFILQRDIKKYPFIPYDKEDNRLEEIFNIQVSALAKRLEHTNLKSTVIGISGGLDSTLALLVTVKTFKLLNLDLKNIIAITMPGFGTTDRTYNNAINLCKKLGVSLREIHIVKSCLQHFEDIGHNPNIHDVTYENVQARERTQILMDIANKEGGLVIGTGDLSEMALGWCTFNGDHMSMYGVNASVPKTLIRYLVKHVALEEKDKETSSILLDILDTPVSPELLPKDNEGNITQKTENIVGPYELHDFFLYYFIKGFEVRKIYYLTCEAFKEDYKEDIIKRWLEFFIKRFFTQQFKRSTVPDGPKVGTVSLSPRGDFIMPSDGSYNSFFK

SEQ ID NO: 53582 - protein, 252 aa, Oryza sativa
  misc_feature (126)..(126): Xaa can be any naturally occurring amino acid
  unsure (1)..(252): unsure at all Xaa locations
MSTKMKKGILRPFRYISNMMDGKEAAQDMQIGFPTDVKHVAHIGWDGPSVPNNNNNTAGAPSWMKDYHSAPLDSASFRSDRGGSAAANPWASQEIVVDGGSLGDTSFSETRSEASGSMDITAGDSXPPSPDSRRSRRHRSRGSAATSSMDCTAADGGAAPEKKDKAKKSSRGKNRKKDKSDKSAAAGAGDDASGATCQDLPAVPKKSNRRKNKGGSEGTGAAAASKADGAGAGGEDAAAPEPPATEEAQDHD

SEQ ID NO: 53583 - protein, 540 aa, Lactococcus lactis subsp. lactis
MRAHEILNNPFLNKGTAFTMKERQELGLIGLLPPTVQTIEEQAEQTYEQYLTKPSDLEKRHFLMEIFNTNRTLFYYLFNKHIVEFNPVVYDPTIADTIENYSHLFVDPQYAAYLDINHPENITETLKNAAGDREIRLIVVTDAEGILGIGDWGTQGVDISVGKLMIYTAAAGIDPASVLPVVIDAGTNRKELLEDHLYLGNHQERIYGDQYYSFVDQFVETAESIFPKLYLHWEDFGRSNAATILNNYKTKIPTFNDDIQGTGIVVLGGIFGSLDITGEKLTDQVYLCYGGGSAGAGIAGRVHAEMVSEGLSEEEAYKHFFMIDQQGLLFDDMEDLTPAQKPFAKKSADYKDAGDMTDLLNVVKTVKPTILVGTSTNPGAFTKEVVEAMCANTERPVIFPISNPTKKMEATAEQVIEWSDGKAFVATGVPSGTINYKGVDYQIGQANNSLIYPGLGLGMMASEAKLLTDEMIGAAAHSLSGLVDPGKPGAPVLPPFEFVADVSIKVAEAVAKKAQEQGLTESKETDMAKAVRDLKWYPEY

SEQ ID NO: 53584 - protein, 508 aa, Triticum aestivum
  misc_feature (411)..(411): Xaa can be any naturally occurring amino acid
  misc_feature (499)..(499): Xaa can be any naturally occurring amino acid
  unsure (1)..(508): unsure at all Xaa locations
PESSELPLQLTGSLDCHESVGADDTTTLDKIIDSLTSIANAHRGDPNAAEISLKIGRVSECGIDDSMDKVGPKVLILGAGRVCRPAAEFLTSYQNIDQVHVVVASLYQKDAEETVDGIKNATAAQLDVSDTESLSNLVSQVDVVVSLLPASFHAAIARVCIELKKHLVTASYVDDSMSKLEQAAQGAGVTILCEMGLDPGIDHMLSMKMIDEAHARNGKIKAFTSFCGGLPSPAAANNPLAYKFSWSPAGAIRAGRNPAVYKFLGEIIDVDGSKLYESAKRLRLPELPRFGPGNTCQIENSLMYGDLYGISKEASTVYGSTLRYEGFSEIMAILAKIGFFDAENHPLLQETNRPTYRNFLNELLNVNNISTSNTKINGEESGGHDDELVSRLMMLGHCKEKELAVKILKTXQDMVLLHHEVEVEYPDGRPTEKHQATLMEFGKTENGRSTTAMALTVGVPAAIGALLLLQNKVQKKGVIRPLQPEIYIPALEILEAFGXLKVIERVET

SEQ ID NO: 53585 - protein, 558 aa, Neisseria gonorrhoeae FA 1090
MSFKTDAETAQSSTMRPIGEIAAKLGLNVDNIEPYGHYKAKINPAEAFKLPQKQGRLILVTAINPTPAGEGKTTVTIGLADALRHIGKDSVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERFGNILVAYAKDGSPVYAKDLKAHGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLEALAKGLPNLLKHISNLKNVFGLPVVVALNRFVSDSDAELAMIEKACAEHGVEVSLTEVWGKGGAGGADLARKVVNAIDNQPNNFGFAYDVELGIKDKIRAIAQKVYGAEDVDFSAEASAEIASLEKLGLDKMPICMAKTQYSLSDNAKLLGCPEGFRIAVRGITVSAGAGFIVALCGNMMKMPGLPKVPAAEKIDVDEHGVIHGLF

SEQ ID NO: 53586 - protein, 436 aa, Zea mays
  misc_feature (404)..(404): Xaa can be any naturally occurring amino acid
  misc_feature (408)..(408): Xaa can be any naturally occurring amino acid
  misc_feature (417)..(417): Xaa can be any naturally occurring amino acid
  misc_feature (420)..(420): Xaa can be any naturally occurring amino acid
  unsure (1)..(436): unsure at all Xaa locations
MALASKASPPPWNATAAEQPIPTRDKAAANDSTYLNPQAHDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETNADITVAALPMDEKRATAFGLMKIDEEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPMPDFSFYDRFAPIYTQPRHLPPSKVLDADVTDSVIGEGCVIKNCKINHSVVGLRSCISEGAIIEDSLLMGADYYETEADKKLLXEKGXIPIGIGKNXCIXRASLTECSIRHVRYSC

SEQ ID NO: 53587 - protein, 294 aa, Clostridium perfringens str. 13
MKEIFAVLPDKINSCLKDKSNLNKLQEIRVKVGKPLNIVLDNTETIFNYVIRREDVKAIIQKISNYSLYAFEEDIRQGYITIQGGHRVGLAGQCVIEDNSIKTIRNITSLNIRVCREIVGCSNSLMNSLVENNRVNNTLIISPPKCGKTTLLRDITRNISNGISQIGLKGKRTVVIDERSEIAACYNGIPQMNVGMRTDVYDNCIKSEGMMMAVRGLSPEVIICDEIGTYKDMEGLMMAYNSGVSIIATLHGRNVEELYRRPVFREIVENNIINKVVVLSGKKGIGTIEGIYNV

SEQ ID NO: 53588 - protein, 507 aa, Streptomyces avermitilis MA-4680
MAARAAGRRPCLTRTTPQEAIVPDLFIDGEWRAALDGRTREIRCPADGSLVGVVDEAGGKDTAEAIAAARRAFDEGPWPWLPAADRGDLLLRVADLLVRDRAKLARAESLDTGKRFVESEYDIDDIVNCFRYFGRLAAAESGRVIDTGSASTDSRVVYEPVGVCALITPWNYPLLQTAWKVAPALAAGNTFVLKPSELTPHTAIHLMRLLQEAELPPGVANLVLGAGPEAGAPLADHPDVDLVSFTGGLHTGRRLMAAAAGTVKKVALELGGKNPNIVFADADFDTAVDMALTAVFLHSGQVCSAGARLLVEDSLHDRFVDEVVRRAAEIRLGGPFDERAQTGALISAAHRAKVEAYVAKGLDEGAVLRCGGRRPEGLDEGFFYLPTVLDECTSGMSVIQDESFGPVLTVERFTGEAEAVRLANDTVYGLAGAVWTTDEAKAQRVVSRLRIGTVWINDYHPYVPQAEWGGYKQSGFGRELGPSGLAEYREAKHIWRNTDPSPQGWFA

SEQ ID NO: 53589 - protein, 599 aa, Arabidopsis thaliana
MEISVASVTVSVAVVVVSWWVWRTLQWVWFKPKMLESYLRRQGLAGTPYTPLVGDLKKNFSMLAEARSKPINLTDDITPRIVPYPLQMLKTHGRTFFTWFGPIPTITIMDPEQIKEVFNKVYDFQKAHTFPLGRLIATGLVSYDGDKWAKHRRIINPAFHIEKIKNMVPAFHQSCREVVGEWDQLVSDKGSSCEVDVWPGLVSMTADVISRTAFGSSYKEGQRIFELQAELAQLIIQAFRKAFIPGYSYLPTKSNRRMKAAAREIQVILRGIVNKRLRAREAGEAPSDDLLGILLESNLRQTEGNGMSTEDLMEECKLFYFAGQETTSVLLVWTMVLLSQHQDWQARAREEVKQVFGDKEPDAEGLNQLKVMTMILYEVLRLYPPIPQLSRAIHKEMELGDLTLPGGVLINLPILLVQRDTELWGNDAGEFNPDRFKDGLSKATKNQVSFFPFAWGPRICIGQNFALLEAKMAMALILQRFSFELSPSYVHAPYTQMKQFHISLPIMLVQRDTMMWEFKPERFKDGLSKATKSHVSFFPFAWGPKICIGQNFAMLEAKMAMALILQRFSFELSPSYVHAPQIVVTIHPQFGAHLILRKL

SEQ ID NO: 53590 - protein, 465 aa, Mesorhizobium loti MAFF303099
MGAKHGSGKNRPTWKEEREKEAAELGFKTQPYTLIIGGGQGGIALGARLRQLGVPTIIVEKNERAGDSWRKRYKSLCLHDPVWYDHLPYIDFPKNWPVFSPKDKIGDWLEMYTKVMELNYWSSTEAKSASYDDKTKEWTVVVRRDGKDITLKPKQLVLATGQSGKANLPKFKGMETFKGDQHHSSKHPGPDDYAGKRAVVIGSNNSAHDIAAALWEAGADVTMVQRSSTHISRSDTLMEIGLGSLYSEQALQNGITTAKADLIFASLPYKILHEFQIPAYAEMKKRDAAFYKGLEKAGFMLDWGDDESGLFMKYLRRGSGYYIDVGASQLIIDGSIKLKSGVDVEEIKQHSVLLSDGSELPADLIVYATGYGSMNGWAADLISRETADKVGKCWGLGSNTTKDPGPWEGELRNMWKPTQQEALWFHGGNLHQSRHYSQFLSLQLKARHAGLPTPVYGLQKVHHKG

SEQ ID NO: 53591 - protein, 384 aa, Streptomyces avermitilis MA-4680
MSPTYDVIVIGLGGMGSAAAHHLSARGARVLGLEKFGPVHNRGSSHGGSRITRQSYFEDPAYVPLLLRSYELYEEVERSTGREVATLSGGVMVGRPDSLTVAGSLRSATQWDLPHEMLDAKEIRRRFPTLNPSNDEVALYEKKAGLVRPENMVAAHLQLATRQGAELHFEEPMTRWEPYRDGVRVHTAENTYTAGQLVICPGAWAPQLLTDLGVPFTIERQVMYWFQPRHGVGPFRPENHPIYIWEDAEGVQVYGFPSIDGPDLGAKVAFFRKGVVCTPETIDRTVHDHEVQAMADHMSRCIPDLPGTFLKAATCMYSNTPDEHFVIARHPAHPDSVTVACGFSGHGFKFVPVVGEIVADLALTGTTAHPIGLFDPRRLAAAPA

SEQ ID NO: 53592 - protein, 437 aa, Oryza sativa (japonica cultivar-group)
MMARGAAGGEVGRSMPAVHDAHDDSENFLELLNSRTLAPELFAEPPACDYLKKMEYGGGGGGGGGGWPEHQFTAAAALEKHLSSAAAAGYGGALAHHHHAAGAPERLTANLSDLVSNWSIAPPNHGHHVGGAAACDNPAVAAAMAAAHGGGNVKQSGSSFLDSGGGGGGAMLQQESSSSTGTGGGGQDFLRPMGLAAGSSSYSSMLGLSSRMYGGGGTATMDVPWGSSNAGAARSLSDLISFGGGAMDKPPPPPPSSAPARTSSADYKKQQGQQEISSPVKTSSSGGGGKEGKKKRSEEAAGSEGSTKKSKHEATSPTSSLKSQVPKVKLGDKITALQQIVSPFGKTDTASVLYEAINYIKWLHEQVQLLSDPYMKSSSSKDYNAWGGLDRKEKADAEVDLRSRGLCLVPVSCTPQVYRDNNGPDYWTPPYRSCLYR

SEQ ID NO: 53593 - protein, 509 aa, Solanum tuberosum
MTLRISELFAAAIIYIIVHIIISKLIATVRERGRRLPPGPTGWPVIGALSLLGSMPHVALAKMAKNYGPIMYLKVGTCGMVVASTPNAAKAFLKTLDINFSNRPPNAGATHLAYNAQDMVFAPYGPRWKLLRKLSNLQMLGGKALENWANVRANELGHMIKSMFDASHVGECVVIADMLTFAMANMIGQVMLSKRVFVEKGAEVNEFKNMVVELMTVAGYFNIGDFIPKLAWMDLQGIEKGMKSLHKKFDDLLTKMFDEHEATTYERKENPDFLDVVMANKDNSEGERLSTTNIKALLLNLFTAGTDTSSSVIEWALAEMMKNPKIFKKAQEEMDQVIGKNRRLIESDIPNLPYLRAICKETFRKHPSTPLNLPRVSTEPCTVDGYYIPKNTRLSVNIWAIGRDPDVWENPLEFNPERFLSGKNAKIEPRGNDFELIPFGAGRRICAGTRMGIVMVEYILGTLVHSFDWKLPNDVIDINMEESFGLALQKAVPLEAMVTPRLSLDVYCC

SEQ ID NO: 53594 - protein, 608 aa, Brucella melitensis 16M
MELRNIAIIAHVDHGKTTLVDELLKQSGSFRENQRVAERMMDSNDIEKERGITILAKATSVVWKNTRINIVDTPGHADFGGEVERILSMVDGAIVLVDAAEGPMPQTKFVVGKALKVGLKPIVAINKIDRPDGRHEEVVNEVFDLFANLDATDEQLDFPILYGSGRNGWMALSPEGPKDQGLAPLFDLVLKHVPAPKVAEGPFRMIGTILEADPFLGRIITGRIHSGSIKPNQAVKVLGQDGSVLENGRISKILAFRGIERQAIDEAHAGDIVAIAGLSKGTVADTFCDPSVSEPLAAQPIDPPTVTMSFIVNDSPYAGTEGDKVTSRVIRDRLLKEAEGNVALKIEESTEKDSFFVSGRGELQLAVLIENMRREGFELGVSRPRVVMKDGENGEKLEPVEEVVIDVDEEYSGTVVQKMSERKAEMVELRPSGGNRVRLVFYAPTRGLIGYQSELLTDTRGTAIMNRLFHDYQPYKGEIAGRNNGVLISNDQGEAVAYALFNLEDRGPMIIEAGVKVYQGMLIGIHSRDNDLEVNVLKGKKLTNIRAAGKDEAVKLTPPIKMTLERALSWIQDDELVEVTPKSIRLRKLYLDPNERKRFEKSKSSSAA

SEQ ID NO: 53595 - protein, 487 aa, Nocardioides sp. JS614
MHVVVIGAGFGGLGMAHALRQAGVTDVTVLERADEIGGVWRDNTYPGAACDVPSPLYSWSWATNPEWGRRYSPQPEILDYIRRTAAADGLLELVRTGVEVSAVEYDDATSTWRVTTSTGTVTADLVVSAVGQLSNPVVPAIPGASTFAGPAFHSAHWRHDVDLTGKRVAVVGTGASAIQFVPGIVDRVGAITIFQRSAPYVVPKPDQAYRPRHHRLFRRWPGIPAAERRAVYWLTERLNGALAGESPISRPMIAALRAAWRLQLRRQVRDPELRHRLVPDYPIGCKRLLFSNDWYPALDRDHVEVVTDRITGIEPAGVRTADGALHEADVLIWGTGFAATEFLAGIDVRGAGGVSLKELWADGARAHLGLTVPGFPNLFCVYGPNTNLGGSSIIAMMEAQAGWIAQVARRIADGRAHRVAVRRDVWEVYDREMQGRLGESVWAGCDSWYVDGDRITTNWPGLVTEYKQRTATVDWSELQEVDLQRAK

SEQ ID NO: 53596 - protein, 363 aa, Streptomyces avermitilis MA-4680
MVVPHEVRAVVAVKKGAPVEVQTIVVPDPGPGEVLVAVQACGVCHTDLHYREGAITDDFPFLLGHEAAGTVEAVGAGVTDLAPGDYVVLAWRAPCGSCRSCRRGRPWYCFDSRNATQPMTLLDGTPLSNALGIGAFAEKTLVAAGQAVKIDPAARPEAAGLIGCGVMAGYGAAVNTGKVGRGDTVAVIGCGGVGNAAIAGACLNGAMKVIAVDIDDKKLDQAEKFGATHTVNSRGTDPVEAVRALTDGFGVDIAIDAVGRPETYKQAFYMRDHAGTLVQVGVPDPEMKIDLPLIDLFSRGGALKSSWYGDCLPSRDFPFLIDQYLYGLLDLNAFVSETISLEQVEEAFAKMHRGEVLRSVVVL

SEQ ID NO: 53597 - protein, 413 aa, Streptomyces avermitilis MA-4680
MRTVTVVGASLAGLYAARELRAQGFDGRLVIVGEEPHPPYDRPPLSKDFLTGRADQDRLALADAEETAELGAEWLLGVRARGLDPRGRTVLLDDGRTVSTDGVVIATGASARRLPGDDLSGVHTLRTLDDARALRDELSRGARRVVVIGGGFIGAETASSCAALGHDVTVVEAAPLPLVPQLGAEMAAVCAALHRRGGAGLVTGTGVAGLRGRAGAGAERSGHQGAGAAGPRRSVTAVELSDGRLLPADGVIVGIGATPNTGWLAGSTLALHDGVLCDDGCATALPQVVAVGDVARVGGTRAEHWTSATEQPRVAVRNLLAGRTTETVRSVPYFWSDQYGARIQFAGRRHDGDTVRITEGAIERGGPAEGGLLALYERDGRTTAVLSVDRPRPFMRARRELSRAADPVEPAAL

SEQ ID NO: 53598 - protein, 461 aa, Carboxydothermus hydrogenoformans Z-2901
MPDFLVIGGGIAGLAAAYELFREGQDFILIEENDYFGGKVKTIEREGFIIEGGPDCFLSEKPQVFQIARELKFEDKIIGTNDEFKGTYILSGGRLHELPEGLMMMVPTRIIPFALSPLISWPGKIRMGMDLFIPRKRDDEDESLYSFVTRRLGREALEKIAEPLIGGIHAGTPEEMSVKASFPRFVEMEKKYGSLIRGMLAAKKASSNRPKTKSNTTYFMSFQKGMGELAENIVKNLPDYKLFTGKKAVKVTYQKGKYRTYLTDGEIIESKHVILAVPAYNAAELLEEINKDLAELLAQTGFASSATITLAYRKEDWPFKVNTFGFVVPRIEKRHLMALTYSSVKWSYRVPDDSYLLVRGFLGGATNQNDVFLPEKEMVELVLAEIKDILGVTAKPLFYEIFRWPRGMAQYKVGHLERLAKIEELVFEMPGLALAGSSYRGIGVPDCIKSGREAVRNLLNK

SEQ ID NO: 53599 - protein, 340 aa, Brucella melitensis 16M
MTLVGNFSPLVLVGDSDRVEAETVGAYLDGWAGHDKVRLATANAIKAILSGAGRLVGRIARGYLPGDPGKLVGVNSDQDQQKSIDVGSHNLFVELLIAAGVASILSEEADLPVAGKADGLVAVAIDPLDGSGNVGLGAPLGTIFSIFPADVEEPFLQPGNRQIAAGYVSYGNSVDLGFSVGEGVIFATLDPVSGQFHITRRNVKLPERTSDLAFNASVQRHLSAGMQAYVNDAFLGKDGPRGRNFNMRWLGAAVGDMHRIMQRGGLFFYVNDSRPGYEKGRLRLVYEANPIAFLAREAGGKATDGSRPILDIVPQTYHERSALVFGVAEEVDILGEYFVK

SEQ ID NO: 53600 - protein, 328 aa, Escherichia coli K12
MSHVELQPGFDFQQAGKEVLAIERECLAELDQYINQNFTLACEKMFWCKGKVVVMGMGKSGHIGRKMAATFASTGTPSFFVHPGEAAHGDLGMVTPQDVVIAISNSGESSEITALIPVLKRLHVPLICITGRPESSMARAADVHLCVKVAKEACPLGLAPTSSTTATLVMGDALAVALLKARGFTAEDFALSHPGGALGRKLLLRVNDIMHTGDEIPHVKKTASLRDALLEVTRKNLGMTVICDDNMMIEGIFTDGDLRRVFDMGVDVRQLSIADVMTPGGIRVRPGILAVEALNLMQSRHITSVMVADGDHLLGVLHMHDLLRAGVV

SEQ ID NO: 53601 - protein, 209 aa, Sulfitobacter sp. EE-36
MTSPHGPLRIGIGGPVGAGKTTTTAALCRAMRDRWSIGVITNDIYTQEDAEALMRLQVLPQDRIIGVETGGCPHTAIREDASINLAAVARMRDRHPDLDCVLIESGGDNLSATFSPELADVTLYVIDVAAGEEIPRKGGPAITKSDILIINKTDLAPHVGASLEVMDRDAKRMRGDLPYLFAEMKHDKGVAELLDLIVKIGGLRPVPEN

SEQ ID NO: 53602 - protein, 609 aa, Wolbachia endosymbiont strain TRS of Brugia malayi
MNEFKSIRNIAIIAHVDHGKTTLLDNMLKQSGTFRENQEVQERVMDSGNQERERGITILAKCTSIMWGDEKINIIDTPGHADFGGEVERVLCMVDGVLLLVDAAEGPMPQTKFVLSKALKADLKSIVIINKVDRPDSRIDEVLNEIYELFFNLDATNEQLDFPVLYASGRNGWCIKELSDKRKDLSPLFSTVIDYIKPANYDRNAPFAMLVTLLESDKFLGRILTGKIYQGIAKVNSDLKVLDLDGKVIKRGRLTKLLSFSGLKRIPVEQAVAGDIIAIAGLEKASVSATIVAPEVTTAISSTPVDPPTMAITLSVNDSPFAGQEGTKLTSAIIKDRLYAEAEINVAITVTPTPNDEAFEVGGRGELQLGVLIENMRREGFELSVSRPRVLFKEEGGKKLEPIEEVVIDVDDEYSGIIMKKLSFRKGEVTDMRPSGSGRTRLIFLVPSRGLIGYQGEFLTDSRGTGIINRLFHSYAPYKGPISRRRNGVLISTDKGEAVAYAIFNLQDRGIMFIKPQDRVYCGMVVGQHSRDNDLEINVLKGKQLTNVRAAGSDEAIKLTPPKTMTLEDMIAYIDDDELVEVTPKSIRLRKKFLDPNERRRAEKAKNKE

SEQ ID NO: 53603 - protein, 435 aa, Chromobacterium violaceum ATCC 12472
MTGSIAVETNRKVTLSYNEGKETLDLPVLGGTLGPDVVDIRGFGKTGMFTFDPGFLATASCESKITFIDGDLGHLYYRGYPIEQLAEKSDYLEVCYLLLNGELPTAAQRKEFERGVMRHNMLHDQLMSLFKGFRRDAHPMAVMVGVVGALSAFYHDSLDISNPEHRRISAHRLIAKLPTIAAQAYRYNKGLPFSYPKNGLTYAENFLHMMFSTPCEEYKVNPVLARALDRIFTLHADHEQNASTSTVRLAGSSGANPFACIAACIACLWGPSHGGANEAVLKMLDEIGSVDNVADFMQGVKDKRYKLMGFGHRVYKNMDPRAAIMKQTCDEVLNELGLHNDPKFKLAMELEKIALSDPYFIERKLYPNVDFYSGIVLSAIGIPVSMFTPIFALARTVGWIAHWNEMIGDPGMKIGRPRQLYTGAARRDFVEVAKR

SEQ ID NO: 53604 - protein, 231 aa, Triticum aestivum
  misc_feature (223)..(223): Xaa can be any naturally occurring amino acid
  misc_feature (225)..(225): Xaa can be any naturally occurring amino acid
  misc_feature (227)..(227): Xaa can be any naturally occurring amino acid
  misc_feature (230)..(230): Xaa can be any naturally occurring amino acid
  unsure (1)..(231): unsure at all Xaa locations
LGSKHHQSVEMASAGLLEAVAPKKKKSNIKYASTCAVVASMASIVLGYDTGVMSGASLYIQKDLEITDVQVEILMGILSIYSIIGTLAAGRTSDWIGRRFTAIFAAFFFFAGALLMGFASGYTMLMLGRFVAGIGVGYAIVIAPVYTAEIAPASARGFLVSFTEVFINIGILLGYISNYAFARLPLHLGWRFMLGIGAVPSVLLAVLVSGMPESPRWLVMKGXLXDXRVXL

SEQ ID NO: 53605 - protein, 409 aa, Chromobacterium violaceum ATCC 12472
MLIEVKVPQLPESVSEARLMSWHKKVGEFVKRDENLIDLETDKVVLELPAPQAGVVVEIIEQDGATVTSGQLIAKIDTAAKAGDAAPAAAAAAPVQAAPAAGAAAMPSAAKLAAETGVDLSKVAGSGRDGRVLKEDVQAAAKSAAPSQAGPVLAPASAGAALSATPAAVNVAGILSGRAEQRVPMSRLRQRVAERLVMSQQTNAILTTFNEVNMKPVMDLRAKYKDRFEKEHGIKLGFMGFFVKAVVAALKKYPIVNASVDGNDIVYHGYFDVGVAVGSPRGLVVPVIRNADQLSLAEIEKQIADFGKRAQEGKLTVEELTGGTYTISNGGTFGSMMSTPIINPPQSAILGMHATKERAVVENGQVVVRPMMYLAQSYDHRIIDGREAVLSLVAIKDAIEDPARLLLDL

SEQ ID NO: 53606 - protein, 227 aa, Glycine max
MAGAGGGYGDANQRIDYVFKVVLIGDSAVGKSQILARFARNEFSLDSKSTIGVEFQTRTLVIDHKTVKAQIWDTAGQERYRAVTSAYYRGAVGAMLVYDITKRQTFDHIPRWLEELRNHADKNIVIILIGNKCDLESQRDVPTEDAKEFAEKEGLFFLETSALEATNVETAFITVLTEIYNIVNKKNLTADENQGNGNSASLSGQKIIVPGPAQEIPAKRNMCCQSS

SEQ ID NO: 53607 - protein, 477 aa, Chromobacterium violaceum ATCC 12472
MSQQFDVVVIGGGPGGYVAAIRAAQLGFSAACVDAFKNPEGKPSLGGTCLNVGCIPSKALLQSSENFHAVQHDFAKHGISVSGAKMDVGQMLSRKTDIINKNAAGIGFLFKKNKVANIHGLAAFKGRQGEKWVIEVTDGGKVVDTLEAVHVIVATGSSPRALPGLATDNQLVLDNEGALALTAVPKRLGVIGAGVIGLEMGSVWKRLGAEVTILEAAPTFLAAADQQIAKEAFKTLTKDTGLDIKLGVKIGEVKAGKKSVSVSYELNGEAVKAEFDKLIVSIGRVPNTQGLGAETVGLALDERGFVAVDDHCHTNLPNVWAIGDVVRGPMLAHKASEEGVAVAERIAGQKPHVDFGVIPWVIYTSPEIAWVGKTEEQLKAEGVEYKKGTSGFGANGRALGLGQAQGTVKILADAKTDRILGLHMIGPMVSELVSEGVVSMEFKAASEDLARIVHAHPSLSEVIHEAALAADKRALHG

SEQ ID NO: 53608 - protein, 122 aa, Zea mays
  misc_feature (68)..(68): Xaa can be any naturally occurring amino acid
  misc_feature (86)..(86): Xaa can be any naturally occurring amino acid
  misc_feature (104)..(104): Xaa can be any naturally occurring amino acid
  misc_feature (114)..(114): Xaa can be any naturally occurring amino acid
  unsure (1)..(122): unsure at all Xaa locations
MSQPSVILATASYDHTIRFWEAETGRCYRTIQYPDSHVNRLEITPDKHYLAAACNPHIRLFDVNSNSXPQPVMTYDSHTNNVMAVXFQCDAKWMYSGSEDGTVXIWDLKGSRVXQKEYESVA

SEQ ID NO: 53609 - protein, 585 aa, Rhodopirellula baltica SH 1
MPSQRSQWSDQPPSRNLMKLTSIPQLYRNLRRGREILRVLRRYGLADWISRTRRLPLQNWIKDRSGVPLTQYTRSQRIRMAITELGPTFIKVGQVLAARPDLVGNEIAEELKQLRNEVSPDSMEVVETTLAEELGPNFRKHFRHIEPMPLATASIGQVHRAELMDGQRVVLKVQRRGIEKMMREDLDVLEGLAQWADHVESLAIWGPSDMVRQLMPMILRELDFNRERSNLKQFAQILEADKAEIVIPSVFDQLCTRRVLVMEEMVGEPLAKVFERDVHSPSRETGEMTRADLPPELGRTLARTYLRMVFEDGFFHADPHPGNLFCLRDGRLAILDFGMTGRIDEAMRESIEEMLAAINAGDCRRLTRLIRRVGNPRVDLDQSALEIDVADFVDTYGRQTLDRFDLSGALNQLSEILHRHGIGLPNQSALLLKMLISLEGTLREIGVGFDSLDIVRSYLRRVMIRRLTPARRLRQARRIYLESEAFMENAPEQLLSLMNQARLGQLQVRLEPKRFAPVVNRLVVGLMTSAVFLGSALMLSYEVSPVLFPDQPMFGIQRVSILGLVGLIASFSVMVALCLAILRSE

SEQ ID NO: 53610 - protein, 390 aa, Helicobacter pylori 26695
MLYSSKIQSLSESATIAISTLAKELKSQGKDILSFSAGEPDFDTPQAIKDAAIKALNDGFTKYTPVAGIPELLKAIAFKLKKENNLDYEPNEILVSNGAKQSLFNAIQALIEEGDEVIIPVPFWVTYPELVKYSGGVSQFIQTDEKSHFKITPKQLKDALSPKTKMLILTTPSNPTGMLYSKAELEVLGEVLKDTKVWVLSDEIYEKLVYKGEFVSCAAVSEEMKKRTITISGLSKSVAMTGWRMGYAASKDKKLVKLMNNLQSQCTSNINSITQMASIVALEGLVDKEIETMRQAFERRCDLAHAKINAIGGLNALKPDGAFYLFIHIGSLCGGDSMRFCHELLEKEGVALVPGKAFGLEGYVRLSFACSEEQIEKGIERIARFVKSKG

SEQ ID NO: 53611 - protein, 424 aa, Bordetella pertussis Tohama I
MSNTTPAWMAQGYPHIWLPYAQMKTAAPPLPVVRSHGSLLELADGRTLIDGVAAWWTACHGYNHPHIAQAVREQLDRMPHVMFGGLAHEPALNLASRLSALLGPGLERVFYTDSGSVAVEVAMKMAVQFWLNQGERGRTRFVAFRGGYHGDTFGTMAVCDPDEGMHAMFRGLLPEHDVLALPRDEAALAALQAHLERHAGRIAGMLVEPLVQGAGGMLLHDPQVLARLRELADRYGILLIFDEIFTGFGRTGTMFAFEQAGVRPDIVTLSKALTGGTLPLAATVASARVFEGFWSDDPGHALMHGPTFMGCALACAAANASLDLFEREPRLRQVAALEQALRAGLEPCRDLPWVRDVRVLGAIGVIELDGIGARDDLRRRLVEAGVWVRPFGNIVYLTPAFTIAEDELQALLEAVRQVVAERRP

SEQ ID NO: 53612 - protein, 529 aa, Debaryomyces hansenii CBS767
LLPLVKINKLLSMFNNSTRQLFKQSSIRLQTINRHLSSSMAPLQAIRKYDYLVIGGGSGGVASARRAASYGAKVLLIELKFNKMGGTCVNVGCVPKKVMWYAGDLAEKRHHLKSYGLSTTDDKVKYGDFDWSTFKDKRDAYVKRLNGIYERNLKNEGVDYIYGFAHFANSNGDVEVTLTGDQELSFLEEGKEFKKDEKLVFAGSKTLIATGGYAINPPNVEGHELGTTSDGFFELQKQPKSVAVVGAGYIGVELSGIFKALGSETHLVIRGDTVLRSFDESIQNSITDYYTDKLGVNIIKQSGSVSKVEKIDGDRKKITLGNGQVLEVDELIWTMGRKSLINIGLDKVGVTLNDKQQVDVDQFQQTANPNIFSLGDVIGKVELTPVAIAAGRRLSNRLFSGDKAFENDHLDYSNVPSVIFSHPEAGSIGLSCKEAKEKYGEDQIKIYKSKFNAMYYAMMEDDSLKSPTSYKVVCAGEDEKVVGLHIVGDSSAEILQGFGVAIKMGATKKDFDSCVAIHPTSAEELVTMK

SEQ ID NO: 53613 - protein, 405 aa, Oryza sativa
MAFLGNGYCSSGSEGEDEDEGMEGYRKGGYHAARPGDRFAGGRFVAQRKLGWGNFSTVWLAYDTLLNRFVALKIQKSARDYAQAALHEIELLSAIAKGDPTNSKNVVQLLDHFKHAGPNGHHVCLVTEFLGDSLLRLIRYNRNKGIGLSGVKEICRSVLVGLDYLHRELGIIHTDLKPENVLLVSTINPSKDPVRSGFTPILERTVSNQYSGSVISFSEKMLKMRARRAVAKISLRRESLGGVAAEMEKERSLDGISLKCKIVDFGNACWGSQQLAGEIQTRQYRAPEVIIGAGYSYSADMWSFACMAFELATGEVLFAPKTCQGCSEDEIASSGTRSKDYFDRHGDLKRIRRLKFWPLERLLVQRYNFTEPDAQGLADFLRPILDFTPENRPTAAACLKNPWLN

SEQ ID NO: 53614 - protein, 228 aa, Francisella tularensis subsp. tularensis SCHU S4
MSDISELIKGNRAWAEEIKKTNPGFFETLSKGQSPEYLWIGCSDSRVPANQVCGLIPGEVFVHRNVANVVSLTDLNCLSVLQFAIEVLKIKKIIVCGHYACGGVETVVKDKSYGLIDNWLTSIHEVKEQNKQFIEESLSCYKDNQEEYMKKKVDMMCELNALHQALNLCKTTVVKNAWAKGLTFTIHAAIYGIGDGKLYEIGGGVGSRAEMDTTYAQAIKDIKSRYCR

SEQ ID NO: 53615 - protein, 318 aa, Pseudomonas putida KT2440
MSLNPDLAAYLQLVEAGRSAGKVLPMHALAADEARRQFEESSALIAGKADEPDCISDLSLTTRDGHTLPVRLYRPPQADPALAGAALLYLHGGGYVVGSLDSHDTLCWNLAQDAGVPVIAVGYRLAPQWRFPTASDDALDAWRWLVEQAEALGIDAQRLAVVGDSVGGSLATILANQLAAQRELPAPRLQVMIYPVTDASCRRPSVQRYGSGYLLEAQTLEWFYQQYATVPADRHDPRFSPLLGSVASNSAPALMLIAECDPLHDQGVAYARHLEQAGVAVQLAVIPGVTHDFMRMGSIIEEADEGLAMVVEALQQHL

SEQ ID NO: 53616 - protein, 143 aa, Arabidopsis thaliana
MSSRSPPFASLSVSASSVKKEVVSTEKAPAALGPYSQAIKANNLVFLSGVLGLIPETGKFVSESVEDQTEQVLKNMGEILKASGADYSSVVKTTIMLADLADFKTVNEIYAKYFPAPSPARSTYQVAALPLNAKIEIECIATL

SEQ ID NO: 53617 - protein, 452 aa, Pseudomonas putida KT2440
MPQPLYEFTDSPLLQRQQQQESNARSYPRRIPLALRRARGIHVEDVEGRQFIDCLAGAGTLALGHNHPVVVEAIQRVLADELPLHTLDLTTPVKDRFVQDLFGILPEALRREAKVQFCGPTGTDAVEAALKLVRTATGRSTVLAFQGAYHGMSQGALNLMGSHGPKQPLGALLGNGVQFMPYPYDYRCPFGLGGEAGVKANLHYLENLLLDPESGVPLPAAVILEVVQGEGGVVPADIEWLKGVRRITEQAGVALIVDEIQSGFARTGRMFAFEHAGIVPDVVTLSKAIGGSLPLAVVVYRDWLDTWKPGAHAGTFRGNQMAMAAGSAVINYLVEHRLAEHAEAMGQRLRGHLQRLQRDYPQLGDIRGRGLMLGVELVDPQGQPDALGHPPANRDLAPKVQRECLKRGLILELGGRHGAVVRFLPPLIISAEQIDEVAQRFSAAVAAAVGSV

SEQ ID NO: 53618 - protein, 510 aa, Phormidium laminosum
MTSTVPAETSLNKFEKLKSEKDGLAVKSELEDFARLGWEAMDETDRDHRLRWMGVFFRPVSQGKFMLRMRIPNGILTSGQIRVLAEVVERYGEDGNADITTRPNLQLRGIRLEDIPDIFRRFEQAGLTSIQSGMDNVRNITGSPVAGIDADELIDTRGLVRKVQDMITNNGEGNPSFSNLPRKFNIAIAGCRDNSVHAEINDIAFVPAYKDGKLGFNVLVGGFFSAKRCEAAVPLNAWVDPRDVVALCEAILIVYRITGCGANRQKSRLMWLIDEWGMDKFRAEVEQQLGHPLQTAAPKDEILWDKRDHIGIHAQKKPGLNYVGLLVPVGRLYAPMFDLARIAEVYGDGEMRLTVERKRDHSRTCPMSSVASLLKEPLLEKFSVSPGLLVRSLVSCTGAQFCNFALIETKNRAMALIRELESELELARPVRIHWTGCPNSCGQPQVADIGLMGTKVRKDGKATEGVDLYMGGKVGKHAELGTCVQKGIPCDDLKPILRNLLIEHFGARPK

SEQ ID NO: 53619 - protein, 378 aa, Solanum tuberosum subsp. andigena
MAIDCMITNAKSPMIDETKQFIFDASHMKRESNIPTQFIWPDHEKPCAVVQELHVPLIDLRGFLSGDSDAAQQASKLVGEACRSHGFFLVVNHGVDANLISNAHRYMDTFFDLPLLEKQKAQRKIGEHCGYASSFTGRFSSKLPWKETLSFRYSAEEESSHIVEDIFKGHWVKILTILGNVYQEYCNSKNTLSLGIMELLGMSLGVEKSHFKEFFEENDSIMRLNYYPPCQKPELTLGTGPHCDPTSLTILHQDCVGGLQVFVDDEWRSISPNFNAFVVNIGDTFMALSNGRYKSCLHRAVVNNKTPRKSLAFFLCPNKDKVVSPPNELVDSNNPRIYPDFTWPTLLEFTQKHYRADMNTLQTFSNWVHDQHNTKTQV

SEQ ID NO: 53620 - protein, 375 aa, Solanum tuberosum subsp. andigena
MAIDCMVMPMIQTSSDEKNPLIFDSSVLKHESNIPRQFIWPDHEKPSGGVPELDVPLIDLGAFLSGDPIAAKRESRLVDEACKNHGFFLVGNHGVDTNLISLAHRYMNMFFELPLSNKQMIQRKRGDHCGYASSFTERFSSKLPWKETLSFSYSALQGSSHMVDQYFLKTMGEDFSHIGKFYQEYCNAMSTLSSGIMELLGESLGVSKNHFKQFFEENESIMRLNYYPTCQKPDLALGTGPHCDPTSLTILHQDSVSGLQVFMDNQWRSISPNLSAFVVNIGDTFMALSNGRYKSCLHRAVVNNKTPRKSLAFFLCPKKDKVVRPPAELVDSNNPRIYPDFTWPTLLEFTQKHYRADTNTLQFFSNWLQQRTTEV

SEQ ID NO: 53621 - protein, 453 aa, Dechloromonas aromatica RCB
MNSKEDLARLQQELEAKGVKYCIGAYVDIHGVPKAKVVPIHHLLHMAKGSERYTGYALDGLGQAPNDDELTSIPDFSRLIQLPWEPKIAWIPSDNHFQGKPYPLNTRVALQNQLAEAAKLGFGMNLGIECEIFLLRQNADGSLSVPDPEDKLAKACYDVRGFTNNFSWLDKVATAINDLGWDLYSFDHEDANGQFEFDFQYADALTTCDRLTFFRYMAKHYAREEGLLATMMPKPFADKTGNGAHFNMSLYDLQDGRNLFACDPKDDPNGIGLTKLGYHFVAGILKHGRALCAVFAPTVNSYKRLVRRGAMNYFSWAPVFNSYGSNNRTNSVRIPSGGGRCESRNADGAVNPYLVATLVLAAGLEGIREGLDPGKPNEDNLYAISEAERHARGIEFLPQTLQEAVAAFAADPLVEQTLGKELRDEFIRYKSEEWEAYHLTVSQWEIDRYSYMF

SEQ ID NO: 53622 - protein, 224 aa, Glycine max
MVSFHKALAETPIAEVPSELEAPPRKRKWEDETLTEEFFKHDPTDEKRKSIFGIELHLETPLPSHKLQQYLTIQSGQIHLCNTGMTMMKTQDFERNSDPKVPSLGQMSLDLELSLKKKEDGYDTDEKKNHGSTGSAFGERDLMIESSNKCKKDDSCVLTRSPPWWLSSEGDDHKEMITTVCMRCHMLVMLCKSSPACPNCKFMHPPDQNPSKFLKRKKVQPLLC

SEQ ID NO: 53623 - protein, 182 aa, Acidovorax sp. JS42
MTCDIDAIVVMGVSGCGKSSVGEACAKALGWVLHEGDAHHAPESIAKMRAGVPLTDADRAGWLDRLAALLAAPAGTAGVVLTCSALRRKYRDRLRAGNPRVGFVFLALDYEQALQRVQTRAGHFFSPALVADQFATLESPEGEPRVLTLDATRPVDELAQSVVQWLRGNAAASLSSSSGDSA

SEQ ID NO: 53624 - protein, 445 aa, Zea mays
MRMGKYEMGRTLGEGHFGKVRLARHADTGRPFAIKILDRQRILAMKIHDQIKREIATLKLLKHPNVVRLYEVSASKTKIYMVLEYVNGGELFDKIALKGKLTEKEGRKLFQQLIDAVGYCHEKGVYHRDLKPENVLVDAKGNIKVSDFGLSALPQNQQKDGLLHTTCGSPNYIAPEVLLNKGYDGSISDVWSCGVILYVMLTGNLPFDDQNVVVLYQKILKGNAHIPKWLSQGAQDILRKILDPNPVTRIDVDGIRAHDWFKQGYAPAMPFSDDEEDISMDEDSLNITEHNDIQDKIAINQINAFQLIGMSSCLDLSGFFEKEDVSERKIRFASNYSPAYLFEKIESIVRKMGFQVHKSNGKLKVIQDCKGLANSRGQESLLISAEVFEINESLYVVELKKSSGDCSLYRKLCETLSEDLGTCKSQQFLKQDSIRQDIGRYNSSF

SEQ ID NO: 53625 - protein, 308 aa, Rhizobium leguminosarum bv. viciae 3841
MILCCGEALIDMLPRDTTLGEKGFAPYAGGAIFNTAIALGRLGIPTAFFTGIADDMMGEILLETLKASNVDYSPCAITPRPSTIAFVKLVNGQATYAFYDEGTAGRMITTADLPDLGDDCEALHFGAISLIPSPCGETYEALLDREAARRVISLDPNIRPGFIKDKPSHMARIKRMAAKADIVKFSDEDLEWFGLQGDHDALAAHWLNHGAKLVVITKGAEGASGYTKERKVTVPSERVTVVDTVGAGDTFDAGILASLKMDNLLTKAQVASLDEKALRNALTLGAKAAAVTVSRAGANPPWAREIGL

SEQ ID NO: 53626 - protein, 560 aa, Rhizobium leguminosarum bv. viciae 3841
MRVRKRIVSATFPPPKEPPMNAIVEQLKSTADATKATDIRAAFAADSQRFSRFSVSLDDLLMDFSKTAVNDDILKLLVKLAEEGGVEKKREEMFSGKAINFTEDRAVLHTALRNRSNAPVLVDGKDVMPDVNAVLAAMGKFADDVRSGTLKGATGKAITDVVNIGIGGSDLGPVMATLALAPFHDGPRAHFVSNIDGAHIADILKLVQPETTLFIVASKTFTTVETMTNAQTARNFIAKALGEAAVQHHFAAVSTALDKVAAFGIDSARVFGFWDWVGGRYSIWSAIGLPLMIAVGPENFGKFLDGAHAVDNHFRKAPITENLPILLGLIGFYHRNVLGYPTRAILPYDQRLSRFPAYLQQLDMESNGKGVTIDGTPVEGNSGPVVWGEPGTNGQHAFYQLIHQGTSIIPAEFMIAANAFEPELRHQHQLLISNVLAQSEALMKGRTFAEAKKQLTDKGMDDKKADFIAPHRVFTGNRPSITFVYDKLTPYALGRLIALYEHRVFVEGVLFRINSFDQWGVELGKELATGLLPVVEGKESAASHDSSTQGLVAALAKLAK

SEQ ID NO: 53627 - protein, 373 aa, Debaryomyces hansenii CBS767
MQIIFKDFKKQKIPIEVDLSDTVLATKEKLASEKDCEVSQLKFVYSGKVLQDEKTLESFKIKEGDSIIFMISKAKKASPAPGPAKAEEKTSTDASATTESTNASSTPAAASGASTNQQGSEPGSAFAQGDDREATIQNIMEMGYERPQIEEALRAAFNNPHRAVEYLLTGIPESLQRHADQSTSAPIGESTTNTTNDHEEEHEHDHEGEEGQGENLFEAAAAAAAQGEGGNTTSGAGGAEAGADDLGEDNQMRLLRTALQTNPELIQPLLEQLAASNPQVAALIQQDPEGFIRSFLGSGDDMGFDFEEGEGEGVEGAGQGNEPETVRIALTEQDESAINRLCELGFDRNLVIQVYMACDKNEEVAADILFRDM

SEQ ID NO: 53628 - protein, 566 aa, Rhizobium leguminosarum bv. viciae 3841
MNSISVHPNGAKPDKPWLAAYPDIVPAEIPPLEYASLAELLEKSCARYADRTAFSSMGKGMRYRELESQTRKLAAWLQSTGLQKGDRVAVMMPNVLQNPIATYAILRAGLVVVNVNPLYTPRELEHQLKDSGAKAIFVLENFARTVEQVLNKTDLRHVVVTSLGEMLGPKGLIVNFVVRKVKKLVPSWSIPQHKSFGQVLREGAGKELQPVTLTGGDIAFLQYTGGTTGVAKGAVLTHENLLANKLQLSLWLRSAFERKKEPEVLNFLCALPLYHIFALTVNSLMGMSHGAHNILIANPRDIPGLVKEFEKSKVHIFPGLNTLFNALMNNADFAKLDFSSLIMSLGGGMAVQRPVAERWLKMTGTAVTEGYGLSETSPVATANRFDSPEFTGTIGLPLPSTDLDIRDEEGNSLPSGQVGEICIRGPQVMAGYWQKPEETARVMTDDGYFRSGDMGFMDERGYTKIVDRKKDMILVSGFNVYPNEIEEVAAMHAGILEAAAIGVPDGHSGEAVKLFVVRKDPNLTEAEVKAHCIANLTNYKLPRFIEFRTELPKSPVGKILRKDLRG

SEQ ID NO: 53629 - protein, 281 aa, Brassica napus
MAVDAAYLMQFVDETSFYNRIVLSHLLPSTLWDPLPHFLQTWLRNYLAGTLLYFISGFLWCFYIYYLKLNVYLPKDAIPTRKAMLLQIYVAMKAMPWYTLLPTVSEYMIESGWTKCYSRVGEVSWILYFVSIATYLVLVEFGIYWMHRELHDIKPLYKYLHATHHIDNKQNTLSPFAGLAFHPLDGILQAVPHVVALFIVPIHFTTHLGLLFMEAIWTANIHDCIHGNIWPVMGAGYHTIHHTTYKHNYGHYTIWMDWMFGSLKDPLLEDVDNKDISKKAE

SEQ ID NO: 53630 - protein, 388 aa, Streptomyces coelicolor A3(2)
MSTKDFIEKDYYKVLGVPKDATEAEIKKAYRKLARENHPDANKGNVKAEERFKEISEANDILGDPKKRKEYDEARALFGNGGFRPGPGAGGGGTFNFDLGDLFGGGAQGGGGQGGAGGFGGGLGDVFGGLFNRTGGGPGTGTRTQPRRGQDIESEVTLSFTEAIEGATVPLRMSSQAPCKACSGTGDKNGTPRVCPTCVGTGQVARGSGGGFSLTDPCPDCKGRGLIAEDPCEVCKGSGRAKSSRTMQVRIPAGVSDGQRIRLRGKGTPGERGGPAGDLYVVVHVKEHPVFGRRGDNLTVTVPVTYAEAALGGEVRVPTLGGPSVTLKLPAGTPNGRTMRARGKGAVRKDGTRGDLLVTVEVSVPKDLTGKARDALQAYREATADEDP

SEQ ID NO: 53631 - protein, 122 aa, Oryza sativa (japonica cultivar-group)
MNSRSNYRSTRTSLFDGIEEGRIRATSYSSHEIDENENDQAIDGLQDRVSILKRLSGDIHEEVETHNRMLDRMGNDMDSSRGFLSGTVDKFKMVFETKSSRRMGTLVASFVALFLLVYYLTR

SEQ ID NO: 53632 - protein, 254 aa, Thermosynechococcus elongatus BP-1
MLRATTTNGPPVMSQSFADTAIDILIELAERGEIDPWDIQVVDVCDRCLAELARRGEPNLSESGQAFLYAAMLVLLKSDRLVAVTEPSPPAEGEEPPEIAENQSSGVLPPALEQHLHRRPVAPPQQWRRLTLEELIGHLKTMALQSDRTKVLRPHQPRQRPRPTTLKAITQLAHQENLTEMARDVESLLREMAPEGTWLDFQKLLQRKPDAVGVFWALLFLAAQSKVDLQQTDFYQPLQVRTCLPDAIPLEDLG

SEQ ID NO: 53633 - protein, 391 aa, Nocardioides sp. JS614
MSQDLYELLGVGRDADADAIKKAYRRLARQYHPDVNPDPEAQERFKEISLAYEVLSDPQKRAHYDRGGDPFGGGAGGFGQGAGFSFTDIMDAFFGGGGAAGAGRGPRPRERRGQDALIRLEVELAEAAFGVTREIKVDTAVRCSTCHGEGTAAGTHPIPCETCHGAGEVAHVQRSFLGEIRTLRPCPACRGFGTIIPEPCRECSGDGRVRSRRTLTVKIPAGVDNGTRVQLSGEGEVGPGGGPAGDLYVEIHTAPHETFTRHGNDLHCTVTLPMTAAALGTTLTLPTLEADVVTGDPDESEVETSFDLDVRPGTQSGTEQVLRGRGVPGLRGGRGDLVVTVVVETPTRLDPRQEELLIELAAIRGEEAPTGQVRPGAKSVFGRLRDAFNAH

SEQ ID NO: 53634 - protein, 309 aa, Glycine max
MAQQEVVEGFKFEQRHGKERVRVARVWKTRQGQHFVVEWRVGITLFSDCVNSYLRDDNSDIVATDTMKNTVYAKAKECSDILSAEDFAILLAKHFVSFYKKVTGAIVNIVEKPWERVIVDGQPHEHGFKLGSEKHTTEAIVQKSGSLQLTSGIEGLSVLKTTQSGFVNFIRDKYTALPDTRERILATEVTALWRYSYESQYSLPQKPLYFTEKYQEVKKVLADTFFGPPNGGVYSPSVQNTLYLMAKATLNRFPDIAYVSLKMPNLHFLPVNISNKDGPIVKFEDDVYLPTDEPHGSIQASLSRLWSKL

SEQ ID NO: 53635 - protein, 337 aa, Phaeosphaeria avenaria f. sp. triticae
MVVKVGINGFGRIGRIVFRNAIEHNDVEIVAVNDPFIEPHYAAYMLKYDSQHGQFKGDIKVDGNDLTINGKTIRFYTEKDPANIPWSETGAYYVVESTGVFTTTDKAKAHLKGGAKKVVISAPSADAPMFVMGVNNETYTKDIEVLSNASCTTNCLAPLAKVIHDKFTIIEGLMTTVHSYTATQKVVDGPSAKDWRGGRTAAQNIIPSSTGAAKAVGKVIPDLNGKLTGMSMRVPTSNVSVVDLTVRLEKGATYDEIKEAIKAAADGPLNGILGYTEDEIVSTDLNGDTRSSIFDAKAGISLNKNFVKLVSWYDNEWGYSRRVLDLLVYIAKVDGNA

SEQ ID NO: 53636 - protein, 652 aa, Phytophthora parasitica
MMLNSCIAKLIAQSETLSRLGDSTGWDAVTEPAKIVPMFGDEGRRASVLVTRERDRNGSGISYTSSECSNNHAEPDIPAEEIRAARQDLLIDDEEEAKPAVHDVQATARVTPVSVSEELLSPTVAGYCCSPEFPSNESSNSQELDTDNNATDEKESNNQEDNQGDDDSEEDSIAGDLATQSSVAPYKSAVLAGRGTSTYHSMGMEGGVSTYQRMGLEDEYTKASSRSAVAAVNGPRPLPRAAFGATSSSSGLFPMMRPQTHSFNANGQVFTLDTRYQLVKPIGNGAYGAVIAVKDVVNGGDNLAVKKITNIFEDLVDAKRILREVRLLGHFNHKNITRLHDLSPPPSRKQFDDMYIITELMETDLHQVIYSMQPMSDDHVKYFLYQMLCALHHIHSAGVLHRDMKPSNILLNANCDLKVCDFGLARGGVGSSSSLQQELPQLGELTEYVVTRWYRAPEIMLNCLHYTTAIDVWAVGCIFAEMLLREPLFPGNDYLHQLKLIIKFLGTPKQEDIGFVKNTKALRFLTKLAISKPKKWRDVFATSGAENVVSAEAIDLLSKMLLFNPDKRISVDAALRHPYLATFFDENDLILSKPFDFSFDLPDDQLSKDALINLLCEDIEHFHPPVPLSVTPMPLSTAASRFFRMGMTASAS

SEQ ID NO: 53637 - protein, 365 aa, Phytophthora parasitica
MGEEVEKHVLRKYELLQKLGKGAYGIVWKAIDKNNRQVVALKKCFDAFRNATDAQRTFREVMYLQELNGHSNIIRLLNVVKADNDRDIYLVFDFMETDLHAVIRANILEEIHKKYIIYQLLKSLKYMHTAELLHRDIKPSNLLLNSDCHTKLCDFGLCRSVAEISGPNPILTDYVATRWYRAPEILLGSTKYAKSVDMWAVGCIVAEMATGRPAFPGTSTMNQLERILDVTGPPSQEDIESIKSPFANTMLESLPAPKKKPLEELFPKASPEALDLIKQCFWFDPSKRISVIDALKHPYVAQFHNEKDEPSAPAPLQIVVNDNTKYSAADYRDRLYREIIKKKKEVRRKAGEQDGATAAAATTAQ

SEQ ID NO: 53638 - protein, 234 aa, Glycine max
MFTLNHSSDLYHVSPELSSSLDTSSPASEGSRGVAFSDEEVRLAVRHPKKRAGRKKFRETRHPVYRGVRRRNSDKWVCEVREPNKKTRIWLGTFPTPEMAARAHDVAAMALRGRYACLNFADSAWRLPVPATAEAKDIQKAAAEAAQAFRPDQTLKNANTRQECVEAVAVAVAETTTATAQGVFYMEEEEQVLDMPELLRNMVLMSPTHCLGYEYEDADLDAQDAEVSLWNFSI

SEQ ID NO: 53639 - protein, 214 aa, Brassica napus
MTGFSVSLIVSNFSNVASYLSPIFETIPSKVVPAQIEKVVSLVSRTGRDLQRYDNSGYRQVVGCVPYRYKTQQVNGTESKEIEVLLISAQKGKGMLFPKGGWEIDESMEEAALRETIEEAGVTGELEEKLGKWQYKSKRHNIIHHGYMFALLVDQEFERWPEAEMRQRKWVGLDEAGEVCQNWWMREALEAFVNVKCNTEEVEIEASNESGNDV

SEQ ID NO: 53640 - protein, 506 aa, Phytophthora parasitica
MGEDDDVNMSEEGERSGCSTPIQGGRTPRHRKSFDRLQELHKETGQNRRVSERYSLAASDVPGGFELVEADGVDQQDKTSASEEEEMYTFTVASTKFRVYRRYQLIRAIGHGAYGVVIAASDQVTGNSVAIKNIPRTFDDLVDAKRIVREIRLMRHLRHPHVVSVLDVMRPPLLATFEDTYIVTDLMETDLHRVINSPEPLSSDHIAFITYQLLCGLRYVHSAHIIHRDVKPSNVLINRDCLVKLCDFGLARGIDIRPVTPSSVDGNTTPSSQDGEPALDEALTEYVVTRWYRAPELLLASRYSTAIDLWAVGCILAEMFTRKALFPGHDHVHQLHLILQLVGSPPPDDMGFVTNMKAKRWMARQQQHEAKPLNSVCPNAPTEALDLMTKLLQFDPRKRISVDEAIAHPFLAPCRADGVEMDSERLADSAFDFSFERENKGNLDKNTLRRLIFEDVCHFHPEATAELEQFKQEQERLKRLEEEKWRKEEAQAKAKARTGKSWAVSV

SEQ ID NO: 53641 - protein, 203 aa, Zea mays
MFSLFYGLWKHVFSKAEFHVLILGVHKAGKTTLLEKLKSIYLKGEGLPHDRIVPTVGLNIGRIEDANVKLVFWDLGGQPGLRTIWEKYYEEAHAVIYVIDSASASSFEDAKSALEKVLRHEDLHGAPILIFANKQDSPAAVTEEELARHLHLKELDERPCMFQAGSAFNGTGIKHGVDWLVEEMERSKRTEALRARTEAAGKI

SEQ ID NO: 53642 - protein, 683 aa, Phytophthora parasitica
MPNLSRKFSFMTSVASSAASAASSAVGVGTSSNNSTPVVDPFSTGTPRNAGDESYLPTHPVWNRVLELPFSHVIGTCSLVVDVKDHSKNGVESQLGFATLNVAKYLMAADGTERTKKREEAAMAADSKWYSISNAKGEYCGKVQLGITCQRKKIMEEGDGVQPRLKKSQSVVIDRKNPPSSNMLQWDATPAHSQALLGAATPALKKGMTLDEFQMGGSEHARRHGWANVKLSPEDTARTQSAGAIVSSKEDDDESVHKRFPEGSAALPAATDAVICKENADMHTFMVCGAPFTIPRHYQLIKVCGRGAYGIVIAATNLRTGGNVAIKKVIDCIWHPHQLKQILRECRLIRHMAHENVLSLLDLIPPPSYTDFRDVYMTVDLMEMDLHRIIYSKEVLRDDHIRYFLYQMLSGLHHMHRAGVLHRDLKPSNLLINSDCQLKICDLGLARSKEADDVGMTEYVVTRWYRAPELLLGSAYGEGVDLWAAGCIFAEMLGRKPLFPGETYVHQLQLIMNVLGVPEEHSFKENPLANKLKGRQLLSRTQAVAGIDTSTMFPNANPEGLDLLWKMLVFDVEKRITVEEALRHPYLAMYYDEERENAPVEKFQSFDLDDLDETDLKELMFKEICHFHPEEMVKRAQQQKEHPEAVEKLPPGWVKRESRSVPGKFYYSNPKRGISTWIKEEMD

SEQ ID NO: 53643 - protein, 492 aa, Zea mays
MDLEDQEAQKPLLVTAPGRIGDGSHLAESDAASSSSSIAVVVASTAVAVAGSFEFGISVGYSSPSQSGIMRDLSLSLAEYSVFGSILTIGAMLGAVVSGTVADRVGRRSAMAISDLLCIFGYLLITFSQNFWWLDIGRFSIGCGIGLLSYVVPVYISEITPKNLRGGFATVNQFMICCGASLAYVLGTFITWRTLAIIDFDFPIVGVAPCLLQLVGLLVTPESPRWLARFGHPGAFEAALQKLRGKGTDISDEATGIKDFTEKLQQLPKSKMLDLFQKDYIRAVTVGVGLMVLQQFGGVNAICFYASEIFVSAGFSSGNTGMLAMVAVQIPMTGLGVILMDKAGRRPLLMVSAAGTCLGCLLVGLSFLAKEHHWGKDLNLVLALAGILIFGGSFSLGMGGIPWVIMSEIFPINMKGAAGSLVTLVSWLGSWIVSYAFNFLLVWNSYGTFFIFASICGLTVVFVEQLVPETKGRTLEEIQASMNSSLASPFDI

SEQ ID NO: 53644 - protein, 244 aa, Arabidopsis thaliana
MAGIDTQKQLLSLIRDFTSERSRGEQRVVGLKKRIEILQSEVEAANSEVEKAKRIKEVAEEELNGYEVELSLNDATIQSLEARISLLQDEVTTIGSEVDALKRSVYKPNGRTEQGDKVIFYSLRYHLVPGVTHLSCLVGNREFQKTVDSSLSSDDGIGITANVKASEDGSGADLEAIKGMLSEVNSQLAKEEEGYLAEQKIQEQLQKELDDYEKKMSLMEAITDKTNSVQVLTRYPLILLAGEA

SEQ ID NO: 53645 - protein, 1194 aa, Debaryomyces hansenii CBS767
IRYKFGASSVRARLQDFATIILCRDNATRGLDSATALEFIRALKTSATILDATPLIAIYQCSQDAYDLFDNVVVLYEGHQIFYGKANKAKEYFINMGWDCPKRQTTADFLTSLTNPAERVPRPGYEDKLPYTPVEFEEYWKKSPQYKKLIEDIEEYLKQKEGSDRDLYHQAHVARQSNHISQKSSFTVSFFMQTRYIMSRNILRTKGDPSIALQSIALQVVMGLIIGSTYYNLETTTGSLFYREAVLFFAILFNSFSSILEIMSLFEARPIVEKHKQYALYRPSADALAGIITELPTKFFMSMGFNFFVYFLSNMRRDAGRFFFYWLMNALCTLVMSHFFRSLGAVSTSFPGAMTPATVVLLAMVIFSGYCIPPPNMLGWSRWIGYINPVSYVFEALMINEFNDREFTCSAFVPAGPSYMDISSDQSICSVTGSRPGLSFVNGSDHIAVTYEYYNSHKWGCFGIIVGFIVFFLVLYVILSEFNKGSMQKGEVTLFLKSSLKEHKKQAAKGAATTKDIENSNISNEKISHKDQLDANKEENNNNNNALPSSKDIFHWRDLTYQVKIKSEDRVILNHVDGWVKPGQLTALMGSSGAGKTTLLNCLSERVTSGIISDGTRMINGQELGSSFQRSIGYVQQQDLHLPTSTVREALRFSAQLRQPNSVSIQEKNEYVEYIIHLLDMNLYADALVGVAGEGLNVEQRKRLTIGVELVAKPKLLIFLDEPTSGLDSQTAWSICKLMRKLADHGQAILCTIHQPSAILLQEFDRLLFLQKGGKTVYFGDLGENCHTLIDYFEKYGAHHCPEEANPSEWMLEVVGAAPGSHANQDYHEVWKNSAEYQMVKDHLTEMETELVKIPRDESQEAKRSFAAPIWKQYLIVTKRIFEQNWRSPSYIYSKLILVISSSLFNGFAFFKADRSLQGLQNQMISIIQFLVPFMTLVQQMMPYYIKQRDIYEVREAPSKTFSWFAFITAQITSEIPYQVVIGTLGFFCWYYPVGLYDNAVPTDSVDSRGVLMWLYITAFYVYTSTMGQLCISFIEVPENAANLAVNLFTVCLIFCGVLAPYDFLPGFWTFMYRCSPMTYFVQGMGSTGLSNVEAVCSESELLRFEPRSGQTCGSYMADYIKQTGGYLVDGNATSKCEYCTTKSTNDYLASVDSLFSERWRNWGIVICFIAFNIIFTVFFYWIARVPKSNRQKK

SEQ ID NO: 53646 - protein, 508 aa, Bifidobacterium longum NCC2705
MQLFRTKSVEQTIAETGEEGRKLKRNLTWWDLSIMGVAVAVGAGIFSVGAQAAAFHAGPAVIISFLIAGIVCGAAVMCYAEFASMIPVAGSAYTFTYTTVGEIMAWIIGWDLILEMLMAGSVISKYWGVYLNDFMRLMGWNANTNLTFGSFHIDIAPIIIVAFFTTLLVFGTKIGARVDGAMTVLKIAIVFFVVIVGFFYVKASNFTPFIPPSQPASTVEGSSAVTGVMTQPLWQFATGMTPSVYGVPGILSGAALVFFAFIGFDVVATASEETKNPHKNVPLGIGVGMLLIIVMYMLVAVVTTGMVSYADLAKQDSPSLATAFELVGADWAAKIISFGIVLGLATVVMVLLLGLTRIVFAMSRDGLLPRGLSKTGKHGTPAALQIVVGAVVALVAAFFDIGVLSDMVNIGTLSAFTLVAISIPIMRKKRPDLPRAFKMPGSPWIPILIAVANFWLMLNLSVLTWIRFVVWLVVGFAIYFGYGYWHARLGKGDLTETLSAETDKAVNG

SEQ ID NO: 53647 - protein, 112 aa, Nocardioides sp. JS614
MEDCLFCKIVAGDIPGEVVHTTERTVAFRDIDPKAPTHVLVVPRDHYTNAAELAAADPQATAELVTTAAAVAAAEGYADYRIVFNTGAEAGQSVFHTHLHLLAGRPLTWPPG

SEQ ID NO: 53648 - protein, 254 aa, Triticum aestivum
  misc_feature (208)..(208): Xaa can be any naturally occurring amino acid
  unsure (1)..(254): unsure at all Xaa locations
HYRTSLYKKAGWYRSGIPGISSTHASDGGASGMLATCVIQPIDMIKVKIQLGEGSAAQVAKTMYANEGLGSFYKGLSAGLLRQATYTTARLGSFRVLTNKAIEANDGKPLPLVQKAFIGLTAGAIGACVGSPADLALIRMQADSTLPAAQRRHYKNAFHALYRITADEGVLALWKGAGPTVVRAMSLNMGMLASYDQSVELFKDKLGXAGRISELLFGASGHFLEFCAGCFESCPFDFVKTQIQKECTLMPLGK

SEQ ID NO: 53649 - protein, 308 aa, Erwinia carotovora subsp. atroseptica SCRI1043
MKTGKLVVLGSINADHILNLEQFPRPGETVIGEQYSVAFGGKGANQAVAAGRSGANIAFIACVGEDDIGSRICQQLSKDNIDVSAVEAISGETTGVALIFVNAEAENMIAINAGANAAVTPDYLHRHQQHIIDASALLMQLESPLETVIAAARLAHEHQTKVILNPAPARELPDELLSLVDMITPNETEAQLLTEITVETEEDAARAAQVLHDKGIETVLITLGSRGVWLSESGQGQRIPGYRVKAVDTIAAGDTFNGALVTALLENQPMSSAVKFAHAAAAISVTRRGAQPSVPWREEIDAFLQAQE

SEQ ID NO: 53650 - protein, 404 aa, Acidovorax sp. JS42
MNPLLSLLQPYPFERLRQLFAGVTPSAAHRAISLGIGEPRHATPPFIQEALAANLAGLASYPSTAGDPSLREACAGWMQRRYHIPVNPATQVLPVNGSREALFAFAQTVVDPTRAGATVVCPNPFYQIYEGATLLAGATPYYAPSDPARNFAVDWDSVPEEVWQRTQLLFVCSPGNPTGAVMPLPEWEKLFALSDRYGFVIASDECYSEIYFRDEPPLGGMEAAAKLGRSDYRNLIAFTSLSKRSNVPGLRSGFVAGDAALIKAFLLYRTYHGSAMGPAVQAASVAAWNDEVHVEENRALYRQKFAQVTPMLAEVMDVRLPDAGFYLWAKVPDALGMSDAEFAQALLAQYNVTVLPGSYLARDSGGANPGAQRLRMALVAETAECAEAASRIVQFIQSRTLFHP

SEQ ID NO: 53651 - protein, 221 aa, Larix griffithiana
KAAGARIIVTQAAYVDKLADLQSDDMIVIAIDGAPKEGCQHISILTEADETQCPSVEIHPDDVVALPYSSGTTGLPKGVMLTHKSLVSSVAQQVDGENPNLYFHSEDVILCVLPLFHIYSLNSVLLCALRAGAATLIMQKFNLTTLLELIQRYKVTVAPIVPPIVLEISKNPIVSRYDVSSVRIIMSGAAPLGKELEDALRERFPKAIFGQGYGMTEAGPV

SEQ ID NO: 53652 - protein, 221 aa, Larix griffithiana
KAAGARVIVTQAAYVEKLADLQSDDVIIITIDGAPKEGCQHISVLIEADETQCPSVEIHPDDVVALPYSSGTTGLPKGVMLTHKSQVSSVAQQVDGENPNLYFHSEDVILCVLPLFHIYSLNSILFCALRAGAAILIMQRFNLTTLLELIQRYKVTVAPFVPPIVLDITKNPIVSQYDVSSVRIIISGSAPLGKELEDALRERFPKAIFGQGYGMTEAGPV

SEQ ID NO: 53653 - protein, 221 aa, Larix himalaica
KAAGARIIVTQAAYVEKLADLQSDDVIIITIDGAPKEGCQHISVLIEADETQCPSVEIHPDDVVALPYSSGTTGLPKGVMLTHKSQVSSVAQQVDGENPNLYFHSEDVILCVLPLFHIYSLNSILFCALRAGAAILIMQRFNLTTLLELIQRYKVTVAPFVPPIVLDITKNPIVSQYDVSSVRIIISGSAPLGKELEDALRERFPKAIFGQGYGMTEAGPV

SEQ ID NO: 53654 - protein, 337 aa, Rhodococcus sp. RHA1
MTSVNRQVRLAKRPVGRPDDSTWEITSEPIPEPADGEFTVKVDYVSLDPAMRGWLDDVKSYVPPVAIGEVMRTHAVGRVVASKNAKFPEGQLVSGQFGVQEFALSDGRGALAVDESLAPAPTWLGALGFPGMTAYFGLTDVGKLEKGDTVLISGAAGAVGSIAGQIAKLKGATVIGIAGGPEKCAWLTEDLGFDAAIDYKSESVGKALRAAAPDGIDIYFDNVGGEILDAALARLRKNARVALCGAISGYNATDPQPGPSRYLSLLVNRASMTGFIVFDYLDRFPEGMEAMSEWIRAGEIVTREQVETGGVEAFGRTLNLLFDGANTGKLVLEIGDH

SEQ ID NO: 53655 - protein, 517 aa, Oryza sativa
MGNGGSTAHRPRVRVHRNSGGDDEAIDSWTLAPRHPTVPARCSYPYSTTALSGREARKRHAPRSRHLDFSGERRKNNTPPPLTYGDSDTMAMAAASASAMARRAASWPRLLLLSRAFAAAAAEPKRVLVPVADGTEPVEAAATADVLNRAGARVTVATADPAGDDRGLLVEAAFGVKLVADGRVADLEGEAFDLIALPGGMPGSANLRDCKVLEKMVKKQAEQGGLYAAICATPAVTLAHWGLLKGLKATCYPSFMEKFTAEIIPVNSRVVVDRNAVTSQGPATAIEYALALVEQLYGKEKSEEVAGPLYVRPQPGVDYVIDEFNSVEWKCSGTPQVLVPVANGSEEMEALNLIDILRRAGANVTVASVEDKLQVVTRRHKFNLIADIMVEEAAKREFDLIVMPGGLPGAQKLSSTKVLVDLLKKQAESNKPYGAICASPAYVLEPHGLLKGKKATSFPPMAHLLTDQSACDSRVVVDGNLITSKAPGSATEFALAIVEKLFGREKAVSIAKELIFM

SEQ ID NO: 53656 - protein, 203 aa, Isochrysis galbana
GEGTYGVVYKAQDTEDPQGATVALKKIWLDDRDEGVPVTTLREVALLRNLDHVNIVRMREFVTIPPRIYLVFEYLDHDLKACLDTKFRSGMPAPLVKSCALQILRGLAFCHSHRILHRDLKPQNVLIDNAGIVKLADFGLARASLLLNSQLYTNEVVTLWYRAPELLLGTQNYINSVDVWAAGCIFTELSCRMPLFPGDSEIE

SEQ ID NO: 53657 - protein, 211 aa, Neisseria gonorrhoeae FA 1090
MPMNLFQNAKFFTTVNHLKDLPDTPLEIAFVGRSNAGKSSAINTLTNHVRLAYVSKTPGRTQHINFFELQNGNFMVDLPGYGYAQVPEAVRAHWVNLLGDYLRHRKQLIGLVLIMDARHPLKELDIRMLDFFHTTGRPVHILLSKADKLSKNEQIKTLSQVKKLLKPYSDRQNISVQLFSSLKKQGIDEANRTVGSWFDAADAAASSPEEN

SEQ ID NO: 53658 - protein, 463 aa, Nostoc punctiforme PCC 73102
MADLTPNSSFSLTLRLQIPNRVGMLASVTQAIATTGGNLGQIDLIEQTRKESTRDITVDAASTEHAETIVQAVKALPDIKLLSVYDRTFNLHRGGKISITSRIPLKSVSDLAMAYTPGVGRICTAIAQDPEEVYKLTIKQNTVAIVTDGSAVLGLGNLGPAAALPVMEGKAMLFKEFAGLDAFPICLATQDTEEIIQTVKNIAPVFGGVNLEDIAAPRCFEIEKRLREELDIPVFHDDQHGTAIVTLAALFNSLKLVHKPMAEIRIVINGAGAAGVAIARLLRKAGAEKIWMCDSKGIISTSRADLTEEKLEFAVKAQGTLAGAMQGADVFIGVSAPGVLTPEMVHSMAKDPIVFAMANPIPEIQPELISKDVAVIATGRSDYPNQINNVLAFPGVFRGALDCRAKTITTTMYLEAANAIASLVKPSDLDREHIIPSVFDERVVNAVAAAVQQAARQEGIAQN

SEQ ID NO: 53659 - protein, 238 aa, Oryza sativa (japonica cultivar-group)
MSYFGNHAQNSHLVGAPIYIADASSPPEVEILQGNDDGNGNGNVRTEKRILWTEEEDIILMSAWIEHSTDSTCGADKGGGQYWGEVVESYNKTTPPLRKRNLKQCKDRWHKINRWTDLFECAYVKARRIFTSGYSNQMWIDAAHKFYVDDNKEAKLGPFVLMEVWKICREVSKWKTYNDNLRNARKRKSFHLEGDSEEADDTFDEMPKRPMGQKAAKKAALDAKIKSNGLGSSDDDRK

SEQ ID NO: 53660 - protein, 429 aa, Bacillus thuringiensis serovar konkukian str. 97-27
MRKFDKSIAAFEEAQDLMPGGVNSPVRAFKSVGMNPLFMERGKGSKVYDIDGNEYIDYVLSWGPLIHGHANDRVVEALKAVAERGTSFGAPTEIENKLAKLVIERVPSIEIVRMVNSGTEATMSALRLARGYTGRNKILKFIGCYHGHGDSLLIKAGSGVATLGLPDSPGVPEGVAKNTITVAYNDLESVKYAFEQFGDDIACVIVEPVAGNMGVVPPQPGFLEGLREVTEQNGALLIFDEVMTGFRVAYNCGQGYYGVTPDLTCLGKVIGGGLPVGAYGGKAEIMRQVAPSGPIYQAGTLSGNPLAMAAGYETLVQLTPESYVEFERKAEMLEAGLRKAAEKHGIPHHINRAGSMIGIFFTDEPVINYDAAKSSNLQFFAAYYREMVEQGVFLPPSQFEGLFLSTAHSDADIEATIAAAEIAMSKLKA

SEQ ID NO: 53661 - protein, 846 aa, Bifidobacterium longum NCC2705
MKNPPLHRYATRPGLYFTDDGGADVVVRSETADQVWLCVLEPIDEPSAFFQDAIRLFEDPNISFIQQIHEFPVCTRIIEHLYLRETLFRMTGPNYGLWYVHLPKAWDGMRYGYRVDGAWDPKHGVRFNPYKFLLDPYGKGIDGSMELTPAAFSYECDVVDHKVTGSAYGAMSTVDSLGHVPVSVAIDDRDIHKHEGDPQHPHVPWRKTVIYEMHVKGFTANAPWLPESLRGTYAGLAHPTTLAYLQGLGITSIELLPIMAKQDELFLQEHGRKNYWGYSTLSYFAPEPSYATKAAQEKGAAAVRQEVIDMVRALHEAGFEVIMDVVYNHTCEGGVEGPTVCWRGLDDLAYYRHQKSNTGRLEDTTGCGNTLDFTNTHVVTFAIDSLRYWAKRIGIDGFRFDLGVTLARLEGEFTHHHPFLYALRSDLLLGNLKLIMEPWDLGNLGWRTGQFSVPFAEWNDRFRDTARTFWLEDVDGGSDFGRISLQEMSTRLCGSADLFATEPGRGAPASINFVSCHDGFTLTDLTRYRSKHNEANGENNNDGSSVNHSANFGVEGVTDDPDVIAAREQAAMNMIGMLLLSLGTPMMLAGDEFRNTQDGNNNAYCQDNDITWLKWDWMYSTNKTREMRRLETVSRLVALRKSLDLYHHEDFFTRLTQLGLLKPSSRVQWFLPDGTTPMERDWFDLGVRSFTMRLLSNSEVDVCIVVNGTADDRTFRLPPDTHWTPKWCSAEINGRRAGHGTQVEECDLNGDTTVWTQHVPDASETVLKMVKEVAMQRTESSTENEADTIKFAMPVTDHAANGTSSAPRDEVSADMPDAPVDDTPDTPVDDNVWTMPALSITLMKQV

SEQ ID NO: 53662 - protein, 408 aa, Debaryomyces hansenii CBS767
VIGEVLLEQAYGGMRGIKGLVWEGSVLDPIEGIRFRGRTIPDIQEQLPKAPGGSEPLPEALFWLLLTGEVPSVAQTKAFSQELAARSALPKHVEELIDRSPSHLHPMAQFSIAVTALESESQFAKAYAKGVNKSEYWDYTYEDSIDLLAKLPNIAARIYRNVFHDGRLGAIDSSLDYSANLANLLGFGENKEFLELMRLYLTIHSDHEGGNVSAHTTHLVGSALSSPFLSLAAGLNGLAGPLHGRANQEVLEWLFKMRGELNGDYSKENIEKYLWETLNAGRVVPGYGHAVLRKTDPRYTAQREFALKHMPDYELFQLVSNVYEVAPGVLTKHGKTKNPWPNVDSHSGVLLQYYGLTEESFYTVLFGVSRAFGVLPQLILDRGLGLPIERPKSFSTEKYMELVKNIKA

SEQ ID NO: 53663 - protein, 211 aa, Erwinia carotovora subsp. atroseptica SCRI1043
MTQQYNYHMTRFIISAPDIRHLETDNGIEVAFAGRSNAGKSSALNTLTNQKSLARTSKTPGRTQLINLFQVAEGVRLVDLPGYGYAEVPEQMKIKWQRALGEYLQKRNSLKGLVVLMDIRHPLKDLDQQMILWAVDVKLPVLVLLTKADKLASGARKAQLNMVREAVLPFMGDIQVEAFSSLKKIGVDKLQQKLDNWFSTLQHIEEEQDAE

SEQ ID NO: 53664 - protein, 387 aa, Dechloromonas aromatica RCB
MELNSMTVTLRTLTANDSEALEQVRQYFRNYAAWLGVDLSYQNFDQEMASLPGTYVAPQGRLFFAEVDGRPAGCVGVRPLPDSDGVCEMKRLYVDPAERGHGIGAALALAAIKAAKEIGFRKLMIDTLPNMRMAVKLYRELGFTEAPNYYQTPVEGTMFLALDLENWSEEEIRSENLSHLFDFNRAWARQMQEVDPTYFDRLSHLQTPEFLWIGCSDSRVPANQIVGLLPGEVFVHRNVANVVVHTDLNCLSVIQYAVDVLKVKHIMVVGHYGCGGVGAALQRDRVGIVDLWLRHVHDVHNKHLANVNSLPEAQRHDRLCELNVLEQVVNVCHNPVVQDAWSRGQQLTVHGWVYGLKDGLIHDLGITIDCPQDLPSRYDAALKALDA

SEQ ID NO: 53665 - protein, 286 aa, Kineococcus radiotolerans SRS30216
MCHIVPSGRVPTPSPARQELTVDVTGSTALITGASGGIGAGIARALAARGADLVLVARSADKLEALAADLRARHGRDVLVVPLDLSTPGAGARVQEALSGRTVDVLVNNAGFGVTGRLAETEDPDRLSAMITLNCTTLTDLTARFLPAMVQRRRGAVVNIASMAAYLPAPGFAAYAATKAFVLSLSQALWAETRGTGVRVAALSPTVTDTGFFDVAGENASGGMRRRSVDQVVATFLDTLDGDRPVVVDGRRNEVLAAAAHLVPRGPLLRLVGPRFADRVATAPAG

SEQ ID NO: 53666 - protein, 393 aa, Nocardioides sp. JS614
MKAVTWQGRKDIRVEEVPDPRIEEPTDAIIRVTTTGLCGSDLHLYDPLTPFMTPGDIVGHEPMGVVEAVGSEVTELAVGDRVVVPFNISCGSCWMCERGLHSQCETTQNRDTGTGASLFGYSSLYGAVPGGQAELLRVPFADFLPVQVPHGPPDDRFIYLSDVLPTAWQGIAYAGVPEGGTLLVLGAGPIGDMATRIALHRGIRVIVVDRVPERLARVSARGAEILDLGEIDDVAEQVRGLTGGRGADSVLEAVGMEAHGSPVAEAVQKSLRLLPKKLQQLMMTNLSVERLAALYLAFEAVRRGGTVSISGVYGGTSDPMPMMQLFDKQLQLRMGQANVRAWTDELRTLLEQDEDHLDVEGFATHHLPLDAAPQAYASFQAKDDGMVKVLFRP

SEQ ID NO: 53667 - protein, 454 aa, Haemophilus influenzae R2846
MTMITPVQAILASNQHFLDRQDVMESNVRSYPRKLPFAYAKAQGCWVTDVEGNEYLDFLAGAGTLALGHNHPILMQAIKDVLDSGLPLHTLDLTTPLKDAFSEELLSFFPKDKYILQFTGPSGADANEAAIKLAKTYTGRGNIIAFSGGFHGMTQGALALTGNLGAKNAVENLMPGVQFMPYPHEYRCPFGIGGEAGAKAVEQYFENFIEDVESGVVKPAAVILEAIQGEGGVVSAPISFLQKVREVTQKHGILMIVDEVQAGFCRSGKMFAFEHAGIEPDIIVMSKAVGGSLPLAVLAIRKEFDAWQPAGHTGTFRGNQLAMATGYASLKIMRDENLAQNAQERGEYLTNALRELSKEYPCIGNVRGRGLMMGIDIVDERQSKDATGAYPRDCELAAAIQKACFKNKLLLERGGRGGNVVRVLCAVNINQNECEEFIKRFKQSVVDALKVVRS

SEQ ID NO: 53668 - protein, 221 aa, Larix himalaica
KAAGARIIVTQAAYVEKLADLQSDDVIIITIDGAPKEGCQHISVLIEADETQCPSVEIHPDDVVALPYSSGTTGLPKGVMLTHKSQVSSVAQQADGENPNLYFHSEDVILCVLPLFHIYSLNSILFRALRAGAAILIMQRFNLTTLLELIQRYKVTVAPFVPPIVLDITKNPIVSQYDVSSVRIIISGSAPLGKELEDALRERFPKAIFGQGYGMTEAGPV

SEQ ID NO: 53669 - protein, 221 aa, Larix himalaica
KAAGARIIVTQAAYVDKLADLQSDDMIVIAIDGAPKEGCQHISILTEADETQCPSVEIHPEDVVALPYSSGTTGLPKGVMLTHKSLVSSVAQQVDGENPNLYFHSEDVILCVLPLFHIYSLNSVLLCALRAGAATLIMQKFNLTTLLELIQRYKVTVAPIVPPIVLEISKNPIVSQYDVSSVRIIMSGAAPLGKELEDALRERFPKAIFGQGYGMTEAGPV

SEQ ID NO: 53670 - protein, 336 aa, Zea mays
  misc_feature (277)..(277): Xaa can be any naturally occurring amino acid
  unsure (1)..(336): unsure at all Xaa locations
MAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVSGFKVDTVDTTGAGDAFXVGSLLVNVAKDDSIFHNEEKLREALKFSNACGAICTTKKGAIPALPTVATAQDLIAKAN

SEQ ID NO: 53671 - protein, 221 aa, Larix mastersiana
KAAGARIIVTQAAYVDKLADLQSDDMIVIAIDGAPKEGCQHISILTEADETQCPSVEIHPDDVVALPYSSGTTGLPKGVMLTHKSLVSSVAQQVDGENPNLYFHSEDVILCVLPPFHIYSLNSVLLCALRAGAATLIMQKFNLTTLLELIQRYKVTVAPIVPPIVLEISKNPIVSQYDVSSVRIIMSGAAPLGKELGDALRERFPKAIFGQGYGMTEAGPV

SEQ ID NO: 53672 - protein, 422 aa, Clostridium tetani E88
MNNLEIFKESEKYMPGGVNSPVRAFSNASINPPIIKKGLGSRIVDEEGKEYIDFVASWGPMILGHNDPEVVEAIQNTVEDAISFGAPTELELKLAKHMVETLDNIDMVRMVNSGTEATMSAIKLARGYTRRDRIIKFAGCYHGHFDGFLVEAGSGVLTERIPGSPGVPKGSIENTLIAEYNHIDTVEALFEKYPEEIAAIIIEPIAGNMGTIPAKTEFLQRLREICTKYGALLIFDEVMTGFRVAYKGAQSRYGVKPDLTTYAKIMGGGLPSGAYGGRRDIMEKLSPIGPVYQAGTMSGNPVVMAAGYTTLRKLYNNPSYYEHMEKIGAELQKGIEIVAKEKGLPVVVNRCGAMLTPFFSKRDKVADYEDAKSSDTELYGRFFEHMIKSGIYIAPSQFEAMFIGVKHDIYEVERFLEAMRKF

SEQ ID NO: 53673 - protein, 552 aa, Nostoc punctiforme PCC 73102
MAKPIEFNLFAPYNKGAALIGSFSDWQEIPMEKGNDGYFRTSVELKDGVYKYKFRVQSNSWFFEPEQWVDVTDPYATDIDELSGKDDSVIHVKDCERITDTYVWQNDDKPLPADHELVIYELHVGDFSGGEDDPYARGKYKHVIEKLDYLSELGINAIELMPLKEYPGDYSWGYNPRHFFATESSYGSTAELKKLIDECHGRGIRVIIDGIYNHSEASAPLTQIDHDYWYHHEPRDPDNNWGPEFNYEHYDEKLEIHPARKFIGETIRFWIQEYHLDGIRYDAARQIANYDFMHWIVQEAKNTAGAKPFYNVAEHIPETTSITNVDGPMDGCWHDSFYHCILEHICGDTFDLERLKDVIDCKRQGFLGATNVVNYLTNHDHNHIMVELGNREIFDEEAFRRAKLGVAILMTAVGVPLIWMGEEFGEYKPKQPESSKIDWTLLGNDLNRSLFESYKGLTNLRKSNHALYTENIDFIHENPEAKVLAYTRWNDEGSRVVVIANFSENFLAGYHVPNFPSAGTWHEWTGNYDVESGDDGIITDLGPYEAKVFVWQ

SEQ ID NO: 53674 - protein, 737 aa, Arabidopsis thaliana
MNAKDVISRLPDEVLGRILSLISTKEAVSTSVLSKRWKNMFVLVSNLDIDDRQSVPKTKQNRIEIHRNYMAFVDKLLDTQRGSSIKKLTLKSHVGVRGGTDSSRIQSWICNVLDHGVMDLDVFITLKGKSPPVPAMIFKSKTLVKLRVGRGFTIKLSQDVSLPLLRTLCLDSVNFVGGHNVVGTLISRCPVLEELVVEERRCVDWTCSVSSPSLKRLHIRFDRKFTSISLDAPNLIYYKHSGYVLGKYPNVKLDSLIEARLNLRMDETRMVGVRNGSLGSIPADMRNLINGIRNVRILHLSSHTLELLYFSCKEMPLFDSLVSLSIGNDKARGWQMLPLLIKNSPNLETLIFMGLDHYITNRCGDVCVCYDTDESITSCLSSSQVKVLEILSYQGTTRELNQMKHFLEKLPCLELVKICVVNNSNNLQTTMEMRNLMMLPRASSKYRERERPFQQLPNYLLLRCFETLVTSRERESKQTHTKDRSELRTTMQKQEFLELYEAALRAAKSVKGVKNSSKVSRFVDARNRLKDAPTSLACEVVSKTSMGKGLSFLNDHKNPHIRSEGRLLRDLWMKILYASGREKSHDRETQVKIPTHSTMKKTGDSKRDKVREILQTSLVKVASEIVDTEMKTRVTACDPSVVAVSVESAMFEKLGCFMGPHKAKYRSILFNMGDSNNPDLRRKVLIGEINGERLVTMERQEMGSEKIQKEVQRIKENARFKEESRMKILQSASMIMT

SEQ ID NO: 53675 - protein, 221 aa, Larix mastersiana
KAAGARIIVTQAAYVDKLADLQSDDMIVIAIDGAPKEGCQHISILTEADETPCPSVEIHPDDVVALPYSSGTTGLPKGVMLTHKSLVSSVAQQVDGENPNLYFHSEDVILCVLPLFHIYSLNSVLLCALRAGAATLIMQKFNLTTLLELIQRYKVTVAPIVPPIVLEISKNPIVSQYDVSSVRIIMSGAAPLGKELEDALRERFPKAIFGQGYGMTEAGPV

SEQ ID NO: 53676 - protein, 716 aa, Erwinia carotovora subsp. atroseptica SCRI1043
MKKITSVCPYCGAGCKLKLVVEDNKIIRAEAADGVTNQNELCLKGYYGWDFLNDTQLLTPRLTQPMIRYEKGGRLTPVSWDEAIRYTAQRFSEIKAKYGPRSIMTTGSSRGTGNETNYVMQKFARAVLNTNNVDCCARVCHGPSVAGLQEVLGNGAMSNSISDIENSKCLLIFGYNSADSHPIVARRVVKAHQNGAKIIVCDPRRIEAARIADQHLQLNNGSNMALVNAFGYVLLEEKLYNQHYVDRFTEGLDTYREIVKDYAPEAVEHLTGVPAADVRQAMRTFAAAPSATIMWGMGVTQFGQAVDVVRGLAGLALLTGNLGRENVGVGPIRGQNNVQGACDMGVLPNMFPGYQSVTDPDVRAKFADAWGISPAVMDENIGTRITEVPHMALEGKIKAYYIMGEDPLQTEADLSLVRRGVEALDFLVVQDIFMTKTAEVADVLLPATSWGEHGGVFTCADRGFQRFEKAIEPKGNVKRDWEIISLIASEMGYPMHYADNQQIWDEMRSLCSLFYGVTYEKMGDMGHIQWPCPTLDHPGTPYLYQDSHFDTPTGKGKLFATQWRAPAEVPDEAYPLVLCTVREVGHYSCRSMTGNCAALQALADEPGRVQMHPQDANRLGIKDRSLVWVSSRRGKVISRADISERINKGTIYMTYQWWIGACNELTQDNLDPISKTPETKYCAAKVDVIEDQRWAEDFASTSYNDMKARLRAAVAH

SEQ ID NO: 53677 - protein, 227 aa, Arabidopsis thaliana
ILVDWLVEVSEEYTLASDTLYLTVYLIDWFLHGNYVQRQQLQLLGITCMLIASKYEEISAPRIEEFCFITDNTYTEDQVLEMENQVLKHFSFQIYTPTPKTSLRRFLRAAQASRLSPSLGVEFLASYLTELALIDCHFLKFLPSVVAASAVFLAKWTMDQSTHPWNPTLDHYTTYKPSDLKASVHALQDLQLNTKGCPLSAIRMKYRQEKYKSVAVLTSPKLLDTLF

SEQ ID NO: 53678 - protein, 110 aa, Glycine max
MGMIVDFENDQNDAVLVPPPNFAMVEDCVFRSSFPTPSNFPFLQTLNLRSIIYLCPEPYPEENLEFLRSQNIRLFQFGIEGKTDVSMPVLKDSIMDALQVFNILRVCVCV

SEQ ID NO: 53679 - protein, 142 aa, Aquifex aeolicus VF5
MAVERTLIIVKPDAMEKGALGKILDRFIQEGFQIKALKMFRFTPEKAGEFYYVHRERPFFQELVEFMSSGPVVAAVLEGEDAIKRVREIIGPTDSEEARKVAPNSIRAQFGTDKGKNAIHASDSPESAQYEICFIFSGLEIV

SEQ ID NO: 53680 - protein, 469 aa, Erwinia carotovora subsp. atroseptica SCRI1043
MSAEHVLTMLNEHEVKFVDLRFTDTKGKEQHVTIPAHQVNADFFEEGKMFDGSSIGGWKGINESDMVLMPDASTAMIDPFFEDTTLIIRCDILEPGTMQGYDRDPRSIAKRAEDFLRSSGIADTVLFGPEPEFFLFDDIRFGSSTSGSHVAIDDVEAYWNSGKAYEGGNKGHRPGLKGGYFPVPPVDSSQDIRSAMCLTMEQMGLVVEAHHHEVATAGQNEVATRFNTMTKKADEIQIYKYVVHNVAHAYGKTATFMPKPMFGDNGSGMHCHMSLSKDGTNLFAGDKYGGLSEMALFYIGGVIKHAKAINALANPTTNSYKRLVPGYEAPVMLAYSARNRSASIRIPVVASPKARRIEARFPDPAANPYLCFAALLMAGLDGIINKIHPGDAMDKNLYDLPPEEEAEIPKVAGSLDEALAALNEDREFLTRGGVFTDDAIEAYIELRKPEIDRVRMTPHPVEFELYYSV

SEQ ID NO: 53681 - protein, 793 aa, Clostridium perfringens str. 13
MKVPFNWLKDYVDIDMTAEELGDALTLSGSKVEEVVTAGAEIENIVTCQIDKIEQHPDAEKLKICQVNIGSEMIQIVTAADNMKEHDKVPVALHGAILADGSKIKKGKLRGEVSNGMFCSEEELGIADGKEVIGLMILPEDAPIGVCIKEYLGLNKQVLDFEITSNRPDCLSVLGMARETAATTRKTYRMPNTKFEVKCDKNINDEIKVTVNDKLCNRYMARGVKNVKVAPSPTWMQERLLDAGVRPINNIVDITNFVMLELGQPMHAFDRRELKSSNIVVERAKDGDKFVTLDEIERELNSDVLCIKDGEEIVALAGIMGGLNSGVKDDTTEIVFESANFDGTNIRVNSKNLGLRTESSSRFEKDIDPNLAALALDRACALVEELGCGEIMEGTIDVYNNVKEEKTLEVSVSWINKFLGTSLEAEEMKKCLDSLDLKTTINGDTLEILVPTFRIDVDIREDVAEEVARIYGYNNIPATLISTSTEKEAKDKKQLLDEKVIDTMLASGLNQSISYSFVSPKVFDKICVPEDSSLRNVVKIKNPLGEDYSVMRTSTLPSMMESLARNYSRSNEIVRLFEIGKTYIPNSDENELPTERNILTIGIYGQCDYFDLKGIVENLLDSLGLKSASFKRMSENPSYHPGKTAELILGRTSLGVLGEIHPDVNENYGVDVPCYVAELDLDAMYNFSKTEKYYKPLPKYPAITRDIALLVDDAVLVQEIEDAIRKAGGQVVEKVELFDVYKGAQIPEGKKSIAYAIAYRDPSKTLKDKDINKVHDKILRALEYKLGAQLREQ

SEQ ID NO: 53682 - protein, 270 aa, Arabidopsis thaliana
MTSLKAVRCQTVRIQPRNSFHRLDRYALGYDKNRNHKILRFVDDHLAVGEHVFGYEIYDFSSSSWRVLDVTPDWDIQFYQRGVSLNGNTYFFAQEKITEDGEYEEFEDFLLYFDFSTERFEPRLPLPFHFYVLETVSLSSVRDEQLAVLYQRLDSYEILDIWLTTKIEPSAVSWSMFLKLDMRPLTGFQFMVDGGSFFIDEEKKVAVVFDLTKHKQTVTRRYQTAYIIGQDGYFKPVSLGEAPYLGDPHELYCLPLVCPSYAPSLVQLYN

SEQ ID NO: 53683 - protein, 621 aa, Listeria monocytogenes EGD-e
MCGFVGCVHDRITEITGADKETFRQMNSMITHRGPDDEGYFTDDHVQFGFRRLSIIDVENGHQPLTYENERYWIIFNGEVYNYVELREQLVAEGMTFETESDTEVIIATYAKYKEKTAERLRGMFGFVIWDKQEELVYGARDPFGIKPFFYAEEDDKLFMGSEKKSILHALKEKELDEVSLQNYMTYQFVPEPDSLTKNVKRLEPGHQFTKKIGQPMEITTYWKASFAPVTKSEDAWIKEVRDVMYDSVKMHMRSDVPVGSFLSGGIDSSIIAAIAKEYHPAIKTFSVGFERDGFSEIDVAKETADKLGVENISYVISPEEYMKELPKIVWHMDDPLADPAAIPLYFLSREARKQVTVALSGEGADELFGGYNIYNEPNSLAMFNKMPGVFKSMLNNLARIMPEGMRGKSFLERGTTPMEERYIGNAKMFTEKEKQILLPKYQAGHDYTNITDPFYAETTNYHPVERMQYIDIHTWLRGDILLKADRMTMANSLEVRVPFLDKEVYNVARNIPDTMKTTNGTTKYILRKAAATFVPEHVLNRRKLGFPVPIRHWLKDEMNAWVKNIIKESPTDHLINKQYVLDLLDDHCAGKFDYSRKIWTVVIFMIWYDVYVADKYDFGK

SEQ ID NO: 53684 - protein, 182 aa, Pseudomonas putida KT2440
MHSDAFDLKALIRPVVDFPKPGVIFRDITPLFQSPRGLRYVADQFIERYVEAEFSHIGAMDARGFLIGSIIAHQLNKPLILFRKQGKLPADVLSEGYQTEYGEAFLEVHADSLCEGDSVLIFDDLIATGGTLLAAANLVRRTGAQVFEAAAIIDLPELDGSRRLQAAGVPTFCLTEFSLSEY

SEQ ID NO: 53685 - protein, 79 aa, Brassica napus
  misc_feature (10)..(12): Xaa can be any naturally occurring amino acid
  misc_feature (16)..(16): Xaa can be any naturally occurring amino acid
  misc_feature (18)..(18): Xaa can be any naturally occurring amino acid
  misc_feature (27)..(27): Xaa can be any naturally occurring amino acid
  misc_feature (48)..(48): Xaa can be any naturally occurring amino acid
  misc_feature (50)..(51): Xaa can be any naturally occurring amino acid
  misc_feature (58)..(58): Xaa can be any naturally occurring amino acid
  misc_feature (60)..(60): Xaa can be any naturally occurring amino acid
  misc_feature (63)..(63): Xaa can be any naturally occurring amino acid
  unsure (1)..(79): unsure at all Xaa locations
MAYSMLSSAXXXTSPXQXTMDAPFTGXLKPSSAFPVTRKVNNDITSIXSXXGRVSCMXVXPPXGKNKFETLSYLPDLTE

SEQ ID NO: 53686 - protein, 648 aa, Oryza sativa (indica cultivar-group)
MGRHGGVPVEAGGVEAKLLGRWLAATSLDNIGELWNVDLEAQEQQGVAVSNQGCVGVFGSFCSLRKASSIVKHVAATGCLPEYSSEAPARYFSSESSLQVDSTEENGFKGHGMLAPFTAGWQSTDLHPLVIDRSEGSYVYDINGKKYIDALAGLWSTALGGNEPRLIKAATDQLNKLPFYHSFWNRTTKPSLDLANEILSMFTAREMGKIFFTNSGSEANDSQVKLVWYYNNALGRPNKKKFIARSKSYHGSTLVSASLSGLPALHQKFDLPAPFVLHTDCPHYWRFHLPDETEEEFATRLATNLENLILKEGPETIAAFIAEPVMGAGGVIPPPKTYFEKIQAVLKKYDILLIADEVITAFGRLGTMFGCDMYDIKPDLVSIAKALSSAYMPIGAILVSPEITDVIYSQSNKLGSFAHGFTYSGHPVSCAVAIEALKIYKERNIIEHVQKIAPRFQEGIKAFSGSPIVGEIRGLGLILGTEFVDNKSPNDPFPAEWGVGSLFGAECEKRGMLIRVAGDNIMLSPPLIMTPDEVEEIISKYGDALKATEERIAELKAKRVIDDGDDKLTMFNVYRVVSSVDANNEVLFELADFESFAGGVRWLSSSSIGGHLKHMSRRQQQQSAAQLKQHNTGEQRMHASSAGDHTVN

SEQ ID NO: 53687 - protein, 260 aa, Thermosynechococcus elongatus BP-1
MAPTLPSLLALDFDGVLCNGLREYFQTSWRVYQQVWPEPLLGISLEQLEREFGQLRPVITVGWEMPLLLRAIVAGTPAQQILQDWPKVRDRLLATYHLTAADLGARVDGLRDRWIETDWQSWLALHDFYDGVIAALQHWQAQGQALAIVTTKEQRFVTYLLEQAGLSFPSEAIYGKEQQQPKPVILQALQSTYGAPLWFVEDRLGALLQVAVTPELGQTELFLAAWGYTTAGDRAQAEAHPRIHLLSLEQFCQFPHWLPP

SEQ ID NO: 53688 - protein, 272 aa, Salmonella enterica subsp. enterica serovar Paratyphi A str.
MEIYAVFGNPIAHSKSPFIHQQFAQQLDIVHPYGRVLAPINNFINTLDAFFAAGGKGANITVPFKEEAFARSDELTERASLAGAVNTLKRLEDGRLLGDNTDGIGLLSDLERLNFIRPGLRILLIGAGGASRGVLLPLLSLDCAVTITNRTASRAEALAKIFAHTGSVHATDMDKLDGCEFDLIINATSSGIRGEIPAIPASLIHPSLCCYDMFYQKGNTPFLSWCVQQGAKRYADGLGMLVGQAAHAVLLWHGVLPQVEPVIELLQQELLA

SEQ ID NO: 53689 - protein, 429 aa, Erwinia carotovora subsp. atroseptica SCRI1043
MTRRAIGVSERPPLLQTIPLSFQHLFAMFGATVLVPILFKINPATVLLFNGVGTLLYLFICKGKIPAYLGSSFAFISPVLLLLPLGYEVALGGFIMCGVLFCLVALIVQKAGTGWLNVLFPPAAMGAIVAVIGLELAGVAAGMAGLLPADGASVDSTAVTISLATLAITILGSVLFRGFLAIIPILIGVLAGYVLSFALGVVDLTPIREAHWFAMPTFYTPRFEWFAILAILPAALVVIAEHVGHLVVTANIVKKDLMRDPGLHRSLFANGISTVLSGFFGSTPNTTYGENIGVLAITKVYSTWVIGGAAILAILLSCVGKLAAAIQAVPVPVMGGVSLLLYGVIGASGIRVLIESKVDYNKAQNLILTSVILIIGVSGAKVHLGSTELKGMALATVVGIGMSLVFKVISLFRKEEEILDAPEENDARS

SEQ ID NO: 53690 - protein, 294 aa, Rhodopseudomonas palustris CGA009
MDPTTMPAPAPINYSQTWTFFEGEWHDGNVPIMGPRTHAAWLGSMVFDGARAFEGVTPDLDQHLARINWSATNFKLNALVDKATWLGLVQDGLKRFAGNAELYIRPMYWAQNGVGGGVLFDPDTTNWCLCIYEAPMPKPTGLSITLSPFRRPTAECAPVEAKAGCLYPNNSRAMMEAKSRGFDNCLLRDMLGHIAELGNSNIFMAKDGVVYTPAANGTFLSGITRQRVIELLRGDGITVLETSLSYRDFETADEIFASGNFAKVQPIIRIDDRSLQPGPFYAKARKLYWEFAHG

SEQ ID NO: 53691 - protein, 425 aa, Wolbachia endosymbiont strain TRS of Brugia malayi
MTKRIINNVFAREILDSRGYPTVEVEIELCDGATGRASVPSGASTGKLEALELRDQDEKRYCGKGVLKAVKAVNGVIANAIIGMDAADQSTIDKALIELDGTRNKSKLGANATLGVSLASAKAAANSFKMPLYRYLGGEQANVMPFPLINIINGGVHADNKLDFQEFMILPIGAEAFSEAIRMSAEVFHNLRSILRKRGYSTNVGDEGGFAPNIESTEEALDLIVHAIESASYSTQNHFALGLDVASSTFYKNKIYKFANKELTSEELVEYYYNLVEKYPITSMEDAMSEDDYEGWKLLTAKLGSKVQLVGDDLFVTNCELIRKGIEEKMANAVLIKPNQIGTLTETFTAIGMTKSGGYKAVISHRSGETEDTTISHIAIASNCGQIKTGSLSRSDRLAKYNELIRIEGTLERNAKYYYGLAWTS

SEQ ID NO: 53692 - protein, 449 aa, Pseudomonas syringae pv. tomato str. DC3000
MFGFFRPARHQAPLPEEKVDSTYRRLRWQIFAGIFIGYAGYYLLRKNFSLAMPYLIDEGYTRGQLGVAMSAIAIAYGLSKFLMGIISDRSNPRYFLPFGLLVSAGIMFIFGFAPWATSSVTIMFVLLFINGWAQGMGWPPSGRTMVHWWSQKERGGVVSVWNVAHNVGGGLIGPLFLLGMGWTNDWHAAFYVPAAVALLVAVFAFATMRDTPQSVGLPPIEHYKNDYPEGYDESHEEEFSAREIFVKYVLRNKFLWYIAMANVFVYLLRYGVLDWAPTYLKEAKHFTVDKTSWAYFLYEWAGIPGTLLCGWMSDKIFKGNRGLTGMVFMFLVTIATLVYWLNPEGNPTVDMIALVSIGFLIYGPVMLIGLQALELAPKKAAGTAAGFTGLFGYLGGSVAASAAMGYTVDHFGWDGGFVLLIGACILAMVFLAPTLRHKQVASTSRDIKR

SEQ ID NO: 53693 - protein, 429 aa, Salmonella enterica subsp. enterica serovar Paratyphi A str.
MKKQNNLRSLAAQAVEQVVEQGQSLSNVLPPLQQKVADKDKALLQELCFGVLRTLSQLEWLINKLMSRPMTGKQRTVHYLIMVGFYQLLYTRVPPHAALAETVEGAVSIKRPQLKGLINGVLRQFQRQQETLLNEFATSDARFLHPGWLVKRLQNAYPTQWQRIIEANNQRPPMWLRVNRTHHTRDGWLGLLEDAGMKGYPHPDYPDAVRLETPAPVHALPGFAEGWVTVQDASAQGCAVFLAPQNGEHILDLCAAPGGKTTHILEVAPEADVLAVDIDEQRLSRVYDNLKRLGMKATVKQGDGRYPAQWCGEQQFDRILLDAPCSATGVIRRHPDIKWLRRDRDIAELAQLQAEILDTVWPRLKPGGTLVYATCSVLPEENRDQIKTFLQRTPDAALSETGTPDQPGQQNLPGGEEGDGFFYAKLIKK

SEQ ID NO: 53694 - protein, 197 aa, Francisella tularensis subsp. tularensis SCHU S4
MNYSKAKYIMGAAKVSQLPEDTGVEVAFAGRSNAGKSSALNTLTDQKGLARVSKTPGRTQLINLFDLGNNNRLVDLPGYGYAKVSESIKRQWQSEMENYLTSRKCLNGIVLLVDLRHELKEFDSLMIEMAISFDLNLHILLTKADKLNNKERAQANRMIESFLKTFVSTDKISYQLFSSLTKMGLDKFKEKLDTWYQ

SEQ ID NO: 53695 - protein, 253 aa, Triticum aestivum
MASLSSMQMVHTSQIGVKSQLVSSANRTSPSVSSGSALSSRLHYAASFPLKKQFSGAYATIKNQRTACVKSMAAEEEEVIEPQAKVTNKVYFDVEIGGEVAGRIVMGLFGDVVPKTVENFRVLCTGEKKYGYKGSSFHRIIKDFMIQGGDFTEGNGTGGISIYGAKFEDENFTLKHTGPGILSMANAGPNTNGSQFFICTVKTPWLDNKHVVFGQVIEGMKLVRTLESQETRAFDVPKKGCRIYACGELPLDA

SEQ ID NO: 53696 - protein, 399 aa, Pyrococcus abyssi GE5
MNIMSGDEVQFHENYDDYITYLKRRIRQLELQVRMLEADKERLERELSRLRSEMSRLRQPPAFAGTVIEVLDDDRAIVQNYNGPRFVVRIAPWIERDKLRPGARVALDQRTMAIIELLPSSKDPTVLGFEVIERPNVTYNDIGGLKKQLQELREAIELPLKHPELFEEVGIDPPKGVLLYGPPGCGKTLMAKALAHEVNATFIRVVGSELVRKYIGEGARLVHELFELAKEKAPTIIFIDEIDAIGAKRMDETTGGEREVNRTLMQLLAEMDGFDPRGNVKVIAATNRPDILDPALLRPGRFDRLIEVPLPDFEGRLEILKVHTRRMKLKNVDLRVIAEITEGASGADLKAIATEAGMFAIRERRTYVTQEDFLKAVDKVLGNERKLLQQITSHEIIYG

SEQ ID NO: 53697 - protein, 201 aa, Sinorhizobium meliloti
MSEALNELASYLREGRGALIADAEVKYGELTVTAKAENLIALLTFLRDDVQCGFVSFIDVCGVDYPQRPDRFDVVYHLLSPRQNQRVRVKVATRENDPVPSATSVFPGADWFEREAYDMYGILFTGHPDLRRILTDYGFEGYPLRKDFPLTGFVEVRYDNEAKRVVYEPVELKQEFRNFDFLSPWEGTEYVLPGDEKARPR

SEQ ID NO: 53698 - protein, 116 aa, Yersinia pestis CO92
MTTIDKIQRQITENPILLYMKGSPKLPNCGFSAQAVQALSACGERFAYVDILQNPDIRAELPKYANWPTFPQLWVDGELVGGCDILMEMYQRGELQTLLKETADKYRSQEDQPAAE

SEQ ID NO: 53699 - protein, 1789 aa, Ustilago maydis 521
MPSRTRVRKPDPLPYPTRPYLALGLEGSANKLGAGIVLHKPFDPSAPSSSSTSVPSSISSRSVGRVEILSNVRHTYVTPPGSGFQPSDTAKHHKEWIIRVISEAVRRSGIKSLADVDCICYTKGPGMGAPLQSVAVVARTLALMYSKPLVGVNHCVGHIEMGRTITGAHNPVVLYVSGGNTQVIAYSAQKYRIFGETLDIAVGNCLDRFARVIGLSNDPSPGQNIEKEARKGTKLLPLPYTTKGMDVSLAGILSATEAYTRDKRFKPNAHVEYNDAAVGSLANGDVWTGEGGGKHIINISDNAPTLTSDADADAPTARTDADVDVSQSGVSQLDSSVDTITPADLCFSLQEHIFSMLVEITERAMAHIGSKEVLIVGGVGSNQRLQQMMGVMASERGGSVFATDERFCIDNGIMIAHAGLLSHRMGLDTSLDKTLFIAAAGLSGLATMSQVPVASSQQRSVSAGNHPSSSSTSSSFAVPFSSTSATSTPLLAQGSLHAGSPTSNHLSSSPYAAAGSLPAAATPASLSHQHSSSLVGTPAILATTSFRKLVWDGTIPICVSVDPAELPPGSDATIDSTYLVVPRISYLPLIIADVRRNLLELVLEQPALNVLNEKELWFEYEGQPLRWHWQIGLLYDYHTSNPARTAIAYQSSSTNTTGLGSLRPNTPLIPQGGSDTEFSSAAQPSRLPWNIRLRLSKLPVERLHSNSGLESCKTSFMSMIKEADFVRYGSTKKVVNLRKQEQDTLWDSVVSHDYELFWSIANKLVPNAGVSGSDAAAGNGLALGRSPIAARTMSLNLGGTQEDRTNASAQRSLTTLQNESQASLAPSTLSTLTSTTSSDPTSATNSTPTSSAGNSVRSIPIRFFLPDNAPIVQEPVPPTLDDGRANTLAAVLSALFPLLFPPPPSFSSFQAPAPPLAYALVQGVRMPLDTEIAWLGSALVGPDGWVSVVVGLRYRVRSETIMASCVITVVLIPIVNLDSTGVGNKAEGDHDGHPRDCRVRHQVAVTLSQSTSMNNQGQQAQQAQQAQQAQQAQQGQQPGQPQTAAQAAQYKAALIQQQQIQAMRAQALAQQQAQQQGQSSAQVQQPQQQPQQQPHPQQPQQQAANLQALHALVQNNPQGLAALVQAAREGRMSPDQLAQLKAFIGAHQQQQQQQQQQNRPPQQQNQQQVRPPQQQQQQAQPNLQQQQQMAAALQQQLQQQQQQQRNAQNAQQQQQQPQQQPQQQNLGLARPPQGPAQPQLPQNEQALLEQFNRIAQPLRIKVQALESALNNPNLKPDERQQCQNALQETRNQQAALAKQIQIVRESFRLQQQQQQQPQQQQRQQQPMGQQQMPQMNPATAQAGTPQQQQQQQQQTASPVVLPTAATAAGTPATPVPVPPPPAAAAAAASTPAATGTPKTQAKATPKAPAKSKAAQKKEKEAKEKEEKEKKEKEAKETKAAKGGAKAKAAAAGGTSASPAPTAAPAPASASAAATAKASPVTGTPAAVGGAGSAAGGGGAPGGAGAAGSAMMTPTSGSAGASAPASGSVAPGAPLASPAGAGGANAQNAVTAMSTNTAASYANAAIAPVLNVNATWTPEPYPNASGPRSSMTAGLGVAAVLGTPAVLTRPTPTEGGQEALDELLGLSAKTASVGADELLGLPTDDPEVASAAALTASAALSSTALPALALPALPLSSTHAAHASVSTSGSMLTKRKISDLISELDSNEKLSGAVEDLLLELADEFIDSVTSMSCKLAKHRHADKLEVKDVQLHLERNWNLRIPFPGSAPIAPPRVKPNPAPAANPLATHK

SEQ ID NO: 53700 - protein, 249 aa, Xanthomonas campestris pv. campestris str. ATCC 33913
MTRKLVLLRHGQSQWNLDNRFTGWVDVDLTEQGRQEAAAAGKLMKDEGLQFDVAYTSVLKRAIHTLQGALKELDQDWLPVHKSWRLNERHYGGLQGLDKAETAAKHGEEQVKIWRRSYDIPPPAMDVTDPGHPGHDRRYATLDRNALPGTESLATTLVRVLPYWHDAIAPQLKAGQTVLVTAHGNSLRALYKYLNDISNAQILELNIPTGIPLLFELDDNLQVQSYRYLGDPEAAKRAAEAVANQGKAK

SEQ ID NO: 53701 - protein, 616 aa, Acidovorax sp. JS42
MAIIDIKVPDIGDFAEVGVIEVLVQPGDTIRAEQSLVTVESDKASMEIPSSHAGVVKELKVKLGDKVAEGSVLLTLEVAQGAAAPAAAPAAASTPSAPPSESKPAPAPAVQAPAAPKTEAASFGGSADVECDVLVLGGGPGGYSAAFRAADLGLNVVLVERYATLGGVCLNVGCIPSKALLHVAAVMDEVSHLKSAGIDFGAPQVHIDTLRGHKEKVIGKLTGGLAQMAKMRKVTVLRGYGHFVGANHLEVEETTGTGQDKTGSKKVVAFKKAIIAAGSQAVRLPFMPDDPRVVDSTGALALQGVPQKMLIVGGGIIGLEMGTVYSTLGARLDVVEMMDGLMQGADRDLVKVWEKMNKHRFDNILLKTKTVGAQATPEGIQVQFEGLDGTKSEGTYDLVLQAVGRTPNGKKIAADKAGVSVTDRGFINVDIQMRTNVPHIFAIGDIVGQPMLAHKAVHEAHVAAEVIAGELQGNKELASAAFNARVIPSVAYTDPEVAWVGLTEDQAKAQGIKVKKGLFPWAASGRAIANGRDEGFTKLLFDDSPEAHGHGRILGGGIVGTHAGDMIGEIALAIEMGADAVDIGKTIHPHPTLGESIGMAAEIAHGSCTDVPPQRR

SEQ ID NO: 53702 - protein, 390 aa, Wolbachia endosymbiont strain TRS of Brugia malayi
MSDLKTMMLNFGPQHPAAHGVLRLVLEMDGEIIERADPHIGLLHRGTEKLIEHKTYLQALPYFDRLDYVSPMSQEHAYSLCVEKLLQCEVPIRAKYLRVLFCELTRILNHLLNISSQALDVGAMTPLLWLFEEREKILEFYERASGARFHAAYIRPGGVAADVPEGLIEDIAKFIEQFPQYIDDVDELLTENRIWKQRTVGISEISIKQALDWGFSGPMLRAAGLAWDLRKSQPYEIYDQLDFDIPVGQNGDCYDRYLVRMEEIRQSVSLVKQCIEKIPEGPVKTEDRKISPPPRTEMKRSMEALIHHFKLYSEGYHVPEGEAYAAVEAPKGEFGVYIVSDGTNRPYRCRIRAPGFAHLQALDFMAKGHMLADVAAIIGSLDIVFGEIDR

SEQ ID NO: 53703 - protein, 891 aa, Azoarcus sp. EbN1
MAATSNVILKPDQDSQETQEWLDALAGVVANEGPERAHFLIEKMIEAGREEGIDLPYSATTQYINTIPVSQQPKYPGNPDMEIKLHSYIRWNAMAMVVRANKHTNVGGHIASFASAAALYDVGFSHFWRAPTKDHGGDLIFFQGHSVPGVYARAFMLGRLTDEQLDGYRQEVSGKGISSYPHPWLMPDFWQFPTVSMGLGPLCAIYAARFMKYLDSRGMVEAKDRKVWAFVGDGETDEVETLGAIGLAAREKLDNLIFVINCNLQRLDGPVRGNGKIIQELEAEFRGAGWNVIKVIWGTHWDPLLARDTKGLLKKRMMEAVDGEYQTFKAKNGAYVREHFFNTPELKEMVADWTDDEIWRLNRGGHDLFKIFSAYKAAVEHKGQPTLILAKTIKGFGMGQAGEAMNISHQQKKLDTDGVRRFRDRFELPVPDDQIAEVPYLKFADDSPEQKYLLERRMALGGFLPARPRRAETLPVPPLATFAALLKSSGEGRELSTTMAVVRIMNTLMKDKQIGRHVVPIVPDESRTFGMEGMFRQYGIWNQQGQNYVPEDHDQLMFYKESKTGQVLQEGINEAGAMADWIAAGTSYSVHGVQMIPFYIFYSMFGLQRTMDLCWAAGDQRTRGFLIGGTSGRTTLNGEGLQHEDGHSLLLANMIPNCVSYDPTFQYEVAVIVQDGMRRMFAEQQDVYYYITVLNENYEHPEMPTGAEADIVKGMYAFRKGGESTSNLRVQLLGSGSIFREVIAAADLLKNDWGIESDLWGCPSFNELVRDGQDVDRFNMLHPLDAPRVSHVEKCLKDTTGPVIAATDYIKLFAEQVRPFVKRTYVTLGTDGFGRSDTREKLRHFFEVDRRWITVAGLKALADDGLIERDKVAAALLKYQLDPNKPNPMTV

SEQ ID NO: 53704 - protein, 583 aa, Azoarcus sp. EbN1
MSELIEVKVPDIGDYADVPVIELFVKPGDTIKVEDPIATLESDKATMDVPSTAAGVVREVLVQVGDRVAEGKVLIKVEAAGAENTAAPEAAGNAAAQATPASSGAALEQSEASAPSAASAATASAPTPTPTSAPAATGGSTEVRVPDIGDFSDVPVIELFVKVGDTIKVEDSIATLESDKATMDVPSSAAGVVREVKIKVGDRVSEGAVLIVVDSAAGAATAPAPAATPATARIAAADATPADAPEAFEQSKLSAPAAGQAGAPSAVALGGRVHASPSVRAYGRELGVDLAQVRATGPKGRVVREDVTAFVKGAMQTGIVPGKAAAAGAGVSLGGGLDLLPWPKVDFSKFGEIETKPLSRIKKISGQNLARNWVMIPAVTYHEDADITDLEAFRVAINKENEKSGKKLTMLAFIIKASVRALQQFPEFNTSLDASGGEMSLVYKKYFNIAFAADTPNGLVVPVIKNADRKSVFEIAAESGELAKKARDGKLGPADMSGACFTISSLGGIGGTYFAPIVNAPEVAILGVNKSAMKPIWDGKQFVPRLTLPMSLTADHRVIDGALATRFNVYLAQLLSDFRRVML

SEQ ID NO: 53705 - protein, 260 aa, Zea mays
MAADLPCDDAGVCMVCGVAAPSEVDLLRCSTCATPWHSPCLSNPPALSEAAIWSCPDCSGDPVAPAAPAAGGELVAAVRAIEADTTLSDAEKARRRQNILAGRSAASAPDDDVDDSAEDDVLNIFGRSFSCAFCMKLLDRPVTTPCGHNFCLKCFNRWTHNGASACGKCRRPIPYKMVQQPRINSAIVSAIRAARMSKNTNPAAAGSSAGSHHYIQNVDRPDRAYITERAQRGRKANASSGQIFVTTAPDHFGPILAEHD

SEQ ID NO: 53706 - protein, 615 aa, Azoarcus sp. EbN1
MSQIVEVKVPDIGDFSDVPVIELFVKPGDSIKVDESICTLESDKATMDVPSSAEGVIREVLVKVGDRVGEGAVLLKVEPQGAGAAPAGAGEAKPVPAAAAPAASPSPSAAAPAQTAAKSGAYAGSVDLECDMLVLGAGPGGYSAAFRAADLGLKTVIVERYATLGGVCLNVGCIPSKALLHVAQVMDEAEHMAVAGIKFAKPEVDLDALRAHKDKVVGKLTAGLAGMAKGRKVEVVRGLGTFLDANHLEVELSSGSGQDKTGEKKVVRFKQCIIAAGSAAVHLPFIPKDPRIVDSTGALELRTSDGKAPAKMLVIGGGIIGLEMATVYSTLGTRVDVVEMLDALMQGPDRDAVKVWEKQNAQRFDNIMLKTKTVAVEAKDDGLWVTFEGEKAPQGPQRYDMILQAAGRSPNGKKIGADRAGVVVTDRGFIEVDAQMRTNVPHIFAIGDVNGNPMLAHKAVHEGHVAAEVAAGETQGKSELARSAFDATVIPSVAYTHPEVAWVGFTEEQAKKEGRKVETAKFPWAASGRAIANGADYGFTKLIFDAETHRIIGGAIVGPSAGDMIGEVCLAIEMGADAVDIGRTIHPHPTLGETIGLAGEVAHGSCTDIPPMRKK

SEQ ID NO: 53707 - protein, 256 aa, Brassica napus
  misc_feature (229)..(229): Xaa can be any naturally occurring amino acid
  unsure (1)..(256): unsure at all Xaa locations
MAAAAKLSFKDSLKALEADIQHANTLALDYPREKDGARVQMRLSYSPAAQFFLFLVQWTDCHLAGSLGLLRVLIYMTYADGKTTMSVYERKASIREFYAVIFPSLLQLQRGITDLEDRKQREVCNMRYRKKDEGKKCELSEIEMEREEECGICMEMNSLVVLPNCTHSLCIKCYRDWRGRSQSCPFCRDSLKRVDSGDLWMFLENTDTVNPSVIARENQKRLFVYIEKXPLVVPRQAFASSPYDLHVKVKKEKKGC

SEQ ID NO: 53708 - protein, 266 aa, Zea mays
MYASLCLVSCLFIHHRPAGGFPFIIDLPASLNFFCCVCWPGAEVATRIYSEEEIEMTSVWKTKVLPGLNKIFDKDGKKAAAAGFLKSFNKEEIDKEIEDKKTELEPKVVEAYEASPPEVKALFKDKKPVKVSKKNSAAVTKFLDELAKIDFPGAKVVSEAVAKSGTSPLLPAITFILDKVAPFIPKEEPKAEPAAEATSREVAVEEKKEEAEPAAATEAAPAPAETPSEAAVVEEKKEEEKKEEEDKPAAEEAAPPAEAAAAAEEK

SEQ ID NO: 53709 - protein, 279 aa, Pyrococcus abyssi GE5
MEFIEWYPRGYGVAFKVKEKIFEGHSKFQKIEVYETEGFGRLLALDGTVQLVTEGEESYHESLVHPVMLAHPNPRRVLVIGGGDGGTIREVLRHEEVEEAIMVEIDEEVIEVAIKFIGIDGGLLDKMMKGECKRAKLIIGDGVEFIKENSGFDVVIVDSTDPVGPAKMLFSREFYERAYEALNDPGIYVTQAGSVYLFTDELVTAYENMSRVFDKVYAYSFPVIGYASPWAFLVGIKGDLDFRKIDLERAKKLNLKYYDPENHETIFQMPRYVREMLKP

SEQ ID NO: 53710 - protein, 221 aa, Pseudomonas syringae pv. tomato str. DC3000
MKHIVDGFVHFRKEVFPQQEELFKKLATAQSPRAMFITCADSRIVPELITQSSPGDLFVTRNVGNVVPPYGQMNGGVSTALEYAVVALGVQHIIVCGHSDCGAMRAVLNPSSLDKMPTVKAWLRHAEVARTVVEQNCNCSGELETMQVLTQENVISQLHHLRTHPSVAAKMASGQLFIHGWVYSIETSEILAYDAERDTFVPLDGTGPTPMASPKARFSAD

SEQ ID NO: 53711 - protein, 291 aa, Clostridium perfringens str. 13
MFKGSCVALITPFTEDGVNYEELRKLLEWHIKNHTDAILVCGTTGEGSTMTLEEKKEVIKFSVEVVNKRVPVIAGTGTNNTKASIELSKYAEEVGADMVLIITPYYNKTSQKGLYAHFSAINDAINIPIMLYNVPSRTGMNITPLMLDKLADLNNVVAIKEASGDLSQVAKMAELCGDRIAIYSGNDDQIVPILSLGGAGVVSVLANILPEETHNICEKYFLGEVIESRNLQLKYLSLANSLFIETNPIPVKTAMNLMNFNCGPLRLPLCEMEDSNLIILEENLKANGLIK

SEQ ID NO: 53712 - protein, 458 aa, Gloeobacter violaceus PCC 7421
MLRSLTLAWGGDQCFCNIEYSCLNPFVKGRSMVTSLNDSPSPAYICPNDMACSNLDRAAQILRLDPGVVEVLGTPHRVLTVSVPVRMDNGRIRVFAGHRVQHCNVLGPYKGGMRYHPDVTLREVSTLAMLMTWKCALMGIPYGGAKGGIAVNPTTLSVGELERLTRRFTSELVRDIGPQIDIPAPDVGTGPREMAWMMDTYSMSIGHASPGVVTGKPLSIGGSKGRDAATGRGVVIATREALDTAGLALRGATIAIQGFGKVGKAAALIFQQHGARVIALSDGSGGIYNPDGLDIEQAADFVRDGSRLAQYPFPGVKPIANPELLTLPCDVLVPAALEHQITEANAARVRARLVVEAANAPTTMEADRILEERGVTVLPDILANAGGVVVSYLEWVQGLSYLFWDEEKVNLELEKLMVGAYARVLQQATQFRLPLRPAAYTLAVGRVVEAFNHRGLYP

SEQ ID NO: 53713 - protein, 700 aa, Oryza sativa (indica cultivar-group)
  misc_feature (184)..(184): Xaa can be any naturally occurring amino acid
  unsure (1)..(700): unsure at all Xaa locations
MQATSRHTLYRAHSLAWFRWWPIVYNVIQKASVPGPLPDPAHTGPINGATVIERARGVTCPVASRAKSDISVANAEESAPATGAAPTPVANHQNSRPTRSAYVPPHLRGQAPTTTAAPAPAPGPAAVQPSASVQPSGYAAIVGGSRWAGPASGDGTGAVCGPRQSVGGRGGGGGGGGGWNSRPXWDRRDREPNPFANSEAEEATEVDFDTANTGINFDAYEDIPVETSGHDVPPPVNTFAEIDLGDALNENIRRCKYVKPTPVQRYAIPISIAGRDLMACAQTGSGKTAAFCFPIISGIMSSRPPQRPRGSRTAYPLALILSPTRELSVQIHEEARKFAYQTGVRVVVAYGGAPIHQQLRELERGVEILVATPGRLMDLLERARVSLQMVKYLALDEADRMLDMGFEPQIRKIVEQMDMPPRGVRQTMLFSATFPKEIQRMASDFLADYIFLAVGRVGSSTDLIAQRVEFVLEADKRSYLMDLLHAQKANGTHGKQALTLVFVETKRGADALENWLYTNGFPATSIHGDRTQQEREYALRSFKSGATPILVATDVAARGLDIPHVAHVINFDLPNDIDDYVHRIGRTGRAGKSGLATAFFNEGNLSLARPLCELMQEANQEVPQWLERYSARSSFGGGGGRNRRSGGARFGGRDFRRDNRGGGGGGYGGGGGGYGGGGYGGGGGYGGGYGGGQGSTSSWD

SEQ ID NO: 53714 - protein, 862 aa, Prunus dulcis
MLHNLFDKITGQEQNGKNGRKIKGTVVLMKKNVLDFNDFNASVLDRVHELLGQGVSLQLISADHGDSENGFKGKLGEPAYLEDWITTITPLTVGDSAYNVTFDWEEEIGVPGAILIKNNHHSEFFLKTVTLEDVPREGRVHFVCNSWVYPAEKYTKDRVFFVNKTFLPSETPLPLRKYREEELVHLRGDGKGELQEWDRVYDYAYYNDLGNPDKGSKYARPTLGGSSGYPYPPRGRTGRPATKTDPNSESRIPLIMSLNVYVPRDERFGHLKLSDFLAYALKSIVQFIRPELEALFDKTPNEFDSFEDVLKLYIGGIPLPEGLLKDIGDNIPAEMLKEIFRTDGAQLLRFPMPQVIEEDKSAWRTDEEFAREMLAGVNPVNISLLQEFPPASKLNPKVYGDQTSRITEQDIGNKLDGLTVHEALKQNKLFILDHHDALMPYLRRINSTSNKIYASRTVLFLKSDGTLKPLVIELSLPHPDGDQFGRISKVYTPAEEGVEGSIWQLAKAYVAVNDSGYHQLISHWLNTHAVCEPVVIATNRQLSVVHPIYKLLHPHFRDTMNINAFARQIVINAGGILETTVFPSRYAMELSSVVYKDWVFTEQALPADLIKRGVAVKDANSPHGLRLLIEDYPYAVDGIEIWFAIKTWVEDYCSFYYKTDDIIQEDTELQSWWKELVEEGHGDKKDEPWWPKMQTREDLVETCTIIIWTASALHAAVNFGQFPYAGYLPNRPTLSRKFMPEKGTPEYKELESSPDTVFLKTITAQLQTVLGIALIEILSRHSTDEVYLGQRDTPEWTADTEPLKAFDKFGRKLAKIEDRITSMNNDEKLKNRVGPVKMPYTLLFPTSGGGLTGRGIPNSVSI

SEQ ID NO: 53715 - protein, 355 aa, Arabidopsis thaliana
MEKLKQQFSKDRLITPSSNLVRNYIDSIPVDLLIDILSRFPPKSIARFYCVSKLWESILRGPDFTELYLTKSVALRRLFFALKVNTELLVFSSPQPQIPDENSSLVVEATPYKCFPKKIPTEICTALGGLFITLPKLKTIGTKRFSFGYDPISKKFKVLCVTWSPCGTLPNIHQVLTLETGERLWRTIHDPVIPRYSINYDAICINGVLYSEAYYQGSSKIVCFDFKIEKVSFVNIDGMCNLRLFNCKGKLGVHQYDVQSRNEKLVFHVLEDAEKHKWSKSICILPSVVSGKRIVEITCTGEIVFSPSGGSLHPFYIFFYNIERKTYTRVQIKGFKKYADCVHTFLDFVEDTKLI

SEQ ID NO: 53716 - protein, 395 aa, Oryza sativa (indica cultivar-group)
  misc_feature (395)..(395): Xaa can be any naturally occurring amino acid
  unsure (1)..(395): unsure at all Xaa locations
MEAVAVAGGGAGLTRWQAAALSAVTGWVWAASSFDLTRRSRALVQPWVTRRVLAETPSIVRFQKVHHKLLDSFFSVLSCVVSVPFYTGFLPLLFWSGHSKLARQMTLLMAFCDYLGNSVKLLTLWKSVDTGRGVSPSAKLSSGRIYLGMHSLIDVIAGICFGVVILAFWLAVHNHVDAFVVSGQNVTTFWASLSLLLCFAYPKPEFPTPSFEYHTAFNGVAFGIVYGIQQTYFHFHNPDVPLIFSPQLPLIVFVGRVLVGIPTILVVKFCSKALSKWLLPVMCNTLGIPIVSTCYVPALKASEKCKVKSDAKQGGYLQKVFSLFPQKAYDVDTGIRIDKASCWAAGEARTTCTLRLRFSRTRISRGAGVGERTNRADGDERNNLPQESKAQRLFX

SEQ ID NO: 53717 - protein, 432 aa, Listeria monocytogenes EGD-e
MDHSMSKKLHDEALLHIVGGVNSPSRSNKGVGGGIPVTMERASGAYFYDVDGNKYIDYLAAFGPIITGHAHPHITEAITKAAQNGVLYGTPTKHEITFAKMLKEAIPSLEKVRFTNSGTEAVMTTIRVARAYTGRDKIIKFAGCYHGHFDLVLVEAGSGPSTLGIPDSAGVTKSTAEEVITVPFNDLDSFKEALAIWGDQVAAVLVEPIVGNFGMVAPEDGFLEAVNELAHVNGSLVIYDEVITAFRFMYGGAQNYLGVIPDLTAMGKIIGGGLPIGAYGGRIDIMEKVAPLGPAYQAGTHAGNPASILSGIACLEVLQEEGLYERFEKYGSMLKDGIEKAAAKHNIAVTVNQIVGALTVYFTEDPVTNYAEAGATNGELFGRFFKGMLEEGINLAPSKYEAWFITSAHSEADILETIQAVDTVFGKMVQDN

SEQ ID NO: 53718 - protein, 117 aa, Pseudomonas putida KT2440
MGRLTTHVLDAAHGCPGSSIKVELYRVEGQQLELVNTALTNSDGRVDAPLLQGDDYRTGVYQLQFSAGDYYRARGVQLPAQAFLDVVVLRFGIDESQEHYHVPLLISPYSYSTYRGS

SEQ ID NO: 53719 - protein, 260 aa, Oryza sativa (indica cultivar-group)
MATASSINKRFSLAGATALVTGGSKGIGRAIVEELASFGATVHTCARNQAELSRCQEEWTAKGLAVTVSVCDVAVRADREALAGRVSAMFDGKLSILVNNAGTAYLKPAADLTPEETSRLMTTNFESCFHLSQLFYPLLKDSGRGSIVNISSVASVLAFHSLPIYSAAKGAMNQVTRNLACEWASDGIRVNSVAPGYIQTPLLTTFVAGNDFAQVEFNRLPLGRLGKPEDISSLVAFLCMPAASYITGQIICVDGGRMLS

SEQ ID NO: 53720 - protein, 380 aa, Oryza sativa
  misc_feature (93)..(93): Xaa can be any naturally occurring amino acid
  unsure (1)..(380): unsure at all Xaa locations
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFXNELRVAPEEHPALLTEAPLNPKANREKMTQIMFESFNVPAMYVAIQAVLSLYASGRTTGIVLDSGDGVSHTVPIYEGYALPHAILRLDLAGRDLTDALMKILTERGYSFTTTAEREIVRDIKEKLAYVALDYEQELNAAAAAKNSSSVEKSYELPDGQVITIGAERFRCPEVLFQPSLVGMEAAGIYETTYNSIMKCDVDIRKDLYGNVVLSGGSTMFPGIADRMSKEITALAPSSMKIKVVTPPERKYSVWIGGSILASLSTFQQMWISKAEYDESGPAIVHRKCF

SEQ ID NO: 53721 - protein, 324 aa, Streptomyces lividans
DPATLMAGLLHDTVEDTEYGLEDLRRDFGDVVTLLVDGVTKLDKVKFGEAAQAETVRKMVVAMAKDPRVLVIKLADRLHNMRTMRYLKREKQEKKARETLEIYAPLAHRLGMNTIKWELEDLAFAILYPKMYDEIVRLVAERAPKRDEYLAVVTDEVQQDLRAARIKATVTGRPKHYYSVYQKMIVRGRDFAEIYDLVGIRVLVDTVRDCYAALGTVHARWNPVPGRFKDYIAMPKFNMYQSLHTTVIGPGGKPVELQIRTFDMHRRAEYGIAAHWKYKQEAVAGASKVRTDAPKSSGKSKDDHLNDMAWLRQLLDWQKETEDP

SEQ ID NO: 53722 - protein, 463 aa, Chromobacterium violaceum ATCC 12472
MPGEQQTLHRGLEERHINLMALGATIGVGLFLGSATAIKMAGPAIMLAYGLGGLAIFMIMRALGEMAIHNPVAGSFSRYAQDYLGPLAGYLTGWNYWFLWLVTCMAEITAVGVYMGIWFPDVPSWYWALAAMLAMGGVNFIAVKAYGEFEFWFALIKIVTIVLMIAGGFAMIAFGFGNHGVATGISNLWAHGGFMPNGFSGVLMSLQMVMFAYLGVEMLGLTAGEAKNPKKALARAVDSVFWRILIFYVGALFVILSIYPWNELGTRGSPFVLTFESMGIPAAAGIINFVVLTAALSSCNSGIFSTGRMLFNLAEQKQALPIFAHVSKRGVPVPALLMSVAALLLGVLLNYLAPKEVFTWLTAISTFGAVWTWLIILLAQLRFRRSLSADELASISHRMPLWPYGSYLTLGFLALVIGLMAYFPDTRVALIVGPGWLVFLVAAYYLLGYHKQDAAWRLAQQSR

SEQ ID NO: 53723 - protein, 461 aa, Triticum aestivum
MGARRRLALLALAVALAAAAATTGHAGVTSPYRRKLEATADMPFDADVFRVPPGYNAPQQVHITLGDQTGTAMTVSWVTASELGNGTVRYGPSPDKMEMSAQGTHTRYDYFNYTSGFIHHCVLRNLKHGVKYYYAMGFGHTVRTFSFTAPPKPGPDVPFKFGLIGDLGQTFDSNSTLSHYEANGGDAVLFVGDLSYADAYPLHDNRRWDSWARFVERSVAYQPWIWTAGNHELDYAPEIGETVPFKPFTHRYRTPYRAVASTEPLWYSVKIASAHIIVLSSYSSYGKYTPQWTWLSDELARVDRKATPWLILLMHSPWYNSNNYHYMEGETMRVQFESWLVAAKVDLVLAGHVHSYERSRRFSNVAYNIVNGKATPVRDMDAPVYVTIGDGGNIEGIANNFTEPQRSYSAFREASFGHATLEIKNRTHAYYAWHRNHDGAKATADSVWLTNRHHLPTDDSK

SEQ ID NO: 53724 - protein, 559 aa, Rhodococcus sp. RHA1
MSTATEVLVHGLGVSPGLVCAPWLAFGTPVATSAEDPVGESITAEAARVRDALATVSGDLEARAAQVDGVASEILLVSAAMARDRGIVAAAEENLRAGMPTAHAVSVAFDGYCAKLEALGGYLAERVADLRDLGHRAVAVLLGVPMPGIPDPGYPFVLVARDLSPADTAMLGGSDVVGLLTAEGGPTSHTAILAKSLGLPAIVNCADLDLLVEGRPVVLDGTTGEIVVDPGDLRQAEVAEQLAEARARVAATSGPGRTRDGAHVGLLVNIGTVDDATRAATADSEGVGLFRTEFLYLGRQIAPTLDEQIATYTSVLEQFAGRKVVVRTLDSGSDKPLPFLDLGAEENPALGVRGLRVGAVYPDVPATQLEALGAAAAVTGADLWVMAPMVATAEEAEGFAALARSLGIATVGAMIEIPSAALRARDLLEHLDFVSIGTNDLSQYTCAVDRMAGSLAPLLDPWQPAVLDLIGLVGAAGAEAGTPVGVCGEAASDPALAPVLVGLGVTSLSMVAPSLGAVRASLADTDLGLCREMAAAARRARSPQAARSAVAALASGARR

SEQ ID NO: 53725 - protein, 329 aa, Triticum aestivum
  misc_feature (295)..(295): Xaa can be any naturally occurring amino acid
  unsure (1)..(329): unsure at all Xaa locations
MGSDFKAIPLIDISPLVEKIDDPAMAGDEGLLDVVRMLDDACREAGFFYVKGHGISESLMTEVRDVTRKFFQLPREEKLKIKMTPQSGYRGYQRVGENVTKGKPDMHEAIDCYTPIEPGRYGDLAKPMEGSNLWPDYPSNFDALLENYISLLRDLSRKIMRGIALALGAPLDSFEGGVAGDAFWVLRLIGYPVSDDIPQEERTDIGCGAHTDYGLLTLVNQDDDICALEVRNQSGEWIYAKPVPGTFVCNIGDMLKVWSNGIYQPTLHRVVNNSPRYRVSVAFFYESNFDAAVEXPVEFCREKTGGVAKYEKVVYGEHLVQKVLTNFVM

SEQ ID NO: 53726 - protein, 319 aa, Geobacter sulfurreducens PCA
MTDTGLPPLPVPFLALMEEVLPPDLRDACLASFSQEKPTSLRLNPLKGDPDETRRELESAGFDPVPVSWYPLAFTVDGERRRALTESPPFREGRIYIQSLSSMTAPLALAPEPGETVLDLAAAPGGKTAMMAAMMENRGRLSAVEAVRGRFFRMKANLDHQGATMVRTYLTDGRSVGRKCPEMFDRVLLDAPCSSEARFTRLNPESWAHWSPRKVEEAARKQRGLIRSALEALRPGGLLLYCTCSFSPEENELIVNDVLRRDGDNLRVCAVDLPLPNRRPGLTRWKGKELHPDLARAVRILPDRLMDGFFLCLIRKSSD

SEQ ID NO: 53727 - protein, 339 aa, Pycnoporus coccineus
MPGQVPVGINGFGRIGRIVLRNALLHGDINVVAVNDPFIDLEYMVYMFKYDSVHGRFKGSVEAKDGKLWVEGKPISVFQEKDPANIPWGSVGAQYIVESTGVFTTTEKASAHLKGGAKKVVISAPSADAPMFVCGVNLDAYDPKYTVISNASCTTNCLAPLAKIINDKFGIVEGLMTTVHATTATQRTVDGPSHKDWRGGRAVGNNIIPSSTGAAKAVGKVIPSLNGKLTGLAFRVPTIDVSVVDLVVRLEKPAKYEDIKNAVKEAANGNMQGIMAYTEDKVVSTDFTGSDASSIFDAEAGIALNDHFVKLISWYDNEWGYSKRVCDLLAYAAKRDGAI

SEQ ID NO: 53728 - protein, 215 aa, Oryza sativa
  misc_feature (98)..(98): Xaa can be any naturally occurring amino acid
  unsure (1)..(215): unsure at all Xaa locations
MTIYIAREASKVWRKVTTETSVELSLLREKWGLLLAGIVFQYIHGLAARGVHYLHRPGPLLQDLGFMALPEFGQDKGYLSESIFASIFASFVLWTFHXHMIFTLVFVRTYHKYGSKRFVKLLAWFMAIVQSLLIIASRKHYSVDVVVAWYTVNLVVFFVDNKLPEMPDRTNGVPLLPLSTREKDGRLKEEKDSRLKEEFHKLLNGNHGDPTDRVL

SEQ ID NO: 53729 - protein, 106 aa, Myxococcus xanthus DK 1622
MTPELKARLEQETRSHKIVLFMKGNALFPQCGFSARALQLLQPLGQVHTVDVLADPEIRQGIKDFTNWPTIPQIFINGQFVGGSDILMELAERGELADLVAGKSPA

SEQ ID NO: 53730 - protein, 277 aa, Bacillus cereus E33L
MKQLYGVIGNPIGHSLSPVMHNDAFEHLNMDAHYHAFLVKEEVLGEAVRGLKALGISGFNVTTPHKVAIMDYLDEIDPLAKQIGAVNTVVHKDGKLIGYNTDGIGFVRALQSISNEPLQEKRILLLGAGGASRAIYFSLADVGVKEIDVANRTVDKAKELIAACTATVHSVALSLEKATKEQGNYDIIIQTTTIGMHPRVEHTPLQISSLKKGTIVSDIIYNPFETKILCEAKEQGAIIQNGIDMFVYQGALAFEMWTGCVPNIERMKQLVIRKLGG

SEQ ID NO: 53731 - protein, 451 aa, Pseudomonas putida KT2440
MSESRKAYIPIAPPREPLPLFQLILVGLQHVLLMYGGAIAVPLIIGQAAGLSREEVAFLINADLLVAGVATIIQSFGIGPVGIRMPVMMGASFAAVGSMVAMAGMPGVGLQGIFGATIAAGFFGMLIAPFMSKVVRFFPPLVTGTVITSIGLSLFPVAVNWAGGGHEAETFGSPIYLLVAGLVLAVILLINRFMRGFWVNVSVLVGMGLGYILAGSIGMVDLSGLNEAPWLQVVTPLHFGMPTFSLAPILSMCLVVVIIFVESTGMFLALGKVTDREVTPGMLRRGLLCDAGASFIAGFFNTFTHSSFAQNIGLVQMTGVRCRYVTIVAGALLILLSLLPKAAFLIASIPPAVLGGASIAMFGMVTATGIKILQEADIGDRRNQLLVAVSVGFGLIPVVRPEFFAQMPQWMEPITHSGIAMATVCALVLNVLFNILGGADRAMHNDVCHQH

SEQ ID NO: 53732 - protein, 174 aa, Brassica napus
MTTKSLTVEEVLKEKKTHDLDSVKELNLGHRALTDVSCLSKFKNLEKLDLRFNNLTDLQGLKSCLNLKWLSVVDNKLQSLSGIEGLTKLTVLNAGKNKLKSMNEISSLVNLCALILNDNEISSICKLDQLKDLNSLVLSRNPISEIGDSLSKLKNLTKVSLSDCRIKAIGSSLK

SEQ ID NO: 53733 - protein, 279 aa, Thermosynechococcus elongatus BP-1
MTSSLELQPQTSRLNWGFVLFLGAVHILAAVALFFFSWSALAVTIFLHWLFGSIGICLGYHRLLSHRSFQVPQWLEYVIAVVGALAMQGGPIFWVAGHRLHHAHTEDEIKDPYSARRGFWWSHMLWLVYPQSQFFNAEEYARFAPDLTRDPFYRWLDRYFLLLQLPLALLLYGLGGWSWLLWGMFMRAVFLWHSTWLINSATHKWGYRRFETEDNSRNLWWAALLTYGEGWHNNHHAYPHVAKAGWYWWEVDPTWWVIRTLQGLGLAAKVQLPPPKALS

SEQ ID NO: 53734 - protein, 332 aa, Xanthomonas campestris pv. campestris str. ATCC 33913
MTIAQDLPTVLGLPQIQSLAAPDMAAVDALIRRRLASDVVLINQIADHIISAGGKRLRPMLVMLAGHAAGGSGPEHHQLAAIIEFIHTSTLLHDDVVDESDLRRGRSTANALWGNAPSVLVGDFLYSRSFQLMVELDRMEVMQILADTTNRIAEGEVLQLLHVHNPDTDEAAYLRVIERKTAVLFAAGTRLGALASGADAQVQQCLYDYGMQLGFAFQIADDVLDYAADATDLGKNLGDDLAEGKATLPLIHAIAHSDAATQQRLRQIVEQGDAEAMPEVLTAIRATGGLDYSRQRAAEYAAAAEQALDGLPPSPAVAALRGLARYAVERTH

SEQ ID NO: 53735 - protein, 608 aa, Glycine max
  misc_feature (51)..(51): Xaa can be any naturally occurring amino acid
  misc_feature (59)..(59): Xaa can be any naturally occurring amino acid
  unsure (1)..(608): unsure at all Xaa locations
MYTFLLLLPIMSSSFSVRFLAPLPPSSSSCFPTSSLPKTWLCAAATPTVAXVNHHLLLXEVEASRLEPRVEERDGFWVLKEEYRGGISPQEKVKLEKDPMKLFMEGGIEELAKMSLEEIESSKHTKDDIDVRLKWLGLFHRRKQHHGRFMMRLKLKLPNGVTTSAQTRYLASVIRKYGKDGCADVTTRQNWQIRGVVLPDVPEILKGLDEVGLTSLQSGMDNVRNPVGNPLAGIDPDEIVDTRPYNNLLSQFITANSRGNPAMSNLPRKWNVCVVGSHDLFEHPHINDLAYMPANKDGRFGFNLLVGGFFSAKRCAEAIPLDAWVSADDVIPLCKAVLEAYRDLGFRGNRQKTRMMWLIDELGIEVFRSEVEKRMPGKKLERASKEELVKKQWERRDYLGVHPQKQEGLSYVGIHIPVGRVQADDMDELARLADEYATGELRLTVEQNIIIPNVDNNKIDGLLNEPLLKGRFSPEPSLLMKTLVACTGNQFCGQAIIETKERALKVTEEVERQVAVTRPVRMHWTGCPNTCGQVQVADIGFMGCMARDDNGKATEGVDIFLGGRIGSDSHLAQVYKKGVPCKDLVPVVVDILVKHFGAVLRNREEGED

SEQ ID NO: 53736 - protein, 627 aa, Acidovorax sp. JS42
MAIIDIKVPDIGDFAEVGVIEVLVQPGDTIRAEQSLVTVESDKASMEIPSSHAGVVKELKVKLGDKVAEGSVLLTLEVAQGAAAPAAAPAAASTPSAPPSESKPAPAPAVQAPAAPKTEASSFGGSADVECDVLVLGGGPGGYSAAFRAADLGLNVVLVERYATLGGVCLNVGCIPSKALLHVAAVMDEVSHLKSAGIDFGAPQVNIHTLRGHKEKVIGKLTGGLAQMAKMRKVTVLRGYGHFVGANHLEVEETTGTSQDKTGAKKVVAFKRAIIAAGSQAVRLPFMPDDPRVVDSTGALALKDVPKRMLILGGGIIGLEMGTVYSTLGARLDVVEMLDGLMQGADRDLVKVWQKMNQHRFDNVMLNTKTVAAEATPEGIKVSFAPAKDGVTVPEPQVYDLVLQAVGRTPNGKKIAADKAGVAVTDRGFINVDIQMRTNVPHIFAIGDIVGQPMLAHKAVHEAHVAAEVIAGELQGNKELASAAFNARVIPSVAYTDPEVAWVGLTEDQAKAQGIKVKKGLFPWAASGRAIANGRDEGFTKLLFDDSPEAGSGDGHAGRGHGKILGGGMVGTHAGDMIGEIALAIEMGADAVDIGKTIHPHPTLGESIGMAAEVAHGSCTDVPPARK

SEQ ID NO: 53737 - protein, 281 aa, Petunia x hybrida
MSSTVGQVIRCKAAVAWQPGKPLVIEEVEVAPPQKMEVRLKILYTSLCHTDVYFWEAKGQNPVFPRILGHEAAGIVESVGEGVTELVPGDHVLPVFTGECKDCAHCKSEESNMCSLLRINTDRGVMIHDGQSRFSINGKPIFHFVGTSTFSEYTVVHVGCLAKINPLAPLDKVCVLSCGISTGLGATLVAKPTKGSSVAIFGLGAVGLAAAEGARIAGASRIIDVDLNASRFEEAKKFGVTEFVNPKDYSKPVQRVIAEMTDGGVDRSVECTGHIDAMISA

SEQ ID NO: 53738 - protein, 567 aa, Acidovorax sp. JS42
MALVNIQVPDIGDFDEVGVIELLVKVGDTVKAEQSLITVESDKASMEIPSSHAGVVKELKVQLGDKVKQGSVIAVLEAAGEAAASDEKPAPAPAAQAPAAIETQAPVAPAAPAAPAAGGGAVEVRVPDIGDFKDVAVIELLVQPGDAVKVEQSLFTVESDKASMEIPSPAAGVLKELKVKIGDKINVGDLVAVLEGAAAAPAAAPAQGSTPAAASAPAAAAPVAAQGSAPAPAAATATATATATAPVPAHQPSTPTPGLPHASPSVRKFARELGVPLAEVKGTGIKGRITQEDVAAFTRQVMSGALQTQAQGSKAPAAGGSGVGLDLLPWPKVDFAKFGPVERKELSRIKKISGANLSRNWVMIPHVTNNDEADITELEAFRVSTNKENEKSGVKVTMLAFVIKAVVAALKKFPEFNASLDGDALVYKQYFHIGFAADTPNGLVVPVLKDADKKGILQISAEMAELAKKARDGKLGAADMQGGSMSISSLGGIGGTHFTPIINAPEVAILGLSKSQMKPVWDGQQFVPRLTLPLSLSYDHRVIDGASAARFNAYLGQVLADYRRILL

SEQ ID NO: 53739 - protein, 898 aa, Acidovorax sp. JS42
MSDPTKVLTATDIDQQETREWLDALSAVIDKEGPERAHFLLEQLLEQARQSSIDLPFSANTGYVNTIEPDQEARCPGNIAIEKRLRAYMRWNAMAMVVRANRLHPHDGGDLGGHIGSFASLASMWGAGFNHFWHAESEGHGGDCIYFQGHSAPGIYARAYLEGRITEDQLENFRQETGGKGLSSYPHPKLMPGFWQFPTVSMGLGPMMAIYQARFLKYLDARGIADTKNRKVWVFLGDGEMDEPESKGAISLAARENLDNLIFVINCNLQRLDGPVRGNGKIIQELEGGFRGAGWHVIKLLWGKGWDELLARDKSGKLKQLMMETLDGDYQTYRAMDGAYIRKHFFGRYPETAKLVEHMSDDEIWELRRGGHDPEKVYAAFHAANEHQGQPTVLLVKTVKGYGMGKAGEGKNTVHQTKKLSDEDIKYIRDRFNIPIPDSELDKLPYYKPADDTPEMKYLHERRKALGGYLPQRRTHADESFTVPALETFKAVLEPTAEGREISTTQAYVRFLTQLLRDKALGPRVVPILVDEARTFGMEGLFRQIGIYNPEGQLYTPVDRDQVMYYKEDKAGQILQEGINEAGGMCSWIAAATSYSTNNRIMIPFYVYYSMFGFQRFGDFAWAAGDMQARGFILGGTSGRTTLNGEGLQHQDGHSHILANTIPNCVSYDPTFAHEVAVIMQDGLKRMVEKQENVYYYITLLNENYAMPGLQPGTEEQIIQGMYLCKAGADGDKRVQLLGSGSILRESIEAQKLLAADWGVQADVWSCTSFNELTREGQDVARWNLLHPLETPRVSFVAQQLGGRPGPVVASTDYMKNYAEQIRAFIPAGRSYTVLGTDGFGRSDFRYRLREHFEVNRHYITVAALSALADEGKLPKAKVAEAIAKYGIQTEKINPLHA

SEQ ID NO: 53740 - protein, 252 aa, Zea mays
MAATAPNGNPTVSSLAATVPVQAVLFDIDGTLCDSDPLHHVAFQEMLLEIGYNNGVPIDEEFFIKNIAGRSDVEAAQNLFPDWELEKGLKFLEDKEAKYRSLAKERLVPVKGLAKVVQWVKDHGYKRAAVTNAPRINAELMISLLGLSDFFQAVIVGGECEQPKPAPYPYLRALKELQVSAEHSFVFEDSPAGIRAGVAAGMPVVGVATRNPEKSLVEAGAALLVKDYEDPKLWAALEEMDGEEAKLKKASE

SEQ ID NO: 53741 - protein, 360 aa, Arabidopsis thaliana
MASSMLSSATMVASPAQATMVAPFNGLKSSAAFPATRKANNDITSITSNGGRVNCMQVWPPIGKKKFETLSYLPDLTDSGGRVNCMQAMGEPNLNPAYTLDQAIANLQQTEDASARYYAAWWIGRFRAAQPETIAALLVALEDETDRSPDGGYPLRRNAAKALGKLGDRQVVPALIKALECEDYYVRESAAQALEGLGDARAMAPLMAKLTGGLAAAQLVEGKPHLAQPYEAIIEALGTLQAVESIGLIEPFLEHFSPKVQYAAARALFQLTGDNRYGDLLITALGGTDLQLRRSAMMDLGATGYLPGAQAIAKAFAENSLKLIALRDLWATHRQRQASSESKALSPASRQILELMDSLL

SEQ ID NO: 53742 - protein, 567 aa, Oryza sativa (japonica cultivar-group)
MDAVAFPPPPAPFLDDDLDFGDFAFADPQPAAAAAFDAFGAYDDDWGDFVDSRLGSNPDGGSSAAAPAEKPPSWEKPRGPLPLSLFGADEDEEEEEGPAELPPTAADQRGASHASSNGSKPADLKDLIAGLYGSHPQPSSTDAAEVGTQEGSAVAAAEEEEEDGDGFEDDGWEFKAAAPSSSSDAVQDGGRQAHGDLTQDVPKSMSSDQEGWSLFTSVSENLNNVQTTDHVGTHENHSIKSASDRILIDFYHKLREESLTVISQYKKDLKESQKNSMLSDEKNEVMTETEREIQEICKELQDSSLAKGFCKDEHPSKDVCISELLNSAKEDHLKDFDKEYHLTEIIAMALEDMSSAVKLYKHSVSILRTLEIASKEEQCDYVSAWYSMLLSCAQELQHGAMIWQESCHANVGETVISQGAHYFIALGEIYRVAQILHISMLSFKPWVLADPGMLSKMLVCWNSCVNSWTSGLGMALTMVVDSKNLHAPVAKVLLESIININDIEVPNLQSFLPSDKMACKLTLLPTSLVPGMEVIIWDADHYFVKVANLWANQISSDPPQFSVSRVA

SEQ ID NO: 53743 - protein, 120 aa, Brassica napus
  misc_feature (117)..(117): Xaa can be any naturally occurring amino acid
  unsure (1)..(120): unsure at all Xaa locations
MASSSSSSQRRCVFVGNIPYDATEEQLREICGEVGPVVSFRLVTDRETGKPKGYGFCEYKDEETALSARRNLKSYEINGRQLRVDFAENDKGTDKPRDQGQGGTSLPPAVAATTESXKQV

SEQ ID NO: 53744 - protein, 794 aa, Yersinia pestis CO92
MSNNGHTRCNVLWYNQLGMHDVDRVGGKNASLGEMITHLSELGVSVPNGFATTAQAFNDFLEQSGVNQRIYQLLDNTNIDDIAELSKAGAQIRQWVIETPFHPEFEQSIYDAYKQLADGEPEASFAVRSSATAEDMPDASFAGQQETFLNVQGIDAIMVAIKHVFASLFNDRAISYRVHQGYDHRGVALSAGVQRMVRSDLASSGVMFTIDTESGFDQVVFITAAHGLGEMVVQGAVNPDEFYVHKPTLRNGKPAIVRRNMGSKKIRMIYAENQEHGKQVCIEDVPEIQRNRFALSDDEVEALAHQALLIEEHYGRPMDIEWAKDGHTGQLFIVQARPETVRSNEQVMERYQLNNQSNVLVEGRAIGHRIGAGPVKVIHDISEMDRIQAGDVLVTDMTDPDWEPIMKKASAIVTNRGGRTCHAAIIARELGIPAVVGCGNATELLKEGQNVTVSCAEGDTGYVYHELLDFSVQSSQVTELPDLPLKIMMNVGNPDRAFDFARLPNEGVGLARLEFIINRMIGVHPKALLEFDQQEPALQAEIKALMHGYDDPVEFYIGRLTEGIATLGAAFWPKPVIVRLSDFKSNEYANLVGGAGYEPHEENPMLGFRGAGRYVSDHFRDCFALECEAMKRVRNVMGLTNVEVMVPFVRTVAQAEAVVAELARQGLKRGENGLKIIMMCEIPSNALLAEQFLEHFDGFSIGSNDMTQLTLGLDRDSGVVSALFDERNEAVKALLSMAIQAAKRHGKYVGICGQGPSDHEDFALWLMEQGIDSLSLNPDTVVKTWLSLAQHTKH

SEQ ID NO: 53745 - protein, 232 aa, Bifidobacterium longum NCC2705
MDKAQQDALKKAAGIEAAKLVENGMIAGLGTGSTVKFLVDELGRRHQEEGLEFTGVTTSRRTQAQAESYGIKIVDIDDVDHIDVTIDGADEVDKNFNGIKGGGAALLWEKIVATNSNQIVWIVDESKVVDTIGKFPLPVEVIPFGAGQVIKKFEARGYKPVLRLDADGKEVRTDENNFVVDLHLERIDHPQELAEDLINTVGVVEHGLFLNMVDKVIVGDPNGPRVMTNANK

SEQ ID NO: 53746 - protein, 259 aa, Bordetella bronchiseptica RB50
MISLPYLQRFALSGQVALVTGSARGLGLRIAQALAGSGAHVLLNGRDAHAVEAAVSDLRQQGLRASALPFDVSDEQATEQAFARIDAEHGRLDILVNNVGARNRKPLAETSPAEIRAMMDTNLVAGILLARLAAQRMVRQRYGRLIAITSVAGELARANDAVYPAAKQGLTGMMRALAVEFGRHGITSNAIAPGAFATETNAAMANDPQAGAAMAARNPTGRWGDPEEIAGAAVFLASPAASYVNGHVLVVDGGLSVQF

SEQ ID NO: 53747 - protein, 212 aa, Zea mays
MASSPASSYDCSFKVLLIGDSAVGKSSLLVSFVSAAHIDDDIAPTIGVDFKIKFLSVGGKKLKLTIWDTAGQERFRTITSSYYRGAHGIILVYDVTKRESFTNLADVWTKEIELHSTNKECIKMLVGNKVDKDEDRMVTKEEGLAFAQERGCLFVESSAKTRENVEKCFEELALKILQVPSLLEEGSSVVKRNTLTLKQKQENANRSGGCCQ

SEQ ID NO: 53748 - protein, 483 aa, Oryza sativa (japonica cultivar-group)
MAAPWAIPRRGLFIGGGDIPAATAEDVELAVSAARDAFGRDGGRHWSRAPGAVRAKYLKAIAAKIKDKKSYLALLETLDSGKPLDEAAGDMEDVAACFEYYADLAEALDGKQRAPISLPMENFESYVLKEPIGVVGLITPWNYPLLMATWKVAPALAAGCTAVLKPSELASLTCLELGGICAEIGLPPGVLNIITGLGTEAGAPLASHPHVDKIAFTGSTETGKRIMITASQMVKPVSLELGGKSPLIVFDDVDIDKAVEWAMFGCFANAGQVCSATSRLLLHEKIAKRFLDRLVAWAKSIKISDPLEEGCRLGSVVSEGQYQKIMKFISTARCEGATILYGGARPQHLKRGFFIEPTIITNVSTSMQIWREEVFGPVICVKEFRTEREAVELANDTHYGLAGAVISNDLERCERISKAIQSGIVWINCSQPCFVQAPWGGNKRSGFGRELGQWGLDNYLSVKQVTKYCSDEPYGWYRPPSKL

SEQ ID NO: 53749 - protein, 114 aa, Coccidioides immitis RS
MSDVKIQDLLNKPRSELTEYEVSLLEEHELTTGPLSILQTATRSHSQVLISCRNNRKLLARVKAFDRHCNMVLENVKEMWTEKPKGGKGKGVNKDRFVSKMFLRGDSVILVLLS

SEQ ID NO: 53750 - protein, 869 aa, Xanthomonas campestris pv. campestris str. ATCC 33913
MSASLSTDRWIVLKFGGTSVSRRHRWDTIGKLASKRANETGGRVLVVVSALSGVTNELTAIADGAADSAQRVAALELRHREFLAELELDADAVLGARLAALHALVGDARAASRTLDWQAEVLGQGELLSSTIGAAYLHANGLDMGWLDAREWLSALPPQPNQSEWSKRLSVSCQWQSDAAWRARFDAQPTRLLITQGFISRHADGGTAILGRGGSDTSAAYFGALLGASRVEIWTDVPGMFSANPKEVPDARLLTRLDYYEAQEIATTGAKVLHPRSIKPCRDSGVPMAILDTERPDLPGTSIDGSAEPVLGVKAISRRNGIVLVSMEGIGMWQQVGFLADVFTLFKKHGLSVDLIGSAETNVTVSLDPSENLVNTDVLAALSADLSQICKVKIIVPCAAITLVGRGMRSLLHKLSDVWATFGQERVHMISQSSNDLNLTFVIDESDADGLLPILHAELIDSGAMPVSEGEVFGPRWRDIIGSVRPRPTPWWHAERAHLLTLSKAGTPRYVYHLPTVRARAQALAQIAAVDQRYYAIKANSHPAILMALEQAGFGLECVSHGELRRVFDTLPELSPRRVLFTPSFAPRSEYEAAFALGVTVTVDNVEALKRWPELFRGRNVWLRIDLGHGDGHHEKVNTGGKASKFGLSSTRVDEFVELARTLEVTITGVHAHLGSGVETGEHWRMMYDELAGFARRIGTVETIDIGGGLPIPYSAEDEPFDLELWAKGLAEVKAVHPGFRLAIEPGRYLVAEAGVLLAQATQVIEKDGVHRVGLDAGMNSLIRPALYDAWHDIENLSQLGAPADGSFDVVGPICESSDVFGKRRRLPAATAPGNVMLIADAGAYGYSMASTYNQRELPREEVIDAAAG

SEQ ID NO: 53751 - protein, 229 aa, Acidovorax sp. JS42
MTAPTSLSQDELKTLVGQAALQYVVPGELVGVGTGSTVNKFIDALASIKDSIRGAVSSSEASTARLKALGIPVLDANDVRSLSVYIDGADEIDGNGYMVKGGGAALTREKIVAALARRFVCIADESKLVNVLGAFPLPVEVIPMAAAYIARRFESLGGQATLRLKDGQPLVTDNGQHILDVRGLTISDPLAFETEVNQWPGVVTVGVFALQKANVCLLGTAQGVRTLSL

SEQ ID NO: 53752 - protein, 271 aa, Rhodococcus sp. RHA1
MNQLDKDTLLCISLSGRPSNIGTRFHNYLYGELGLNFVYKAFTTNDLQAAVGGIRALGIRGAGVSMPFKEQIIEYVDVMHESASVIESVNTVVNENGVLHAYNTDYQAIANLLRDNALPHSLSVAVAGSGGMAKAVVAAVRDYGFTDVTVVARNETTGGAVAKQYGFDWQPELGAARPGLLINATPVGMAGGPEADDLAFELDAIDAAEAVFDVVAMPAATPLIRAAAERHKTVITGAEVIALQAAEQFVLYTGVRPSPEEIRRASEYSRS

SEQ ID NO: 53753 - protein, 489 aa, Arabidopsis thaliana
MDSSYSVISKTSYVELQKPTVNGKPRNKLLPSDEESFVNDFDDARNGVGGEDADDLDFDVADYPLVHGKSSNQGSGIYGAVFNLTTSIIGAGIMALPATMKVLGLVLGFVLIILMALLSEISVELLVRFSVLYKSKSYGEVVQFALGKTARVLSEICIIVNNGGVLVVYLIIMGDVMSGSLHHIGVLDQWLGNGFWDHRKVLILIVMVIFLAPLCALNKIDSLSVTSAASVALAVVFVVVCFVVATIKLIEGTIDPPRLSPDFGSKQAILDLLVVIPIMSNAYVCHFNVQPIYNELEGRSPHKMNRVGRITTAICVVVYASTAVSGYLLFGKDTESDILTNFDQDLGIRFSSAVNYIVRIGYILHLVLVFPVIHFSLRETVNTLLFEGSPPLSESKKRSLGLTVVLLALIYIGSTMIPNIWTAFKFTGATSAVSLGFTFPALIALRLGKQSNSLSFVERSVSWLMLILAVVVSIVGTIGNIYSLESKSD

SEQ ID NO: 53754 - protein, 461 aa, Mycobacterium sp. JLS
MTQSYITEPVTSELGAKANRHLWGHFARHGEGITPPIITRGEGVRIWDDKGRSYIDGLSGLFVVQVGHGRKELAEAAAKQAETLSFFPLWSYATPPAIELAERIANYAPGDLNRVFFTTGGGEAVESAWKLAKQYFKLTGKPGKYKVVSRSIAYHGTPQGALAITGIPTFKAPFDPPTPGGFRVPNTNFYRAPEPYAHDVKAFGQYCADRIAEAIEFEGPDTVAAVFLEPVQNAGGCFPPPPGYFERVREICDEYDVLLVSDEVICAYGRIGSMFACDDFGYVPDIITSAKGLTSGYSPLGAMIASDRLFEPFNDGKTTFGHGYTFGGHPVSAAVALANLDIFEREGLNDHVKENAPAFRATLDKLYDLPIVGDVRGEGFFYGIELVKDKATKETFDDDESERLLRGFLTPALWEAGLYCRADDRGDPVVQLAPPLISGQAEFDAIYEILHGVLSEAARRL

SEQ ID NO: 53755 - protein, 114 aa, Rhodococcus sp. RHA1
MSEISQVTTHVLDAAEGMPAREVPVTLTVQRQSDWITVAEAVTDDDGRVTTLGPARLEPGTYRIVFDTGRYFAVKGRPAFYPDITITFALTDSEQHYHVPVLLSPFAYSTYRGS

SEQ ID NO: 53756 - protein, 297 aa, Rhodococcus sp. RHA1
MSKIVLGQNQYGKAEVRLVKITRDTKRHEIEDVTVTSQLRGDLDAVHTEGDNAHVVATDTQKNTVYAFARDGVGSIETFAMRLGQHFTGEFEWITGGRWEIEQYSWARIPVDGEGHDHSFVRSSDERRNTVVTMDGDRTWIVSGLSNMVVLKSTGSEFRGYPKDKYTTLQETSDRILATSVSARWRYLTTDVDFDKTFENVRAIMLEAFATTHSLALQQSLFQMGSAVLEAHPEIAEVKFSMPNKHHFLVDLEPFGLDNPGEVFFAADRPYGLIEATVEREDAPDAGRAWDSVPGFC

SEQ ID NO: 53757 - protein, 477 aa, Rhodococcus sp. RHA1
MKRIGHRVAGTPGPEDERLPLGKSYVYGLQHILTMYGGVIAPPLIVGGAAGLTGVEIGLLVSAALFVSGAATLLQTLGVPYFGAKLPLVQGISFASVSTMVAVASGPGGLRSVFGAIMVAGAIGLLISPFFCRIVRYFPPVVTGSIITVIGISLLPVAVRWAMGGNAKAPDWGSMSNIGLAGFSLFVVLLVSRLVQGTLSRLSILIGIVVGTLFAALIGKADFGAVGKGAIFELPQVFSFGTPLFQIGAIISMTVVILVIMTETTADILAVGEIVGTRVDARRVGDGLRADMLATTVAPVFGTFPASAFAQNVGLVAITGIKSRYVVAAGGSVLFALGLFPVLGRLVASVPLPVLGGAGIVLFGSVAASGIRTLSKVSYDGNLNLVIVAVALGFGVIPIAVPEFYSAFPEWVHIVFDSGISAASIVAVLLNILFNEVKAGNRPTPSVVSAAPPVLVHPAEDSEHPADTARTSAVRNE

SEQ ID NO: 53758 - protein, 502 aa, Mycobacterium sp. JLS
MTALASNASASNSVASSWIDGAPAQTGGGSFQIVNPATGAVVTEYARAANVDVDVAVAAARAALPGWATATPAERSAVLAKLAKLADEHTDVLVAEEVSQTGKPVRLAREFDVPGSVDNIDFFAGAARHLEGKATAEYSGDHTSSIRREAIGVVATITPWNYPLQMAVWKVLPALAAGCTVVIKPCELTPLTTLTLARLAGEAGLPPGVLNVVTGFGADVGTALAGHPGVDLVTFTGSTVVGRKVMSAAAVHGHRTQLELGGKAPFVVFDDADLDAAIQGAVAGSLINSGQDCTAATRAIVARDLYDDFVAGVAEVMGKIVVGDPEDPDTDLGPLISTAHRDKVAGMVSRAPAEGGRVVTGGTIPDLPGSFYRPTLIADVGEQSEVYREEIFGPVLTVRSFTDDDDALRQANDTDYGLAASAWTRDVYRAQRASREINAGCVWINDHIPIISEMPHGGVGASGFGKDMSDYSFEEYLTIKHVMSDITGVAEKEWHRTVFKKR

SEQ ID NO: 53759 - protein, 472 aa, Bacillus anthracis str. Sterne
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGAEMKDHPFKMPFAPVTNYLTIAFLIMVLVGMWFNDDTRISLVVGIVFLAIVTISFYAFGIGKRPPLDVPNDQEISSK

SEQ ID NO: 53760 - protein, 275 aa, Musa balbisiana
APAFMALLVSVLAAVPTRVQSMGVCYGMMGNNLPPPSEVIQLYKSNRIGRLRLYDPNHGALNSLRGSNIEVILGLQNGWKKHIASGMEHARWWVQKEVKDFWPDVKIDYIQGGNEIPPVTGTSSLTSFQVPALVGEAGLGNDIKVSTSVDMTLIGNSYPPSQGSFRNDVRWFTDPIVGFQASNGAPLLVNVYPYFSYSGNPGQISLPYALFTAPNAVVQDGRQYRNLFDAMLDSVYAAMTAGGGQWVGIVVSESGWPSAGYHGTAYNLIQHVKEG

SEQ ID NO: 53761 - protein, 533 aa, Ustilago maydis 521
MSIANASSSTASHDLDAADADPCPSACTSVSALCNMSTLPSPRPFGYRPTYVPAMVASGVSAVTVTTNSHRPPSKSHSISSVDSLASVSSNAPSTPTHDADDVRFEMAVIPKLVRASADAYLDRVGKPLPPSPAPQIVATSATTKTNAQAARSVAAAAAAAAAAAAVPPSHSALRNENHKNAISFRVGSKYKVCEIIGEGAYGVVCSAIHRATGQKVAIKKIQPFEHQMFALRTLRELKLLRFFQECDVSENIISILDIIKPSTYEAFTEVYLVQELMETDLHRVIRTQELSDDHCQYFTYQTLRALKPMHCADVIHRDLKPSNVLLNANCDLKVCDFGLARSVLTADQDTGFMTEYVATRWYRAPEIMLTFKQYTKAIDVWAVGCILAEMLTGRPLFPGRDYHQQLSLILDVLGTPTLEEFQNINSRRSRDYIRSMPFRKRREFRTLFPKASPEAIDFLQKTLTFDPRNRLTVEECLQHPYLSAYHDPDDEPGAPRLDPDFFYFDMQKESITKEDLRKELWYQVQEFQPLLR

SEQ ID NO: 53762 - protein, 517 aa, Bifidobacterium longum NCC2705
MTTTTASPVSKQTASAAQETSATGAAATAIETIETGVAGVAGAATNAAANAIEDLEAAESHGFSTRFPLNSAFIFTFGALGGMLFGFDTGIISGASPLIESDFGLSVSQTGFITSSVLIGSCAGALSIGALSDRFGRKKLLIVSALLFLLGSGLCASSTGFAMMVCARIILGLAVGAASALTPAYLAELAPKERRGSLSTLFQLMVTFGILLAYASNLGFLNHNLFGIRDWRWMLGSALVPAALLLLGGLLLPESPRYLVNKGDTRNAFKVLTLIRKDVDQTQVQIELDEIKAVAAQDTKGGVRELFRIARPALVAAIGIMLFQQLVGINSVIYFLPQVFIKGFGFPEGDAIWVSVGIGVVNFVSTIVATLIMDRFPRKGMLIFGSIVMTVSLAVLAVMNFVGDVAVLAVPTMILIAFYILGFAVSWGPIAWVLIGEIFPLSVRGIGSSFGSAANWLGNFIVSQFFLVLLDAFGNNVGGPFAIFGVFSALSIPFVLRLVPETKGKSLEEIEKEMTKR

SEQ ID NO: 53763 - protein, 456 aa, Corynebacterium glutamicum ATCC 13032
MALKGYTNFDGEFIEFGSVQAKEEEKRAFDNDRAHVFHSWSAQDKISPKVWAAAEGSTLYDFDGNAFIDMGSQLVSANLGHNNPRLVEAIQRQAARLTNINPAFGNDVRSDVAAKIVSMARGEFSHVFFTNGGADAIEHSIRMARLHTGRNKILSAYRSYHGATGSAMMLTGEHRRLGNPTTDPDIYHFWAPFLHHSSFFATTQEEECERALKHLEDVIAFEGAGMIAAIVLEPVVGSSGIILPPAGYLNGVRELCNKHGILFIADEVMVGFGRTGKLFAYEHAGDDFQPDMITFAKGVNAGYAPLGGIVMTQSIRDTFGSEAYSGGLTYSGHPLAVAPAKAALEIYAEGEIIPRVARLGAELIEPRLRELAEENVAIADVRGIGFFWAVEFNADATAMAAGAAEFKERGVWPMISGNRFHIAPPLTTTDDELVALLDAVEAAAQAVELTFAGALF

SEQ ID NO: 53764 - protein, 371 aa, Bacillus cereus E33L
MSKRDYYEVLGLSKGASKDEIKKAYRRLAKKYHPDVSKEENAIEKFKEVQEAYEVLSDDQKRAQYDQFGHAGANQGFGGFGGGGDFGGGFGFEDIFSSFFGGGGGRRRDPNAPRQGADLQYQVTLDFEEAIFGKELNVEIPVEDPCDTCKGSGAKPGTSKETCKHCSGSGQVSVEQNTPFGRIVNRQACSHCSGTGQMIKEKCTTCHGSGKVRKRKKINVKIPAGIDNGQQIRVSGKGEAGVNGGPAGDLYVVVHVRSHEFFEREGDHIICEMPLTFAQMALGAEVEVPTVHGKVKLKIPAGTQTGTEFRLKGKGAPNVRGYGQGDQYVVVRVVVPTKLTSHQKDLLREFAGQEEQDDSLFGKLKRAFKGE

SEQ ID NO: 53765 - protein, 281 aa, Stevia rebaudiana
AWCFKAEHHGGKDYHDPPPAPLIDGEELTKWSFYRAVIAEFIATLLFLYVTVLTVIGYKSQTDPNLNTDQCGGVGILGIAWAFGGMIFILVYCTAGISGGHINPAVTFGLFLARKVSLIRALLYMVAQCLGAICGVGLVKAFQSSYYNRYGGGANELADGYNKGTGLGTEIIGTFVLVYTVFSATDPKRSARDSHVPVLAPLPIGFAVFMVHLATIPITGTGINPARSFGAAVIYNKDKAWDDQWIFWVGPFIGAAIAAFYHQFVLRAGAIKALGSFRSNA

SEQ ID NO: 53766 - protein, 436 aa, Triticum aestivum
  misc_feature (102)..(102): Xaa can be any naturally occurring amino acid
  misc_feature (106)..(106): Xaa can be any naturally occurring amino acid
  misc_feature (402)..(402): Xaa can be any naturally occurring amino acid
  misc_feature (430)..(430): Xaa can be any naturally occurring amino acid
  unsure (1)..(436): unsure at all Xaa locations
FEKIDKIGQGTYSNVYKARDSLSGKIVALKKVRFDNLEPESVRFMAREILILRRLDHPNVMKLYGLVTSRMSCSLYLVFDYMVHDLAGLAASPDIKFTLPRXSPRXLPPRDIKGSNLLLDDDGVLKIGDFGLASFFDPNHKQPMTSRVVTLWYRPPELLLGATDYGVGVDLWSAGCILAELLAGKPIMPGRTEVEQLHKIFKLCGSPAEEYWKKSKLPHATIFKPQQPYKRRIAETFKDFPQSALRLIETLLSIDPADRLTATDALNSDFFKTEPRACDPSSLPQYPPSKEMDAKRRDEEARRLRAAGSRPNGDGARKTRTRDRPRAVPAPEANAELQANIDKRRLITHANAKSKSEKFPPPHQDGALGYPLGCSNHMEPTFEPPDPSSFSTVFPYDKTAVXPTWSGPLVDPPGGNQKRKHKSGRSSKQXSTARAR

SEQ ID NO: 53767 - protein, 431 aa, Lupinus luteus
MPSIAHSHVAAEPQHPKGENKQKNEGRNRRVLKDIGNLVVKQADPVANVPKRTTRNFGCQLLANAQAAAEKNKKPNTDVGNLAVVTKVEQTKKETEHEVIIISSDDEEEEKEKQVVKGGRKAREKVAGRGKNDKAFSAVLSARSKAACGLTHKPKDLVLVDDIDVADIANELEAVEYLDDIYKFYKLTEDDGRVHDYMPSQPDINIKMRSILFDWLIEVHRKFELMQETLYLTLNIVDRFLSMKAVPRRELQLVGISSMLIACKYEEIWAPEVHDFVCISDNAYVRENILIMEKTILSKLEWYLTVPTTYVFLVRYIKASTPYDKKIEDMIFFLAELSLMDYPLVISYCPSMIAASAVYAARCILGRVPYWTETLKHYTGYYEEQLRDCAKLMVNFHSVAPESKLRAVYKKFSSLERGAVALVAPTKNLLA

SEQ ID NO: 53768 - protein, 327 aa, Gloeobacter violaceus PCC 7421
MILAGDVGGTNTRLAGFEPVAGNLMPIVSETYASRDYSSLDQIVYLFISEYHLRVAAACFGVAGPVRRGRAETTNLPWSIDASTLAAGLKLPTVGLINDLEANAHGIALLGPADFAVLNPGAADAMGNQAVIAAGTGLGEAGLFWDGRRHRPFATEGGHTDFAPGDALQIELLHHLRVRFAHVSWERVLSGPGLVNIYQFLRDTRRGEEPNWLTEELRNHPNPAAVISQVALAGKSWLCEQALDLLIVLYGAEAGNLALKVAALGGVFLGGGIAPKLVERLKGPAFLEAFLAKGRLRPLLEAMPVRVILNDRAALLGAAHCAMQTLI

SEQ ID NO: 53769 - protein, 352 aa, Oryza sativa
MADEWWSASQRSHGTSACSAAPSPLTADRVSCGWTSPAAAAAAESTSSITFQDPSRSSAAHHQPLSDAASSLGDPHMVDWTQAFLSGRSDASFQAVLQDDMAASTRPFRAQPTAADEAVMTNPFRDMGVGQGLLLDQASAPLHGLSFDAGEPAVAPATHSITTSFGDYQHSASYDAAAAVMQFSQTPRAPSLPAAAQMQFLSGSYQLPFGGAPPLPSQLLLQAMQPKPSCSSNANTLLAKVRKKKLGDRIIALQQLVSPFGKTDTASVLHEAIEYIKFLHEQVGSLSSPYLKNGNPLQHFQQKGSESTKDAEQPKPDLRSQGLCLVPVASTYTVASKTVPKFWHPTFGGTFR

SEQ ID NO: 53770 - protein, 393 aa, Actinobacillus pleuropneumoniae serovar 1 str. 4074
MNSNDIKQLDADYIAQTYGRFNLALSHGKGCDVWDFEGNQYLDFTSGIGTNSLGWADDGWLAAVTTQAGKLQHTSNIFFTEPSAVLAKSLVEASGLKRVFFCNSGAEANEGAIKTARKYSHDKYGKGRATLLSLVNSFHGRTISTLAATGQDVFHQHFFPFTQGFEHTPANDLDALHARIEQDDVCAIILEIVQGEGGVCALDTEYLQGVQAICQAKDIILIIDEVQTGIGRTGKLFAYQHFGLQPDIITLAKGLGGGLPIGAFVLGGKCQNTLGKSDHGSTFGANPVCCAAANAVLAKIDEKFLADVAAKGEKLRAALLTLPKVKSVSGLGLMLGIEFEDGVKAADVVAKAIEKGVLTLTAKTKLRLLPPLVISEQQIDHGVAVLREVLESL

SEQ ID NO: 53771 - protein, 481 aa, Oryza sativa (indica cultivar-group)
MLAGGGSRVSGGGGGGGFNLASYKYKDPLLGRGGRSFLFGNTWFLLSTYPARLLHTADRRAPAAFFAAINRTPCVRTHCTGQSLLQRGIVMAACGYAFRRAELGAAKRQPEKDSSVGTRISCVVAMGSAGSTPRPEVSFRHRGVEYCKKVGVSLKCREPWGPSRAFWTNAIGPSYKLSFSVEPWLRDFSTSCVAPYSAGATEHQLSLDEAVQDKQMDNSTVGPDGKPRAPGPLKLVSGSCYLPHPAKEATGGEDGHFICVDEQAIGVADGVGGWADHGVDAGLYAKELMSNSMSAIKDEPQGTIDPSRVLEKAYTCTKARGSSTACIVALKEQGIHAVNLGDSGFIIVRDGRTVLRSPVQQHDFNFTYQLESGGGSDLPSSAQTFHFPVAPGDVIIAGTDGLFDNLYSNEISAIVVEALRTGLEPEATAKKIAALAQQKAMDRNRQSPFAAAAQEAGYRYFGGKLDDITVIVSYVTSASAT

SEQ ID NO: 53772 - protein, 459 aa, Lupinus luteus
MASRPVVPIHQQQVRGEGVIGGGKQKKNVAADGKNRRALGDIGNLDRVKGVEVKPNRPITRSFCAQLLANAQVAAAVENNKKLAIPNVGGAKPNVVEGAVAKRVAPKPAEKKVVEKPKPREAVEISPHEEVQKNKSVVKKKEGGENKKKPQTLSSVLTARSKAACGLTKKPQEQIIDIDANDSGNELAALEYIEDIYKFYKLEESESRPHQYLDSQPEINERMRAILVDWLIDVNNKFDLSLETLYLTINIVDRFLAVKVVPRRELQLLGISAMLLASKYEEIWPPEVNDFVCLSDRAYTHEQILVMEKIILGKLEWTLTVPTPYVFLVRFIKASVPDQELENMSHFLSELGMMHYSTLMYCPSMVAASAVFAARCTLNKTPFWNETLKLHTSYSEEQLMDCAKLLVSFHSTIGGGKLKVVHRKYSDPQKGAVAVLPPAKYLMPESSSSGTRVSKGLDK

SEQ ID NO: 53773 - protein, 83 aa, Oryza sativa
MSGRGKGGKGLGKGGAKRHRKVLRDNIQGITKPAIRRLARRGGVKRISGLIYEETRGVLKTVTAMDVVYALKRQGRTLYGFGG

SEQ ID NO: 53774 - protein, 444 aa, Oryza sativa (indica cultivar-group)
MAEGAKFHGIVGAVGAHDVGGNFCDMGYYQKLGEGSNMSIDSLNSMQTSIYGGSVAMSVDNSSVASSDSRTGMLKHPGLRGPVIVSSYSVGNSIFRPGRVSHALSDDALAQALMDSRFPTETLKDYEEWTIDLGKLHIGMPFAQGAFGKLYRGTYNGGDVAIKLLERPEADPEKAQLLEQQFVQEVMMLATLRHSNIVKFVGACRKPMVWCIVTEYAKGGSVRNFLNRRQNRSVPLKLAVKQALDVARGMAYVHGLGFIHRDLKSDNLLISGDKSIKIADFGVARIEVKTEGMTPETGTYRWMAPYWIALTVPYESIYALNPHSLLIDAQVSEVIQHRPYDQKVDVYSFGIVLWELVTGNLPFANMTAVQAAFAVVNKGVRPAIPHDCLPALAEIMTRCWDANPDARPPFTEVVRMLEQVEMEVVNTVRRARFRCCISQPMTLD

SEQ ID NO: 53775 - protein, 287 aa, Metasequoia glyptostroboides
MSCFKGKYHDELIANANYIATPGKGILAADESTGTIGKRLASINVENVESNRRALRELLFTAPGALPLISGVILFEETLYQKASDGTTFVDILTSAGVLPGIKVDKGTVDLAGTAGETTTQGLDGLGQRCATYYKAGARFAKWRAVLKIGPTEPSQLAIQENANGLARYAIICQENGLVPIVEPEILVDGSHSIDVCADVTERVVAACYKALNDHKVLLEGTLLKPNMVTPGIRRPQSQPGRYCSVHCPGSAADRATRRARDYVLVRWAERGGGHLELECHEQAAGR

SEQ ID NO: 53776 - protein, 402 aa, Triticum aestivum
  misc_feature (25)..(25): Xaa can be any naturally occurring amino acid
  unsure (1)..(402): unsure at all Xaa locations
AAEEEGVARAEAPKKVLILMSDTGXAHASAHAAAFAQEYGDDYQVFVTDLWTEHTPWPFNQLPRSYSFLVKHGPLWKMTYYGTAPRVIHQPHFAATATFIAREVAKGLMKYQPDVIISVHPLMQHVPLRVLRSRGLLDKIPFTTVITDLSTCHPTWFHKLVTRCYCPSAEVTKRALKAGLKPSQIKVYGLPVRPSFAKPVPPKDELRRELGMDEYLPAVLLMGGGEGMGPIEATARALDNALYDESLGEPRGQILIICGRNKKLTNRLQSINWKIPVQVKGFVTKMEECMGACDCIITKAGPGTIAEAMIRGLPIILNGYIAGQEAGNVPYVVENGCGKFSKSPEHIAKIVADWFGPRSDELQIMSQNALKLARPDAVLKIVHDLHELVRQKSFVPEYACAT

SEQ ID NO: 53777 - protein, 327 aa, Rhodococcus sp. RHA1
MTTTTLSLGAALNAGLRRALEHDRKVVIMGEDVGRLGGVFRVTDTLQKDFGDNRVIDTPLAESGIIGAAFGMALRGYRPVCEIQFDGFVYPAFDQIVSQVAKIHYRTQGRVTAPLTIRIPYGGGIGAVEHHSESPEAYFAHTAGLRVVTPSNPADAFHMIQQSVAADDPVVFFEPKRRYWDKAEFDVDAEPDLPLHRARVAREGTDATIVAYGSVVPTALSAASIAADEGHSLEVIDLRSLSPIDFDTIEESVRKTGRLVVAHEASTFLGLGAEIAARISERCFYQLDAPVLRVGGFDVPYPPAKLELHHLPDADRLLDAVDRSLAA

SEQ ID NO: 53778 - protein, 214 aa, Ralstonia solanacearum GMI1000
MYRPKRMLVGNVAWAHEIAERDPRFFSRLAQGQKPQVLWIGCADSRVPAETITHSNPGDLFVHRNIANLVCPADDNTMSVLEYAVRVLKVGHIIVCGHDGCGGVRASLLPQSDALPHVNRRIGPLCALAVRHRAELDAVPDMDDRVNRLAELNVLEQVRWLRESSIVREAEPAPRVHGWIFGLADGRIRVLGSGEPGEAPPVRGDILEPAEAEA

SEQ ID NO: 53779 - protein, 417 aa, Rhodococcus sp. RHA1
MAQEFRLPDLGEGLTEAELVSWAVEVGQTIELNQVIGEVETAKALVELPSPYAGVVEELLVPAGATVPVGTPIIRVATNAATEEPPARTPVLVGYGPEAAAESKRARRRLVTAPETGTSGPDRRRPDASPAARATARELGVDLAVVAGTGPSGAVTRNDVESHAGSAGQSVPSTPEPPEPSEQSERETRTPIRSVRKQTAAAMVRSAFTAPHVTEFVTVDVTRSVELLERLRGLPDFEGLSVTPLSLVAKAMIVALRENPSLNASWDEENQEIVTKHYVNLGIAAATPRGLVVPNIKEAQSLSLLELCRAITELTATARSGRAEPAQLTGGTVSITNVGVFGVDAGTPILNPGESAILCLGSVTRRPWVHEDELAVRWVTTLSVSFDHRVVDGEQGSRFLSSVAAMLHDPASLLAHL

SEQ ID NO: 53780 - protein, 480 aa, Myxococcus xanthus DK 1622
MSLKSRLLGTARRQVKQTLRPVLQRAMAPARNHIPASHWGLRDVPGQGLSLEGVPLAQLVERWGSPLHVVHMAALRRNAERFLAVPPGRTGGCEVYYSYKTNPVPGVLSFLHGLGVGAEVISAYEMWLALKLGVPPERIVYNGPVKSEASVREAISRGIQLLAANHAEEIAVFARLAAELDRRPRVAVRVTTNSGWSAQFGTPIAGGAALRAYQQARGSKHLDVVGLHAHRGETIRTEGDFTAFVESVLDFTDTLHQELGLDLEVLDLGGSLNTPTVEHIAERDWRLNLTFFRDVPAPDPAASLSIDRYVALAVEMVETHYARRGRQRPRIFLEPGRAMTGDTQLLLGRVHALKAGEDRTWAVLDAGINHAECVRNEYHQLFHVNRPDAPADKVYTVVGPICTPGDTLYHAKRLPDLRVGDTLAIMDAGAYFVPFATSFSYPQPAIVALEDGKERLLRRAETFDDLVTFDALDSRAALTG

SEQ ID NO: 53781 - protein, 581 aa, Aspergillus nidulans FGSC A4
MEGVDFQSVLNKGKQMASNVAATATNGSTNKKRRKGTDLKPIVTSDSATPADQTGPTSDNVPPSRSGSSSSEEEIETTAEEEDSEDYCKGGYHPVQIGELYNNGRYVVVRKLGWGHFSTVWLSRDTTTGKHVALKVVRSAAHYTETAIDEIKLLNRIVQANPSHPGRKHVVSLLDSFEHKGPHGVHVCMVFEVLGENLLGLIKKWNHRGIPMPLVKQITKQVLLGLDYLHRECGIIHTDLKPENVLIEIGDVEQIVKTYVKEEAKKEQKEDNRNGRRRRRTLITGSQPLPSPLNTTFEFKHSSQNSHSSLSQVINESPGTSEAPSMRQLLGIKDEDEQQKQREKTAYVERLLEGTSLTDDSDLLEREVSGISLDKPSSDEDIDCGIISVKIADLGNACWVGHHFTNDIQTRQYRSPEVILGSKWGASTDIWSMACMVFELITGDYLFDPQSGTRYGKDDDHIAQVIELLGPFPKSLCLSGRWSQEIFNRKGELRNIHRLRHWSLPDVLREKYHFSVAQAKAISDFLLPMLEVLPERRANAGGMASHEWMKDTRGMQEVDLGLTPGSRGEGIEGWATEVKRR

SEQ ID NO: 53782 - protein, 690 aa, Burkholderia mallei ATCC 23344
MPPVPRFLDSFSGLDMTTSSPASTTLMANAIRALAMDAVQQANSGHPGMPMGMAEIGVALWSRHLKHNPTTPHWADRDRFVLSNGHGSMLLYSLLHLTGYDLPIEELKNFRQLHSKTPGHPEYGITPGVETTTGPLGQGLANAVGMALGEALLAAEFNRDDAKIVDHHTYVFVGDGCLMEGISHEACSLAGTLKLNKLIAFYDDNGISIDGDVVNWFHDDTPKRFEAYGWNVIPNVNGHDVDAVDAAIAKAKSADKPTLICCKTVIGKGAATKAGGHDVHGAALGAEEIAKTRDALGWKWAPFVIPQEVYAAWDAKEAGKRREGDWNAAFAQYRAKYPAEAAEFERRMAGKLPADWAEKAAAIVAGANERGETVATRKASQQTIEGLAAVLPELLGGSADLTGSNLTNWKASKAVRANAHGAGIQWGNHINYGVREFGMSAAINGLVLHGGYKPFGGTFLTFSDYSRNALRVAALMKVPSIFVFTHDSIGLGEDGPTHQSVEHVASLRLIPNLDVWRPADTVETAVAWTHAVSHQHPSCLVFSRQNLAFNARTDAQLANIEKGGYVLRDWDEEIVARKIILIATGSEVELAMKAVEPLAQQGIAARVVSMPSTDVFDRQDAEYRERVLPHGVRRVAIEAGVTDFWRKYVGLEGGVVGIDTFGESAPAGVLFKHFGFTIEHVVETAKAVLA

SEQ ID NO: 53783 - protein, 336 aa, Burkholderia mallei ATCC 23344
MTIRVAINGYGRIGRNTLRAFYENGKKHDLEIVAINDLGDAKTNAHLTQYDTAHGKFPGEVSVDGDYLVVNGDRIRVLANRNPAELPWGELGVDVVMECTGFFTSKEKASAHLKGGAKKVIISAPGGKDVDATIVYGVNHDVLKAEHTVISNASCTTNCLAPLVKPLNDKIGLETGLMTTIHAYTNDQVLTDVYHEDLRRARSATHSQIPTKTGAAAAVGLVLPELNGKLDGYAIRVPTINVSIVDLSFIAKRDTTAAEVNAIMKEASEGALKGILGYNDAPLVSIDFNHNPASSTFDATLTKVSGRLVKVSSWYDNEWGFSNRMLDTAIALANAK

SEQ ID NO: 53784 - protein, 431 aa, marine gamma proteobacterium HTCC2080
MSDKKATLSIDHGNGSVDTIDLPVLQAELGPDVVGVGSLTGNGLFTYDPGFTSTAACESKITFIDGEKGILLHRGYPIEQLAAESNYLETCYLLLYGELPSAAERDDFVSTMHQHTMVHEQIRTFFNGFRRDAHPMAIMCGVVGALSAFYHDSTDISDPYHRKVAAFRLIAKMPTIAAMSYKFSIGQPFMYPDNSMDYATNFLHMMFGVPCEPSKISPTIARAIDRIFLLHADHEQNASTSTVRLAGSSQANPFACIAAGIAALWGPSHGGANEAVVKMLEEIGTVDNIDKFIAKAKDKNDPFRLMGFGHRVYKNFDPRAKVMKQAADEVLAELGIHDEMLEIAKRLEEIALQDPYFIEKKLYPNVDFYSGIILKALGIPTSMFTVIFAIGRTVGWVAHWNEMISGSYRIGRPRQLYTGYQQRDYLPLDKR

SEQ ID NO: 53785 - protein, 219 aa, Burkholderia mallei ATCC 23344
MQDIIEGFLKFRRDAFAPRTALFKRLATSQQPRALFISCSDSRLVPELVTQREPGELFVIRNAGNIVPSFGPEPGGVSASVEYAVAVLEVADVVVCGHSDCGAMRAIASCACLDHLPAVRSWLRYADAAKRVNEAREHAGEQARVDSMVRENVVAQLANLNTHPSVRLALEQGRLTLRGWVYDIETGSIDALDGATGRFVALAEHPRVHATPPRVQRAA

SEQ ID NO: 53786 - protein, 826 aa, Aspergillus nidulans FGSC A4
MTNPGSTDKIQNLMKSFLFRHRAVGFIDADGNGRLYPLVHGQGSYWHPSSACRLPDESDFWPAISPLCQREVTEWRMTGWLWFQSKQPGSLNWKEKIDGRIIPTGTGTRKSDWDSLANGVQCGLSESPINNVESNDTVDRNAVLDDHDAEKILPYEADDSPFPEFFSLRQPSVRISALVAQLVAYPIGCAWAKWMPLGWLNPDRRFNIKEHALITIMANVSFGSAAATQVIEAMVKFYHMPSQGGFQILLCITTQLFGFGVAGMVSRWLVEPATMIWPQVLSNAALLSTLHSKSNKVADGWTITRQKFFLLVFVGGALWYFLPGYLFTALSMFSFVCWIAPTNVVVNQLFGQKTGLGMSLLTLDWSQVVFANDSPLLVPFWAGLNVMGSFVLFFWILVPIIYYTNTWYSAYLPLLDSNTFDNTGRMYDTRRVMNINNGTVNVEAYRNYSPMFIPAGFAVTYGVAFANLTGIFVHTALYHGKDLLQQWSGRHKKDIHSRLMQSYTPVPWWWFGAVSLLMFILSIVNNEVWETRLPAWGVLLAFVLPIIYFIPVGIIKALTNITSNQLNLITEFIGGYAFLGKPVANMAFKFYGYVTVSQGLEFVADMKLAHYLHIAPRTLFFAQGLATLIGAIVQCGVTVFMLTRFEGICTPHADGGFTCPHGLVTFSSSLIWGALGPARNFSPGQIYGNLLWFFLAGPVVVIITYLLGRRWKAANYISWPVAFGAMSMVPPATGINFSSWWVVNVIFNGLVKRKRPAWWSKYNYVLSAALDSGVAVSTVVIFFCIMLPAGPLRWWGNEVFMRTADGRGTPWKTVPPHERFGPTTWE

SEQ ID NO: 53787 - protein, 98 aa, Glycine max
  misc_feature (83)..(83): Xaa can be any naturally occurring amino acid
  misc_feature (87)..(87): Xaa can be any naturally occurring amino acid
  unsure (1)..(98): unsure at all Xaa locations
TRAESPLFAPFTVLKTMAGLPTIKTTNYITSIANNGGRVQCMQVCPPVGKKKFDTLSYLPNLDDAQLAKEVQYLLRKGWIPCXEIRXDHGLEYREHNR

SEQ ID NO: 53788 - protein, 411 aa, marine gamma proteobacterium HTCC2080
MAIEIKAPAFPESVADGEVAAWHKAEGDTVARDELLVEIETDKVVMEVVAPESGVLTSIVAVEGETIESEALLAVLEAGEVTQSAPSSSSTSKTVEPVQPSESGEHAMGPAARAMIDEHGIDPAAITGSGKGGRVTKEDVTKHLKNSAQAAPVKPAPTAPATPAVTTIPNDSFGPSSERIEKRVPMTRMRARIAERLLEATQQTAMLTTFNEVNMAPLMKLRSQYKESFEKAHNGTRLGFMGFFVKACCEALKRYPAVNASIDGSDVVYHGYQDIGVAVSTNDGLVVPVLRDADFMSIADVEAAIRDLGLKAQDKKLTIEEMTGGTFTVSNGGVFGSLLSTPILNPPQTGILGMHTIQERPVAVNGEVVIQPMMYLALSYDHRLIDGKTAVQFLVTVKGFIEDPARILLQL

SEQ ID NO: 53789 - protein, 116 aa, Leptospira interrogans serovar Copenhageni str. Fiocruz L1-130
MTDPNCIFCKIIRKEIPSKVVFENDEILAFYDISPQAPVHIVFIPKKHIPSLSEIENEDSHLLGNILLQIRDTAKNLGFAENGYRVVNNTGKNGGQTVFHIHFHLLAERRLHWPPG

SEQ ID NO: 53790 - protein, 561 aa, Oryza sativa (indica cultivar-group)
MAIPPLAVSGVAVATLAVLGLAVFACRRWRRGASPAPPPPASSQDDDINMRLISDNLDDYSVSSNSSTVDESGIRIDRIITSPKTHGIVGKGATYPTESHVIEGETHVIDVTNSKTEELYLGNTLKRPAVANGPTPDVKHIRRDSGESNHNGTIPDIIVGSNLSLEVIAGPSHGINHYMQSGNKSMLPVTLGRVPPSHLVLKDSEVSGKHAQIDWNANKLKWEIVDMGSLNGTFLNSRSVNHPDVGSRRWGEPAELADGDIITLGSSSKVSVQIELQNQQPVGVGIASDPMTARRTGKKLHMEDVSCCQYPLIGVEKFGLFGIFDGHGGDGAAIAASRILPQNIANILSQQETKERVLSCHSASDVLRHAFALTEAALHHQYEGCTATILLIWFDQNEDCFAQCANLGDSACIMSVNGEIITMTEDHRVVSTTERARMANSGQPLKDGESRICGLNLGRMLGDKFLKEQDSRFSSEPYVSQAVRMTKACLASALIASDGLWDVISANRAAQLVLEGKQKYSEQKTSADKVAHHVLSEARKLRTKDNTSVIFVDLDTLRSDP

SEQ ID NO: 53791 - protein, 401 aa, marine gamma proteobacterium HTCC2080
MTASYDVIVIGSGPAGYVCAIRCAQLGKKVAVVEQWADDKGKPVLGGTCLNVGCIPSKALLDSSHKFLEAKEHFADHGIGIGETQINVATMMQRKDQIVGQLTGGVAGLLKHNQIDVVQGRGKLLANRKVQVLSSDGTESVHEAENIVLAAGSLPIDIPVAPVDQVHIVDSTGALVFESVPERLGVIGAGVIGLELGSVWGRLGAEVVLLEAMDGFLPSMDAQIAKEGQKLFKKQGLDIRLGARVTGSEVIDGQVHVSYAMGEETHTEIFDRLIVSVGRRPQTGELFAEDSGVTMDERGCVFVNEVCSTEAPGVWAIGDMVRGPMLAHKGSEEGVMVAEQIAGHHHPLNYDLIPSIIYTHPEIAGVGKTEQELKAEGVKVKVGTFPFAAIGRALAAATATE

SEQ ID NO: 53792 - protein, 452 aa, Lupinus luteus
MASRPTVRLQQQARDEEVVGGGKQQKNGAGDGKNRKALGDIGNLDHVKPNRPVTRSFCAQLLANAQAAAAAENKKKLAIPNVADPKPNVADGVVAKRVAPKPAEKKVTAKPKAQEVIEINPAEEAQKNKSVNKKKEGGENKKKSRTLTSVLTARSKAACGLTNKPKEKIIDIDAGDSGNELAAVEYIEDIYKFYKLAENENRPHQYMDSQPDINEKMRAILVDWLINVHTKFDLSLETLYLTINIIDRFLALKTVPRKELQLVGISAMLMASKYEEIWPPEVDEFVCLSDRAFIHEEVLAMEKIILGKLEWTLTVPTPYVFLVRFIKASVPDQELENMAHFLSELGMMHYGTLMYCPSMIAASAVFAARCTLNKTPIWNETLKLHTGYSKEQLMDCAKLLVSFHSSIRGEKLKVLYRKYSDPERGAVAVLSPAKNLMSEGGGIDLSVVENNI

SEQ ID NO: 53793 - protein, 467 aa, Arabidopsis thaliana
MESNHPHFKLILGSSSIARRKILTDMGYQFTLMSADIDEKSIRKEKPEELVLALAEAKADAIVSKLQISECEDEEQPRVLIASDTAEAIMQRIPDGENIEEDKSTLLITCDQVVVYEDAVREKPSSVEEAREYIRGYSKGHTATVSSVAVTNLKTGVRKGGVDRVEIYFNEIPEETIEKLIEEGMVLKVAGALLIEHPLILPCVKEVVGTTDSVMGLPKELTEKLIKEIKPKKEENSKRRRNVKPICRETGDHVHYLPTCKTKPKPTRTHHAPPPILDSIFKVTHKPHYYECRKNHAADIGTTAYDGCGEFVSSTGEEDSLNCAACGCHRNFHREELIPENGGVTETVLEVLKISSCQFRRIFCSPYGGGKSEGKKKKKEKESYGGDPIIKDRFGGAEEEEGIVKRLKTKFTAEQTEKMRDYAEKLRWKVRPERQEEVEEFCVEIGVNRKNFRIWMNNHKDKIIIDE

SEQ ID NO: 53794 - protein, 333 aa, Nitrosospira multiformis
MTIKVGINGFGRIGRMVFRAAVQNFPDIEVVAINDLLEPDYLAYMLQHDSVHGRFKGDVSIEDSTLIVNGKRIRLTAIKDPAVLKWGEVGAEVVVESTGLFLTKESCQKHIAAGAKKVIMSAPSKDDTPMFVYGVNNDSYDGQAIISNASCTTNCLAPVAKVLNDTFGVKRGLMTTVHAATATQKTVDGPSNKDWRGGRGILENIIPSSTGAAKAVGKVIPELNTKLTGMAFRVPTSDVSVVDLTVELEKEASYEEICNAMKKASEGSMKGVLAYTDQKVVSTDFRGESATSIFDAEAGMALDGNFVKVVSWYDNEWGYSSKILEMVRVVAGK

SEQ ID NO: 53795 - protein, 333 aa, Nitrosospira sp. HBN8222A
MTIKVGINGFGRIGRMVFRAAVQNFPDIEVVAINDLLEPDYLAYMLQHDSVHGRFKGDVSIEDSTLIVNGKKIRLTAIKDPAELKWGEVGAEVVVESTGLFLTKESCQKHIAAGAKKVIMSAPSKDDTPMFVYGVNNDTYDGQAIISNASCTTNCLAPVAKVLNDTFGVKRGLMTTVHAATATQKTVDGPSNKDWRGGRGILENIIPSSTGAAKAVGKVIPELNTKLTGMAFRVPTSDVSVVDLTVELEKEASYDEICDAMKKASEGSMKGVLAYTDQKVVSTDFRGESATSIFDAEAGKALDGNFVKVVSWYDNEWGYSSKILEMVRVVAGK

SEQ ID NO: 53796 - protein, 354 aa, Schizosaccharomyces pombe
DLDISFHFNTDVTKIDLAEKKIYCGSDEKPTESYTKLILATGGEPNKLPIPGLDSKNVYLLRSIADASKLAAVTTEAGDKKNIVIIGSSFIGLELAVVLKDHNVSVIGMESIPFEKVMGKEVGTALKALHEQNGIAFYLENSIKEVKTSSNDSSKAEHIVLKDGQSIPADVVILAAGVKPNLRYLGNAVSLEKDGGVKVDEHCRVLGAEDVYAVGDIAHAPFAGLPSSGEKSHTRIEHWDVAGNLGRVAADHILFGNKAGYTTKSFTPYFWSAQGKQLRYCGNNAAEGFDDVVIQGSLSDYKFACFFTKGEKVVGVCSIMKDPVVSQCARLFIKDAMPSKSQLKENFDVLSIPL

SEQ ID NO: 53797 - protein, 333 aa, Nitrosospira sp. PM2
MTIKVGINGFGRIGRMVFRAAVQNFPDIEVVAINDLLEPDYLAYMLQHDSVHGRFKGDVSIEDSTPIVNGKKVRLTAIKDPAELKWGEVGAEVVVESTGLFLTKESCQKHIAAGAKKVIMSAPSKDDTPMFVYGVNNDSYDGQAIISNASCTTNCLAPVAKVLNDTFGVKRGLMTTVHAATATQKTVDGPSNKDWRGGRGILENIIPSSTGAAKAVGKVIPELNTKLTGMAFRVPTSDVSVVDLTVELEKEASYEEICNAMKKASEGAMKGVLAYTDQKVVSTDFRGESATSIFDAEAGMALDGNFVKVVSWYDNEWGYSSKILEMVRVVAGK

SEQ ID NO: 53798 - protein, 218 aa, Vibrio fischeri ES114
MTQDEMKKAAGWAALEYVEAGSIVGVGTGSTVNHFIDALATMKNEIKGAVSSSVASTEKLKELGIEVFDCNDVAGLDVYVDGADEINGKNEMIKGGGAALTREKIVAAISDKFICIVDDTKQVDVLGQFPLPVEVIPMARSYVARELVKLGGDPAYREGVITDNGNVILDVHGMKITDAKDLEDKINALPGVVTVGLFAHRGADVLLVGAPEGVKKFD

SEQ ID NO: 53799 - protein, 287 aa, Arthrobacter globiformis
TKVVLGQNQYGKAEVRLVKVTRNTARHEIQDLNVTSQLRGDFEAAHTAGDNAHVVATDTQKNTVYAFARDGFATTEEFLLRLGKHFTEGFDWVTGGRWAAQQFFWDRINDHDHAFSRNKSEVRTAVLEISGSEQAIVAGIEGLTVLKSTGSEFHGFPRDKYTTLQETTDRILATDVSARWRYNTVEVDFDAVYASVRGLLLKAFAETHSLALQQTMYEMGRAVIETHPEIDEIKMSLPNKHHFLVDLQPFGQDNPNEVFYAADRPYGLIEATIQREGSRADHPIWSN

SEQ ID NO: 53800 - protein, 554 aa, Zea mays
  misc_feature (78)..(78): Xaa can be any naturally occurring amino acid
  unsure (1)..(554): unsure at all Xaa locations
DGRVTAVSLQGRGLSGTLPPAVAGLRRLQGLYLHYNGIKGPIPREIGKLSELTDLYLDVNHLTGPVPVEIAAIANLQXIAEVPLLEVFDVRNNTLSGSVPVGLRRLNGGFQYMNNKGLCGAGFSLLELCLSSEDGLKPSKPEPFGPDGTVKTRQVPQSANPDGCSGASCSKSANASQGVLIVSYVGPPPGAAFCGLFAFSWYRRQKQKIGSSLEVSDSRLSTDHFQQKEACRRSASPLISVEYSNSWDPLSAGGAGVGSPGQVVGDSFRFNLEEVECATQYFSDVNLLGKSGFAAATYKGILRDGSVVAVKSLSKTSCKQEESDFLRGLKMLTLLQHDNLVSLRGFCCSRGRGECFLVYDFMVNGCLSRYLDVKDGSSGATVLDWPTRVSIIRGIAKGIEYLHSKKGSKPPVVHQNISADKILLDHHLAPRLSVPGLHKLLADDVVFSALKASAAMGYLAPEYAATGRFTDKSDVFAFGVVVLQVLTGRRDVSQLKVGAAAVSDLGGLVDANLDGAFSRTEAARLAAVAAYCTSETPGQRPTMEAVVQQLSSTQ

SEQ ID NO: 53801 - protein, 643 aa, Burkholderia sp. 383
MNANPKFLSADAHVDAAAVAPLPNSRKVYVTGSQPDIRVPMREITQADTPTGFGGEKNPPIYVYDTSGPYTDPEAKIDIRAGLAALRQGWIDARGDTEVLGGLSSEYGLERAADPATADLRFPGLHRNPRRAQAGKNVSQMHYARQGIITPEMEYIAIRENQRRAEYLESLKASGPNGAKLAAMMGRQHPGQAFGAAAFGANAPAEITPEFVRSEVACGRAIIPANINHPESEPMIIGRNFLVKINANIGNSAVTSSIGEEVDKMTWAIRWGGDTVMDLSTGKHIHETREWIIRNSPVPIGTVPIYQALEKVNGKAEDLTWEIFRDTLIEQAEQGVDYFTIHAGVRLQYVPLTANRMTGIVSRGGSIMAKWCLAHHKESFLYEHFEEICEIMKAYDVSFSLGDGLRPGSIYDANDEAQLGELKTLGELTQIAWKHDVQVMIEGPGHVPMQLIKENMDLQLDWCKEAPFYTLGPLTTDIAPGYDHITSGIGAAMIGWFGTAMLCYVTPKEHLGLPNKDDVKEGIITYKLAAHAADLAKGHPGAQVRDNALSKARFEFRWEDQFNIGLDPDKAREFHDETLPKDSAKVAHFCSMCGPHFCSMKITQDVREFAAQQGVSETEALKKGMEVKAVEFVKTGAEIYHRQ

SEQ ID NO: 53802 - protein, 103 aa, Triticum aestivum
TLSPFAGLAFHPLDGILQALPHSLCLFFMPIHFTTHLVLIFIEGIWTANIHDCIHGKLWPVMGAGYHTIHHTTYRHNYGHYTIWMDWLFGTLHNPEEDEGKAM

SEQ ID NO: 53803 - protein, 387 aa, Ralstonia solanacearum GMI1000
MSEADSSTPAGAFKPKKSVALSGVTAGNTALCTVGRTGNDLHYRGYDILDLAAACEFEEVAYLLVHGKLPNKAELTTYKARLKALRGLPANVKAALEWVPASAHPMDVMRTGVSVLGTVLPERDDHNLPGARDIADRLMASLGSMLLYWYHYSHNGRRIEVETDDDSIGGHFLHLLHGVEPSKSWVDAMHVSLNLYAEHEFNASTFTGRVIAGTGSDIYSAITGAIGALRGPKHGGANEVAFEIQKRYDTPDEAEADVRRRVEAKEVIIGFGHPVYTISDPRNKVIKEVARKLSKEAGNTRMFDIAERLETVMWDVKKMFPNLDWFSAVSYHMMGVPTAMFTPLFVISRTSGWAAHVIEQRIDNKIIRPSANYTGPEDLKFVPLGKR

SEQ ID NO: 53804 - protein, 250 aa, Geobacter sulfurreducens PCA
MAEGFKDYFSDTSDAYRTYRPEYPDALFAWLAGLPPRRDAALDCGCGTGQASVVLASYFPRVYAVDPSAGQIASAVPHEGVVYRVAPAEQTGLPGASVDLVVAAQALHWFDFDRFYPEVRRVGRPGSVFAAFSYGLLSIDADLDRIIGRFYREVIGRYWPPERAHVDDGYRSIPFPFPEIAAPPFAMEARWELEHLLGYLATWSAVREYRQRLGTDPLPELAREVRDAWGIPEEGRTIVWPLALRVGRIA

SEQ ID NO: 53805 - protein, 275 aa, Triticum aestivum
  misc_feature (233)..(233): Xaa can be any naturally occurring amino acid
  misc_feature (265)..(265): Xaa can be any naturally occurring amino acid
  unsure (1)..(275): unsure at all Xaa locations
AYLGDTIEQVCTKKQAGTGPEFPGYRRPTRPKTVMSREKLLMKRNSFIYIFKVAQLVILGLIAMTVFLRTKMPHGQFSDSTKFFGALTFSLMTVLFNGFAELQFTIKMLPTFYKQRDFLFFPPWTIGLVNIISKVPVSLVESIVWVVRRYYVMGFAPAAGRFFRMLLAFFATHQMAMGLFRFLGAVLKSMVVANTLGMFVILLIFLFGGIVIPRGDVRPWWIWAYWASPMMYXWQRECSISRHEFLSSRWANPKNNTFIECPTVXGEAFLKAKGL

SEQ ID NO: 53806 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 53807 - protein, 150 aa, Arabidopsis lyrata subsp. petraea
HITTPTSASDKRSKDKVFEVLNRCGKKVEDVTRKAEALAGGLKDHLKFSPSIGDAAMARLSQGTKMIVEGGPERVFQREFGVLAAEKLLDSFVCYISTTWGPVTGVIYISNRRIAFCSDYAIRLPSSVGGNGVAAYYKVVMEWEKIRSIS

SEQ ID NO: 53808 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFPSKLPWKETLSFRYQAEENSPKHIEEYFHNRMGEDFAEFGTVYQDYCEAMSTLSLGIMELLGMSLGVSREHFREFFNENDSIMRLNYHPPCQKPDLTLGTGPHCDPTSLTILHQDQVGGLQVFVDNEWRSINPNFDAFVVNIGDTFTALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 53809 - protein, 233 aa, Zea mays
  misc_feature (146)..(146): Xaa can be any naturally occurring amino acid
  misc_feature (185)..(185): Xaa can be any naturally occurring amino acid
  misc_feature (197)..(197): Xaa can be any naturally occurring amino acid
  misc_feature (209)..(209): Xaa can be any naturally occurring amino acid
  misc_feature (216)..(216): Xaa can be any naturally occurring amino acid
  unsure (1)..(233): unsure at all Xaa locations
MVGATVVSKWTPLCVASPPERNSASLNPHCSPARVNFRTALAAFRPQFRLFSRNSASRRRLRASSSAESGIFLPHLVASMEDVEETYIMVKPDGIQRGLVGEIISRFEKKGFKLIGLKMFQCPKELAEEHYKDLSAKSFFPNLIEXITSGPVVCMAWEEGLGVVASARKLIGKTDPLQAEPGTKXEGDLAVQTGRNXGVHGSDSPENAXRENFGLXFKEGELMARWDSALLLG

SEQ ID NO: 53810 - protein, 221 aa, Yersinia pestis CO92
MATAHPIKAAIFDMDGLLIDSEPLWLQAELDIFTALGLDTSSRDSLPDTLGLRIDLVVKLWYQTMPWQGPSQEEVCNRIIARAIDLVEDTRPVLPGIEYALALCRQQGLKIGLASASPLHMQERVLAMLGVEKYFDCLVSAEYLPYSKPHPEVYLNAAAQLDVDPLQCVTLEDSVNGMIATKAARMRSIVIPSVEYRADPRWALADIQLESLDQLRKDDIS

SEQ ID NO: 53811 - protein, 333 aa, Nitrosospira sp. PJA1
MTIKVGINGFGRIGRMVFRAAVQNFPDIEVVTINDLLEPDYLAYMLQHDSVHGRFKGDVSIEDSTLIVNGKKIRLTAIKDPAELKWGEVGAEVVVESTGLFLTKESCQKHIAAGAKKVIMSAPSKDDTPMFVYGVNNDTYDGQAIISNASCTTNCLAPVAKVLNDTFGVKRGLMTTVHAATATQKTVDGPSNKDWRAGRGILENIIPSSTGAAKAVGKVIPELNTKLTGMAFRVPTSDVSVVDLTVELEKEASYEEICDAMKKASEGSMKGVLAYTDQKVVSTDFRGESATSIFDAEAGMALDGNFVKVVSWYDNEWGYSSKILEMVRVVASK

SEQ ID NO: 53812 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVSTNWLHQRSLS

SEQ ID NO: 53813 - protein, 336 aa, Desulfitobacterium hafniense DCB-2
MSVRVAINGFGRIGRLTLRAILKQSLPVEVVAINDLGSPDLLAHLFKYDSLHGILPNSVEIDGDTMLVDGKSIAILSERNPLDLPWRKLGVDIVIESTGRFTKRAAASQHLTAGAKKVVISAPAKNEDITIVMGVNDDQYQPQEHHIISNASCTTNCLAPVAKVLLDAFGIEQGMMTTTHSVTNDQRILDLEHSDWRRSRAAYQSMIPTTTGAAKAVTLVIPELAGKMNGLAVRVPTPNVSLVDFVANLTKSTSKEGVNAALREAAEGKLKGYLEYTELPLVSRDFNGNSASSIVDGLSTMIIGERMVKVLAWYDNEWGYSNRIVDLVKLIVMKGL

SEQ ID NO: 53814 - protein, 202 aa, Gloeobacter violaceus PCC 7421
MSSHNLVTLVSWLAGDFSNREQAWDAPAFFSHIRLCMRPLPWQVFEGYGLYSEQADDYDWAHPYRIVVLNLVEQPDGIIECRNYALKDTAPYLGAAREAERARLHRLTPEQLEPLPGCTFLFKREGSLFRGRVRPGKGCRVFRKGRDTYLDGEATVSADYYKSIDRGRDLESDEQVWGSVSGPFHFTKQVDFAPEVLALARP

SEQ ID NO: 53815 - protein, 371 aa, Yersinia pestis CO92
MDYDLIVIGSGSVGSAAGYYASQAGLNVLMIDSAMPPHQAGSHHGETRIMRHAYGEGEKYVPLVLRAQALWDQLAAQTGEKLFQACGVINLGPDNSTFLQNVQRSAQQYDLPVETLNSTQIREKWPVFTVPDNYIAVFEPQSGYLRSELAVKTLIKAVTEAGCGILFNCPVTAIESHQAGVDVVTIDGTYSATKVVVTAGTWVKELLPTLPVTPVRKVFSWHQADGRYSEANHFPAFTVEMPDNILYYGFPAQNDALKLGKHHGGQLIESAAQRKPFGRYAEDGTEVFSFLRHFLPGVGVCLRGEACSYDMSPDEDFIIDTLPEDERVMVVSGLSGHGFKFATALGEVAALFAQDKPSPIDISAFSLARFR

SEQ ID NO: 53816 - protein, 333 aa, Nitrosospira sp. TCH711
MTIKVGINGFGRIGRMVFRAAVQNFPDIEVVAINDLLEPDYLAYMLQHDSVHGRFRGDVSIEDSTLIVNGKKIRLTAIKDPAELKWGEVGAEVVVESTGLFLTKESCQKHIAAGAKKVIMSAPSKDDTPMFVYGVNNDTYDGQAIISNASCTTNCLAPVAKVLNDTFGVKRGLMTTVHAATATQKTVDGPSNKDWRGGRGILENIIPSSTGAAKAVGKVIPELNTKLTGMAFRVPTSDVSVVDLTVELEKEASYEEICDAMKKASEGSMKGVLAYTDQKVVSTDFRGESATSIFDAEAGMALDGNFVKVVSWYDNEWGYSSKILEMVRVVASK

SEQ ID NO: 53817 - protein, 333 aa, Nitrosospira sp. TCH716
MTIKVGINGFGRIGRMVFRAAVQNFPDIEVVAINDLLEPDYLAYMLQHDSVHGRFKGDVSIEDSTLIVNGKKIRLTAIKDPAELKWGEVGAEVVVESTGLFLTKESCQKHIAAGAKKVIMSAPSKDDTPMFVYGVNNDTYDGQTIISNASCTTNCLAPVAKVLNDTFGVKRGLMTTVHAATATQKTVDGPSNKDWRGGRGILENIIPSSTGAAKAVGKVIPELNTKLTGMAFRVPTSDVSVVDLTVELEKEASYEEICDAMKKASEGSMNGVLAYTDQKVVSTDFRGESATSIFDAEAGMALDGNFVKVVSWYDNEWGYSSKILEMVRVVASK

SEQ ID NO: 53818 - protein, 479 aa, Desulfitobacterium hafniense DCB-2
MKKEIRESLFIDGEWQEAINKEVKGVINPATGKVFCEIGYGEVDDALSAVDAADRAFGAWSKTSVRERADILNRTADLLRQRADHIGLILAAESGKPVPQAVGEVKFSAEYFQWFAEEIRRPYGQSIPSDAANKRHHVYTQPAGVALCLSPWNFPVSIQARKLAPALAAGCTVVARGSEVAPLSLIELFKCLQDAGIPKGVANSIQGPAAVTTAAMMKHPAVRVVSFTGSTPVGRSLMRQAADGVIRLALELGGNAPFIVFADADIEKAVEGAMIAKFRNNGQSCIGANRFYVHERIYDKFTALFAEKILRMKIGNPTEEVDLDLGPMVNLKDKARIESLIREAEALGAKPLVPKAEVPAEGYYVPPVILENVPESAALAREELFAPVAPLFKFADENEVIEKANSSDMGLAAYVYTNDLSRSIRVTESLKFGIIGLNNALPSVAYAPMGGVKQSGIGREGARIGLEEFMDVKYVATEI

SEQ ID NO: 53819 - protein, 402 aa, Desulfitobacterium hafniense DCB-2
MKANIAIVQAGGPTSVLNASLAGFLEAAASSERYHHVLGFCNGIEGLIKNQVMHLEGLSKAQLDALKSQPGAVLGAGRYPLTPERLSKVCCNLQLREISQLVLVGGNGTMWAADQIAEACPDVQVVGIPKTVDNDLWGTDHSPGYLSAAKFIGEAVRSLALDLWAMRNFERVRVVEVMGRNVGWLAAAGSLAQTSLPDYPPLHFYLPEHPFELEKFFTKVDEHLHRHPCLLVIVSEGIRLADGSPVAEFEIGRCKVPGGAAQMLSSELRNRGIPSRSEVLGILQRANTWSVCERDRQEAIFLGKQAIGVLGQGKSKVMLGLPAQTVDFAEDSKAQWVDLKSVAGLERPVAPCYLTESGIDPSFTAWLQNKMGEPLAEANSALQVWKLAAEQLSSNPVNRQSR

SEQ ID NO: 53820 - protein, 213 aa, Zea mays
  misc_feature (80)..(80): Xaa can be any naturally occurring amino acid
  unsure (1)..(213): unsure at all Xaa locations
GLSLAESGGFVKAPGGAPANVACAIAKLGGSSAFVGKFGDDEFGHMLVNILKQNNVNSEGCLFDKHARTALAFVTLKHDXGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTT

SEQ ID NO: 53821 - protein, 316 aa, Oryza sativa (indica cultivar-group)
MSRTTPSSPLSRATPPRSPTAGGTPSRLAVAPPSPTTPQCAIPASPHTPGRGRAPPPATPRAPRPEITLRQPSSQAQQKQKRAPSAAARRPSRALRAIRALLRSLPFVAPAACRPSSALPRRHNRPHDGHAAAGARVTGTFYGHRRARITLAVQERPGSLPSLVLELGVPTAKLMQEISTGGGHVRVALECEKRPKKLPSAPPEQASVSLLEETMWTAYVNGRRVGYAVRREASEGDLAVMQLLSTVSVGAGVLPGDVLAEPAGAEGDGEVTYMRAGFDRVAGSKDSESFYMVNPDGDAGAGAGGGTELSIFFVRV

SEQ ID NO: 53822 - protein, 260 aa, Azoarcus sp. EbN1
MAMTRSLEVKGQLVAGGKEPLICAPLVGRDEAAVLRELEVIVAKRPDLLEWRVDFYSGISDVERVVELAKEIRRSSAGIPVIFTRRSTREGGEPIGLSEDEVLSMYRAVARSGAVDFLDYELSSQPEHFEQAVALARETDTKLIASFHDFGKTPPVDEIVAKLVAMEEAGADIAKVAVMPQGLEDVLTLLQATLEAQKKIRLPVISMSMGAYGSLSRLFGWVFGSSVSFAVGQQASAPGQVPIEDLRTVLEVLQRSLKGE

SEQ ID NO: 53823 - protein, 455 aa, Debaryomyces hansenii CBS767
MVLPHEPEFQQAYNELVSALEDSTLFTEKPEYKKVIPVVSVPERIIQFRVAWENDNGDVEVNNGYRVQFNSALGPFKGGLRFHPSVNLSILKFLGFEQIFKNALTGLSMGGGKGGCDFNPKGRTDSEIRRFCVAFMRQLARYIGSDTDVPAGDIGVGSREVGYMFGAYKQMQNNWSGILTGKGLSWGGSLIRPEATGYGVVYFVEKMIEKATGGKESFKGKRVAISGSGNVAQYAALKVIELGSTVVSLSDSKGCIISQTGITPDQIKAIAAAKIHFKTLEEITKESASLFSGSNEVQYIAGVRPWTHCGQVDVALPSATQNEVSGEEAKALVEAGCKFIAEGSNMGSTKEAIDVFEANRSKAVWYAPGKAANCGGVAVSGLEMAQNSQRVTWAAEEVDEKLKNIMYTCFDNCYANAAKYSAEKDAENLPSLLKGANITGFIKVADAMFDQGEVF

SEQ ID NO: 53824 - protein, 210 aa, Petunia integrifolia subsp. inflata
MSAIVEPISPNKAQLIIDQQETMKMVRSSDGIEQEEEENKCNSPMNEEKDKDDERLSKEQPGSVDDSAVREDKDAEVQEPRLYIICPDRPDLELSEPFISTPKACLFTLKEGSRYKLKFSFTVSNNVVSGLKYINTTWKSGVRVDKSEVMLGTFSPRKEPYVYELEEDVTPSGVFARGLYSARTQVIDEKGTCYVDIKYYFDIQKQWLQL

SEQ ID NO: 53825 - protein, 505 aa, Arabidopsis lyrata subsp. lyrata
GLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARNLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRDADFFVVPTGSHFYLRVKVKDSGAGINPQDIPKLFTKFAQTQSLATRSSGGSGLGLAISKRFVNLMEGNIWIESDGLGKGCTAIFDVKLGISERSNESKQSGIPKVPAIPRHSSFTGLKVLVMDENGVSRMVTKGLLVHLGCEVTTVSSNEECLRVVSHEHKVVFMDVCLPGVENYQIALRIHEKFTKQRHQRPLLVALT

SEQ ID NO: 53826 - protein, 98 aa, Oryza sativa (japonica cultivar-group)
MYRGRFASSELMTIAGGFVSSLLFLFLLTFIGNYQEANGVKTGWGAVVVAELTALIVAGTVHRVCITTCFLFSAGFLYEVDKLSGMILAKSESKARRH

SEQ ID NO: 53827 - protein, 132 aa, Arabidopsis lyrata subsp. lyrata
AVSRLGGRSAFVGKLGDDEFGHMLAGILRKNGVDDQGINFDTGARTALAFVTLRADGDREFMFYRNPSADMLLRPDELNLDLIRSAKVFHYGSISLIVEPCRSAHLKAMEVAKEAGALLSYDPNLREPLWPS

SEQ ID NO: 53828 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTPIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 53829 - protein, 287 aa, Arabidopsis thaliana
LGEKTPMKEEDANQKKTENESTGGDAAGGNNKGDKGIASYWGVEPNKITKEDGSEWKWNCFRPWETYKADITIDLKKHHVPTTFLDRIAYWTVKSLRWPTDLFFQRRYGCRAMMLETVAAVPGMVGGMLLHCKSLRRFEQSGGWIKALLEEAENERMHLMTFMEVAKPKWYERALVITVQGVFFNAYFLGYLISPKFAHRMVGYLEEEAIHSYTEFLKELDKGNIENVPAPAIAIDYWRLPADATLRDVVMVVRADEAHHRDVNHFASDIHYQGRELKEAPAPIGYH

SEQ ID NO: 53830 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTSSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPENDKMVTPPHELVDTCNPRIYPDFTWPMLLEFTQKHYRADMKTLEVFTNWLHQRSFS

SEQ ID NO: 53831 - protein, 516 aa, Triticum aestivum
TRARSGHGRSIKVFHEKAEPIFKLAGFHMEVVKTTHAGHAKSLASTFDFGAFPDGIVCVGGDGIVNEVFNGLLTRSDRTEAVSIPVGIIPAGSDNSLIWTVLGVKDPISASLLIVKGGFTTLDILAVEWLQSGLIHFGTTVSYYGFVSDVLELSEKYQKRFGPLRYFVAGVLKFLCLPSYFYELEYLPLSKDMSGHGKGTGQDKVELSDVYTDVMRSRSKREGFPRASSFSSIDSIMTPSRMSLGDFDTSGGTAASSEPSEYVRGLDPKAKRQSMGRSNIVSEPEEVLRPQQHHASYWPRTRSKTRTDRNSVGVTASNDTRLSWAAPSMHDKEDISSTISDPGPIWDNEPKWDTGPRWDTEPTWEPDHPIELPEPPEDIEIGTSMELVPNLDEKWVVRKGHFLGVLVCNHSCKTVQSSQIVAPNASHDDNSLDLLLVGGRGRWKLLRFFILLQFGRHLSLPYVEYVKVKSVKVKPGANTHNGCGIDGELCRVKGQVVCSMLPEQCRLIGRQCKQSI

SEQ ID NO: 53832 - protein, 1075 aa, Ehrlichia ruminantium str. Welgevonden
MPKRTDIESILVIGAGPIVIGQGCEFDYSGTQACKTLKKEGYRIILINSNPATIMTDPEIADSTYIEPITTHILEKIIIKEKPSAILPTVGGQTALNAAISLCNTGILEQYNVKLIGATKEAIKKAEDRNLFRQAMDRIGVKYPKSIIIRSVDEINYALEYIGLPAIIRPSFTLGGIGGGISYNKEEFQKNIEYGLNISPISEVQVDESIIGWKEFEMEVMRDNKDNCIVVCSIENLDPMGVHTGDSITVAPALTLRDVEYQKMRDISFSILREIGVDTGGSNVQFAVNPKNNDILVIEMNPRVSRSSALASKATGYPIAKIAAKLAVGYSLNEIQNDCTQAIPASFEPSIDYIVTKIPRFNFDKFRGTDKELSTCMKSVGEVMALGRSFPESLQKALCSLEIGCCGLNEFFDDNVEIDQIYNALVKLSPERIFIIADALRRNISIEEINKITGYDKWFLMQIQNIIHHEQDIKKYGLPKDAEKLLLLKKMGFSDERLAHLSNNTVEYIEHFRNSLCIKPVYKHIDTCAGEFETSTSYMYSCYEGNTFSKTECESFITNNKKVIILGSGPNRIGQGIEFDYTCVHAAHTIKDMGYESIMINCNPETVSTDYDTSSKLYFSPLTREHVLDIIYKEQETSSLLGVIVQFGGQTPLKLAKVLHQKNIRILGTSFDSIDLAEDRMKFQQLLMQLNIKQPPNITYNSKDELLKNIETLDFPILVRPSYVLGGQSMSIIRDNNALLNYLTIHKNIFDHGSLLLDQFLTNAVEVDVDAICDGKDTYIAGIMEHIEEAGVHSGDSACSLPAYTLTKETIDTIANYTKKISLALNVQGFINIQYAIHNNEIYILEVNPRASRTVPFIAKATGIPIAKIATEILLGKKLPKNLERKFNHVAVKEAVFSFSRFPNIDVLLGPEMKSTGEVMGIDQSFEIAFAKAQMAAGYELPIEGAAFISVKDSDKPLILETAKILKDIGFTIFSTTGTSIFLNKAGIITQHVNKVREGRPHILDLLQDGKINLVINTSEGIKSFSESSSIRKTALIKKIPYSTTIPGAKAIALAIRTLKKQGVQVIPMQEYIIQ

SEQ ID NO: 53833 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKDDKMVTPPHELVDTCNPRIYPDFTWPMLLEFTQKHYRADMKTLEVFTNWLHQRSLS

SEQ ID NO: 53834 - protein, 321 aa, Aquifex aeolicus VF5
MRIGILTAGGDAPGMNAVIRAVVRSAEREGHEVIGIKRGYKGLIEGDFIKLTSRDVGGILDRGGTILLSSRDPRYKKLEYREKAYKNLNEQGIEALIILGGEGTLAGAKLTAEETGIPVIGVPCTIDNDVGGTEYCIGYDTALRNAVDAIDKIRDTASSHERIFIVEVMGRNRGFIAVEAGLATGAELILIPEERFPREQIPEEIEKAKKLGKLHFIIVLAEGYCRAKELEDFLLEKIGDKYGEIRSTVLGHIQRGGIPTHFDRIMGTKFGVVAYESLIAGERSGFVAYEKGKFYIEDFEKAQEYKPIDREAYKLNTRLAI

SEQ ID NO: 53835 - protein, 385 aa, Populus tremula
MAIDCIKSMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKFPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 53836 - protein, 411 aa, Rickettsia sp. DnS28
DSEFAELKIRGKIFKLPILKASIGEDVIDISRVSAEADCFTYDPGFMSTASCQSTITYIDGDKGILRHRGYDIKDLAEKSDFLEVAYLLIYGKLPSGEQYNNFTKQVAHHSLVNERLHYLFQTFCSSSHPMAIMLAAVGSLSAFYPDLLNFKEADYELIAIRMIAKIPTIAAMSYKYSIGQPFIYPDNSLDFTENFLHMMFATPCTKYKVNPIIKNALNKIFILHADHEQNASTSTVRIAGSSGANPFACISTGIASLWGPAHGGANEAVINMLKEIGSSKYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFAIARTIGWMAQWKEMHEDPEQKISRPR

SEQ ID NO: 53837 - protein, 203 aa, Gloeobacter violaceus PCC 7421
MTTAPSEDLLTLARWMAGDFSNQKQALAQPQTFAHIRVFFRPLPFAFFGTVGFYSEQTYDYDLWSPYRQGLHRLLDREGGIYIENYGLQDAGLYAGAGHDPEILATIPTDCLQPRRGCAMVFRREGDCFRGSVEPGNHCLIPRDGYWTYLVSEVELTESTWVSLDRGMDRETHRQIWGSQAGPLHFEKREGFDPPLPPLGKGG

SEQ ID NO: 53838 - protein, 411 aa, Rickettsia sp. DnS14
DSEFAELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELIAIRMIAKIPTIAAMSYKYSIGQPFIYPDNSLDFTENFLHMMFATPCTKYKVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFAIARTIGWMAQWKEMHEDPEQKISRPR

SEQ ID NO: 53839 - protein, 147 aa, Triticum aestivum
  misc_feature (56)..(56): Xaa can be any naturally occurring amino acid
  misc_feature (68)..(68): Xaa can be any naturally occurring amino acid
  misc_feature (71)..(71): Xaa can be any naturally occurring amino acid
  misc_feature (76)..(76): Xaa can be any naturally occurring amino acid
  misc_feature (78)..(78): Xaa can be any naturally occurring amino acid
  misc_feature (81)..(82): Xaa can be any naturally occurring amino acid
  misc_feature (88)..(88): Xaa can be any naturally occurring amino acid
  misc_feature (94)..(94): Xaa can be any naturally occurring amino acid
  misc_feature (98)..(98): Xaa can be any naturally occurring amino acid
  misc_feature (100)..(100): Xaa can be any naturally occurring amino acid
  misc_feature (102)..(102): Xaa can be any naturally occurring amino acid
  misc_feature (110)..(110): Xaa can be any naturally occurring amino acid
  misc_feature (114)..(114): Xaa can be any naturally occurring amino acid
  misc_feature (127)..(127): Xaa can be any naturally occurring amino acid
  unsure (1)..(147): unsure at all Xaa locations
MAAAAAMMVSGGRAALAVAGVLCAVAAMAAAQQASNVRATYHLYNPAQNGWDLNRXSAYCATWDADKXLSXRQKHXWXTAXXRPAGQXGQAACXKCIXVXNXSTGASNLXKILXNATTAAGLDYKTXFKKLTQRQGYKMALSNTIVK

SEQ ID NO: 53840 - protein, 452 aa, Oryza sativa (japonica cultivar-group)
MPVAGGAFSYLRVTFGELAAFLTGANLIMEYVFSNAAVARSFTAYLGTAVGVDAPSKWRIAVPGLPKGFNEVDLIAVGVILLISVCICYSTKESSVVNMVLTAVHVAFILFIIVMGFWRGDTRNLTRPVDLAHNPGGFFPHGAAGVFNGAAMVYLSYIGYDAVSTMAEEVERPSRDIPVGVSGSVVLVTLLYCLMAASMSMLLPYDAIDTEAPFSGAFKGSSGWGWVSNVIGAGASLGILTSLMVAMLGQARYLCVIGRSGVMPAWLAKVHPCTATPVNASAFLGVFTAALALFTELDVLLNLVSIGTLFVFYMVANAVVYRRYVAADDDDADHRRAWPTLVFLAAFSLVALCFTLLWQFAPAGRARTGLLAACGAAAVATVGAFRALVAEARRPELWGVPAMPWVPAASVFLNVFLLGSLDRPSYVRFGFFTAAAVLVYVLYSVHARRLGV

SEQ ID NO: 53841 - protein, 371 aa, Aspergillus nidulans FGSC A4
MPSSKQWILANKPTDLPTLSGPTPTFKLTSADVPKPSSSQALVKTLMLSNDPAQRTWIVPNADPERLYLPPVQEGSPMSAFALAEVVESGSPNELPVGSLVLCPTNWTEYSVHEIKTLQKIQPIEGLDLGHFLGALGMTAVTAYYGIKEVAGTTKDDTVVVSGAAGATGSMVVQIAKKIIGCKRVIGIAGTDDKCRWVETLGADVCINYKKDSFEQDLIKETEGFVEVYFDNVGGNILDLMLTRMKRHGRIAACADDKQEVISMRLHIRGFIVLDYYHKFSDVIAELTQAWKEGKIVVDESMQTVVEAKFEDIPNVWMKLFEGGNTGKLCTKIVSRRHRVRRGKEKRQVLIIIAATGCLNLWSPINVKSMA

SEQ ID NO: 53842 - protein, 266 aa, Corynebacterium glutamicum ATCC 13032
MALPLPSKSARALVTGASQGIGLAIAKDLARYGHNLILVARREDVLKEIAADLEKKHGVIVEVRPVDLSDEPARKVLIDEIKTREINIIINSAGIASFGPFKDQDWSYETAQFSLNATAVFELTHAVLGGMIDRGTGAICNVGSAAGNVPIPNNATYVLTKAGVNAFTEAMHYELRGTGVACTLLAPGPVREAEIPESEKSIVDKVVPDFLWTTYESCSAETLRALSKNQRRVVPGPLSKAMNFVSSVAPTAVLSPVMGWVYKKMG

SEQ ID NO: 53843 - protein, 1612 aa, Debaryomyces hansenii CBS767
MYDDPESIANMGMPPSTQNRIASDGVIYSNQHMSGYMMHPNRNNEFIPHKDNLDNCIDERKLSLPYPSNDNFGTLLQDETSTPNKQNIQVTTNNSSSPIQSDHKDLKSFSFSEQNDSIQEFQVSPIKEDPPRLSRRAFDGFPRDEVSNENSRSARPYSPAPNSSGSDNSNAIGLIIGGYDYSKSSLELASKDNNNNFHNDRKSNTLIQRDDDPTGQFCLTNNPLQSNEVDINVKVHNRNSSESSTVSNTSTTSTITPSTISKGKRFVRYAMNTQSKSSMTNTSTKWHILNVLKWLDYYGFNSSWQETFRRNEISGNRFLELCNYEVDSMIWKQFSKYLVLDNENNSIERFIELLKGHLSTSEPVDDYNANKEYQMQSHSRKGSNESHLSPVLPNSTAENRKSVPIFHKRKSVSISAAYGSSSLNNNIASSGNQRPVSYVDIGSQKPSKDLQSHHKFFRKSKSSYSDIPQTYTGINNISIAPSNNQNISGHRKSNSRTSLSLNDDFIVDSNKIKYTGAPLLKTSSLQNFPTPNNEAIPATTYGRKSGLFSTLKKYSSDKAVGIVKQVQNTSSSSATKTSGINKSNSKNVVSPVSPVEFRELLLPKAKQNITQSNAEQESTNTTTMDDINTRSIAMSSDETLPSPLMNSSAKVINFNNNTYIDLIKKADLLDNLDEKYLPTLHDSFVDKKMILASKDNKHFTPINLTREEIRNIELIRNRVIQELELIDVGIITFHLTEFNSTEGIALKDDVLLDVIRTDILVKLFVNQELTSDTTTTFSTTSSDSKSFELIGENNDERSYPSTPQYLLQNARDPKVDYWNFKDTNNDKLSSISEINSTRAGRKSPSNPQFSMKLHLPENKKFSQDSKPPSLLINTTQIDNSLPSLSPNSSKLSDSHNSFKILRKEGREIDFDKRRKSPYESKAPKLIPNIYSSSVSNPSKSPISATTIATLKDENVESNHNKLSPSISSGSMDRDKSGSIVAKRIAPPPPLDRKLSVIGSHSLKKASILPSISTLSKTLSYSSRSPSGSERSMGSRKAFNKRKGSTSSKNSFVTDDSFAFRENDVSFDDVPTVQRDNNASSDDEDFFVKPIKNQKSNVNDDDNESDEDFFMKPIRSPDSEAPKETLKRRTLTDPISIKMNVRPPVEEVYRNLEKYFPNTNLDKPIIDDSPVSPVNKHQPSIEASNAIPMRKPTISRTFSNANMSPVHPKLDSGDEILYAENQEPTLSRRRMKTIRVVANEARKKRLERQNSPQAGRSLESSYCNTPNSGNFNSLNRTNTKLWGQKVVEVTSTEIEKGFVSKLKNGKHGEFEEFAWIKGELIGRGSFGAVYLALNVTTGEMLAVKQVIVPNDFQNGSPKVSEGIDALHKEVETMKDLDHLNIVQYLGFEQKKNIYSLFLEYVAGGSIASCMKSFGRFEEPLIKFIIKQVLLGLEYLHSNGILHRDLKADNLLLEIDGTCKISDFGISKKSKDIYVNNAEMSMQGTVFWMAPEVIDSIVADKKQGYSAKVDIWSLGCVVLEMFAGKRPWSNEAVVSAIYKIGKTKLAPPIPDDITHLISDEARSFIGRCFTIDPEERPTARDLLGDPFISNESKFSFETTRLAQMIKDNYKKYNI

SEQ ID NO: 53844 - protein, 148 aa, Oryza sativa (japonica cultivar-group)
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIREISDELCKGSVKIAVV

SEQ ID NO: 53845 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYQAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 53846 - protein, 397 aa, Bordetella bronchiseptica RB50
MLVHIPTIAMIRSKLPDVGTTIFTVMSRLAIEHKAINLGQGFPDFDPDPELCALVGKAMAAGHNQYPYMPGVAPLREAIAAKVKTLYGHAYDPETEITVTSGATEALMATVLAAVGPGDEVVVIEPCYDSYLPAIRLAGGTAVPVPLRAPTRDDPYYRIDWQRVRDAIGARTRLLMLNFPHNPTGAVLDESDLDALESIVRETGVLLLSDEVYEHIVFDGKPHASLSRRPLLAEHAFVISSFGKTYHTTGWKVGYCCAPRQLSAELRKVHQFMVFTVSSPMQFALAEYMANPKPYLDLPAFYQAKRDRLAAGLANTRFRPLPSPGTFFMLADYSEITKHAEADFARHLTIDHGVTVIPVSAFYQNPAAPESNHHLVRFCFAKQDATLDAAIERLAHV

SEQ ID NO: 53847 - protein, 109 aa, Kineococcus radiotolerans SRS30216
MTTLSTHVLDAVTGTAAVGVSLTLTGPGGEVLTRAGTDADGRARLDADLGAGVHRLTFATGEWFAAAGRETFHPEVVVAFTVTPGADARPHLHVPLLLSPFAYSTYRGS

SEQ ID NO: 53848 - protein, 385 aa, Populus tremula
MTIDCIKTMPSITAPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 53849 - protein, 853 aa, Pseudomonas sp. G-179
MSSPHTWFSNRQLQKRRCRMTAELTRRDVLKAQAAAIAASTAGIAMPAAAQSVPGGVAALEIKWSKAPCRFCGTGCGVMVGVKENHVVATHGDMEAEVNRGLNCVKGYFLSKIMYGKDRLTTPLLRKRNGVFDKEGEFEPVTWEEAFDIMAEKAKKTLKEKGPTALGMFGSGQWTIFEGYAATKLMRAGFRSNNLDPNARHCMASAAYGFMRTFGMDEPMGCYDDFEHADAFVLWGSNMAEMHPILWTRLADRRLGHEHVKVSVLSTFTHRSMDLADIPLVFKPGTDLAILNYIANHIIQTGRVNQEFIDKNTKFMQATTDIGYGLRAEHPLEVKATGAAKAAEMTPIDFEAFKKHVSEYTLEKVAELAGVDKGFLEQLAELYADPKVKVMSLWTMGFNQHVRGVWANQMVYNIHLLTGKISEPGNSPFSLTGQPSACGTAREVGTFAHRLPADMTVTNPEHRKHAEELWNIPHGIIPEKPGYHAVQQDRMLHDGKLNFYWVQVNNNMQAAANNSNEAYIGYRNPDNFIVVSDAYPTVTAMTADLILPAAMWVEKEGAYGNAERRTHVWHQLVNAPGEARSDLWQLVEFSKRFTTDEVWPQDILDQNPEYKGKTLYDVLFQNGNVDKFPVSEISSDYENREAKAFGFYLQKGLFEEYASFGRGHGHDLGPYDLYHQVRGLRWPVVNNQETKWRYREGYDPYVKEGEGVKFYGQNDGRAVILAAPYEPPAESPDDEFGFWLVTGRVLEHWHSGSMTMRVPELYKAFPGARCFMNGDDARRLGINQGGQVKIQSRRGEIISRVDIRGRNRMPHGVIFVPWFDASQLINKVTLDATDPISKQTDFKKCAVKILPVA

SEQ ID NO: 53850 - protein, 167 aa, Triticum aestivum
VSFHTCYLHSYEHSCCTRVFLESNEGDPELLVFIPFTSDVKIKSIAVVGGADGTSPSRMRAFINREGIDFSDAQNMQPVQEWELAENLQGVLEYQTRYSRFQGVANLTLHFPDNFGGDTTKIYYIGLRGEATQNKRDVVATIVYEVMPNPSDHKTKSETGGGFSHVE

SEQ ID NO: 53851 - protein, 431 aa, Vibrio fischeri ES114
MTKSAELFAKAQDKIPGGVNSPVRAFAGVGGSPIFVERADGPLIFDADGKAYIDYVGSWGPMILGHNHAAIREAVISAAQRGLSFGAPTETEITMAELVSELVPSMEQVRMVSSGTEATMSAIRLARGYTGRDKIMKFEGCYHGHADSLLVKAGSGALTLGQPSSPGVPADFAKYTLTATFNDLDSVRELFAVNKGEIACIIVEPVAGNMNCIPPVEGFHEGLRQICDEEGALLIFDEVMTGFRVAENCAQGYYNIKPDLTTLGKVIGGGMPVGAFGGRKEVMQYIAPTGPVYQAGTLSGNPVAMAAGFACLKVLTEEGNEKRLADTTRHLANGFKELANKHGIPMVVNQVGGMFGFFFTDQETVTSYADVAKCDIERFKRFFHLMLKKGVYLAPSAFEASFTSLAHGPKEIEATLEAADQCFAIIASEAK

SEQ ID NO: 53852 - protein, 346 aa, Burkholderia sp. 383
MAQQETGTATQPMTMIQALRSAMDVMLGRDSDVVVFGQDVGYFGGVFRCTEGLQNKYGKSRVFDAPISESGIVGAAVGMGAYGLRPVCEIQFADYFYPASDQIVSEGARLRYRSAGQFIAPMTIRMPCGGGIYGGQTHSQSPEAMFTQVCGLRTVMPSNPYDAKGLLIASIENDDPVIFLEPKRLYNGPFDGHHDRPVTSWLKHPASAVPEGYYTVPLDTAAVVRPGNDVTVLTYGTTVHVSLAAAEETGIDAEVIDLRTLWPLDLDTIVASVRKTGRCVVVHEATRTCGYGAELVALVQEHCFYHLEAPVERTTGWDTPYPHAQEWAYFPGPARVGEALRRVMEA

SEQ ID NO: 53853 - protein, 87 aa, Lithachne pauciflora
KPSMVVHQPRVDIGGDDMRTFYTLVMVDPDAPSPSDPTLREYLHWLVTDIPGTTGAAFGQEVMCYEPPRPSMGIHRFVLVLFQQLGR

SEQ ID NO: 53854 - protein, 463 aa, Burkholderia sp. 383
MKNEHTTLLVIGGGPGGYVAAIRAGQLGIPTVLVERDRLGGTCLNIGCIPSKALIHVADAFEQARGHAGEGALGIRVRTPEIDIGKSVAWKDGIVDRLTRGVGALLKKNGVRVLHGDAQVVDGKTVDVVAGGHTTRISCEHLLLATGSEPVALPSMPFGGHVVSSTEALSPETLPKRLVVVGAGYIGLELGIVYRKLGVDVSVVEAAERVLPAYDAELVRPVADSLARLGVRLLLGHKVLGPAEHGAVRVQAADGAEQTLQADRVLVAVGRRPRVDGFGLESLPLDRNGRALWIDDECRTSMRNVWAIGDVAGEPMLAHRAMAQGEMVAELIAGKRRKFMPASIPAVCFTDPEIVTAGWSPDDARAADVDCVSASFPFAANGRAMTLQATDGFVRVVARRDNHLIVGWQAVGRGVSELAAAFSQSLEMGARLEDIGGTIHAHPTLGEALQEAALRALGHALHV

SEQ ID NO: 53855 - protein, 510 aa, Arabidopsis thaliana
MATIWFLPLLFLSCLLLAALRLKKRRQHQRKPPSPPGFPIIGNLHQLGELPHQSLWSLSKKYGPVMLLKFGSIPTVVVSSSETAKQALKIHDLNCCSRPSLAGLKQKSYDYLGPRALSYNYLDIVFSPFNDYWKELRRMCVQELFSPKQVHLIQPIREEEVKKLMNSFSESAAQKTPVNLSEKLASLTVGVICKAAFGVSFQGTVLNSDNFDKLIHDAFLFLGSFSASDYFPNVGWIIDWLTGLQGQRERSVRGLDAFYEQMFDLHKQGNKEGVEDFVDLLLKLEKEETVLGYGKLTRNHIKAVLMNVLLGGIGTSAITMTWAMTELMRNPRVMKKVQSEIRNQIGGKSMICLDDIDQLHYLKMVINETWRLHPPAPLLVPREVMSEFEINGYTIPAKTRLYVNVWGIGRDPDTWKDPEEFLPERFVNSNIDAKGQNFELLPFGSGRRMCPAMYMGTTMVEFGLANLLYHFDWKLPEGMVVEDIDMEESPGLNASKKNELVLVPRKYLNL

SEQ ID NO: 53856 - protein, 530 aa, Mycobacterium sp. JLS
MTTTSATTTASDAASPAAQVLPTADELRDRVRTAFDAIGATAHLAAPGDGGLPASTPITGEVLFTVEESSPAQTEAAIEAAADAFGQWRTTPAPVRGALVARLGELLVEHKAALASLVTVEAGKITSEALGEVQEMIDICQFAVGLSRQLYGRTIASERPGHRLMETWHPLGVVGVITAFNFPVAVWSWNTAVALVCGDTVVWKPSELTPLTAIACQALLQRAAADVGAPSAVGQLVLGGRDVGETLVDDPRVALLSATGSVRMGQQVGPRVAQRFGRALLELGGNNAAIVTPSADLDLAVRAIVFSAAGTAGQRCTTLRRLIVHRSVADDLVERIVAAYRQLPVGDPAADGTLIGPLIHETAYRDMVAALETARADGGEVTGGERRIFEGDSGDMSFYVTPAVVRMPSQTAVVHAETFAPILYVLTYDDDLGEAISLNNAVPQGLSSAIFTLDVREAEQFMAADGSDCGIANVNIGTSGAEIGGAFGGEKQTGGGRESGSDAWKAYMRRATNTVNYSAELPLAQGVHFG

SEQ ID NO: 53857 - protein, 389 aa, Glycine max
RAGSFFNWFYFSINIGALVSSTFIVWIQENAGWGLGFGIPALFMALAIGSFFLGTPLYRFQKPGGSPITRMCQVVVASVWKRNLVVPEDSNLLYETPDKSSAIEGSRKLGHSDELKCLDRAAVVSDAESKSGDYSNQWRLCTVTQVEELKILIRMFPVWATGIVFAAVYAQMSTLFVEQGTMMNTNFGSFRIPPASLSSFDVISVIFWVPVYDRIIVPIARKFTGKERGFSELQRMGIGLFISVLCMSAAAIVEIVRLKVAKEHGLVDEPVPVPLNIFWQIPQYFLLGAAEVFTFVGQLEFFYDQSPDAMRSLCSALSLLTTSLGNYLSSFILTVVTYFTTQGGNPGWIPDNLNKGHLDYFFWLLAGLSFLNTFVYIVAAKRYKQKKSA

SEQ ID NO: 53858 - protein, 220 aa, Brassica napus
MSGNQEPILVKEEESVEGIPSPLLKLKSWQWWVLVSTNILFLIGGQAASVLLGRFYYDEGGNSKWMATLVQTAAFPILYIPLLLLPSSEPASCSLKTIVLIYVLLGVIIAGDNMLYSVGLLYLSASTYSLICATQLAFNAVFSYFINAQKFTALILNSVVLLSFSAALIALNDDADAPSGVSRSKYVVGFVCTLAAYALYSLLLSLLQFFFEKILKKETF

SEQ ID NO: 53859 - protein, 413 aa, Corynebacterium glutamicum ATCC 13032
MLTMPIPEYLHEILDDVRDTTSGELADYIPELKSADPNPLAVALCTVNGHIYSAGDDDIEFTMQSISKPFAYALALQECGFDEVSASVALEPSGEAFNELSLDGENRPMNPMINAGAIAINQLINGSDSTVEDRVEKIRHYFSELAGRELTIDRVLAESELAGADRNLSIAHMLRNYGVIEDEAHDAVLSYTLQCAIKVTTRDLAVMTATLAAGGTHPITGKKLLDARVCRLTLSVMASAGMYDEAGQWLSTVGIPAKSGVAGGLIGILPGQLGIATFSPRLNPKGNSVRGVKIFKQLSDDMGLHLMSTEQVSGHAVRSITRDGDTTFIQMQGAMNFSASESFLHAIVEHNFEGTEVVLDLTRVLSFHPVAIRMIKEGLKRIRDAGFEVFILDPDDVLPDFMFSDGTICKERV

SEQ ID NO: 53860 - protein, 486 aa, Aspergillus nidulans FGSC A4
MSKRSADASEDAAALKAGERPLADAPPDDMGEFEDEFEDEFESEDEILEAGVDGRPDAEREEEEKDQQTFIPGRTKLAPGEVLSPDPSTYDMLHTLSTPWPCLSFDIVRDTLGDNRKTYPATVYAVTGTQAEGRRAKENELMVLKLSGLGKMERENETDSESDSDDDEGGEAILEHKSIPLGSTANRIRAHQTPQSDITKPPQTITATMLENSQVVIHDVTPHLTSFDVPGTMLPPSASKPLSTLRMHKSEGYALDWSPLHPLGKLLTGDNDGLIYVTTRTEGGGWVTDTRAFRGHASSVEELQWSPNEKNVFASASSDGTVKVWDVRSKSRSPAVNVKISNTDVNVMTWSKQTSHLLATGADDGQWAVWDLRHWKPNPSSSAPITASPVASFNFHKEPITSIEWHPTDDSVIAVGSADNTVTLWDLAVELDEEESREAGLADVPPQLLFVHYMESVKEVHWQAQMPGTLMATGSGGFGVFKTISV

SEQ ID NO: 53861 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGHASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 53862 - protein, 167 aa, Corynebacterium glutamicum ATCC 13032
MSAAEGLHIVVMGVSGCGKSSVGKALAAELGIEYKDGDELHPQENIDKMASGQALDDDDRAWWLVQVGKWLRDRPSGVIACSALKRSYRDLLRTKCPGTVFVHLHGDYDLLLSRMKAREDHFMPSTLLDSQFATLEPLEDDEDGKVFDVAHTISELAAQSAEWVRNK

SEQ ID NO: 53863 - protein, 219 aa, Arabidopsis thaliana
MIPLPNLHAKNAGYLVNGEVKIVVEINDLEVIGKLDVSEESEETNQPLKKIKLDDNDAVSFDSLNETSPVKESIDVNGFQVLPSQVESVKCIFERHPDFASKFRPKNRHLKSTYMTVLLGLIKTLCQLPEELTDDDLDEASVAVSYVENGGLRLDWLEKKLAEVKAKKKKVETGKARLQRAEEELQKLNQKCLELKAFLEKENADVSEANVPLSFEDVV

SEQ ID NO: 53864 - protein, 425 aa, Glycine max
MFHWLFGIARNFGFVRGYQQGYIYQQKFSLVNIKLKWVKDRTLDAVVTGQRDLKAAGILVSIIYSSSECCLPIYHLSRHRGQLGLPSDLKLSTFIRRYPNIFNESSFLDSGGSPVPCFSLSPEALELHHEEVNILQQNQLELRDRLCKLLMLTSDRILPLQTIDQLKWDLGLPYDYQHSFVPNHPESFLYVRLPDDRIGLKLLFWDDKLAISELQKNTSLQQKAEDIKNGSLAFPISFTRGFGLKRKCMEWLKDWQKLPYTSPYINASHLDPRTDVSEKRIVGVFHELLHLTLHKQTERKNVSNLRRPLALPQKFTKVFERHPGIFYISKRSDTQTVVLREAYNGQEPVQNHALVQIREEFASLLKKGLLDRSKGVYKKSRHTNLVEGFRKEVCIAKKTNQLSSQDESDSMFSEYDSDGPPQNPC

SEQ ID NO: 53865 - protein, 477 aa, Triticum aestivum
  misc_feature (128)..(128): Xaa can be any naturally occurring amino acid
  misc_feature (144)..(144): Xaa can be any naturally occurring amino acid
  misc_feature (196)..(196): Xaa can be any naturally occurring amino acid
  misc_feature (208)..(208): Xaa can be any naturally occurring amino acid
  unsure (1)..(477): unsure at all Xaa locations
MDVPLASKTFPSPSPSKREQCNVDGHKSSSKHADLNPHANDSVLGIILGGGAGTRLYPLTKKRAKPAVPLGANYRLIDIPVSNCLNSNISKIYVLTQFNSASLNRHLSRAYGSNIGGYKNEGFVEVLXAAQQSPDNPDWFQGTXADAVRQYLWLFEEHNVMEYLILAGDHLYRMDYEKFIQAHRETDADITVAALXPMDEERATGIWXLMKIDEEGRIIEFAEKPKGEQLKAMMVDTTILGLDDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 53866 - protein, 218 aa, Gloeobacter violaceus PCC 7421
MAPHQFKSKGAPTLVHVREAARFDRDGLIPAVVQDVLDGTVLMVAWMNREALERTLETGESWFWSRSRQELWHKGATSGHRQKIKALRYDCDSDVLLLTVEQQGDIACHLGERSCFHRDEAGDYDLPPADTLSQVFRVVEERKAHPHPDSYTSRLLEAGSNKILKKIGEEATEVVMAAKDGERVAEEVADLWYHTLVLLAHADVDILDVYRALQQRRR

SEQ ID NO: 53867 - protein, 380 aa, Bradyrhizobium sp. BTAi1
MTERIREFLRNRREEGLDHEPCLVVDLDVVRDNYMNFAKALPDSRVFYAVKANPAPEVLSLLASLGSSFDTATVAEIEMALAAGATPDRISYGNTIKKERDIARAYALGIRLFAVDCAAEVEKISRAAPGAKVFCRILYDCAGAEWPLSRKFGCDPEMAVEVLDLAKRLGLEPCGISFHVGSQQRKVKAWDRALAMASTVFRDCAERGINLSMVNMGGGFPTKYLKDVPPVVQYGRSIFRALRKHFGNQIPETIIEPGRGMVGNAGIIESEVVLISRKSDEDELRWVYLDIGKFGGLAETMDESIRYAIRTPHDGADMTPCVLAGPTCDSADVMYEKLPYPLPVTLSIGDKVLIEGTGAYTSTYSSVAFNGIPPLKTYHI

SEQ ID NO: 53868 - protein, 235 aa, Triticum aestivum
  misc_feature (228)..(228): Xaa can be any naturally occurring amino acid
  unsure (1)..(235): unsure at all Xaa locations
TPPPGSTDLYFSKQYAQSFFTQCVACLWKQHKSYWRNPSYTATRIFFTTVIALIFGTIFLNLGQKVGKRQDLFNSLGSMYAAVIFIGIQNGQCVQPIVDVERTVFYREKAAGMYSALPYAFAQVFIEIPHVFLQTIIYGLIVYSLIGLDWAFMKFFWYMFFMFFTFLYFTFYGMMAVAMTPNSDIAAIVATAFYAVWNIFAGFLVPRSRIPIWWRWYSWACPVAWTLXYGLVASQ

SEQ ID NO: 53869 - protein, 195 aa, Fusarium oxysporum
MAEIRRKLVIVGDGACGKTCLLIVFSKGTFPEVYVPTVFENYVADVEVDGKHVELALWDTAGQEDYDRLRPLSYPDSHVILICFAVDSPDSLDNVQEKWISEVLHFCQGLPIILVGCKKDLRYDQKTIEELRKTSQKPVSPEEGEEVRKKIAAYKYLECSAKTNEGVREVFEHATRAALLSRSTSGSKHKKCLVL

SEQ ID NO: 53870 - protein, 518 aa, Fulvimarina pelagi HTCC2506
MAERYYLTTAISYPNGKPHIGHAYELIATDALARFKRLDGYDVFFLTGTDEHGIKMLQNARAQGLTPRELADANSAEFQRMSAALGGSNDDFIRTSEARHKIACQAIWKRMEEAGDIYKDAYSGWYSVRDEAYYGEDETHISEDGTRIGPQGTPVDWIEEESYFFRLSNFQDPLLKLYAENPDFIGPNERRNEVISFVKSGLRDLSISRTTFDWGIPVPGDEKHVMYVWVDALTNYLTATGYPEDGNGGRTEFWPADLHVIGKDITRFHTVYWPAFLMSAGLPLCKRVYAHGFLFNRGEKMSKSVGNVIDPFALVDTYGLDRLRYFLLREVPFGQDGNYSHDGIVNRTNSELANDLGNLAQRSLSMVAKHCEGRVPDPGAFTEADELILKAAGDLLAQCREAVEKQQLHQVLAAIIGVVSQANRYFAGEEPWALRKTDFDRMQTVLYVTAEVLRTVAILLQPFTPESAGKLLDILGVQEDDRGFDELTKGTRLAPGASLPAPKPIFPRFVEEEATAAS

SEQ ID NO: 53871 - protein, 546 aa, Actinobacillus pleuropneumoniae serovar 1 str. 4074
MQNINPTQTAAWSALEQHKADNLNIPQLFAEDANRFDKYHLNFEQQILVDFSKNAINQKTLELLRQLANECGLASATEAMFSGQKINRTENRAVLHTALRNRSNTPVLVDGKDVMPEVNAVLAKMKDFCERIISGSWKGYTGKAITDVINIGIGGSDLGPYMVTEALRPYKNHLNMHFVSNVDGTHIAEVLKKVNPETTLVLVASKTFTTQETMTNALTAREWLLAAEKDESAVAKHFAALSTNAKEVAKFGIDTANMFEFWDWVGGRYSLWSAIGLSIALSLGFENFEALLSGAHAMDNHFRTAPIEKNIPTTLALIGIWNSNFLGAETEALLPYDQYLHRFAAYFQQGNMESNGKFVGRDGSPVTHQTGPIVWGEPGTNGQHAFYQLIHQGTKLIPCDFIAPAQTHNPVGDHHAKLLSNFFAQTEALAFGKSKETVEAEFVAAGKNLADVAEIVPFKVFTGNKPTNSILVQKITPFTLGALIAMYEHKIFVQGVIFNIYSFDQWGVELGKQLANRILPELQNAEKISSHDSSTNGLINQFKAWR

SEQ ID NO: 53872 - protein, 222 aa, Glycine max
  misc_feature (185)..(185): Xaa can be any naturally occurring amino acid
  misc_feature (193)..(193): Xaa can be any naturally occurring amino acid
  misc_feature (204)..(205): Xaa can be any naturally occurring amino acid
  misc_feature (214)..(214): Xaa can be any naturally occurring amino acid
  unsure (1)..(222): unsure at all Xaa locations
ILGRGWAGLFRKFLVEPGEMWWPSNLVQVSLFSALHEKSKRPKGGTTRTQFFLLVLVSGLAYYVFPGYLFSMLTSFSWMCWLAPKSVLVQQLGSGLRGLGIAAFGIDWSTISAYLGSPLASPWFATANIAVGFFLVMYVMTPIAYWSNAYEAKTFPIFSSKLFMGNGSLYDISTIVNSEFHLDRXAYSIKRPXHLSTFFCMTYXXSIAALSATXCACLLFHG

SEQ ID NO: 53873 - protein, 470 aa, Vibrio fischeri ES114
MIQFGTGGWRAFIGEEFTKDNVRLVAQALSNIMINEQVQNKGFVIGYDRRFLSDKAGKWFAEVVAANGIKVSFIDKFVPTPIVMFQTKEMGCIYSACITASHNPADYNGVKVFIEGGRDADEIITQKIEQQIAHLTQQDVNALEFEEAVTAGKIEIINPMNAFVDSIIDFIDIESIKKANLRVLIDPMFGVAKNALQTVLINGRCDVDVINDGENPAFGGLMPSPSAATLYRLKHLVAHEGYDIGIGTDGDADRLGIIDEKGNFIHPNEVLILLYYYLLEYKGWKGSVVRNIATTHLLDKVAADHGEKCFEVPVGFKHISSQMEADDSLIGGESSGGLTIRGHIKGKDGVFASSLLVEMISVTGKKLSEMLDEIYAKYGYAYTAEGDCTFKPAEKETLYNKIYVEKQLPEFEYEIEKVSYEDGAKVYFKNGGWVIARFSGTEPLLRIFAEMEDKPTAEKVLNEMKAFLSL

SEQ ID NO: 53874 - protein, 483 aa, Burkholderia sp. 383
MDEQLITGRLLIDGELVDSETGEWAASINPATEAVIGRAPAGSRRDVARAVDAAQRAWPAWAERTGEERGELLRGFGERLLERAEELSRIEVLDSGNTYVPTLASMHETVRSLRYYAGLVHGLHGETIPATGRNLHMTVYEPYGVVGRIAAFNHPAMFSAARTASALVTGNTVVVKPPETSPLSVLVLGEVARDTLPAGVFNIVNGTGAEVGDALVRHPDVKRLALIGSVATGQAIQRSAAEVGVKHVTLELGGKNPMIVFPDADPDAAADSAVRGMNFSWQGQSCGSNSRLLVHDDIYDDVLARVVERVAAIRVGDPMSPDTGMGPINSRKSYDHVMSFLDPAQTHGARLMTGGRRPPGHAFEKGFWVEPTVYADVTPGMRLWREEVFGPILSVARWRDVDEVVAMANDTEYGLSAAIWTNDIRQALNTARRIRAGSVFVNGSNTHFLGVPWGGFKNSGVDREEGIEEMYSYVEKKVINVML

SEQ ID NO: 53875 - protein, 173 aa, Stellaria longipes
MPSLKEKIHRSGSSSSSLSDDGGSRRRREGLGSPKKKGITEKIKEKFPGRYKNEYEAATPGLVVREITSTRSRTSTLQTRDSEKIKDKLPGSHNNEDVLLQETSTRSRTSILLQESRITPEEKKGVVGNVKDKLSGNRQARTSSSSSSTRTPLFMFHRAVQQAAREERTLRKN

SEQ ID NO: 53876 - protein, 2027 aa, Debaryomyces hansenii CBS767
MSFLRRDKSKNNIFNSFAAGQYNMSTNNPNNRETNEMNSNKFQEPPSPMTDNFEGSAMNTTTNQTGANSSAIGSENGANTRPKLDKKLSSNGVYPTSSSSSMSSNDRNEGQIFFNSKFSEHDDRIVLQGHHSQVQGNQAQGSQEQGNQVQQQQKMPVRNSSVGFNNEAMYSPRSSIVSLSTPPTQSNNNSELAVSSEQSHIKDNYKGFHANKRPKGLANIPPLAHPIKPRFRKKGSSLLGKLIYSSRKDSEGSQQSGELAPQHSIEVEPEMPEERDQQRRNSSGNNGGQTQVNKKSVSSAGSNSSKHKFRIPSISLDHHHHHHSHNDEPEETNQQPRAHSTSSAEIRYNNKGGDKKMPTSFDLDMDINEMQGIVKSPNQSSTHENKNPLSDIDAARSFTFNLTDTNSKVPLQQTSDNVNLLMQRSSSSVASSVPSGNVNTRQNVNRSGGGWRAPDSWDVKLNGPLGSAKGDNRSLSDSDNEDKMDDRISSADTSSTLSNSMNQLNDKPTNKLQNAQQVSPRKQNKKSDVRAETPKNSRSNLPVLYGSSNISHVVPTQSDSKSLTKGPNHIVRVFKEDNTFTTILCPLETTTAELLNIVQMKFFLESTTNYQISVYIGNCVKVLEPFERPLKIQMGLLMLSGYSDNDNLRIIGREDLSYICKFVVENIYLRNLTHEEEIMLSKDYVDVNISNSDLKNIPIIFHQHTYEIEKLNVSDNPSIYIPLDFIQSCTNLTSIIFSRNGCSKFPINFLEAKQLTHLNMEKNFLDDLPSKIGHLRNLTHLKLNSNQLSTLPKSFGKLQNLVSLNLSSNYLEAYPEAISELYNLADLDLSYNDLSYLPESIGKLTQLIKLNVSTNKLSKTLPLYITKLISLKRFDLRYNKLTNVDVLGSLPNLEVVYASKNNISTFNDEMESLRLLHFDRNPITDLTFDTLLPNLAVLDLSKAKITAIPPEFMHKISSIEKLVLDKNHLINLPNEIGNLTKLAYLSAYGNNLQVLPPSIDKLVSLQYLDLHSNNLQLLPNGIWDLKSLTYLNVSSNMLSTLPQPPLSVAKRISSTANFRQSPISGLSLESDSRRPSFQSVIESDSTNTPIEPTDAIAEVSSEGGPYEESSTSSVNFNNSSGSLADSLLVLVLADNRLDDDCFDSISFLVELKTLNLSYNDLLEIPEGAARRMTKLVELYLSGNELTSLPTDDLDNIKSLKLLYLNNNKFVSLPAELSKLVNLQHLDVGSNQLKYNISNWPYDWNWHWNKNLKYLNFSGNKRFEIKQSHMKNPDTGEDFDSLLVLKNLKVLGLIDVTLTTTSVPDHTIDMRIRTTASELDNIGYGVSDTMGMRDHVSSRDIFIQKFRGNENEVLICSIDGKSGSPNHTHRISALVKSLFVPNFTNELNKLKNEEGIQDAIRRTFLSLNKEINGILSAKKYNCFNPSSQISPEFADLNLRDDAAAGCAMSIVYIKEKKLYTANIGDVETLLSMSNGDHILLTNKHDPTNRTEFERIRASGGYVSGDGALDGDLAVSRGVGFFNYLPHTHSGPDISEIELTSADDMIIMATKVLWNYITFEIAVDILRQEKNDPMIAAQKLRDYAICYGATDKIAVIVITLGEKKSNKMKFGTKAFYNNLGQENDVFAKKRRDRSQLLVGDSTLRRLEEEIEPPEGILALAFTDIKNSTLLWDSYPVAMRSAIKIHNAIMRRQLRIVGGYEVKTEGDAFMVSFPSPTAALLWCFNVQQQLLKQDWPAEILETDHCCEVTDSKGEVIFRGLSVRMGIHWGSPVCELDYVTRRMDYFGPMVNRASRIMAIADGGQIAVSSDFLAEIRALYKIHEDVTSGATTLYDAYQGNVRGGEIIEREIRSIEEIKWSFFELGEKKLKGLETPELITLVYPKKLEVRFEIFQKRLFHIEDSQSSTRIVGTLPVYSIYGLRTVSLRLENICSCINGGVHVNEGFQMNSSDLISEKINSSFKESDLMGLLNHIVTRIENCAATLHLRQQMSLLGDKGGYIDFTQIQPISNVMDDLKNLIEQFEQYKMLQEGL

SEQ ID NO: 53877 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNEDDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 53878 - protein, 844 aa, Burkholderia vietnamiensis G4
MARRQRRADLHEPEQPVDRLRRAAVGARHLRQLLLGRDRRRRPRRRSDDERSVLPARRHAARGGVRRRRARGRGHREGQAAPAARLADERHLLFRREGRPGQSRGKRHRRRARLGRPAVTRRIQRGAVRIRVRGRRAAGADAAGRSDVPVDHRLRAAQVRARQRGRERVLRDDGPLSRATRRARLGDRAHGRPRDEREARSGHRPSERGLSAGRVRPLVRRAVRARDPADHRPVRRASRRARLVRDGLPRAGCRPDRRDVAHRRPRRHRARARQRGSRCALRAAGRPDRRSRGGRAPRHGRRHARARARPVRPDRAAALAWRRVRAGSAADLQPPDRAARPGAPSAQLRRFRFRAEPDRVMIVHPRQDHPAFRAEALRWCGTRASRARVFDIDDPYTGTRVGTAPLASVDDVRAAFDYAIAYRPALTRYERSQILERAAALLRARCEEASDLITLESGVSKQDSRYEIGRVADVLKFASAEALRDDAQSFSCDLTPHGKARRVFSQRQPLDGVIVAITPFNHPMNQVAHKIAPAIATNNRVIVKPSEKVPLSAFYLADLLYEAGLPEPMLQVLTGDPREIADELVTHPHAALITFTGGVSIGKAIAARAGYRRIVLELGGNDPLIVLDDADLERAASLAVVGSYRNSGQRCTAVKRILVQRSIAPAFTELLVEKTRAWKYGDPFDVANEMGTVIDAAAARLFEARVEEAVAHGARLLTGNVRRGALYAPTVLDNVDPSMTIVREETFGPVSPVIAFDTIDDAIRISNGTAFGLSSGVCTDSTAAVVRFVNELKVGTVNVWEVPGYRIELSPFGGIKDSGLGYKEGVQEAMKSFTNLKTFSLPWE

SEQ ID NO: 53879 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYQAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 53880 - protein, 385 aa, Populus tremula
MAIDCIKTMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYQAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 53881 - protein, 873 aa, Ehrlichia ruminantium str. Welgevonden
MSERLIYYFSKNKCDGNLKLNHILGSKGANLAEMCNIGISVPPGFTISTAVCSHYNDNKLPDQISYLIQNAIEFLNNEVNLKFGDENNPLLLSVRSGSVSSMPGMLDTILNVGLNDKTVIGLAKKSGDLFAYDSYRRLIQMYAHTVLQVENSFFEEAIYKKKSVSTSKNEKISDPNIFKELIDEFKRIVKLHTNKDFPQDVNEQLYTAIYAVFRSWMNKRAITYRKIHNIPDNLGTAVNVQSMVFGNMSENSATGVVFTRNPSTGTKEIFGEFLISAQGEDVVSGTHSPLPLNKMKDLMPITHNELEQVCKKLELYYRDMQDIEFTIENGKLWILQTRSGKRSIQSAVKIATDMVKEKLISKEEAITRIDHKSFSKLFHPTLESSTNTDIIAYGLPASPGAATGQVVFTPSDAEQLKKEGKNVILIRQETNPEDINGMNSAVGIITLRGGMTSHAAVVARGMGKPCICSVNNIFIDKSEQFFYTNTGIKVYKGDNITINGCNGEVILGVIKTTLPKLDESFYDLMEWVDEIRTLKVMANADTPEDAEISMNFKADGIGLCRTEHMFFSDKRISIVQEMIVSDKKEERAVALEKLEIMQKEDFKKIFTHTLDKQVTIRLLDPPLHEFLPDNDDAIQEISSRTGKSLEKLKNRILYLLEKNPMLGHRGCRLAISYPEIYEMQVKAIFLAIKELQEETGIKEIIPEIMIPLIMSEEEIIVIKELVNNIAKQFDNPKYLLGTMIELPKAALIADKIAKHVQFFSFGTNDLTQTTLGVSRDDSASFIGTYRDLGIIKHDPFETLDIDGVGKLISIAVSLGKKESPDIKIGVCGEHGGNFESIQFFSRLNINYISCSPYRIPIARLIAAQCTIFNKDIN

SEQ ID NO: 53882 - protein, 333 aa, Bradyrhizobium sp. BTAi1
MPRSKPLTEAPPANADIQSALRTLDAGSNGIAAISAALHGPLGAAFAAAVALIRQAKGRAILTGLGKSGHVARKMAATLASTGTPAFFVHSAEAGHGDLGMITSDDVVIALSWSGEQPEMKTLVNYTKRFAIPMIAITSNAQSSLGQAARIVLELPKAREACPHNLAPTTSTLMQAAIGDALAIALLEGRGFTALEFANFHPGGKLGAMLKHISDLMRSGDAVPLKPLGTGMADALAEMSAKGLGCVVIVDGRGHVAGIITDGDLRRKMRADLLSVTVDEIMTANPRTVGREALASEALEILNSAKITTLIVTDGAKPVGILHMHDLLRAGVA

SEQ ID NO: 53883 - protein, 319 aa, Zea mays
  misc_feature (46)..(46): Xaa can be any naturally occurring amino acid
  unsure (1)..(319): unsure at all Xaa locations
VAIFVVLAMTLRRKPDVLVNVMPKIMGNNKYLGQEKLPIIVWFIAXASQGDLVTGMFCWAHFLFPTLCAKPSGNPLARDLVLQLLERILSVTKARSILLNGAVRKGERLVPPVSFDLFMRATFPVSNARVKATERFEAAYPMIKELALAGPPGSKTVKQASQQLLPLCAKAMQENNAELTREAVDVFIWCLTQNAESYKQWERIYPENTEASVAVLSKIVIDWKDVSPKLSSEALKATVKNFKAKNEAALESTTDAGKQASIKEADKHCKAIFGKLTRGATCLKSSLVVIALAVAASYVLSPGMDLEKVQAMVSSHLSF

SEQ ID NO: 53884 - protein, 324 aa, Actinobacillus pleuropneumoniae serovar 1 str. 4074
MAKQIKKIAVLTSGGDAPGMNAAIRGVVRAALNEGLEVYGVQDGYYGLYTDRVIPLDRRSVSETINRGGTFLGSARFPQFKDPDVRKKSVETLKKYDIDALVVIGGDGSYMGAKLITEEFGYPCIGIPGTIDNDIVGTDYTIGYQTALETAVEAIDRLRDTSTSHQRISIVEIMGRHCGDLTISAALASGCEYIIVPEKGLDKESLMRNIEDGFNKGKRHAIIAITELMTDVQALAKEIEDRFGHETRATVLGHIQRGGAPCPFDRILASRMGVYAVDLLLQGHGGRCIGIKNENLVHHDIIDAINNMRRPFKEELFEAARKLF

SEQ ID NO: 53885 - protein, 152 aa, Brassica napus
MFKKIMKGGHKKPSKSESNEPSSYNLGGSNVVVSHASRGALAPPSQVTTATPPPPITSVTPLPLFRDVPVSERQSLFLRKLQNCCFHFDFTDTTKIVREKEIKRQTLLELVDFIQSGASKIISESCQEEMIKMVSLNLFRCLPPASHENTGQ

SEQ ID NO: 53886 - protein, 501 aa, Arabidopsis thaliana
MAKSSEEPKFSLRLIVDEEKNKVVLAEACRDFVDVLFSLLTLPMGTIVRLLENHRKSEPVTLGCFNNLYRSVVDMGSDCFETEACKQMLVYPKSVKDLQCKRLKLNINPTEDIKCFKCSSYCGLYSNFSTSKCRCGKFMNEEIQLENEEQDLGRFQDDDNGVFVSGRCSFVLTDDLEVSVKSTELVLNKLKSLGCADVGKLGERLLDIGVKEVLTLLGCIFSSNAPLKDIFLNKKITQGATKFYKSQSPCLEKKEDEAEPEKVVTLKAFVRKQDMKILFVECGEEFVELLFSFIAVPLESAWEISGSSISLGCIGNMCRTFRDLNEETQMSTSTCALPSFYNFQMQLPGIITQQPPVYYRYRLYDYRQMNYGLTTNGNRTTYYRKDRIVRVDLKDPKSRGSDKSAQGFLKKATKCTVLDDLTITSMNSCSTVCLLKKLQSHADDLEVQVISISNAEALDLLRASLVTSSALSTTLWNLIAKKLKEETDLWDTVSKKVKEET

SEQ ID NO: 53887 - protein, 727 aa, Desulfotalea psychrophila LSv54
MPLSSMLGPDGIKVLVANYQPDADMQRIDDAWQFAARVHEGQEHFSGTPYLLHLQEVGATLASMQLDLDTILAALLHGTIKHGVEITELRDAFGDDVASIVEGASRITKVQYNNKLVGQAEGVRKMLLAIAADIRVLLVRLVDRLTDLFNLEKLPRERQLEIAWETMNLYAPLASRLGIDWLKRELEDNSFRFLYPDEYAELSRDMESSLEERESYVAEMLATLKGKLEENDIHPLRVLGRPKHLYSIYKKLVAQNIKLDKVYDKVAFRIIVDSVKECYETLGVIHGEWAPVPGRIKDFISVPKANNYQSMHTTVAGPCGHFIEIQIRTEEMDRVASEGVAAHWAYKEGQKTAGRDAKLFGDLKNLVKSLKDVEDPREFLDSVQGELYDPDVYVLTPGGEVKEFRYGSCPIDFAYAVHSEVGDHCTGAKVNGRLVPLKYHMQNGDIIEILTSPSQHPRRGWLDFVQSGRAKARIRSWFRREENERALKLGREICEREIRLHNTSLKKLVKSGQIRLLFKELRCNSLDDMLIKVGNGGITIENLVKALQPHNPQLDRDVPAQDAVTDEALPILPKQATTQIEQSKDGLRIAGVEGMLVRVGQCCRPVPGDKVIGFITHGRGVTVHKADCSNLGSTDPHRRIDVDWAQSSSSSYRAVLHVVTENSKGIFSEVSAIIAGESANMVEMSARVTVEDTAEFTLSLEVKDLEQLQHLMQILRQMPVVISVRRL

SEQ ID NO: 53888 - protein, 319 aa, Brassica napus
METPTMKPDTVLILDFGSQYTHLITRRIRSLNVFSLVLSGTSSLKQISSHNPRVVILSGGPHSVHAHDAPSFPEGFVEWAEGNGVHVLGICYGLQLIVQRLGGVVVEGESKEYGKMEIEVKGGESEIFGKGRVGEKQVVWMSHGDEALKLPDGFEVVAQSAQGAVAALENRERRIYGLQYHPEVTHSPKGMETLKHFLFDVCGVSADWKMEDLMEEEIKVINKTVAADEHVICALSGGVDSTVAATLVHKAIGDRLHCIFVDNGLLRYKEQERVMDTFERDLHLPVTCVDASEQFLSQLKGVVDPEAKRKIIGKEFINI

SEQ ID NO: 53889 - protein, 463 aa, Streptomyces coelicolor A3(2)
MSRSAHPAGPRHADVLPEGHYTAPADDLNALDPKVWARTVGRDADGVVTVGGIPVTQLAEEYGTPAYLLDEADFRERARAWRTAFGDDADVFYAGKAFLSRAVVRWLDEEGLNLDVCSGGELATALSAGMPAERIAFHGNNKSPEEIERAVRAGVGRIVLDSFQEIVRVAHIAQSLGKRQRVQIRITVGVEAHTHEFIATAHEDQKFGIPLAGGQAAEAVRRALKLDGLEVIGIHSHIGSQIFDMSGFEVAAHRVVGLLKDIRDEHGVELPEIDLGGGLGIAYTSDDDPREPHEIAKALTEIVTRECEAARLATPRISVEPGRAIVGPTAFTLYEVGTVKPLEGLRTYVSVDGGMSDNIRTALYDAEYSVALASRTSDAEPMLVRVVGKHCESGDIVVKDAFLPGDLAPGDLIAVPATGAYCRSMASNYNHALRPPVVAVRDGAARVVVRRETEEDLLRLDVG

SEQ ID NO: 53890 - protein, 227 aa, Thiomicrospira crunogena XCL-2
MSQEKIKPGFILIDLDGTLIDSVPDLAYCVDEMMKQLGMPVRGEAAVRNWVGNGVQRLVERALINSVDGMPDQDLMDKAYPIYLELYKENTSKRSCVYEGVVEGIEWMKAQGYRVACVTNKAAAFTIPLLKDKGLYDSFEVIVSGDTCEEKKPHPMPLLYAAEQLGVTPENALMIGDSKSDVKAARAAGFHIFCMTYGYNHGEDIRNYEPDAVMGSFMELPNYLAAK

SEQ ID NO: 53891 - protein, 385 aa, Populus tremula
MAIDCIKTMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKLPLSEKQKAQRKIGEPCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 53892 - protein, 385 aa, Populus tremula
MAIDCIKTMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 53893 - protein, 276 aa, Thiomicrospira crunogena XCL-2
MLYPTWGQQFVMNDVLFEVDTGHQHLIIFKNDQWGTVMALDGVIQTTEKDEFIYHEMMTHVPMFAHGNAKKVLIIGGGDGGILREVLKHPTVDAVTQVEIDQQVIDMCKQYLPKHSAGAFEHPKANVVIADGVDFVNECTEKFDVIISDSTDPIGPGEVLFTSRFYQGIQSCLNDGGVFVAQNGVSFMQTDEVTTTFKRLSPLFNESSFYSAAVPTYVGGIMTFAWATNDLSLKQQSVDVIRSRYDAAAIETRFYTPELHIGAFALPKYVQQAIQA

SEQ ID NO: 53894 - protein, 398 aa, Thiomicrospira crunogena XCL-2
MNTAELVQHFAEQTHPDELEQFDRSTLRDLLTQHETPFLVLDLQEVEYQYSALQKALPGVELFYAIKSLAHPAVIRRLKKLGGSFDLATSGEVDLVKGLGIEGHQCIHTHPIKKDREIRHALDFGCTRFVVDNPDEVLKFIPYKDEVELMIRVSFRSQDAIVDLSRKFGSALEELPGLVNLAMENGLTVSGLSFHVGSQSLSPFAQVNAVQASISAMKEMSHVHWKWLDIGGSFPVSYQGPVMPIEDFCAPIMEALTELPASVKVFAEPGRFISAPSMIEVIRVVGKAKRGARTWYYLDDGVYGALSGQMYDHAKYPIAPLKPVDPTGDFYPSVLAGPTCDSVDVVDEDIELPELAVGDILIAKQMGAYTIASASEFNYYPKPKIVVVEDLIDHTDDE

SEQ ID NO: 53895 - protein, 122 aa, Glycine max
  misc_feature (96)..(96): Xaa can be any naturally occurring amino acid
  unsure (1)..(122): unsure at all Xaa locations
APSLISTAAVTTVNRAGARMDAPFTGLKSMAGYPTRKTNHDITSIASNRGRVQCMQVWPPLGKKKMETLSYLPHLDDAQLATDVEYLLRNGGIPCXEFQLQHGIEYREHNRSPAYYNGRYWT

SEQ ID NO: 53896 - protein, 560 aa, Fulvimarina pelagi HTCC2506
MSDVKSDIEIARAAKKKPIQEIGEKLSIPRDHLLPYGHDKAKVTADFIKSLEGRPDGNLILVTAVNPTPAGEGKTTTTVGLGDGLNAIGKKATICIREASLGPNFGVKGGAAGGGLAQIVPMEDMNLHFTGDIHAIGTAHNLLSAMIDNHIYYDNEQGIDSRRITWPRVMDMNDRSLRHIAISLGGVTNGFVREDRFDITVASEVMAILCLATDLADLQERLGNIIIGQRRDKTPVTVKDIKAEGAMAVLLKDAIQPNLVQTLENNPAFVHGGPFANIAHGCNSVIATKTALKLSDYVVTEAGFGADLGAEKFLNIKCRKAGLNPKAVVLVATVRALKMNGGVAKDDLGTENVQAVKDGCANLGRHIENLKKFDVPVVVAINHFIKDTDAELQAVVDFAKQTGAEDAIVAKHWAKGSEGVTELAQKVVEVCESSRSAYKPLYPDEMGLVEKIETIAREIYRADGIEADSKIITQLKDWEKQGYGNLPVCMAKTQYSFSTDASKRGAPTGFKIPIREVRLSAGAGFVVVVCGSVMTMPGLPRKPAAESIRLNEQGQIEGLF

SEQ ID NO: 53897 - protein, 134 aa, Oryza sativa
  misc_feature (90)..(90): Xaa can be any naturally occurring amino acid
  misc_feature (101)..(101): Xaa can be any naturally occurring amino acid
  misc_feature (111)..(111): Xaa can be any naturally occurring amino acid
  misc_feature (119)..(119): Xaa can be any naturally occurring amino acid
  misc_feature (125)..(125): Xaa can be any naturally occurring amino acid
  misc_feature (132)..(132): Xaa can be any naturally occurring amino acid
  unsure (1)..(134): unsure at all Xaa locations
MGECGGGEYRCWEELLPDALGLVFRNLPLREVLTVVPRVCKSWSRVVAGPYCWQEIDIEEWRQQQGKPEQLVRMVEMLVARSCGSCRRIXVSGLPGDPLFXFIGDHAPGTXRTLEIPRXRRSSDXAVGKTWXPK

SEQ ID NO: 53898 - protein, 289 aa, Desulfitobacterium hafniense DCB-2
MSETKIPQPTFPAQHQDKQPGLETLMNPSPIFEDLNYRPSGKLQGKVALISGGDSGIGKAVAILYAKEGADIAIVYLDEQVDAQATKERIEQLGRRCLLIPGDIGEENFSNQAVQKTLDTLGGLDILVNNAAEQHPQNSLLDITAQQIEQTFRTNIFGMLYLTKAALPHLRYGSVIINTASITAYKGDAKLIDYSASKGAVVAFTRSLSESLIKQGIRVNGVAPGPIWTPLIPASFDANEVSTFGSTTPMQRAGQPVELAPAYLFLACEGSAYMSGQMLHVNGGTIVNG

SEQ ID NO: 53899 - protein, 174 aa, Oryza sativa (japonica cultivar-group)
MLPSRQRSIFHLGEEGGGAADAEHLGADHGDGHGDHGIISIHQQRLRVVGLQIVLAQTRHHHRQQHGHVVLKQMQMVSPPPAARHRRRRRPCGDFLSACSLCRLELGPDKDVYMYRGEQGFCSEECRWQQIMTDEARERDAMAKKERLGLHHRTPRPPPAAIRGGSPRRLLAVA

SEQ ID NO: 53900 - protein, 181 aa, Zea mays
MADSGSIVVTEARKQHPLSQIAASGTHRLLLKQWVKEEDLLARRVALREARLDGARKEIAFLYCAFFAFHAASVLLLFLSSSTAGPASACRRSWIPCLVSLLSSLAMLWALRYKSDTEAVLERLLAREREDALLLARAKSLRVEAKGADRPRRWQARDLAVFALFAVACGVLVLTRFLLCN

SEQ ID NO: 53901 - protein, 519 aa, Zea mays
MDTSNAFAVVTLLLLPLLLALAQLVRRGSPQYPPGPMALPVIGHLHLHLFERPLHRTLACLAARHGTVFQLWFGSRRVIVVSSADAAKECLATLDVAFANRPRLPSGRILSYDWTTMGTSNYGPYWRRVRRITVTHILSVHWVQQFADVHERETRAMVRGLYRPTARNGVRRARVELKSRLFELLMNAMMGMVCAKRYYGCDGKENETEAEVSEEARWFREMVEETMELSGASTVWDFLPAWARWLDVGGVGRRLWRLRESRTKFLQGLIEEQRKEMENGPQPQARKTMIGVLLTLQNEDPDACPDNLIRTMCISSLEAGTSTSADAVEWAMSLLLNNPGALAKAQEEIDACVGQPARLIEAADLPKLQYLWCIIMETLRLYPPTPLLLPHESANDCTVSGFHVPMGTMLLVNTFAIHRDPEIWDRPGSFMPERFLGENSEGKMFNPFGMGRRRCPGENLGTQMVGLALGTMIQCFNWERVGDDLVDMTEGAGLTIPKKVPLEAFYEPRASMANLLSKI

SEQ ID NO: 53902 - protein, 115 aa, Zea mays
  misc_feature (47)..(47): Xaa can be any naturally occurring amino acid
  unsure (1)..(115): unsure at all Xaa locations
PFPRPWAPPIPGPRATPVVAKSGAKRVSFFLGDMGPPPGQWALLGFXGPSPSNPLKSNFFKTFRAPFPKKGFLPKFLLLGGGSLLAYVRGWGSPAPLPFKKGPQDPPPPGPPAKI

SEQ ID NO: 53903 - protein, 250 aa, Arabidopsis thaliana
MVKIEVGSVGDSFSVSSLKAYLSEFIATLLFVFAGVGSAVAFAKLTSDGALDPAGLVAIAIAHAFALFVGVSIAANISGGHLNPAVTLGLAIGGNITLITGFFYWIAQCLGSIVACLLLVFVTNGKSVPTHGVSAGLGAVGGVVMEIVVTFALVYTVYATAADPKKGSLGTIAPIAIGFIVGANILAAGPFSGGSMNPARSFGPAVVSGDLSQIWIYWVGPLVGGALAGLIYGDVFIGSYEAVETREIRV

SEQ ID NO: 53904 - protein, 261 aa, Glycine max
  misc_feature (183)..(183): Xaa can be any naturally occurring amino acid
  unsure (1)..(261): unsure at all Xaa locations
MASPLSAQLVQCQNSLPPLQGNFSQDVSKVQRSRVVCYGTRSPLGYYGKALTSRSHNALRFSVTRQSEARSIGYRRMTCVNAADNVVELQAKVTTKCFFDVEVGGEPVGRIVLGLFGEVVPKTVENFRALCTGEKGYGYKGSSFHRIIKDFMIQGGDFTEGNGTGGISIYGPSFKDESFACKXHVGPGILSMANAGPNNNGSQFFIFTVKTLWLDNWHVVFGHIIDGMDVVKTLESQETSRSDVPRKPCRIVNCGELPIES

SEQ ID NO: 53905 - protein, 195 aa, Arabidopsis thaliana
MVLWELALGTAYFLGIRRTYRLALKTQRRLVSPKHPRIRDFMHRRTYQIFDMALRVHKNIQQRDMVIGRNLGNWILRGLDRMKPSAQVLLPKNTEPSIDKAKRVLQSTRLKPHVNTQTPQNREVDRNLFMSLRNFRSKYPIASMMMIKPPRSTGTTTQYRPYSVGESSLIKPIYARGGFNSVIRKDILQWMVQKR

SEQ ID NO: 53906 - protein, 299 aa, Arabidopsis thaliana
MGCFGPSKASRTRNNEHDKITRQNPSHQPQTMRAEEVLLQIPRCRVHLIGESEAVELASGDFKLVKVSDNGVTLAMIVRIGHDLQWPVIRDEPVVKLDARDYLFTLPVKDGDPLSYGVTFSGDDRDVALVNSLKLLDQFLSENSCFSSTASSKVNNGIDWQEFAPRIEDYNNVVAKAIAGGTGHIIRGIFSLSNAYSNQVHKGGDIMITKAEESQRNGSYNNGNSSGNEKKNGINTHLQRVRKLSKATENLSKTMLNGAGVVSGSVMVPMMKSKPGMAFFSMVPGEVLLASLDALSKCN

SEQ ID NO: 53907 - protein, 982 aa, Solanum lycopersicum
MKHIFKKLHHSNRSNDAQSTSSISSSSSPASSLSSASCTTDHRNSNSVSQSPLSPSTISTASTTTTPAAPVGAGGGGGGGNLSTINRQQDYYTSEEEYQVQLALALSVSSSQSQDPFPSDVNSSNGHGVGRTAVDLARDREDAAADLLSRQYWDYGVMDYEEKVVDGFYDVYNLFTDPASRGKMPSLSELETNPGTSNFEGVIINQRIDPSLEELMQIAHCITLDCPASEISLLVLRLSELVTGHLGGPVKDANIILAKWMEISTELRTSLHTSVLPIGSLKIGLSRHRALLFKVLADHVGIPCRLVKGSHYTGVEDDAVNIVKLPNDSEFLVDLMGAPGTLIPADVLSAKDASFNSPKLNKIPSLPSNSHSGVSYPRRNLLSGQNSVLGDDFSGRSKPEKIESVHSISDAGGSSTAGSSGINKRPSSNQVDWTSPLAIGTSLYKGGRGPNAAGDGLRLNVNVVPYDQNNPEDPKNLFADLNPFQIKGSGNTLLQKNPARNKVSELQQPINTLIPGRPPAPMMWKNRYAPNEVPRKNESDSEGLFPKKNGGSSGYNISSIASTSSNIPQKSSTDTSRLHGNSRPAYRGNDEVASTRNNSSILSAELEFRRLSVQNSQNNNRETSQWEGHSLQSDDLNRTQAYGDDIIVESDHTRNLQAQSIGTNIKLKEPENPTSSGNLGPSQVDPVFDDVGDCEIPWEDLVIGERIGLGSYGEVYHADWNGTEVAVKKFLDQDFSGAALAEFKREVRIMRRLRHPNVVRFMGAITRPPHLSIITEFLPRGSLYRIIHRPHFQIDERQKIKMALDVAKGMDCLHTSNPTIVHRDLKSPNLLVDTDWNVKVCDFGLSRLKHNTFLSSKSTAGTPEWMAPEVLRNEPSNEKCDIYSFGVILWELATLRLPWSGMNPMQVVGAVGFQNKRLEIPKELDPIVARIIWECWQTDPNLRPSFAQLTVALTPLQRLVIPAYVDQLNSRLPQEISVNSTP

SEQ ID NO: 53908 - protein, 590 aa, Saccharum officinarum
PGSTHAGRSIAKCQIVLLHASYPFSKEASYLASVYSQVYLDFGLAIPKLSVHGMTSSLKELLELAPIKKVMFSTDGYAFPETYYLGAKRARDVVYRVLSAACEDGDLSIQEAIEAVEDIFRRNALHLYKLNVVNGSINHETTIVADSVSLSSVEEDVLFVRIIWSDASGQYRCRVVPAGRFYEITRNKGVGLTFAAMGMTSFCDGPADGSNLTGVGEIRLVPDMPTLVRIPWSRREEMVMADMQIRPGECWEYCPRNAMRKVTKVLLDEFNVTMKAGFENEFFLRRKLVSDGVEQWVPYDNTNYCSTSAFDGASSILQEVYSSLKASGIVVEQLHAEAGKGQFEIALKYILCTLAADNLIYARETIQSIARKHGLLATFLPKPDLNDFGSGSHVHLSLWENDQNAFMGSSKDNFHGMSKTGAQFLAGVYHHLPSILAFTAPHPNSYDRIQPDTWSGAYQCWGKENREAPLRTACPPGVPLDLVSNFEIKSFDGCANPHLGLAAIVAAGIDGLRRDLKLPEPIESNPSDHASKLKRLPQNLQESVEALSADKVLHELIGDKLVTAAIAIRKAEIDHFSKNPGAFNDLIFRY

SEQ ID NO: 53909 - protein, 129 aa, Glycine max
ILQSDQYFGPSLFMNPFFNQEVTKMFPEKDTVFHRLGRYLFHPSNEAWKLISDYYQEHLAKADKRIGLQIRVFSPVSTPQQTVMDLVLSCTLKHKILPQVDLQTSAGKNHSVKAVLVASLHREYGDNLR

SEQ ID NO: 53910 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLPLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCDPRIYPDFTWPMLLEFTQKHYRADMKTLEVFTNWLHQRSFS

SEQ ID NO: 53911 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGVYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 53912 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFRNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 53913 - protein, 573 aa, Nitrosomonas europaea ATCC 19718
MANTLPPTDRSCDISQPLERLSPDESLKAESDYLRGTIALGLLDRITSAVPGNDIKLMKFHGIYEQDDREIRDERRRQKLEPAFQFMIRVRLPGGICTTERWLKISELACAHGNETLRMTTRQTFQFHWVLKQNIVPLIRGLHEVLLDTVAACGDDSRGVMATVNPQFPALQAELAALAKTVSDHVIPKTRAYHEIWYGEERIASSEPEEPFYGQTYMPRKFKIGFVIPPNNDIDIYAQDLGYIAIIGENGKIAGFNVAIGGGMGRTDKAPHTYPRTASVIGFITPDRLISVTEAVMGVQRDYGNRADRSRARFKYTIDDKGLDWIKLAIEDRAGPLESARPYDFTSNADIYGWIESGDGFHHFTLFIENGRLNRDMLDKIAQIAHVHKGHFRLTPNQNLMIANVATADKPEIEALLRETGLIAFNERSVLRLNSMACVALPTCGLAMADSERYLPDLITKIEGILTRYNLQNEPITLRMTGCPNGCSRPFIAEIGLTGRAPGKYNLYLGGGFHGQRLNRLYRENIGEPAILETLNEVLGRYATERLPDEHFGDFTIRAGIIREVTEGRFSND

SEQ ID NO: 53914 - protein, 274 aa, Saccharomyces cerevisiae
LADGAHIGNYQIVKTLGEGSFGKVKLAYHTTTGQKVALKIINKKVLAKSDMQGRIEREISYLRLLRHPHIIKLYDVIKSKDEIIMVIEYAGNELFDYIVQRDKMSEQEARRFFQQIISAVEYCHRHKIVHRDLKPENLLLDEHLNVKIADFGLSNIMTDGNFLKTSCGSPNYAAPEVISGKLYAGPEVDVWSCGVILYVMLCRRLPFDDESIPVLFKNISNGVYTLPKFLSPGAAGLIKRMLIVNPLNRISIHEIMQDDWFKVDLPEYLLPPDL

SEQ ID NO: 53915 - protein, 617 aa, Triticum aestivum
  misc_feature (9)..(9): Xaa can be any naturally occurring amino acid
  misc_feature (169)..(169): Xaa can be any naturally occurring amino acid
  misc_feature (172)..(172): Xaa can be any naturally occurring amino acid
  misc_feature (179)..(179): Xaa can be any naturally occurring amino acid
  misc_feature (183)..(183): Xaa can be any naturally occurring amino acid
  unsure (1)..(617): unsure at all Xaa locations
RDERFGHLXLSDFLGYSLKAITEAILPVIRTYVDTTPKEFDSFQDIYDLYDGLLKVPDNQHLKELKKKIPLQFIKSLLPVAGDDLLNLPLPHVIRSNDYAWRSDEEFAREMLAGVNPVCIKRLTEFPVKSTLDPSAYGDQSSTITEDQIQQNLEDGLTVKQAMEEEQAXSFXDHHDNFXPFLXDRIKHPRVRNYIYASRTLLFLKADGTLKPLAIELSLPHPDGIQHGAKSTVYLPADIDSGVDGQIWQLAKAYASVDDSAWHQLISHWLNTHAVIEPFVIATNRQLSVVHPVHKLLSPHYRDTLNINALARTTLINAGGVFEMTVFPEKYALEMSSVVYKNWKLTEQGLPDDLVKRGMAVPDSSSPYGVRLLIKDYPYAVDGLVIWWAIERWVNEYLAIYYPNDGVLRADKELEEWWKEVREVGHGDLKDADWWPNMVTVQELAKTCTTIIWVASALHAAVNFGQYPYAGYLPNRPTVSRRKMPEEGEEEYKQLQKGGKEADKVFIHTITSQFQTILGITLIEILSKHSSDEVYLGQRDTPEWTSDAKALEAFKRFGTRLMEIEKRILDMNKDPALKNRNGPVKMPYMLLYPNTSDAGGEKGLGLTAMGIPNSVSI

SEQ ID NO: 53916 - protein, 475 aa, Vibrio fischeri ES114
MSKQVKAQVVVLGSGPAGYSAAFRCADLGLETVLIERYSTLGGVCLNVGCIPSKALLHVSKVIEEAKAMAEHGVVFGEPQTDINKIRIWKDKVVTQLTGGLGGMAKMRNVTVVNGYGKFTGPNTIEVEGEENTTVTFDNAIIAAGSRPIKLPFIPHEDPRIWDSTDALELKEVPEKLLIMGGGIIGLEMGTVYHSLGSKVEVVEMFDQVIPAADKDIVKVYTKRIKDKFKLMLETKVTAVEAKEDGIYVSMEGKKAPAEAERYDAVLVAIGRVPNGKLIDAEKAGIEVDERGFINVDKQMRTNVAHIHAIGDVVGQPMLAHKGVHEGHVAAEVISGKKHYFDPKVIPSIAYTEPEVAWVGKTEKEAKEEGLNFEVATFPWAASGRAIASDCADGMTKLIFDKETHRVIGGAIVGTNGGELLGEIGLAIEMGCDAEDIALTIHAHPTLHESVGLAAEVFEGSITDLPNKKAVKKKK

SEQ ID NO: 53917 - protein, 320 aa, Vibrio fischeri ES114
MLHPEAESESTVHHHRFLVTNPAIAATDYMETTLNVGFPRIGLMAWSAGVPQARGFLLGHTAGRSTLNGEGLQHEDGHSHIMANTVPNCISYDPTFAYELAVIMQDGIRRMYGENQENIYYYLTVMNENYAMPAMPEGAEEGIRKGIYKLESHAGAKGKVQLMSSGTIMNEVRKAAQILSEEYGVASDIFSVTSFNELTRDGQDAERYNMLHPEAEAKVPYITTVLGNEPAIAATDYMKNYAEQVRAYMPTESYKVLGTDGFGRSDSRENLRRHFEVNAGYVVVAALTELVKRGDIEKSVVTEAIAKFNIDTEKTNPQYA

SEQ ID NO: 53918 - protein, 751 aa, Vibrio fischeri ES114
MSDMKHDVDALETQDWLEALESVVREEGVERAQYLLEQVLDKARLDGVDMPTGINTNYINTIPAAQEPAYPGDVTLERRIRSIIRWNAIMIVLRASKKDLDLGGHMASYQSAAAFYEVCFNHFFRAPNETDGGDLVYYQGHISPGIYSRAFVEGRLTEEQLDNFRQEVDGKGIPSYPHPKLMPEFWQFPTVSMGLGPISAIYQARFLKYLEGRGLKDTSAQRVYAFLGDGEMDEPESRGAISFAAREKLDNLCFLINCNLQRLDGPVMGNGKIIQELEGLFKGAGWNVVKVIWGNNWDALLAKDTTGKLLQLMNETIDGDYQTFKSKDGAYVREHFFGKYPETAALVADMTDDQIFELKRGGHDSSKLFAAFNNAKETGGKPTVILAKTVKGYGMGDAAEGKNIAHGVKKMDMTHVQYLRDRLGLQDILSDEKVAELPYLKLEEGSAEYEYLHARRKALQGYTPQRLPKFTQEFKVPELEEFAPLLGEQKRDISTTMAYVRTLNILLKNKNIGKNIVPIICDEARTFGMEGLFRQIGIYNPHGQEYTPEDKGIVSYYKEATSGQVLQEGINELGSMASWVAAATSYSTNDLPMIPFYIYYSMFGFQRIGDMAWLAGDQQARGFLLGATAGRTTLNGEGLQHEDGHSHIMANTVPNCISYDPTFAYELAVIMQDGIRRMYGENQENIYYYLTVMNENYAMPAMPEGAEEGIRKGIYKLESHAGAKGKVQLMSSGTIMNEVRKAAQILSEESA

SEQ ID NO: 53919 - protein, 248 aa, Populus trichocarpa
MGRGRVQLKRIENKINRQVTFSKRRTGLLKKANEISVLCDAEVALIVFSHKGKLFEYSTDDSMEKILERYERYSYAERQLVATDLDSQGNWTLEYNRLKAKVELLQRNHRNYLGEDLDSMSLKELQNLEQQIDTALKHIRARKNHLMSQSISELQRKEKAIQVQNNMLVKQIKEKEKNDKALAQPAFWDLQDHGPNASSFLLSQPAGLPLPCLNIGGSHQEEAPEARRNELGHTLEPIYSFHLGGYGA

SEQ ID NO: 53920 - protein, 161 aa, Fragaria x ananassa
NLFGVAIGYTIASSISMVAIKRSNCFHSSDGKDECHVNSNPYMIAFGIAEIIFSQIENFDQLWWLSIVAAVMSFTYSTIGLGLGIGKVVETGTIRGSMTGVDIGTVTEAQKIWRSFQALGDIAFAYSYSLILIEIQDTVESHHREAKTMRKHSNQCAPHPF

SEQ ID NO: 53921 - protein, 224 aa, Brassica napus
GNGSVASLLHGNRGENRVPLDWETRMSIAIGAAKGIARIHQENNGKLVHGNIKSSNIFLNSERNGCVSDLGLTAVMSALAPPISRQAGYRAPEVTDTRKSSQLSDVYSFGVVLLELLTGKSPIHTTAGDEIIHLVRWVHSVVREEWTAEVFDVELLRYTNIEEEMVEMLQIAMSCVVKAPDQRPKMSDLVRLIESVGNRQASLGPEPKPKSENGASETSTPGEI

SEQ ID NO: 53922 - protein, 121 aa, Brassica napus
  misc_feature (10)..(10): Xaa can be any naturally occurring amino acid
  unsure (1)..(121): unsure at all Xaa locations
PLQYARARDXFKISSHDRVYEVKKGELLCGYQPLVMRDANIFEDPEEFKPDRFVGQTGSKLLNYLFWSNGPQTGTPSVSNKQCAAKDMVTITAALIIANLFLRYDKITGDAGSIKTVVKAT

SEQ ID NO: 53923 - protein, 389 aa, Fulvimarina pelagi HTCC2506
MRKHGSGPSDRSGIEPFHAMTFLAEANRLKAEGADVLSLAVGQPASPAPLPAREAATTMIGRGAVGYTDAMGRPALRSALAAHYRQAYGVTIDPARVMITSGASGGFNIAFLAAFEAGDRIAIAAPGYPAYRNIMRALGIAPVEIEVGPSDDYILTSDRLEAYFRREPFQGVLIASPANPTGTMTPPDEIRRIADFCRTNGVWLISDEIYHRLSFGQEERSALQDLEEAIVVNSFSKYYCMTGWRIGWMILPPSLTDAAERLGQNLYISASDLSQTAALAALSAGDELDAVRESYRRNRLTMRERLPEIGFRTIAPIDGAFYAYAQIPEGFPSATVFAKTLLKQSHVAVTPGTDFDLRRGDGFVRLSYAGAEADVARALDRIADFVSKA

SEQ ID NO: 53924 - protein, 574 aa, Oryza sativa (japonica cultivar-group)
MEVAGMRKASSHASMAAAAADPDDFDLTRMLNHRPRINVDRQRSFDDRSLAELSISGTASRGGGGGGYPAMMESYESMYSPGGGLRSLCGTPASSTRLSFDPHPLVFDAWDALRRSLVCFRGQPLGTIAAVDHSSDEVLNYDQVFVRDFVPSALAFLMNGEPEIVKNFLLKTLLLQGWEKRIDRFKLGEGAMPASFKVLKDAKRGGAERLVADFGESAIGRVAPVDSGFWWIILLRAYTKSTGDLSLAETAECQRGIRLIMNQCLAEGFDTFPTLLCADGCCMIDRRMGVYGYPIEIQALFFMALRCALLMLKPDAPEGKETMDRVATRLHALTYHMRSYFWLDFQQLNDVYRYRTEEYSHTAVNKFNVIPESIPDWVFDFMPSRGGYFVGNVSPARMDFRWFALGNFVAILASMATPEQAAAIMDLIEERWEDLIGEMPLKISFPAIESHEWEFVTGCDPKNTRWSYHNGGSWPVLLWLLTAACIKTGRLKIARRAIELAEARLARDGWPEYYDGKLGRYVGKQARKLQTWSVAGYLVAKMMVEDPSHLGMISLEEDRAMMKPVLKRSASWTV

SEQ ID NO: 53925 - protein, 205 aa, Brassica rapa subsp. pekinensis
MAMLGGVRDVPANQNSGEVESLARFAVDEHNKKENALLEFARVVKAKEQVVAGTMHHLTLEIIEAGKKLYEAKVWVKPWLNFKELQEFKPASDDGSPSATITPSDLGCKKGEGASGWREVPGDDPEVQHVADHAVKTIQQRSNSLFPYELQEVVHANAEVTGEAAKYNMVLKLKRGEKEEKFKVEVHKNHEGVLHLNHMEQQHHD

SEQ ID NO: 53926 - protein, 492 aa, Flavobacteria bacterium BBFL7
MTNPPKPNQKNMDIKNFINNNEHIPLSGLWLDNYEPASGLVYGQIPNSNEDDVEKAYQAANAAFKDWSTTSIDERSRIMLRIADLIEENLEELAAAESRDNGKPLWLATAVDIPRASSNFRFYGNAITQYSSDAHETTGKNTMNFTMRKPIGVVGCISPWNLPLYLFSWKIAPAIAAGNCVVAKPSEVTPATAFLLGEIVKKAGLPAGVLNIVHGLGGSCGQAIVAHPGIKAISFTGGTTTGEHIARTAAPMFKKLSLELGGKNPNIIFADCNYDKMLTTTLRSSFANQGQICLCGSRILVEQSLYEKFKTDFVARVQQLKVGHPNQSDTKVGAVVSAAHRDKILDYIAFAKANPKEYTILSGGNSVLIEGHEGGYYLEPTVIEVQSNDCKLNQEEIFGPVVTIIPFKDEAQALELANGTRYGLSATLWTSDLSRTMRMSNELEAGIVWVNTWLNRDLRTPFGGVKDSGVGREGGFEALNFFTEPKNVCIEY

SEQ ID NO: 53927 - protein, 1451 aa, Oryza sativa (japonica cultivar-group)
MTMMTPPPLEPEEDEMLVPHQELVAADAAQPMEVVAQTEAASTAESQPAEDPQTSRFTWTIENFTRINAKKHYSDAFVVGGYKWRVLIFPKGNNVDHFSMYLDVADSANLPYGWSRYAQFSLAVVNQIQQKYTIRKDTQHQFNARESDWGFTSFMPLSELYDPSRGYLVDDTVVVEAEVAVRKMVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKVTNLRTVVEGTIEKLFEGHHINYIECINVDYKSNRKESFYDLQLDVKGCRDVYASFDKYVEVERLEGDNKYHAENHGLQDAKKGVLFLDFPPVLQLQLKRFEYDYMRDTMVKINDRYEFPLQLDLDRDDGKYLAPDADRSIRNLYALHRYKFDDERVTKEDTKKALEEQYGGEEELPQINPGFNNAPFKFTKYSNAYMLVYIRESDKDKIMCNVDEKDIAEHLRVRLKKEQEEKEHKKKEKAEAHLYTIIKVARDENLKEQIGKDIYFDLVDHEKVRSFRIQKQLLFTTFKEEVAKEYGIPVQFQRFWLWAKRQNHTYRPNRPLSPHEETQSVGQLREVSNKAHNAELKLFLEVELGPDLRPLPPPEKSKEDILLFFKLYNPEKEELCFVGRLFVKALGKPSEILTKLNEMAGFVPNEEIELYEARAKFMMLYLWDNLVYVTPLRRVLGEIKFEPNVMCEHIDKKATFRASQLEDGDIICFQKSPIPDSDTQMRYPDVPSYLEYVHNRQVVHFRLLEKPKDDDFSLELSKLHTYDDVVERVARQLGVDDPAKIRLTSHNCYSQQPKPQPIRYRGVEHLLDMLIHYNQTSDILYYEVLDIPLPELQGLKTLKVAFHHATKDEVVIHSIRLPKNSTIADVINDLKTKVELSSPSAELRLLEVFYHKIYKIFPLHEKIENINDQYWTLRAEEIPEEEKNLGPNDRLIHVYHFMKDPLQNQQIQNFGDPFYLAIREGETLAEVKERIQKKLQVPDEEFCKWKFAFISMNRPDYLQDSDVVSARFQRRDVYGAWEQYLGLEHADTAPKRAYTANQKKLTRITAAVSAALGSVIVIADEIFASTYILTILSKKLYLMSRIKFGVTRSIFFSRHYDLNKAPVHLTLQLPTSPMDNPTPSSSSGGGGAAAAANASSDEHRKTSPATAADFFDEEHTFDDILLPVDLFDFTHGLDAGDGCYVDDQAAIGQKPLSPAPEPAAEQQPSPAPEHGDDERLVMYYQGQEYIFDPVQPQKIENIFHHLNGQEMIPQSIRPQPTNLVRPITVPEDFDRFAALTRYREKKRNIKFIKKADYSARKEVALRMKRSKGKFAPRVQTSENSLAHRKGITFCTNCGESSDATPMMRHAPNGTKSFCNACGLMWANSRKIRKIRNPTSGEQEDQ

SEQ ID NO: 53928 - protein, 504 aa, Flavobacteria bacterium BBFL7
MNKKTILMILDGWGITQDPKVSAIAQAQTPFIDSLYDQYPHATLRTDGEHVGLPEGQMGNSEVGHMNLGAGRIVYQDLAKINKAIKEDTLKDEQVLVDALAFAKANSKKVHFLGLLSDGGVHAHIDHLKALLDVAESHEIEDVFIHAFTDGRDVDPKSGASHVANLEKHISGTNAQLATVTGRYFAMDRDQRWERVKKAYDVIVHGMGQPSHDATDSIKEFYNQGVTDEFIEPIVVLNGTEPVATVEDGDVIIFFNYRTDRGRELTQMLSQQDYHEQNTHALDLYYVTMTKYDDSYNNVKVIFEKDNLKNTLGEVLADAGKTQIRIAETEKYPHVTFFFNGGQEKPFKGEQRIMCNSPKVATYDLQPEMSIDCVSSSIIPEINRQVADFICLNFANPDMVGHTGSMEAAVKACEAVDQAAHDVITAAMEQDYTIIVIADHGNCEVMLNPDGSVNTAHTTNPVPIILVDKDLKEVKDGILGDIAPTILKLIGVKQPEEMTQNSLL

SEQ ID NO: 53929 - protein, 118 aa, Ricinus communis
MAAEEGQVIGCHTVEAWNEQLQKGNDTKGLIVVDFTASWCGPCRFIAPFLAELAKKLPNVTFLKVDVDELKTVAHEWAVESMPTFMFLKEGKIMDKVVGAKKDELQQTIAKHMATAST

SEQ ID NO: 53930 - protein, 149 aa, Glycine max
MAARSENESDGDVGTNPAEGGSSLSLPPLAAGPAVCVLRSAGDFAGGAFVGSIFGYGQGLLSKKGLKGSLGNAGSSAKSFAVLSGVQSLVLCLLRKLRGKDDIINSGIAGCCTGLALSFPGTPQALLQNCATFAAFSCIMEGLNKQQTR

SEQ ID NO: 53931 - protein, 112 aa, Fragaria x ananassa
EITGHPAGITQLQRVGIGLVLSAVSMAVAGIVEVKRRNYALAHSPLAPGGISLFWLSFQYAIFGIADMFTLVGLLEFFYREAPAGMKSLSTSFTWLSLSFGYFLSSTLLRTH

SEQ ID NO: 53932 - protein, 264 aa, Pseudomonas fluorescens Pf-5
MSSIQSQGTALVTGASSGIGAVYAERLAARGFDLLLVARDEGRLKVAANALSDKYNVQVEVLKADLTLKNDLLNVEQRLRDDSRISLLLNNAGVAANGALAGADLDQMEHMIQLNVVALTRLAGVAATSFSATGRGAIINIASVVALIPERFNATYSATKAYVLSLTQSLQAELKGSGVRVQAVLPGVTRTEIWERSGLDAKAIPAEMVMEVQEMVDAALSGLDQGELITLPSLPDPADWQALVAARLALGPNLSRSSAAARYK

SEQ ID NO: 53933 - protein, 587 aa, Brassica oleracea
MEMESCKLFIGGISWETTEDRLREYFQSFGEVLEAVIMKDRATGRARGFGFLVFSDPIVAERVVFLRHVIDGKLVEAKKAVPRDDHVVLNKSYNTSLQGSPGPANSKKIFVGGLASSVTEAEFKKYFAQFGVITDVVVMYDHRTQRPRGFGFISFESEDAVDKVLQRTFHELNGKMVEVKLAVPKEMALNPIRNQMNVNSFGSSRISALLMNEYTQGFSPSPISGYGVKPEVRYSPGLGNRGGGFSPFGHGYGIELNFEPDQSQNFGSGSSAGFGRPLSPGYAPSLGRYGSQIESGGAGNGPVLNAATKNHLWGNGGGLGYMSNSPISRSSFNGMSSLGSIGDNSRRNSYRSEGGGGLGLEAMRGGHVGGYSSGSSSLETDSLYSDSAWLSLPAKAEERMGAFDFMSRGPAGYINRQPNGEVAAASPLSSASSECNSNSCRWKPYSNSTDFQANASVLLILIFSSLICALSLCAAIRCFLRPTTPETDDNDHKSDLEADSSFTIPTPTLVYSSDLELAGAEAECAICLSEFEQGESIQVLEKCHHGFHVKCIHKWLSSRSSCPTCRTSIFLQSTLDSTPSTEAPSTN

SEQ ID NO: 53934 - protein, 184 aa, Treponema denticola ATCC 35405
MKKAFLFLANGFEDVEALTPIDYLRRAGIDLITVGVGGKTIVSSHKVPITCDIVLEEALQKDGDLIAVILPGGLPNSSTLAGSEAVREFAKKTLAGGGIVAAICAAPALALGSWGLLEGKNYTCYPGMGQDLSTKPKAGERVIRDGNIITACAAGAAEEFAFAIVEAICGKTALNKLKTEVVAR

SEQ ID NO: 53935 - protein, 324 aa, Oryza sativa (japonica cultivar-group)
MTMPFAVSDPSASVEEMVAAAAADDECVCVWLEEQYEKVEKIGEGTYGVVYKGKHRHTNETIALKKIRLEQEDEGVPSTAIREISLLKEMQHRNIVRLQDVVHKEKCIYLVFEYLDLDLKKHMDSSPDFKNHRIVKSFLYQILRGIAYCHSHRVLHRDLKPQNLLIDRRTNSLKLADFGLARAFGIPVRTFTHEVVTLWYRAPEILLGARHYSTPVDMWSVGCIFAEMVNQKPLFPGDSEIDELFKIFSIMGTPNEETWPGVASLPDYISTFPKWPSVDLATVVPTLDSSGLDLLSKMLRLDPSKRINARAALEHEYFKDLEVA

SEQ ID NO: 53936 - protein, 224 aa, Cryptococcus neoformans var. neoformans JEC21
MSSSPNNRAIRRKLVIVGDGAAGKTSLLNVFAVGHFSESYEPTVFDNYVTEIELDGKPVQLALWDTAGQEEYERLRPLSYSKAHVILIAFAVDTPDSLENVTQKWIEEVRSICGKAIPVILVACKADLRDKAVANGTYSPERFTDHATGQRIADSIGAKGYFETSALQNRNVDAVFEAATRAAVLVRDAGHGGVGAPNGSFDAGGRKDWGREKEEKKFGCCVIA

SEQ ID NO: 53937 - protein, 299 aa, Candidatus Carsonella ruddii
MNLFNFVKKKIKISIDSADLNLIKKYNFDSLTSNPSLILLSFLNNSYNKILKFFFKNNNKKILLDPDTEISFYDYLLIFVVCNLIKFIKDKISIEIPARISYNYNKIIIYSQKILFLCDQFGINKNRILIKIPATDSGIKAASKLKLSGIECNLTLIFDLNQVKKCFDNEIYIISPFVGRISDIINCNFDSGVNFVKNIYNYKKNYNYKTKIMAASFRNLNQILNLLFCDYITISPIYFEKLLNKKINFNINDFQIFKINFNLNFLNLISSKLLINGIIQFEKDHNSLIKLIYFLINNF

SEQ ID NO: 53938 - protein, 948 aa, Yarrowia lipolytica CLIB122
MIVFLGAFSACMSGEVDIGLYLADSSSDLGFFVCIYISISPVDCTHSSHPPTMLRLKLFGKEKSSEEEVETEIGEVLDVSDVPEISEIPPDVTEYVAQQLGTPPNDVDGSYPADVLFMAEKFLLMSENEAIEICTRNLKYHEFDPNFRDSHKDLLAELLKSFNGSGDPDEAASDEKDEKDEKDDLDPIQKSMLLRFWATLFHWWSPYPEVRAVTDPFDDDSQTCLTWRVLLLGTIWVGVGAFVNQFFDPRLPAITLSASVCQLLLYPSGRLLQYCLPDWGFSIRGHRFTLNPGEWSQKEQLLATVMVNCANGTPYVAENIFIQYMPMFYNQKWAGGFGYGFLLMLVTQFMGFGLAGLLRRVGVYPVMAMWPSILPTLAVNKALLAPNRKESINGWTITRYHFFFLVFLASFLYFWIPNYLWTAISTWNWMTWIAPNNADLAIVTGSISGMGYNPIPTFDWNMMNMLISPILTPLYSSMNQYVGMFVSGLFILAVFYTNNNYTKWLPINDNTLYDNTGNPFDVTKILTNFIFDESKYKKYSPPYYSAANLVLYGAFFALYPMAFVYSVLCYWKQMGIALRDTWLSLRYIHRSNYEGLDDAFSRIQKKHKEVPDWWFYAILLIMFGLSIALVEHWPTDTPVWVIVLCLGMCLVFLLPFTIFYSISGVLLTLNVLGELIIGYALPGKFQALNTTKALMVQIADQAMNYTTDQKTTHYAHLPPRSIFMIQLWATLVNGLVCLGVLQFQMFSVKEICTKHNSMKFSCPNENTLFSASVIWGVIGPKRIFDHQYPVLKWMFLLGAGVGLLFWAFQYGLPMVLVKRYPASIKKILRYQRIVSKAHPLILCSAMLSWAPYNLSYMTGGFYLAILFNWYLKTRYLEWWRKYAYVFSSGMDTGVALSAIVIFFAVEYNDYGLSWWGNNVSSAGVDGQGIPIPPLPDVGYFGPGPDHYP

SEQ ID NO: 53939 - protein, 338 aa, Treponema denticola ATCC 35405
MKILGIESSCDETAAAVVEDGNKILSNIVATQIPFHKMYNGVVPEIASRKHTEWILPVVKQALAEAGLSLKEIDGIAATGRPGLMGSLLVGLTFAKTLAWSSNKPFIAVNHMLGHLYASHLENDIPYPYLGLLVSGGHSIICKVNNFDDIEVLGTTIDDAPGEAFDKVAKFYNLGYPGGAVIDKLAKSGNPKAANFPMPIIHKEGHKYDVSYSGLKTAVINQIDQFWNKDFEKTPENIAAAFQTRAVKILLRPLLDASIDTGLKTIVAGGGVAANSLLREKLAEHKELKCIFPSLKFCTDNAAMIAGLGYHYLKRGDRTPFTVEASARVEGFSKKGRQ

SEQ ID NO: 53940 - protein, 144 aa, Arabidopsis thaliana
  misc_feature (12)..(12): Xaa can be any naturally occurring amino acid
  misc_feature (47)..(47): Xaa can be any naturally occurring amino acid
  misc_feature (52)..(52): Xaa can be any naturally occurring amino acid
  unsure (1)..(144): unsure at all Xaa locations
MASSMLSYAAEXTSPAQATMDAPFTGLKPSDALPDTHKANIASVASXNGGRXICRKARPPSGKKKKETLSYLPDLTDVELAKEVDYHLHNKRMTCAENEMEHGFVYREHGNSPGYYDGRYWTLWKLPLIGCTDSAEVLKEDEEC

SEQ ID NO: 53941 - protein, 249 aa, Synechococcus sp. RS9916
MSSWRRCGECWTLWPRQQVQGVVEFVGGSYLAATPHISYRRLLEGLVHSGLAVHAWSYVPGFDHQLQARQAWNAMRQCRTTLQERIGSRLVPLRLGHSLGCKLHLLAPDGGRGCHGLVALSFNNFTADQSIPLLGVVAPSLGVSTEFSPSPQETLRLIACHYHQAHNLVVRFGDDQLDQSLELVKALQSRNGDGSQLLHLPGDHLTPASAGLRRQFLGDWAEGSERQQQVEQLQQLITSWAVTGTTASG

SEQ ID NO: 53942 - protein, 166 aa, Oryza sativa (japonica cultivar-group)
MGVVSAAADAAVVLFSLTVAVAAPLIDAQSVLPRHLFPAPLVSLKRWYAREFGDYLVARPPGFLRGLVWLELAFLWPLALATLYGILARRRWAATTSLIAGVSTLTSMSAILGEIVGSKKATLKLLQMYVPFAVFAVIAILRGLCSSAPRGTAGSSLGPSARKKRA

SEQ ID NO: 53943 - protein, 293 aa, Staphylococcus aureus subsp. aureus MSSA476
MAAQDPRTKFKTTDYEKQEQEVPGLQSEMTPAPDCGETSYQGHQRLQGYKILVTGGDSAIGRAAAIAYAKEGADVAINYLPSEEQDAQEVRQVIEESGQKAVLIPGDIRDEQFNYDLVEQAYQQLGGLDNVTLVAGHQQYHDDIHGFTTEAFTETFETNVYPLFWTVQKALEYLKPGASITTTSSVQGYHPSPILHDYAASKAAIISLTKSFSEELGPKGIRVNCVAPGPFWSPLQISGGQPQSKIPTFGQKTPLGRAGQPVELCGTYVLLASEESSYTTGQVFGVSGGVQID

SEQ ID NO: 53944 - protein, 617 aa, Magnaporthe grisea 70-15
MNQAAPTTAIDIAQIEEGIKMANLDTLRGYSNTTPAPVQQAIKTEYTPMSQAAGYQVIREPMWNKGLMFTPEERVSKNLTGLLPHTMETEDIACARAMKMIRSRSTNVDRYLYLSSLKSSNTDLFYRLLMDNVRELMPLVYTPTIGDVCLQYSSLFTRPEALYISIKQRKSIKTMLANWPYPNPEICVITDGSRILGLGDLGINGVGISIGKLALYTAAAGIHPSKQLPIVIDCGTNNEENLRDPLYLGLRSKRPSVQEQQDFCDEVMHSIKEVYPNMVVQFEDFETEKAFNYLDRYRFDPKLNCMFNDDIQGTGAVVLAGYINAVKLSNVPVEEQRLVFMGAGSAGAGVARQLVDYYRNAHGMSEQEAKDKFYLVDTKGLITSDRFDGAKLPSHKRYFARDDNNGHQFQTLEDVIEFARPSALVGLTATFGVFTESIVRGLKASVDAAGHRNRRPILFPLSNPLTKAECTFSQAIDWTDGTVIFASGSPFAPHTVKNGDSATTYYPNQGNNVYVFPGIGLGAILAKASRVTDEMVYTSAEALANCLNADEIATGLIYPRIDRVQDASLVVAREVMKCCRRQGFSKLDDELWKSWEEWGDNALMAWIKTKLYKPLKE

SEQ ID NO: 53945 - protein, 450 aa, Schizosaccharomyces pombe 972h-
MPSILLLGSGFVAHPTLEYLSRRKENNITVACRTLSKAEAFINGIPNSKAIALDVNDEAALEKAVSEHDLTISLIPYTYHATVMKAAIKHGKHVCTTSYVNPKMAELEEAAIKAGSICMNEIGVDPGIDHLYAIKTIEEVHKAGGKIKSFLSYCGGLPAPEDSNNPLGYKFSWSSRGVLLALRNSAKFYENGKLVEIDGKDLMETAKPYFIYPGYAFVCYPNRDSTVYQERYQIPEAETIIRGTLRYQGFPEFIHCLVDMGFLDETAQEYLSPEAPALPWKEVTARVIKAESSSEADLIKKISSIHKFKDEDDKKRILNGLKWLGMFSSKPVTPRGNPLDTLCATLEELMQYEEGERDMLILQHKFEVETKEGKRQTRTCTLLDYGVPNGYTSMAKLVGVPCGVATQQILDGVINTPGVLAPNDMKLCGPLIDTLAKEGIRLEEEIIDEE

SEQ ID NO: 53946 - protein, 226 aa, Oryza sativa (japonica cultivar-group)
ARWTSRSSLSTRSATATVRCFSCWWGATSRRRYQRPASEAVPYFEQIGPLFSQVMPMMEASPVYSAARNASGDAWKALFDLAGGLIQVYDQEAMLSLSKFVDQLPSVMNQVTEGVSEFKPTPPENREFCKNSYNVPNTLLVKFSIDAIDDTEIVEDVLKPRVESIGGQIKKVILSGTHLTPCIQDVKWQVGSEYTPADALAQGLKSLALNETRVLSRTIADWFRSL

SEQ ID NO: 53947 - protein, 385 aa, Triticum aestivum
MALRAASPPCAAGRCLPSSPPPRVGGRHFFRPLSSAAPAPLRKSAVCTKAISNSDGTPGTSDSPHVVCFGELLIDFVPTVSGVSLADAPAFKKAPGGAPANVAVGIARLGGSAAFIGKVGDDEFGYMLSDMLKENNVNNQGLLFDTHARTALAFVTLRSDGEREFMFYRNPSADMLLEEKELDLDLIRKAKIFHHGSISLITEPCKTAHIAASKAAKDAGVLISYDPNLRLPLWTSADDARDGILSIWDTADLIKVSAEEVSFLTNGENPYDDSVVKKLIHPNTKLLLVTEGPDGCRYYSKEFSGKVGGLKVTAVDTTGAGDAFVAGILSQLAADFSLLQDEARLREALKFANICGALTVTERGAIPCIAPPDSKWLDALTNVVA

SEQ ID NO: 53948 - protein, 113 aa, Brassica juncea
DTIFGKIISKEIPSTVVYEDDKVLAFRDITPQGPVHILLIPKVRDGLTGLFKAEERHIDILGRLLYTAKLVAKQEGLDEGFRIVINDGPQGCQSVYHIHVHLIGGRQMNWPPG

SEQ ID NO: 53949 - protein, 128 aa, Zea mays
MSSEKEAALRRLDDSPTIFDKIIKKEIPSTVVYEDEKVLAFRDINPQAPTHILIIPKVKDGLTGLAKAEERHIEILGYLLYVAKVVAKQEGLEDGYRVVINDGPSGCQSVYHIHVHLLGGRQMNWPPG

SEQ ID NO: 53950 - protein, 379 aa, Desulfotalea psychrophila LSv54
MRMKDIFEFADELGPLKVIHVYEPSVNLRAVLVVDNIARGPSLGGVRMATDVSVEECVRLARAMTYKNSAAGLPHGGGKAVLYGDPKMAKVEKEKMIRALAKVLRNEDSYIFAPDMGTDEECMAWVQDEIGRVVGLPREIGGIPLDEIGATGFGLSHAVDVALNYCDFQLEGARVVVQGFGAVGKHAARYLSQRGAVLVAVADSRGAIYNPDGLDVQQLIALKAAGGFVGDYPEARKMTGDDLLDVACDIWIPAARPDVIHEANVHRLNTRLVVEGANIPLTHGAERILHERGILCLPDFIANAGGVICAAMEYQGASQVAALAMIEEKLRANTEQVLAMVKDRDMLPREAAMEMALGRLKKAMSYRRFSLFSSGPKFI

SEQ ID NO: 53951 - protein, 539 aa, Symbiobacterium thermophilum IAM 14863
MRHQLTLHTMLERARRFFPDKEIVSRTGAGIFRYTYADYYDRTRRLAAALERLGVRRGDRVGTLAWNHHRHLEAYFAVPCMGASLHTVNLRLPPEHLAYVINHAGDRVLLVDADLVPLVEAVRPQLKTVEHYIIMADVSLPETRLSPVHGYEELLASAQEDYRFPEDVDEWAEAGICFSSATTGMPKGVCYAHRAIYLHSMMVCMADTVGVGERDVVMPVVPMFHVNAWGLPFAAVWMGAKQVLPGPRPDPHTLCRLIQDEKVTLAAGVPTVWMGVLQAVEQERYDLSSITRIACGGAAPPRALIEAYELKLGVPFLHAYGMTEGAPVTHVGRLKSTLEGAPTDQRYAKKAKQGLLAPGLDMKVVDAEGNEVPWDGRSMGEMALRGPWIADAYYDDGRTAETFRDGWYYTGDVVTVDPDGYMQIVDRVKDLVKSGGEWISSVDLENAIMAHPKVAEAAVVAVYHPKWQERPLACVVPKPGVELTGEEIKEFLKGRVADWWIPDDVVFIPEVPKTSVGKFDKKVLRTQYWNHLAQQQTMP

SEQ ID NO: 53952 - protein, 330 aa, Mycobacterium leprae TN
MVVAGINFGDAAFAATVQDRVVRIEQLMDAELRDTDEVMTESVLHLFAAGGKRFRPLFTVLSAQIGPRPDAPEVIIAGAVIELVHLASLYHDDVMDEAEVRRGAPSANLRWSNSVAILAGDYLFATASRLVSQLGLDAVRIIADTFAQLVTGQMRETRGVPEGADSIEQYLKVVYEKTGCLIGSAGRLGGLFAGAHAEQVERLSRLGSIVGTAFQISDDIIDIDSDYTKSGKLPGTDVREGVRTLPILYALRETGPDSERLRALLAGPVDNDAEVVEALALLRASPGMARARQVLAHYADQASGELAQLPDGPSRDALATLVDYTTNRHG

SEQ ID NO: 53953 - protein, 175 aa, Triticum aestivum
  misc_feature (63)..(63): Xaa can be any naturally occurring amino acid
  unsure (1)..(175): unsure at all Xaa locations
MAPTVMATSVTSVAPFQGLKSTAGLPVSRRSSSAGLGSVSNGGRIRCMQVWPIEGIKKFETLXYLPPLSTEALLKQVEYLIRSKWVPCLEFSKVGFVFREHNSSPGYYDGRYWTMWKLPMCGCTDTTQVLKEVEDVKKEYPDAYVRVIGFDNLRQVQCVSFIAFRPPGCEESDKA

SEQ ID NO: 53954 - protein, 540 aa, Piromyces sp. E2
SNPDSTNGNVACDSYHKFDEDIKMMKIMNANHYRFSMSWSRLFPDGQAKKVDGKWNVNEKGAEYYDMMINTLIENDIVPMATLYHWDLPYALHEKYGGWLDYHSQFDFANYAEFCFERFGDRVKNWVTINEPWVNCVGGYKNGPGKAPYRCTGEAPRKLANDTTGLDLEGGCSYEIGPSQYYKGAKVLSANRPPQRLEDVWCSHNILLGHAQAVKVYREKFQKKQKGLIGITVDGEAEIPWEEPNMSEEELENNKKYAKLGTEFRIGWYSDPKIFGDIAGSVKQRMGKEMPVFSDEEKAILKGSSSDFLGWNTYTSHWAAQVKNEDGTYIQPPTDEKASYENSKRDMWDDNCKGRGEGWTCIPPTLGSQAGSSWEYLYGPTILVGLNWLYDRYKSVLKNGIVITENGCAQPNYKVSRANDQVTLDYFKSIGKEEFVDTYDESIIEDEKNIEGSILHDTYRINWYKQYLENLRLAYVEDKFDVRGYMAWSLIDNFEWENGYETRFGMTYIDFYNDKELTRVPKDSLTFLGQWYLDNVEQKN

SEQ ID NO: 53955 - protein, 302 aa, Brassica oleracea
MDSHPYSKSANFVELLNSQQENVFAFSQDSVDLSASQLPGFCFKATEASNLVQETAAQRKERRKWTPVDDVVLISAWLNTSKDPVIGNEQRCGTFWKRIATYFAASPKVAGTEQGEWSHCKQRRQKINYLVNKFCGAFEAASREKSSSQNENDVLKLAHEIFYNNHKKKINLEHAWIELYNDQKWCELSSSKTQGSAKRRKCDDGAQSSSSHMNETTTAEDDQERNRPPGVKAAKGHDKKKMAERKALSEFQDMWSIKKEDMAMKERLSKMKPLDSLLAKQVPLAEYEEALKKKLINELLLN

SEQ ID NO: 53956 - protein, 324 aa, Brassica oleracea
MKGLFKSKPRTPADIVRQTRDLLLYADRSKSLPDLRESKREEKMAELSRNIRDMKSILYGNSEAEPVAEACAQLTQEFFREDTLRLLITCLPKLNLETRKDATQLVANLQRQQVNSRLIASDYLEANLDLMDVLMEGFENTDLALHYGAMFRECIRHQIVARYVLESEHVKKFFDYIQLPNFDIAADAAATFKELLTRHKSTVAEFLTKNEDWFFTDYNSKLLESSNYITRRQAIKLLGDILLDRSNSAVMTRYVSSRDNLRILMNLLRESSKSIQIEAFHVFKLFAANQNKPADIINILDERFEADKSQVLREIAALEPRDLA

SEQ ID NO: 53957 - protein, 339 aa, marine gamma proteobacterium HTCC2143
MPTINRRRFLQFGAATAVVASATACSSDGPQATIDKQLPVGPYGADATAESVTKDMDLSGKTAVVTGCNSGIGYETMRVLALRGAHVIGTGRTLEKAQIACASVEGITTPVALELSDFQSAVDCANRIKAMNTPIDIVICNAGINTFGELELIDGIERIFRVNHLGHFVLINNLLPALASANAGRIVHVGSVSGYVQAPAVGIDFDNLRGEKIFDAGEAYGRSKLANALFSLQLSKNLADTTTTSNVIHPGLVLTNIARTAPAFLRKGFEWVGPLFAKTPAQGAATQVYVATHPSLEGISGAYFEDCNPVTISGDHHMFDEAMADKLWSVSMEMTRGFI

SEQ ID NO: 53958 - protein, 221 aa, Brassica oleracea
MAFYSEDNKSEDYLFKIVLIGDSAVGKSNLLARFARDEFYPNSKSTIGVEFQTQKIVINGKEIKAQIWDTAGQERFRAVTSAYYRGAVGALLVYDISRVQTFQSIGRWLNELHTHSDMNVVTILVGNKSDLKDIREVPTSEGKALAEAQGLFFMETSALDSSNVAAAFETVVKEIYNILSRKVMTSQELNKQDPASLSNGKKVVIPSEGESKTGGGGCCSR

SEQ ID NO: 53959 - protein, 376 aa, Brassica oleracea
MEGLLSYRSNVLRNIMREREKDRKKMLISEIFSENEDEEVVIIGGLVMVQFVYAGNSLLMSYLMSLSLGPLTIVIFSTFATFLILSPFAILFERKQWPDELSPRLIGKLVLISFAGVTLFQTLFLEGIRLTSPAMATAMPNLAPGLIFFIAWMVRLEKMDMKCVYSKLKILGTLLCVFGALTMSLMHSASIIQDEKDNASIFVFDRDRVVGCMYLLGAVFILSSNVVLQASTLAEFPAPISLSAITSLIGVVITTMLQLLQNPNTKVVTRSLISISNLVGFSLLGGMVSGACVSFNGWAMKKRGPVMVSMFSPIATVISVGLSVVTLGEPVRIGSVGGMALMFIGLYLVLWAKGKEGFSQIDSFESEYDPKKPLLS

SEQ ID NO: 53960 - protein, 297 aa, Candidatus Carsonella ruddii
MNLLNYLYINKKISIDSADLNLIKKYKFNSITSNPTLILKSFLNKTYNLLLNLFFYKNNKKILLDSDIQISLYDKILILIVGNLIPFINDKISIEIPARISFNYNLIIIYSKKIIFLCNKYGINIKKILIKIPGTDSGIKAAKKLKEIGIETNITLIFDINQVKKCLDYGVYIISPFVGRISDSIFCKYDSGVNFVKNIFIYKNNNNYKTKIMAASFRNINQILNLTFCDCLTISPIYFSKLLKFNLKLLFTNNIKKSIKINFLNKHSSKLIINGINIFDKDHKKFINIISTIINNL

SEQ ID NO: 53961 - protein, 1812 aa, Oryza sativa (indica cultivar-group)
MADPFVADDQTDADFFDKLVDDDDDLSPAPAPAPVPAQQSAEAALLPALSDLSLADDDTDPSPAPPPVEAPPEGASPESGKGAVHTTVKQVQWASFGGAADDGADPFSDLSGGAADDGFLGTMAGNQSFQTSVIGSVGASAHGIFGGSQSLTAEVTDQDFFGGTSDQNTDTQQQQLEQSGSGAFDSTDPKYLESIYPGWKYDEATQQWYQVDNSDTHGNATQVDTSTENIQQQQLAASYMHNPTQSSLETIAEEGTTTGSVSTWGQGGTSEYPPNMVFYTEYPGWYFDTNTQQWQSLESYQQAVTASAVQDGANNGVVASSAETNYSVKQTEDLPVHNQVAQHNSFSNNYSYQSQWQTNSFSNSMQPESATASLPDSFQSLGQHAISESFNSSTNSQVSFNTAETATSHYGNVNLDSSSTQGGYTASGGQQTGYKGFEPFTGHQAGYKGFEPSTGHQTSHKLFDPSAGQQAGYTGSLPSTGHQSSYMGFETSSNQGYGDANNVANSQGFVPMESMYGSHNQAHTNPQVPLSNSYLSADNSKNFSQQQFLGPNASHLQFGQSPHEERSSAGRPPHALVAFGFGGKLILMKETNSMATNYDSGNQGNSSGTVSVLNLSEVVTDKADALSASNGSALSYFHALCRQPVPGPLVGGSAASKDVNKWLDDMIALYESSTSEFQRGDPRKLLISLLKILCHHYGKLRSPFASDPSHEDTDGPEMAVTKLFSSCKRSSFQMGDFGSHVRCMKNIPSENQMQAVAQEVQNLLVSGRRKEALQCAQEGQLWGPAIILALQLGDKFYVDTVKKMAHCHFLSGSPLRTLCLLIAGQPADVFNADNNISSNYGSQQPMEPSPNGMLDDWEENLAIITANRTKGDDLVITHLGDCLWKEKNEVAAAHSCYLVAELNIDPYSESARLCLLGADHLKCPRTFASPEAIQRTEIYEYAKVLGNSQYILLPFQPYKLIYAYMLAEVGRVADSLRYCQASMKVLKASGRAPELEAWKQLFSTLEDRIRTHQQGGYGTNLAPAKLVGKIFTSLDKSISRMMGTPSAPLPPLPQGAVSDRESYTAPGATKFANSQSVMTMSSLMPSASVQSMSEMSDSGRKIAHNRSVSEPDFGRTPKQGAGSDSTQSTAPGSGSSRFGWLGSTLQKTMGFVSKSHRQAKLGQQNKFYYDEKLKRWVEEGAEIPAEEPPLPPPPSKPSFQNGVVDYKLNGPMSASHTPNGFMEGKSSTSSEHGSGMPPIPPSQNQFSARGRMGVRSSMRDERGQYHVVVWFDVIHLLRTLRDALDYDRSALVRYFSAASASFPTTGGAAAGVEKRIGGARFPQCKQPGKELETFKVSLGGLNGRYACRRAPNNCIPTTITGLNGSLSCGQVSSARSFSSSADLPPHQEIGMPSLSPTMTEGNIARWLKKEGDKVSPGEVLCEVETDKATVEMECMEESYLAKIIHGDGAKEIKVGEIIAVTVEEEGDLERFKDYKPSTSAVPAAPSELKAQPEPAEPKVKETEPSRIPEPKAPKTEEASQPGGRIFSSPLARKLAEDNNVPLSSVMGTGPDGRILKADIEDYLASVAKGGKREALAAPGLSYTDVPNTQIRKVTANRLLSSKQTIPHYYLTVDARVDKLIKLRGELNPLQESSGGKKISINDLVIKAAALALRKVPQCNSSWMSDFIRQYHNVNINVAVQTEHGLFVPVIRDADKKGLGTIAEEVKQVAQRARDNSLKPEDYEGGTFTISNLGGPFGIKQFCAIINPPQSAILAIGTAEKRVIPGSVDGQYEFGSFMSATMSCDHRVIDGAIGAEFLKAFKGYIENPNSMLL

SEQ ID NO: 53962 - protein, 200 aa, Arabidopsis thaliana
MGDSVSSSSRVSVHQSLGAGSVADLLLWRNRTGAVILLISSTGFWFLFERAGYNLLSFVSNVLLLLVPIFFLWAKSATVLNRPLPPVPNMEIPEEFANKAADDLRVWINYVLSIASDITIARNPIRLLQVSLVLWAISYVGTLINSLTLVYIGVLLSLSFPIVYEKYQDHIDEKVNSTSKFVRNISRKFPLPINKEKKHQ

SEQ ID NO: 53963 - protein, 398 aa, Oryza sativa (indica cultivar-group)
MGGSRHLFRFLAADDHPFFPTFPTSSSSFLLDDTHPFFFPPSSSCPLGFTSPPSSSCPLGFTSSYDLDAAFHHHLDLDLDLDLFLPTPTPPVTTSCPALRDPFLLHHSLAHRVSALELAAPRSKYTYEAESAGRKIKWTTHDKPDGDRTFKWEAQIDTPNDDGFDRKWKWESKASAAGATKLKWAKEVKGKGFLHPWSHAYSVEEVFGDDDHHHKADKTAENKVKQHNKDTSAKEEKKKTNKSNVQIVEIDDNTAGCVAINKAFASSYAKGKRKQLSPQDAALLIQMNYRAHLAHRSQVLRCLRHLAVAKAKLKDIRSLFYNISYRRRISHDSEERQRFADKIIALLATVDALEGPDYMVRNAKRSMLEELEGMLEIVGPQSLGKPRTLSRRKFENHI

SEQ ID NO: 53964 - protein, 223 aa, Pseudomonas fluorescens Pf-5
MAIRAVLFDMDGTLLDTAPDFIAVCQGMRRDRGLPPIADQHIRDEISGGARAMVAVTFSMDPESPGFEELRLEFLERYLKHCAVHSKLFDGMAELLADIEKAHLVWGVVTNKPLRFAEPIMQQLGLAERSALLICPDHVKNSKPDPEPLILACKMLDLAPSSVLFVGDDLRDIESGRDAGTRTAAVTYGYIHPDDNPRHWGADVVVSHPLELRQVLDNALCSC

SEQ ID NO: 53965 - protein, 390 aa, Nostoc sp. PCC 7120
MQFAKRLEKIPPYLFAEINRKREALIAKGVDIINIGVGDPDKPTPAHILQAMREAIDDASNHNYPPYEGTQEFREAAVEWMERRFGVMDLNPNTEVVSSIGSKEAIHNTFLAFVEAGDYTLIPDPGYPVYRTSTIFAGGEAFSMPLKAENKFLPDLDLIPEEVARKAKMLWINYPNNPTGALATLEFFEELVALCQQYSILLCHDHAYSEMAYDGYKPPSVLQIPGAKDIAIEFHSLSKSYNMTGWRIGFAVGNAYAIKGLSQVKTNVDSGVFKAIQKAAIAAYATDEVELQAVMSVYQSRRDIIVKGLQSLGWPIEPPKATLYVWVPVPPGYTSTEFTTLLLDKCGIVVPPGVGYGASGEGYFRVALTISDERLHEAIQRMQDAGIRYA

SEQ ID NO: 53966 - protein, 354 aa, Arabidopsis thaliana
MKIEEDLGFINILKRATKLLCGNINLVLFLFLCSLPLFCFLIFFELSLQTTVSLASQYLVRQLTNWDYYYVPQDASVLENLIPLLIQTFLLYLFPYGLIDLFTTTTIVSASWIVHTSEEEPLRFGQLVRRTVEICQNRLEGCLITSLYVLLLSTPVFFGFLFVATNYFHIISLTGSGENSYYYSINIEEDAEGYYRSSSVNSPVKMLFDAVLAMFHGAIFLGLLAMFSKWSAGWNMGLVVSVLEEEENGQSIYGTDALTLSSNYGKGHEKRGLQVMLVFLVFAIAMRMPCFCFKCTESSNGNRVLYTSFYVGLICVGNMIKWVACVVFYEDCRTRVLEKKGDVEIGSKCKTFVA

SEQ ID NO: 53967 - protein, 450 aa, Gibberella zeae PH-1
MPQSALLLGSGFVATPAVEVLSKAGVHVTVACRTLASAKNLAGTFDNTKAVSLDVNDSAALEQAVSEHDITISLIPYTFHAAVIKAAIKAKKNVVTTSYVSPAMEELHEEAKAAGITVLNEIGVDPGVDHLYAVDFIDRIQQEGGKIKSFKSYCGGLPAPENSNNPLGYKFSWSSRGVLLALKNNAKYYEDNKLVDISGVDLMSTAQPYHSGYLGFNFVAYGNRDSTGYRERYRIPDAETVVRGTMRYNGFPQFVKALVDIGFLSTDEQDFFKQSIPWKDALQKFIGANSSSEEDLTKAILSKTSFKDESVKNQVLAGLKWIGVFSDVKTTPRGTALDTLCASLEQKMAYEKGERDIVFLQHTFEVINKDGSQNTWTSTLVEYGAPEGSGGFSAMSRLVGVPCGVATKMVLDGTITDKGVVAPVYPSLARTLMNELKNNYGIECKEKIIA

SEQ ID NO: 53968 - protein, 479 aa, Glycine max
  misc_feature (331)..(331): Xaa can be any naturally occurring amino acid
  unsure (1)..(479): unsure at all Xaa locations
MMENGGKQTFEVSNDTLQRVGSKSFDDDGRLKRTGTIWTASAHIITAVIGSGVLSLAWAIAQLGWIAGPVVMILFSIVTYYTSTLLATCYRSGDQLSGKRNYTYTQAVRSYLGGFSVKFCGWVQYANLFGVAIGYTIAASISMMAIKRSNCYHSSGGKNPCKMNSNWYMISYGVSEIIFSQIPDFHELWWLSIVAAVMSFTYSFIGLGLGIGKVIGNGRIKGSLTGVTIGTVTESQKIWRTFQALGNIAFAYSYSMILIEIQDTIKSPPAESETMSKATLISVLVTTVFYMLCGCFGYASFGDASPGNLLTGFGFYNPFWLIDIANAGIVXHLVGAYQVYCQPLFSFVESNAAERFPNSDFMSREFEVPIPGCKPYKLNLFRLVWRTLFVILSTVIAMLLPFFNDIVGLIGAIGFWPLTVYLPVEMYITQTKIPKWGIKWIGLQMLSVACFVITILAAAGSIAGVIDDLKVYKPFVTSY

SEQ ID NO: 53969 - protein, 386 aa, Gibberella zeae PH-1
MFPSLFFTSILAAGISAQSIPDPALTANRAFQHLGCVAIRPGTFPRQFNLGQTGCASTCSSNGNIIGFRGNSCVCDRLDLSDRPITYRVVKVDNALCTQWCDPADKSKGTCGGASVQGWPIYDLYKRNNAQIVYENFPSATPTPMSSAYPVQTGGPKPGDVWHECPPHVVNCPYRNKCPSGNCHPVHKPIVKPCYGCSHNGTGNWTAPTCPPGGCGNGGKPAPAPVPVPVPNPPCKDCNNGNDGNGGNGGNGGNGGNGGNGNNEGNGGNGGNGGSGGNGGDGGSGGNGGSGGNGGNGGNGGNGGNGNNGGNGGSGGNGGSGGNGGNGGSGGDGSSGNSSDGQNGSDGNGNGNGGDTPPVIVNSAIKIQSASFISFFLTFSLTFILL

SEQ ID NO: 53970 - protein, 938 aa, Magnaporthe grisea 70-15
MAFKTTFEPEKVIQPIFTGGSIALDSKAQILASTLGEDAVLTDITTGKRLATIEGDGEPISTLTLTPSSSHLIISSRSLSLRIYSLAIDSDNASIEATLTRTLKPHGTPVVVLAVDRTSTLLATGAADGAIKVWDIVGGYVTHTFRGPSVLASALRFFEVAATAEDTKGQKKKKGKKSQGAAEAESDVNSTTVNFRLASGSQDGRVRVWDLHKRAAIGDLESHVSDVTGIDYSAQENSLITASRDKTIIWWDVRTWQPKKIVPSLELVEAAGFLDDGRLAYSAGANGRVRLWESETGREVTKEQSPRTEGEAFVGAVYCAQQSLLVCVQSDHTLVLYTTPTVNSATIPELEPLSPTRRISGTHDDIIDLGYLLPDRSLMALATNSEEVRVVSVSQEAEGSTYFGQDVTALKGHEDIVIALDTDWSGHWLATAAKDNTARLWRIDPANNSFTCYATFTGHAESLGAIALPKSIPPKSSQAYTDPLNHPPSFLITGSQDLTVKKWEIANVAQQGSKKASRAAFTRKAHEKDINAVDISSTGQLFASASQDKVVKIWSVQEGEVQGILKGHRRGVWSVRFAPADMPILQGEDGATSAGKGIVLTGSGDKTIKIWSLTSYTCIRTFEGHSNSVLKVIWLPIPSTKEDNEAAKKRPVQFASAGGDGLVKVWDANTGECVATLDNHTDRVWALAVKPGTQGSIADADDVDMDGDSEEQVGDALVLASGSADSTITFWRDTSSMTQLAAAKAADELVEKEQELQNHMRAGHYREAIVLALQLNHPGRLLSLFKTVMEEGSNLATAEMRLDEDRKSLTGRAAVDEVIATLSDEQLSVLLLRLRDWNANARTAPVAQRILSVVVRSYPASRLAGLAVARRRAVGGKGVGEVLDALKAYTERHYRRLEELVDESYLVEYTLQEMDSLAPPVDMTAIEEASRDVVMLET

SEQ ID NO: 53971 - protein, 315 aa, Gluconobacter oxydans 621H
MQACNRAIIARMESPVPLIPQLGAHLVAAGGKRLRPLLTLASSRLCGYKSTPENQRHVGLAACVEFIHTATLLHDDVVDESNLRRGLASANAVFGNKASVLVGDFLFARSFQLMTADGSLKVMAILSDASATIAEGEVLQMVTQNDLSTPVDRYLEVIHGKTAALFAAACRVGAVVADRPEAEELALDRFGTNLGMAFQLVDDALDYAADQQILGKTVGDDMREGKITLPVLAAYEAGSAEDRAFWERVIEKGEQTEADLPHALALIEKTGAIATTIARAQAYAAEAVDALSIFPDSELRRLMTETVQYTVDRAR

SEQ ID NO: 53972 - protein, 337 aa, Ajellomyces capsulatus
MVVKVGINGFGRIGRIVFRNAIEHGEVDVVAVNDPFIETHYAAYMLKYDSTHGQFKGTIEVNSNGLTVNGKAVTFYQERDPANIPWGKHGVEYVVESTGVFTTTEKASAHLKGGAKKVIISAPSADAPMFVMGVNEKTYDPSVNVLSNASCTTNCLAPLAKVINDNFGLTEGLMTTIHSYTATQKTVDGPSSKDWRGGRTAAQNIIPSSTGAAKAVGKVIPSLNGKLTGMSMRVPTANVSVVDLTCKTEKPVTYDQIKQTIKKASEGELKGILGYSEDALVSSDLNGDSRSSIFDASAGIALNDHFIKLISWYDNEWGYSRRVVDLIAYIAKVDAGK

SEQ ID NO: 53973 - protein, 665 aa, Piromyces sp. E2
MKSLTIFTTLLAISAAKKCVVRNPVDNTKNDLAPVFNEDTPSDDETPVNVDDNTPVEKEDDSAIENSDIEDSENKSKGKLPADFKWGAATAAYQVGGAWNEDGRGESVWDHFTPLYPKNVESGDRTNPDSTNGNVACDSYHKFDEDIKMMKIMNANHYRFSMSWSRLFPDGQAKKVDGKWNVNEKGAEYYDMMINTLIENDIVPMATLYHWDLPYALHEKYGGWLDYHSQFDFAKYAEFCFERFGDRVKNWITINEPWVNCVGGYKNGPGKAPNRCTGEAPRKLANDTTGLDLEGGCSYEIGPSSYYKGAKVLPANRPPQRLEDVWCSHNILLGHAQAVKVYREKFQKKQKGLIGITVDGEAEIPWEEPNMSEEELENNKKYANLGTEFRIGWYSDPTIFGDFPRSVKQRMGKEMPVFSDEEKAILKGSSSDFLGWNTYTSHWAAQVKNEDGSYVQPPTDEEASYENSKRDMWDDNCKGRGEGWTCIPPTLGSQAGSSWNTLYGPTIRVGLNWLYDRYKTVLKNGIVITENGCAQPNYKVSRANDQVTLDYFKSIGKEEFADTYDESIIEDEKNIEGSILHDTYRINWYKQYLENLRLAYVEDKVDVRGYMAWSLIDNFEWENGYETRFGMTYIDFYNDKELTRVPKDSLTFLGQWYLDNVEQKN

SEQ ID NO: 53974 - protein, 576 aa, Schizosaccharomyces pombe 972h-
MSQKSQFAYRSSKSIGLVNASENYASPPKFEAISEPARNACYSPNGKLFAYATATQVVINDTESGAKLTQLPAANTYELGFSPLGKYLSTWERPGKEADGTPKQNMKVWNTETGQLVFSFVQRNQTGWNLQYTCDESLAARLVTNEVHFYETGNMSKGPIAKLRVEGISDFALSPGQNHAVAVFIPEKKGAPASVRTYSIPNFNSPLSQKTFFKADKVQFKWNALGTSLLVLTQTEVDKSNKNYYGETNLYLLGITGQFDCRVDLDREGPIHDVCWNADSKEFGIVYGYMPAKTAIFDNRANVVSIIPPAPRNTLIFSPNSRYILLAGFGNLQGSIDIFDAANNMKKITTVEAANCTYCEFSPDSQFLLTAVTSPRLRVDNSIKIWHITGAPMFYEEFNELYQAFWRPRPLNPTLLQNALTSASLPSPPTPHASASKLAAKPSVKPAGAYRPPGARGQNSTFSYRREEIDVMSSGSANKHVNSSRQRVVPGATPVIDGNKKNNKKTKPAVKQVAQPTAEVSDEKKIRSLCKKLRAIDDLKSRLNNNEKLEATQVKKIESEGKVLAELKALGWTPDA

SEQ ID NO: 53975 - protein, 851 aa, Ipomoea batatas
MNAISNLLRIKDVSFSISFLLNFSYYPNLCILRFRHSVKLKAFLSDPEAPSSVIGRRQLPGALFFSGVACDQDSRVISLAISAVPLFGSLPPEIGLLDRLLNLTLTSVNLSGALPSEMAKLTSIKAINMSNNLLSGHFPGEILVGMTELQVLDVYNNNFSGRLPHEVVKLKKLKILNLGGNYFTGEIPEIYSNISSLQTLNLQTNSLTGNIPASLAQLQNLRELRLGYLNTFERGIPPELGSITTLQMLDLRECNLSGEIPKSLGNLKQLYFLYLYGNSLTGHIPAELSGLESLVHLDLSENNMMGEIPQSLAELKSLVLINLFRNTFQGTIPAFIGDLPKLEVLQLWNNNFTSELPVNLGRNRRLRFLDVSSNQISGRVPENLCMGGKLEALILMENKFSGPFPQVLGECKSLNGVRVEKNYLNGAIPPGFLQFAVGLIYVCLQNNYFSSELPTKMLAKNLTDLDLHNNRINGQIPPAFGNLENLWKLSLHSNRFSGKIPNQISHLKKMVTMDLSSNSLTGEVPASIAQCTQLNSFDLSANNLTGKIPKEISSLERLNVLNLSRNLLTGSVPSELGLMNSLTVLDHSFNDFSGPIPTNGQLGVFDNRSFYGNPKLFYSPPSSSPVNHNNHSWTTKRILIITVLILGTAAAFLSAVIWVRCIIVARREKIMKSNNAWKLTTFKKLEYKVEDVVECLKEENIIGQGGAGTVYKGSMPDGVIIAIKRLDRRGTGRRDLGFSAEIKTLGRIRHRHIIRLLGYASNRDTNLLLYEYMPNGSLSGILHGTNGANLLWEMRFRIAVEAAKGLCYLHHDCSPPIIHRDVKSNNILLTSDYIACIADFGLAKSFNNVGV

SEQ ID NO: 53976 - protein, 531 aa, Schizosaccharomyces pombe 972h-
MGFKRGKNFTLVMLIFVSMAGWMFGADTGSIGGVTSMRDFRERYADRYDPITDQYSLSSARQGLLTGMVNVGSLFGCIISSPIADRFGKRLSIIGFCAVYIIGIIVQVTAVPSWVQIMVAKIWTGIGIGALSVLAPGYQSETAPPSIRGTVVVTYQLFVTGGIFIAACINMGTHKLHKTAQWRVSIGINLLWGIITMIGILFLPESPRYLIQVGKDEEAVRVLSESAELFPDSEEVQNEYHRLKSSIDEEFAGGPCSWASIFGKDIRYRTFLGMFVMSLQQLTGNNYFFYYGFSVMQGAGINSPYLSAMILDAVNFGCTFGGMYVLERFGRRNPLIIGGIWQSICFFIYSAVGSRALYHKNGTSNTRAGAVMIVMACLFIFGFAQTWAPAAYVIVGESYPVRYRSKCAAVATASNWLWNFLISFFTPFIQASIGFKYGYVFASCNLTGAIVIFLFAKETKGLTLEEINELYMSVIKPWESGNFKLNYSEQKKVEKEKSRKGGARGESVEYVERASNTDSSPQYSSHEEDYA

SEQ ID NO: 53977 - protein, 542 aa, Flavobacteria bacterium BBFL7
MGKGFFKVPVAVNEPIKTYAPGTVERDQVLAAYKELWNANTEVPLYINGKEVRTGDTAAIRPPHDHQHVAGTYHRGGKKEVQEAIATAIEARKTWSQLPWEQRAGIFLKAAELIAGPYRARINAATMINQSKTIFQAEIDSACELIDFLRFNVQYMTEIYAEQPESTSGAWNRLEYRPLEGFVYCISPFNFTAIAGNLPASAALMGNVCVWKPSDHQMLSAQVIVEVFREAGVPDGVINMVNADPVMMTDEVMTHPDFSGVHFTGSTSVFRSLWTKVGENINNYKTYPKIVGETGGKDFIVAHSSAVPAQVATAIVRGAFEFQGQKCSAASRAYIPQSMWSEVENLIRTDVESFKMGSPEDMSNFITAVIHEGSFDKLAKYIDGAKNDSNADVVIGGNYDKSKGWFVDPTVIVTTDPKYVTMETELFGPVITIYIYEDDKYAEMLELVDETSEYALTGAILGQDRYAVSQATTALENCAGNFYINDKCTGAVVGQQPFGGARASGTNDKAGSKLNLLRWVSPRMIKETFVTPTDYRYPFLGE

SEQ ID NO: 53978 - protein, 445 aa, Agrobacterium tumefaciens str. C58
MRKDWGDGPGGLGTAMQDKILLIEDSVALSMLLRTRLSDETEAEVVHCASMAEADALMQANNFTLALTGLNLPDAPKGEILTLLSERKVPAIVFTATVDEEARKRYAEKKIIDYIVKDGHRTVDAVVKTVDRIMTNKRFSVLVVDDARTARSGLVEILERQNFKVSEAHSGNRALEILSQDPSIQLVITDYHMPDMDGYELTRRIRDSRSSEDLRVIGISSSTDRLLSASFLKAGASDFVYRPFVPEELQCRIDNNIETLKQLKRLRELAERDHLTGLPNRRSFFERTRALMDVINDNDESGAVAILDIDHFKKINDTLGHDAGDRALKKLAELLQGMCDEQRHIPARLGGEEFAVFLRGLDARAAYAFCEELREQVEKNGRQLSGSSLALTISLGVVEIEKGEPFDNQLNAADQLLYLAKANGRNRVYSDIMIQEGLQKIGLNG

SEQ ID NO: 53979 - protein, 250 aa, Brassica oleracea
MVKIEVGSVGDSFSVASLKAYLSEFIATLIFVFAGVGSAIAFGKLTSDAALDPAGLVAIAVAHAFALFVGVSIAANISGGHLNPAVTLGLAVGGNITLITGFLYWIAQCLGSIVACLLLVYVTNGESVPTHGVGAGLGALEGIVMEIVVTFALVYTVYATAADPKKGSLGTIAPIAIGFIVGANILAAGPFSGGSMNPARSFGPSVVSGDLSQIWIYWVGPLVGGGLAGLIYGDVFIGSYQEVETCEIRV

SEQ ID NO: 53980 - protein, 297 aa, Candidatus Carsonella ruddii
MNIINYLYNNKKISIDSADLNLIKNFKFNSITSNPTLILKSFLNKTYNKILNLFFIKNNKKKIIDSDKEISLYDKILIFIVGNLIPYINDKISIEIPSRISFNYNLIIIYSKKIIYLCEKYGINKSFILIKIPGTDSGIKAAKKLKEIGIEVNITLIFDINQVKKCFDYGIYLISPFVGRISDNIFCKYDSGVNFVKNIFIYKNNNNYKTKIMAASFRNINQIINLRFCDCLTISPIYFNKLSKYNLKILLNNNFNNLVKFNFYNKHSSKLIIEGLKSFDKDHKRLINLLSTIINNL

SEQ ID NO: 53981 - protein, 388 aa, Arabidopsis thaliana
MAAFLQTNISLNAIKIVPGKYSSLTDHQFRAPYRIRCAAASPGKKRYNIALLPGDGIGPEVISVAKNVLQKAGSLEGLEFDFKEMPVGGAALDLVGVPLPEETFTAAKLSDAILLGAIGGYKWDKNEKHLRPEMALFYLRRDLKVFANLRPATVLPQLVDASTLKKEVAEGVDMMIVRELTGGIYFGEPRGITINENGEEVGVSTEIYAAHEIDRIARVAFETARKRRGKLCSVDKANVLDASILWRKRVTALASEYPDVELSHMYVDNAAMQLIRDPKQFDTIVTNNIFGDILSDEASMITGSIGMLPSASLGESGPGLFEPIHGSAPDIAGQDKANPLATILSAAMLLKYGLGEEKAAKRIEDAVVDALNKGFRTGDIYSPGNVCA

SEQ ID NO: 53982 - protein, 413 aa, Arabidopsis thaliana
MERAAILPSVNQNYLLCPSRAFSTRLHSSTRNLSPPSFASIKLQHSSSSVSSNGGISLTRCNAVSSNSSSTLVPELADIDWDTVGFGLKPADYMYVMKCNIDGEFSKGELQRFGNIEISPSAGVLNYGQGLFEGLKAYRKKDGNNILLFRPEENAKRMRNGAERMCMPAPTVEQFVEAVTETVLANKRWVPPPGKGSLYVRPLLMGTGAVLGLAPAPEYTFIIYVSPVGNYFKEGVAPINLIVENEFHRATPGGTGGVKTIGNYAAVLKAQSIAKAKGYSDVLYLDCIYKRYLEEVSSCNIFIVKDNVISTPEIKGTILPGITRKSMIDVARTQGFQVEERNVTVDELLEADEVFCTGTAVVVSPVGSVTYKGKRVSYGEGTFGTVSKQLYTVLTSLQMGLIEDNMKWTVNLS

SEQ ID NO: 53983 - protein, 297 aa, Candidatus Carsonella ruddii
MNLLNYLYKNKKISIDSADLNLIKNYKFNSITSNPTLILKSFLNKTYNLLLNFFFYKNNKKILLDSDIQISLYDKILIFIVGNLIPFINDKISIEIPARISFNYNLIIIYSKKIIFLCNKYGININKVLIKIPGTDSGIKAAKKLKEIGIETNITLIFDINQVKKCLDFGVYIISPFIGRISDSIYCKYDSGVNFVKNIYTYKNNNNYKIKIMAASFRNINQIINLTFCDCLTISPIYFLELLKFNLKLLFKNKIKKTLKINFFNKYSSKLIIEGIKSFDKDHKKLINIISTIINNL

SEQ ID NO: 53984 - protein, 178 aa, Brassica rapa
MENMGTRVIEPLIVGRVVGDVLDNFTPTIKMNVSYNKKQVSNGHEFLPLAVSSKPRVEIHDGDLRSFFTLVMTDPDVPNPSDPFLKERLHWLVMNIPGTTDATFGKEVVSYELPKPNIGIHRYVFVLFRQKQRRVKFPSNIISRDQFNTREFAIENDLGLPVAAVFFNAQRETASRRR

SEQ ID NO: 53985 - protein, 537 aa, Aspergillus oryzae
MALFTFRLLPLVCTASIAIYVLSRFMHFETKSTGALTYSITFIIYLLYWLYIYPYHLSPLRHVPTVPGCPLWGHVFEIFNAEIGAVQQKWHKTHGPIVRYFYPFGKEILSVVDNSALKHILVEASYNYEKTASNRKFLSRLFGEGILTAGGKVHAQQRKALNPAFSISAIKALAPAFWDYSCSMSSYWEQDIKESSDDSVSLDISDWASRATLDIIVAVGFGAKIDTLHNSTAPLIEAFRTVFRFDAVAKLLAVLHILFPIVRYLPIKENREVDAAKRTLFEFASGLIQEKEANINSTGNNILSQLVRGDRKPQAAGEDIFSRVICDQIATFLGVGQDTSATWLSWTLHLLSKHQHMQVKLREEIRSHFPFLFRGATHEKIDFTEVDVDRLPYLNNVCRESLRFIPPIPFVSREAARDERLGEYFIPKGTVIHIPINTIHRMPEYWGPNSNAFDPDRWNCLPASYTNNAFLPFTQGPRGCIGRKFADTEVKTILCCLLSKFQFSPDPAVQDPEELKRYRIVQKSQYGIRLKVSKLDG

SEQ ID NO: 53986 - protein, 178 aa, Brassica rapa
MENMGTRVIEPLIVGRVVGDVLDNFTPTIKMNVSYNKKQVSNGHEFLPLAVSSKPRVEIHDGDLRSFFTLVMTDPDVPNPSDPFLKERLHWLVMNIPGTTDATFGKEVVSYELPKPNIGIHRYVFVLFRQKQRRVKFPSNIISRDQFNTREFAIENDLGLPVAAVFFNAQRETASCRR

SEQ ID NO: 53987 - protein, 455 aa, Oryza sativa
  misc_feature (250)..(250): Xaa can be any naturally occurring amino acid
  misc_feature (326)..(326): Xaa can be any naturally occurring amino acid
  unsure (1)..(455): unsure at all Xaa locations
MSSSVGGGGGQQFRYTQTPSKVLHLRNLPWECAEEELVELCNPFGRIVNTKCGVGANRNQAFVEFTDINQAISMVSYFASSSEPAQIRGKTVYIQYSNRQEIVNNKSPGETAGNVLLVTIEGVQANDVTIDVIHLVFSAFGFVHKIATFEKAAGFQALIQYTDAATASAAREALDGRSIPRYLLPEHVTSCCLRISFSAHKDLNIKFQSHRSRDYTNPYLPVNSSAIDTLQPAVGADGRKVEAEGNVLLXSIENMQYAVTVDVLHTVFSAFGTVQKIAIFEKNGGTQALIQYPEIIFLGTNQYVTTASVAKEALEGHCIYDGGYCXHSDKSRDYTIPQGAMQAVPQPPGVPTTSAGWQGNPQAGGAYAPPGAAAPNHGTTGQAPNWNPGNSGYAPAPGAYPGQMYSSPMQYGASGGFSAPAAPPQELHTSQQMPPPQYGNQPGPAGAPGTGQPHP

SEQ ID NO: 53988 - protein, 177 aa, Brassica oleracea
ENMGTRVIEPLIVGRVVGDVLDNFTPTIKMNVSYNKKQVSNGHELFPLAVSSKPRVETHDGDLRSFFTQVMTDPDVPNPSDPFLKERLHRLVMNIPGTTDATLGKEVVSYELPKPNIGIHRYVFVLFRQKQRRVKFPSNIISRDQFNTREFAIENDLGLPVAAVFFNAQRETASRRR

SEQ ID NO: 53989 - protein, 298 aa, Glycine max
NSAPKIKKREMATETKVAVLGGITEVQGAANSVEINNLARFAVEEQNKRENSVLEFVRVISAKQQVVAGVNYYITLEAKDGEIKNEYKAKVWERESQELLEFKPTLGAGGIIDVPGAANSIEIDHLARFAVEEQNKRENSVLELVRVISAKKQVVAGMNYYITLEAKDGVIKKEYEAKIWVRGWLNSKELLEFKPVNVSSTQMGGITDVTANSLEIDILARFAVDQHNKKENANLEFVGVIRAKQQVVEGFIYYITLEAKDGETKNVYETKVWVRSWLNSKEVLEFKPISINPLSVSV

SEQ ID NO: 53990 - protein, 377 aa, Stevia rebaudiana
MADTEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTTAEREIVRDMKEKLAYVALDYEQELETAKSSSSVEKNYELPDGQVITIGAERFRCPEVLFQPSLIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 53991 - protein, 144 aa, Zea mays
QGNGLGSYDLSLVYPKRVFFEQGADDVGGNSGAGGYFGYLRTVLSYVNPLSYLRGNTNSSNTELQSNEDLRQLRHGSGPWSEPRPLGNRGHEVTDADSANTLRRRPRPFGANIHTLGSEDHGPSDERNVFWNGNSTEFGGDDRK

SEQ ID NO: 53992 - protein, 338 aa, Arabidopsis thaliana
  misc_feature (142)..(142): Xaa can be any naturally occurring amino acid
  unsure (1)..(338): unsure at all Xaa locations
MSYSGAGLGKPGSGKRRIRDLLTQSDNRVCADCGAPDPKWASANIGVFICLKCCGVHRSLGSHISKVLSVTLDEWSDEEVDSMIEIGGNASANSIYEAFIPEGSSKPGPDASHDQRMRFIRSKYEHQEFLKPSLRITSVRGXSSTKTPAFLSSSLSKKIVDSFRTNSSSQQPQLEGMVEFIGLLKVTIKKGTNMAIRDMMSSDPYVVLTLGQQKAQSTVVKSNLNPVWNEELMLSVPHNYGSVKLQVFDYDTFSADDIMGEAEIDIQPLITSAMAFGDPEMFGDMQIGKWLKSHDNALIEDSIINIADGKVKQEVQIKLQNVESGELELEMEWLPLEQ

SEQ ID NO: 53993 - protein, 129 aa, Zea mays
MRVSVLADCLNNIHNAEKRGKRQVLIRPSSKVIVRFLTVMQKHGYVEEFEEIDDHRSGKIVVQLNGRINKTGVISPRFNIQLSQIENWVNLLLPARSFGYIILTTSAGIMDHEEARRKHVAGKILGFVY

SEQ ID NO: 53994 - protein, 395 aa, Flavobacteria bacterium BBFL7
MKNNLSDRINNLPVSATLAMAAKARELREQGKDIIGLSLGEPDFNTPDFVKDAAIQAINENYNSYTPVDGYVELKDAIILKFKRDNNLEYTRDQIVVSTGAKQSIANVAMVLLNEGDECILPAPYWVSYAAIVQLAEGVPVEVRAGVEQNFKITPDQLRAAITPRTKMILFSSPNNPSGSVYSKNELEELAAVLKDHPQIVVVSDEIYEHINYGDGHASMASVNGMYDRTVTINGVSKAFAMTGWRVGYIGAPAWIARACNKMQGQITSGTNCIAQRAVITALEAPVSEIQYMVDAFHKRRDLILELLSKIHGFITDIPEGAFYVFPDISSFFGKTIKGHKIENATDFSLLLLEEALVATVTGDAFGAPNCIRLSYAASEDQITEAIKRIDEVLS

SEQ ID NO: 53995 - protein, 162 aa, Schizosaccharomyces pombe 972h-
MLRALGSRLLVASRPAAYRSFQQSLRPVPRFFIHKMSTKTPINSPKLSSAGPYNQAIKANGVIYCSGQIPVANGKVIEGTVGDQTRQCLLNLQEVLTEAGSSLNKIVKVNIFLADMDDFAAVNKVYTEVLPDPKPARSCVAVKTVPLSTQGVKIEIECIALE

SEQ ID NO: 53996 - protein, 600 aa, Nitrosomonas europaea ATCC 19718
MAISENKTMTQFIKVTLPDIGDFQEVPVVEILVSPGDEVEQETPLLVLETDKASMEVPAPQAGIVREIHVKAGDRISQGSLIVTLETRETDTQVASPTPPRDTMAVPDSQPTITSAAEATAGKVALASVADRGDIHAEVVVLGAGPGGYTAAFRAADLGKQVVLIERYPALGGVCLNVGCIPSKALLHAAKTLTEAKEASLYGIRFGQPEIDVGKLRSWKESVVGKLTKGLSMLARQRKVTVIHGTGKFVNPHLIEVETSDGIKTISFDHCVIAAGSSAARIPGLPADERIIDSTGALALAEIPERMLILGGGIIGLEMATVYHALGTRISIVERMAQLIPGADTDLIKPLYKKLKTECEAIYLNTSVSRVEADKEGLQVFFEGEQAPEPQRYDRVLVAVGRRPNGKLIDAGAAGINVDERGFIPVDKQMRTSVPHIFAIGDIAGDPMLAHKASHEGKIAAEVIAGHKVTFDARTIPSVAYTDPEVAWMGLTETEAEKQGIAYEKAVFPWAASGRAITMTRDEGMTKLLFDKVSKRILGAGMVGPHAGELIAETVLALEMGADMQDIGLTIHPHPTLSETILFAAELAEGTITDLYVPKK

SEQ ID NO: 53997 - protein, 969 aa, Schizosaccharomyces pombe 972h-
MVSFNQLRNYFLESNSLRPSKWLFQSYGTSSSANILNGKLLARKLQRSVAEEVQALKAKDRNFKPALAIVQVGKREDSNVYVRMKEKAARLVGIDFKYCPFPETIQMPALLHELKKLNDDHTVHGVLVQLPLPKHLNERTVTESITPPKDVDGFGAFNIGLLAKNDATPIHYPCTPKGIMELLKDNKISVAGLNAVVLGRSDIVGNPISYLLRKDNATVTVCHSKTKDLIQHISNADLVIAALGKPEFVRGEWLKPGSVVVDVGINAVQRNGKRVLVGDVHFESASKVASSITPVPGGVGPMTVAMLMENIVNAAKIARTENIYRKIDLNPLELKKPVPSDIEIANSQEPKLISNLAKEMGIYDTELENYGNYKAKVNLAVYERLKHRKDGNYVVVSGITPTPFGEGKSTVVAGLVQAMGHLGKLGIACVRQPSQGPTFGVKGGAAGGGYAQFIPMDDFNLHMTGDIHAVTAANNLLVAALETRMFHENTQSDAALIKRLIPVKNGRRVIPRGLIGRWNRICASHNMDPEDVNNASPELLKEFVRLNVDPDTIECNRVLDVNDRFLRSIEVGKASTEKGHVRKTSFDISVASECMSILALSCDLNDMHSRLSRMVIANDKYGNAITAGDLGVSGALTVLLKDAIKPNLMQTLEGTPAFVHAGPFANISIGASSIIADKIALKLAGTESFDRPEDAGYVVTEAGFASDMGMEKFFNIKCRYSKLVPNTVVLVTTVKALKLHGGGPKLKPGAPIPEEYLVENLDLVKNGCSNMVKHIQNCHKFNIPVVVAINSYKTDSSKEHEIIREAALQAGAVDAVPSDHWAQGGKGAIELAKSVMTACDQSSNSKFRLLYDSETSIEDKVNVIAKEMYGANGVEFSSLAKERINTFIKQGFGNLPICMAKTQYSLSHNPEFRNVPKNFTVPIRDMRLNAGAGFIYPLAAEIQTIPGLPTAPAYLNIDICENGEIVGLS

SEQ ID NO: 53998 - protein, 321 aa, Fulvimarina pelagi HTCC2506
MAADGKETPGKVLVFGSLNIDLVCRVERIARPGETVLGPSYEQLFGGKGANQAVAAARSAASGISVRMIGAVGPDDFGTAIIANLEANGIDAGSILRTQEPTGAAFIAIDSGGENAITVASGANRVLGADALVGAQLSERTILLLQMESPLDETIAAARRAQEVGGRTILNLAPVPANLTAESLRKLTEAIEWLIVNELELDAAARALDLKAGSITDLASTVGQALDVNVIATLGANGVVTITKDGESFIEPAMSVAIEDTTGAGDTFCGVFAASLAAKLEIHLAVRRATTAASLACRRTGAQTAMPTFEEITAALNAPLP

SEQ ID NO: 53999 - protein, 297 aa, Candidatus Carsonella ruddii
MKFFDFIKNKTKISIDSADINFIKNKLFNAATTNPSLILKSILSKVYNKLLYAFLLKNFKKKIIDSDYNISLYDKLLVNIIANIIPYIEEKISIEIPARISFNYNKIIFYSYKIIYLCEKIGINLKKILIKIPATNSGIKAAKQLKNNNINSNLTLIFNLTQAKKCFDSGIYIISPFVGRVSDSIYCKYDSGVNFVKNLVNLKNNNNYSTKIMAASFRNINQIINLTCCDFITISPIYYNKLKNINYKNSVLNYKSNIDFCNNENYNSIKLLNNGIKQFDIDHNRLIKLISNLINNL

SEQ ID NO: 54000 - protein, 177 aa, Brassica oleracea
ENMGTRVIEPLIVGRVVGDVLDNFTPTIKMNVSYNKKQVSNGHELFPLAVSSKPRVEIHDGDLRSFFTLVMTDPDVPNPSDPFLKGRLHWLVMNIPGTTDATFGKEVVSYELPKPNIGIHRYVFVLFRQKQRRVKFPSNIISRDQFNTREFAIENDLGLPVAAVFFNAQRETASRRR

SEQ ID NO: 54001 - protein, 197 aa, marine gamma proteobacterium HTCC2143
MADRKATVSRNTLETQITVSINLDGTGQSRFETGVPFLDHMMDQIARHGLIDLDIEAKGDLHIDAHHTVEDIGITLGQAFNEAVGDKKGIVRYGHSYVPLDEALSRVVIDFSGRPGLEWHVPFTRGSVGGFDVDLFIEFFHGFINHAKVSLHVDNLRGKNTHHQAETVFKAFGRALRMALSADERMAGVMPSTKGTL

SEQ ID NO: 54002 - protein, 204 aa, Staphylococcus aureus subsp. aureus MW2
MANPIKIGIGGPVGAGKTQLIEKVVKRLSKEMSIGVITNDIYTKEDEKILVNSGVLPESRIIGVETGGCPHTAIREDASMNFAAIDELLERHDDIELIFIESGGDNLAATFSPELVDFSIYIIDVAQGEKIPRKGGQGMIKSDFFIINKTDLAPYVGASLEQMAEDTKVFRGKRPFTFTNLKTDEGLDEVIDWIERDTLLKGLS

SEQ ID NO: 54003 - protein, 590 aa, Pseudomonas fluorescens Pf-5
MCGLAGELRFDHQPADLAAVERITHHLAPRGPDAWGFHSQGPIALGHRRLKIMDLSDGSAQPMVDNQLGLSLAFNGAIYNFPELRAELEAKGYAFYSGGDTEVLLKGYHAWGADLLPKLNGMFAFAIWERDAQRLFIARDRLGVKPLYLSRTGQRLRFASALPALLKGGDINPLLDPVALNHYLNFHAVVPAPRTLLAGIEKLPPATWMRIEADGRTEQQTWWTLPYGPRADETNLTLEDWRDRVLDSTREAVAIRQRAAVDVGVLLSGGVDSSLLVGLLREVGVDNLSTFSIGFEDAGGERGDEFQYSDLIARHYGTRHHQLRIDEREIIEQLPAAFRAMSEPMVSHDCIAFYLLSREVAKHCKVVQSGQGADELFAGYHWYPQVDGASDPYAAYRAAFFDRSYDDYAATVQPQWLTANDAAGDFVREHFAQPGADAAVDKALRLDSTVMLVDDPVKRVDNMTMAWGLEARTPFLDYRLVELSARVPARFKLPDGGKQVLKEAARLVIPSEVIDRKKGYFPVPGLKHLQGATLDWVRELLLDPSQDRGLFKPAMLDRLLTDPQGQLTPLRGSKLWQLAALNLWLSEQGI

SEQ ID NO: 54004 - protein, 296 aa, Oryza sativa (japonica cultivar-group)
MFKTIDARRSQHLDLTGSLVGPESVAFDGKGHGPYSGVSDGRVMRWNGEAAGWSTYTYSPSYTNNKCAASTLPTVQTESKCGRPLGLRFHFKTGNLYIADAYMGLMRVGPGGGEATVLATKADGVPLRFTNGVDIDQVTGDVYFTDSSMNYQRSQHEQVTATKDSTGRLMKYDPRTNQVTVLQSNITYPNGVAIGVDRTHLIVALTGPCKLMRYWIQGSKAGKSEPFAELPGYPDNVRPDGKGGYWVALHREKYELPFGPDNHLVAMRVSAGGKLVQQMRGPKSLRPTEVMGEEGW

SEQ ID NO: 54005 - protein, 392 aa, Cryptococcus neoformans var. neoformans JEC21
MTIAATSIPTTKYEAHYDPTKVIQHPEFQTLSEDAPELSDPKLNIACAYNPAHEIHMVKKPRFEPGPGEVTIHVRATGICGSDVHFWKHGHIGPTMIVTDECGAGHESAGEIVAVGEGVAQWQVGDRVAVEAGVPCGLASCDPCRTGRYNACPAVVFFSTPPYHGTLTRYHNHPAAWCHRLADNVSYEEGSLCEPLAVALAGLDRAGVRLGDPIAICGAGPIGLVTLLAAHAAGCTPIVITDLFPSRLEFAKKLLPTVKTVQIEKTAKPEEVAKQIKGAAGMQLSLAFDCTGVESSIRSAIFSVKFGGKVFVIGVGPSEQSYPFGYCSANEIDLQFQYRYNNQYPKAIRLVAGGLVDLKPLVTHRFALKEAVKAFHVAADPSQGAIKVQIRD

SEQ ID NO: 54006 - protein, 991 aa, Polaromonas sp. JS666
MLLTKKSHGIHGDPAHRAGSARFVQSLSRGLSGALPTMDRRAFLRRSGLGVGVGLAATQLTLVKKAKAATSAAGDGSGKIEVKRTVCTHCSVGCAIDAVVENGIWVRQEPVFDSPINLGAHCAKGAAVREHGHGEFRLRYPMKLVNGKYERITWDTALGEISAKMLELRKASGPDSVYWIGSSKHNNEQAYLMRKFVSFWGSNNCDHQARICHSTTVAGVANTWGYGAMTNSYNDMQNSKVALYIGSNAAEAHPVSLLHMLHAKETGCKMIVVDPRFTRTAAKADEYIRIRSGSDIPFLFGMLYHIFKNGWEDKKYINDRVYGMDKVKEDVMAKWTPDKVEEACGVPEARVYMAAEAMAKNRPSTIVWCMGQTQHTIGNAIVRASCILQLALGNVGTSGGGTNIFRGHDNVQGATDVGPNPDSLPGYYGLAEGSWKHFAKIWGVDFDWIKGRYASPAMMGKPGITVSRWIDGVMEKNELIDQDPNLRAVVFWGHAPNSQTRGLEMKRAMDKLDLLVVIDPYPSATAAMAAMPGKAEDLNPNRAVYLLPAATQFETSGSVTASNRSLQWREKVIEPLWESRTDHMIMHQFAEKLGFAKELSKNYKMQKVKGLDEPMPEDILREINKTCWTIGYTGQSPERLKAHMRNMHLFDVKTLKSKGGKDKETGYDTTGDYFGLPWPCYGTPELKHPGSPNLYDTSKHVMEGGGNFRANFGVEKDGVNLLAEDGSHSLGADITTGYPEFDHLLLKKLGWWDELSEAEKAAAEGKNWKTDSSGGIIRVTMKNHGCHVFGNAKARAVVWNFPDAIPQHREPLYGIRPDLVAKYPTHDDKKAFWRMPTLYKTIQQKNITDKVHEKFPLILTSGRLVEYEGGGEETRSNPWLAELQQEMFIEINPKIAADRGIRNGERVWVSTPTGARLNVQALVTERVGPDTVFMPYHFSGRWQGADMLAHYPSGAHPIVRGEAANTATTYGYDSVTMMQETKTTICNVERA

SEQ ID NO: 54007 - protein, 272 aa, Anabaena variabilis ATCC 29413
MTIATSTKPQINWVNTLFFLGLHIGALFAFVPGNFSWAAVGVALLLYWITGGLGITLGFHRLVTHRSFQTPKWLEYFLVLCGTLACQGGPIEWVGTHRIHHLHSDTDPDPHDSNKGFWWSHIGWLIYHSPSHADVPRFTKDIAEDPVYQFLQKYFIFIQIALGLLLLYLGGWSFVVWGIFFRIVWVYHCTWLVNSATHKFGYRTYDAGDKSTNCWWVAVLVFGEGWHNNHHAFQYSARHGLEWWEVDLTWMTVQLLQVLGLATNVKLADKKQ

SEQ ID NO: 54008 - protein, 431 aa, Silicibacter pomeroyi DSS-3
MTEEKKTATLSLNGQSYDLPVYSPSAGPDVIDIRKLYGQAGVFTYDPGFTSTASCDSTITYIDGELGELLHRGYPIDQLAAKSHYLEVCYLLLYGELPTAAALEKFETTITRHTMIHEQMHYFFRGFRRDAHPMATMVGVVGAMSAFYHDSTDIADPHQREIASHRLIAKMPTIAAMAYKYSIGQPFMYPRNDLDYAANFLQMCFAVPAEHYHVDPILARAMDRIFTLHADHEQNASTSTVRLASSSGANPFACIAAGIACLWGPAHGGANQACLEMLKEIGSPDRIPEFIARAKDKNDPFRLMGFGHRVYKNFDPRATVMKQSADEVLDLLGVENNPILATAKELERAALADDYFAEKKLFPNVDFYSGIILEAMGFPTSMFTPIFAVSRTVGWVSQWKEQLADPQHKIGRPRQLYLGSTARDYVDIEDR

SEQ ID NO: 54009 - protein, 363 aa, Glycine max
MASTASEVSQQVQSNNNRPIFKSVKALTESPELTSLPPSYTYTTNSDDEIVADPDEDDPIPIIDYSLLVTGTPDQRAMTIHDLGKACEEWGFFMLINHFVSKTIMEKMVDEVFAFFNLREEEKQEYAGKDVMDPVRYGTSSNVSMDKVLFWRDFLKIVVHPEFHSPDKPPGFRETSAEYCRRTWKVGKELLKGISESLGLEANYIEDTMNLDSGWQMIAANMYPPCPQPELAMGIPPHSDHGLLNLLLQNGVSGLQVLHNGKWINVGSTSNCQLVFVSDHLEVVSNGKYKSVLHRAVVSNKATRMSLAVVIAPSLDTVVEPAKEFLDNQRNPAAYVGMKHRDYMQLQKSNRLNGKSVLDRVKI

SEQ ID NO: 54010 - protein, 515 aa, Glycine max
NSLRSHIPPQLVHFDKLQVFDVSSNDFFGNIPSFIISLPSLQYLNLASNHLSGNLSVNMACSSSLTFVDISHNLLVGKLPSCFGSMSSKAKVLYSGNCLSTKNRLNDQQHPFSFCKREGALAVKPPAKNLKKESNLGTKLGLMLGIIVGIVVIGGLLVLLVVCIIRKSKAERSPHKMDKSVANKYSTSVSPRPIGTRHIPQAMKQAAVGLPPYRIFTSEEIEDATNNFDPSNLIEEGSQGQLYKGWLRDGSVVLVNCVKIKQKGLPHSIMQQVEVLHNLRHRHMVSVLGHCVITEQEHPQTTSTVFIVFEYISNVSLRDQLSDGRKREMLKWPQRMAMSIGIARGVQFLHTGVAPGIYGNNLKIENILLDDSLNAKVSRYNIPLPSKSAHNEQNATNHISSTNNTEKEDIYQLGVILLEVITGKQITSSSEIEELKEELENGSPEATSVIRSAIDPTLRGTYAYESMKTAVQITINCLSKVSSQRPSIEDVLWNLQYAMQVQESWTSSGNLSTKL

SEQ ID NO: 54011 - protein, 456 aa, Arabidopsis thaliana
MDLLSNLPYELLCHILSFLTTKEAALTSVLSKRWRNLIAFVPNVDIVDHDIRELFMDFVDRVLALQGNSPINKFSLDCSGVDSDRVDCWIQNVMVRGVSELNLSIFVDSVFEDDYNLFPKVFENKKLVKLGLSYISWLDGSIFLPMLKTLVLESVLLSVEKFEILLHALPALEELVMNNIYWKERDVVDLIVSSESLKTLTINFIVCTHTLSFDTPILAYLSYSGYVVDDYAEAKMENLFEARISLLVVEGDISRVRALINNDLLEDDEYDVLQFENVWKLMNGIRNIRCLYLSPNTLEVLSLCCESMPVFKNLKSLSIKSAENRGWQAMPVLLRNCPHLETLVLEGLLHHVTDKCGDACDCVSREDKGRSLTSCPVKVLEIKGFQGTTKEMNMIKHFLEYFPCLKELKMYMEENDPAQLRVPEVITGEMMERYKKSSSCNVQLLVGGWLYKKWTP

SEQ ID NO: 54012 - protein, 266 aa, Gluconobacter oxydans 621H
MPAPYKDRFAGKKVLVTGASQGIGEATALRFAEEGAQVALNGRKEDKLIAVREKLPKVSGGEHPIATGDISKEDDVKRLVAESIKAMGGLDVLVCNAGYQIPSPSEDIKLEDFEGVMAVNVTGVMLPCREVIRYWLENGIKGTIIVNSSVHQIIPKPHYLGYSASKGAVGNIVRTLALEYATRGIRVNAVAPGAIVTPINMSWIDDPEQYKAVSSHIPMKRPGESREIADAITFLAAEDSTYITGQTLYVDGGLTLYGDFENNWSS

SEQ ID NO: 54013 - protein, 235 aa, Anabaena variabilis ATCC 29413
MLNLVSELISTPPLWLQISIVAAWVSFILAIAGLVNRFATSDSEIVRKIVHIGAGHVILLAWWLDIPASVGIGASIVASVVTLLSYIFPLLPGINSVGRQSLGTFFYAVSVGVLVAWFWHIQQPQYAAIGMMVMAWGDGLAALVGQRFGKHKYKLLGAQKSWEGSLTMALASYLVCSLILLGVLGNVWQTWTVSLAVAFVATSLEAFSFLGVDNLTVPLGSAAIAFALIQFWPLH

SEQ ID NO: 54014 - protein, 1106 aa, Coccidioides immitis RS
MKRRFTSRRSHPYRTHRVSRSPDRAATDNPPHADAANDYMAASRRSPSMRDQWRADGDYDREIHHHRPRARERHSRRQLSPPAPRRRDRDRERPSRGRGSGSTAHYHPCRRPIPRGEDRNPENTRTTPFKAAREENRDAKHSLKNQVRSRQREDSPPSPSNPSFPRRKRSRSPSPSRSHRRPHHKKGRHNDRGDHFGRGGRRPQRYSSPERFVPPRETGPGRKSHYSKAPTSDSLSISRCRRSRSPVPSDFGLRASLSPHSPSNRSCNSIDYPSRPPSRHSFASKVSRESSPSRAFRSMQDTLPIQSLEDESIGSASTFRPAANADIPSSNHSVDGDSHMRDAYPMHGMRPSETRGSRRQARPHVDTRQPYSSPQYIPGSDSRHPSPQSGSPYGSSRGSWVGQPQHPYPHGQQRQMHGYSPPYRQPSYSSQGGSQGQYYQGQPPQYPPSPNAGQQGYSGQPPYRGTSSSYRGNPYSQPPPPDRRFSGANSQNYGSPPQPQRSRSGHFTSLQWTASAGRGRGSQTGPGQPSPTIPSLQPPHHALDDPLSPDMDDNDNPFRPSKDLQVEDEEAVKKNENNDVKKMPPPRQGSGSSQPKETGKFSFAFKSKAPATPVPKPVSGLAQKMREPPRPLEPPKKELLSAQTRLKHEIRPDRRDDRRDRDGRRGDRRFDRRDDRRRDRREDRRPDVKHDRRKDRERERDREHSPPTQEKPKKKMLTRMKPRPTLSEEFSKSDSVYYRKPGNESVVGAGTYGKVFKAVHVFTKNKVALKRIRMEGEKDGFPITAVREIRLLQHLRHENVVSLQEVMVERNECFMVFEYLSHDMTGLINHPSFTLSAAHKKHLAKQMFEGLNYLHHRGVLHRDIKAANILISNKGQLKFADFGLARFFSKSRQLDYTNRVITIWYRPPELLLGETRYGPAVDVWSAACVYMEMFTKKAIFPGDGSEINQLDKLYNSLGTPTRTDWPAIIDMPWFELMRPRERKKRAFENMYKDYLSPAALDLVSKIFQYDPVKRPSTEEVLAHPYFTEEEPAPQQAIELADVEGDWHEFESKAHRKEKDKEARRAEQREREKRRISNHTGESVDRERKRTKVDDDTSAPVSQGPEN

SEQ ID NO: 54015 - protein, 371 aa, Gluconobacter oxydans 621H
MDVTAAIAFEAGRPLEIDTVQLEGPRDGEVLVEIMATGLCHTDKYTLSGQDPEGLFPAILGHEGAGIVREVGAGVKHLKPGDHVIPLYTPECRECPSCLSRKTNLCTAIRSTQGKGLMPDGTSRFSYKGQPIHHYMGCSTFANFTVLPEIALAKIRPDAPFDKVCYIGCGVTTGIGAVLFTAKVEPGSTVAVFGLGGIGLNVIQGAKMVGANRIIGIDINPEREAIARKFGMTDFVNPKDLGPDGDLVGHLIEMTGGGLDYTFECVGNPTLMRQALESAHRGWGVSCVIGVAGAGQEISTRPFQLVTGRRWIGSAFGGARGRTDVPKIVDWYMEGRIDIDDLITHKLKLADINLGFDMMSRGESIRTVVEY

SEQ ID NO: 54016 - protein, 93 aa, Pinus pinaster
ESLASSASSAMTAWGLTLLAMGLACKEIHVGGRNSKLITLESFLIILSGTQLFYILVIHGGYFGGNYGSYQDTYVATTTAEPREGSTPAGSSV

SEQ ID NO: 54017 - protein, 156 aa, Gluconobacter oxydans 621H
MQWTAAFGSLARLVSRGDAFVTYVPPAPSIVDDIIAQVKFDANGLISALAQAPDGVVLMLAWMNADALRETLLTGRVCYWSRSRQKLWRKGETSGQQQKLIEARLDCDMDAVLMIVDQTGVACHTGRRSCFYHGVTPDGLRDTSQPEISAEELYGR

SEQ ID NO: 54018 - protein, 78 aa, Pinus pinaster
WPSCGRVPRGEYRYIDVILKAPISVSSSAIRIVIDTDFRSQFQIARPTAKYQAALKILPTIYIGRPERLMKIVEIMSE

SEQ ID NO: 54019 - protein, 265 aa, Escherichia coli
MKIYKELSMSVPLILTILAGAATFIGAFLGVLGQKPSNRLLAFSLGFAAGIMLLISLMEMLPAALAAEGMSPVLGYGMFIFGLLGYFGLDRMLPHAHPQDLMQKSVQPLPKSIKRTAILLTLGISLHNFPEGIATFVTASSNLELGFGIALAVALHNIPEGLAVAGPVYAATGSKRTAILWAGISGLAEILGGVLAWLILGSMISPVVMAAIMAAVAGIMVALSVDELMPLAKEIDPNNNPSYGVLCGMSVMGFSLVLLQTAGIG

SEQ ID NO: 54020 - protein, 333 aa, Xylella fastidiosa Temecula1
MSIATTPLHTALSLPQIQSFAASDMAAIDTLIHDRLTSDIVLINQIADHIICSGGKRLRPMLTMLAGHAIGPTGPHHHQLAAIIEFIHTATLLHDDVVDGSELRRSRSTANALWGNAPSVLVGDFLYSRSFQLMTELANLEVMQILAETTNRISEGEVLQLLHVHNPDTDETTYLSVIERKTAILFAAAAQLGALASHADTQTQTRMYEYGMQLGYAFQITDDVLDYTANNSQLGKNLGDDLAEGKATLPVIHAMTHSDAATCERLRMIISKGDSDAMPEVLNAIRTTGSLDYSRQRASAYAATAERALDGLPETEAVAALRGLARYAVQRTY

SEQ ID NO: 54021 - protein, 432 aa, Flavobacteria bacterium BBFL7
MEHIVIIGNGIAGVTAARHIRKLSDKRITIISAESKFFFSRTALMYVYMGHMKFEHTQPYENDFWAKNRIELVHDYVHTVETDAKKVHLNSGRDIMYDKLILATGSISNKFGWPGQDLEGVQGLVSRQDLEQLEISAPNNKVCKRAVIIGGGLIGVELAEMMASRQIPVTFLIREKGFWSGVLPMPNADMISRHVKSHHIDLKEEEEMAEIIADDSGKVKAIITKKGQTIPCDFVGLCAGVRPRISFLKNSGIELQRGIMVNRHLETSVKDVYAIGDCAQQRDPVGERKPIEAVWYTGRMMGEALAQTICGNPTKWNPGHWFNSAKFFDIEYQTYGWVWSKPKQGHDHFHWLHEDDKRAVTIEYDISTRKFIGINTFGIRMKHEVFDLWLSQSKSIDEVIENLDKACFNPEFFNKPFEQIKRAFSSNQQIKS

SEQ ID NO: 54022 - protein, 403 aa, Brassica oleracea
MNCLFLLKSKKPEPRNQQKDRRKAQNSAPGQRNKSETPSFNLHRPRSLPSGRSIRNLDREREQSLRVFTYEELSEATCGFSRRLKIGHGGFGNVYKGKIPTTRDSDPPLVVAIKKLNPQGLQGHKQWLAEVEFLGVVNHQNVVKLLGYCSEDGENGMERLLVYEYMSNRSLEEHLFTRGARTLPWKQRLEIMLGAAEGLAYLHEVKVIYRDFKSSNVLLDDEFCPKLSDFGLAREGPQGDNTHVTTAKVGTEGYAAPEYVQTGHLRLKSDVYSFGVVLYEIISGRRTIERNKPPAERRLLEWVKEYPPDSRRFSMIVDPRLRNNYPSAGTRSLAKLADLCLKKNDKERPTMEIVVERLKKIIEECDSGDSYIAASKESSQVRCNSRAAGPVEGSLRGGVSVRE

SEQ ID NO: 54023 - protein, 259 aa, Fritillaria agrestis
MSPAEPSREENVYMAKLAEQAERYEEMVEFMEKVARTVDTEELTVEERNLLSVAYKNVIGARRASWRIISSIEQKEESRGNEDHVALIKDYRGKIEAELSKICDGILKLLDSHLVPSSTAAESKVFYLKMKGDYHRYLAEFKSGAERKEAAESTLLAYKSAQDIALAELAPTHPIRLGLALNFSVFYYEILNSPDRACNLAKQAFDEAISELDTLGEESYKDSTLIMQLLRDNLTLWTSDINEEAGDEIKEASKAGEGQ

SEQ ID NO: 54024 - protein, 522 aa, marine gamma proteobacterium HTCC2143
MPADMPTSAPRKPTVLVILDGWGYREDPRDNAIANANTPTWDKLWATAPRTLISSSGRNVGLPEGQMGNSEVGHMSLGAGRIVYQNISKIDKAIEEGEFTANPAYINAIDQAIANDRAIHLLGLLSPGGVHSHEKHIYAMVDMAAKRGAKKVYVHAFLDGRDTPPRSAKNSLQTLSEQFSSLGCGRIASLVGRFYAMDRDNRWDRVQSAYRLLTEERADYHYNTAVDGLEAAYLRDENDEFVSTTIIKKEGESSAAIEDGDSVIFMNFRADRAREISRAFVDKDFSGFKRDKTPELASFVMTTEYASDIAAACAFPAEKIHNSFGELIEKAGKKQLRIAETEKYAHVTFFFSGGREQPFEGEERELIPSPDVITYDLKPEMSAPEVTDKLVAAIKGGQYDTIICNYANGDMVGHTGIYEAAVKAAEAIDESLRRVTNAILDAGGDCLITADHGNCEQMQDYQSGQAHTQHTTELVPLIYVGDKAVTVKESGGKLADVAPTLLALMGIPQPAQMTGQPLLNLD

SEQ ID NO: 54025 - protein, 277 aa, Zea mays
SKGHGIDESLMREVRNVTREFFQLPYEEKLKIKMTPQSGYRGYQRIGENITKGKPDMHEAIDCYTPIRPGKYGDLAKPMEGSNLWPKYPSNFEVLLENYIKLCRDISRKIMRGIALALGGAIDAFEGDTAGDPFWVLRLIGYPVDIPEEQRTDTGCGAHTDYGLLTLVNQDDDICALEVQNRSGEWIYATPIPGTFVCNIGDMLKVWTNGIYQPTLHRVVNNSQHYRVSVAFFYESNFDAAVEPVEFCREKTGGAAKYEKVVYGEHLVQKVLTNFVM

SEQ ID NO: 54026 - protein, 357 aa, Arabidopsis thaliana
MSSPEKFSPAPESNSNPSLPDALIISCIARVSRLYYPILSFVSKSFRSLLASPELYKERSLLNRTEGCLYVCLYLNPFESPSWFTLCLKPDQALSSETSNKKKSSGYVLATVSIPHPRLVQRSSLVAVGSNIYNIGRSISPYSSVSIFDCRSHTWREAPSLPVELVEVSAGVLDGKIYVAGSCKDGDSLNLKNTFEVFDTKTQVWDHVPIPYNETKHNIYSKSLCIDEKWYVGAKRKVVSYNPKKGIWDLVESEMCSYKSSYDYCEIENVLYSVEKTWRGTVFRWYDTELGRWRKLEGLNMPYSGTGDRGGKKMIWCAVITLERRKNSGIWGNVEWFAHVLTVPKTFVFQKFLAATV

SEQ ID NO: 54027 - protein, 575 aa, Xylella fastidiosa Temecula1
MNVRLQGHGAARGTALGRAWVRQMNIIEIQDKYITDTNAELHSLYQAMSAARQEIQVLRERMHGTLSHEVGEFLDLYTLLIDDPELLRSLNELILTHNYSAEYALKIQRDRLTTEFEAMEDHYLKSRMDDLNHVLGRIHAFLKKHSPEPKDAAGEILICNNIAPSELAQVQAQGIIGIVIAAGNTLSHSAILAHSLHLPLIVGAGELLLQKITNGDMLIIDGNSGEIIVNPSPQDLRHYHSRLRERAKEQRELEQLRSKHSRTRDNVDIVVQANAESPDDVSQAYALGAAGVGLYRTEFLFLQRNKLPDEEEQFQTYRDTVLRMNGRPVTIRTLDLGADKTDCTGLTLSNEENPAMGLRGIRLSMAHPAVANTQLRAILRTSTYGHVRILVPMVSCREEIILLRKQIKALSIQLRTEGHDIAEQVPLGAMIEVPAAAIALNSFIKEIDFLSIGTNDLVQYLLAADRNNAAISEIYSPLHPGVLAVLAQIIVTAHTHATPVAICGEIAGDPHYVPMLLALGLTEFSLHPATLLEVRRAIRNSDLGTLKTSVTTLLRARDRKSIEEWMAAHANTTPT

SEQ ID NO: 54028 - protein, 278 aa, Aspergillus oryzae
MADLIESAKRAAGQAAVKNHYPKDAKYVGIGSGSTIVYVVEAIKESGVDTSQTKYVPTGYLSKQLIVSNGLTAVDFDSLPEGTVLDIAFDGADEVDDDLNLIKGGGACLFQEKIVALQAKEFVCVADSRKLQSRLLSNWKYIPIEVAPIAASRVLGELRELGSISPALRLNTTAPEGAPKPTPLKTDQAFNIIDAPFKSLLTKADIAAGQDGTGKDGVWEVEALSRAIKQIPGVLDVGIFSGETGPQAQARGGTGGQKPIAAYFGMPDGSVSVRKASA

SEQ ID NO: 54029 - protein, 115 aa, Buchnera aphidicola str. Sg (Schizaphis graminum)
MNNKDLIFQKIIKRETSTHIIYQDKIVTAFEDIAPKAPIHIIVIPNIFIKTLNDINQKNKNIFAHMLYIAVKIAKNKKISEDGYKIVMNCNKNGGQEINYLHMHLLGGEKLKALY

SEQ ID NO: 54030 - protein, 183 aa, Brassica napus
RYLQLHTQIKRKDISKKIVRSKKIFLRTMASASLPPPPPSSTSLTSQQSSPPPSQLPIRKMPGSYGLPLVGPLSDRLDYFWFQGPDKFFKSRSEKYKSTVFRTNIPPSFPFLGNVNPNIVAVLDVKSFSYLFDMDLVDKRDVLIGDFRPSLDFYGGIRVGVFLDTTEPKHAKVCMYIQYVAVC

SEQ ID NO: 54031 - protein, 366 aa, Triticum aestivum
  misc_feature (241)..(241): Xaa can be any naturally occurring amino acid
  misc_feature (302)..(302): Xaa can be any naturally occurring amino acid
  unsure (1)..(366): unsure at all Xaa locations
MERLISRTAVSPAQPRIHLPGRSPFLTTRRAASASAGAGSAAPWTRLCAQPPRLGAAVAAAARHDGASAPAPVEEVAAAAAAGPPWKLLGSLLPKASTAALVLLMTLTASALHSSIPHPAYASAQPVIKSGGLLSAELLSSGWAGFFAGRLHTLSGPDHLVALAPLSIGRSRLESGLVGALWGCGHDAGQIIFGLLFLLLKDRLHIEVLRIWGTRVVGLTLLMIGATGIREASEVQESGLXLEGVDMSGSEPLPQAPAVAPRKKKVGSTTFATGVVHGLQPNALLMVLPALALPSRFAGAAXLGMFLGRDWIFEWGSSPALVGSGSEAPKGWLPKITEKLTWAASLVAVCMGLALLVGQFFGFTLY

SEQ ID NO: 54032 - protein, 341 aa, Streptomyces coelicolor A3(2)
MRIGVLTAGGDCPGLNAVIRSVVHRAVDNYGDEVIGFEDGYAGLLDGRYRALDLNAVSGILARGGTILGSSRLERDRLREACENAGDMIQNFGIDALIPIGGEGTLTAARMLSDAGLPVVGVPKTIDNDISSTDRTFGFDTAVGVATEAMDRLKTTAESHQRVMVVEVMGRHAGWIALESGMAAGAHGICLPERPFDPADLVKMVEERFSRGKKFAVVCVAEGAHPAEGSMDYGKGAIDKFGHERFQGIGTALAFELERRLGKEAKPVILGHVQRGGVPTAYDRVLATRFGWHAVEAAHRGDFGRMTALRGTDVVMVPLAEAVTELKTVPKDRMDEAESVF

SEQ ID NO: 54033 - protein, 321 aa, Thiomicrospira crunogena XCL-2
MTLSQIRKLIQDDIEATDQLILSKLSSDVVLINQIGHYIINSGGKRLRPLLVLLSAHACDYKGKDHLTLAAVIEFIHTSTLLHDDVVDESETRRGNQTANEVWGNAASVLVGDFLYSRSFEMMVEPGIMRVMEVMSETTNVIAEGEVLQLLNCHDADTTSQRYMEVIHRKTAKLFEAATLLGPILGKKPELESAFSSYGRHLGAAFQLIDDALDYTADADELGKNLGDDLAEGKPTLPLIYVLENGTENEKSLIRKAIETEGIKLLKEVTSIIQTSGAIQYTQEVATQEAEKAKAALAPLNDSEIKQALLSLADLAVQRNH

SEQ ID NO: 54034 - protein, 335 aa, Zea mays
  misc_feature (45)..(45): Xaa can be any naturally occurring amino acid
  misc_feature (185)..(185): Xaa can be any naturally occurring amino acid
  unsure (1)..(335): unsure at all Xaa locations
MGECEDGEEHRCWEELLPDALGLICRNLQLQEVLTVLPRVCKSWXRVVAGPYCWQAIDIEEWSQQQSKPEQIGRMVELLVGRSGGSCRRISVSGLPCDPLFSFIAANARALGTLEMPRGEISDSVGGAVAPRLSTVTFLDSSSCTKLGAGTTTASGTPCTTPVGLRRMMHPVYLAEKVGQHEEAXASARRMPRLRHLEMGYMLVAAEAVLEILEECSELKFLDLRGCWAVDDRFLRERHPGLRVLGPRVVDDCYENSYWEECSDYYSDEDEDYDDDVVSWGLFVDDDDDYYYAVGSDDDEAIWDDAQGLENLEVRFYGGGGFGESFAGFDWPPSP

SEQ ID NO: 54035 - protein, 522 aa, Mycobacterium sp. MCS
MPGLPDPRFLDDRLNHWAHTTPDAEAVVYLDRTWTWAQWDDRVRRLAGALSRFGVGHGDAVAFLDKNHPACVELTFAAASLGAANAVVNFRLAGDELDYVLGDSGAKVLIVGRELRPTIDKIRDRLTHVEHVVEVTPDGQDGDEYEALLAGSAPTGRAEDVAPDDVCVIMYSSGTTGRPKGVELTQANLIAHTVNAHDGWGFDEGDKNMVSMPLFHVGGQSYVQFGIHDGVPTVMTREVDGASLADAILKGANRTFLVPAVLAKVLETGPDAVKLFGALKTFCYGASPMPLPLLRQALKAWPDTDFIQVYGLTEVCGVISHLMPEAHRDAEHPERLVSAGQLIPNAELRVADPDTGDELPTGQQGELWFRTPQLMKGYHNKPEATAEAVTPDGWFRTGDVGRIDADGFIFVEDRLKDMIISGGENVYSIEVERVLAEHSAVTEVAVIGVPDEKWGEAVKAVVVVEGSASEQELTEWCRERLAHYKCPRSIDITEELPRNPTGKILKKELRKPFWEGRDRTTV

SEQ ID NO: 54036 - protein, 327 aa, Synechococcus sp. RS9916
MAGTLLFNALREAIDEEMARDPHVCVMGEDVGQYGGSYKVTKDLYEKYGELRVLDTPIAENSFTGMAVGAAMTGLRPIVEGMNMGFLLLAFNQISNNMGMLRYTSGGNFTIPTVVRGPGGVGRQLGAEHSQRLEAYFHAVPGIKIVACSTPTNAKGLMKAAIRDNNPVLFFEHVLLYNLTEDLPEGDYVCALDQADLVQEGSDVTILTYSRMRHHCLKAVEQLEADGISVELIDLISLKPFDMETIGRSIRKTHKVIVVEECMKTGGIGAELIALITEQCFDDLDARPVRLSSQDIPTPYNGNLENLTIIQPHQIVEAAQQIVREGL

SEQ ID NO: 54037 - protein, 537 aa, Medicago truncatula
MDMDLDEETILLYENVLKTARAKAVENPNDDDVDNLLDCAGALLTLHNVKDFTTSKEMLEEAVTKFKKVTELNPDLHRPFWALGKTLTAQAILFSTRAEAKDHYELAYDYFLKAVEKNPKNKLYRISLQEAAKKAPGRGPFTSAGFKQSAGTADPSSAGTENVPGTCPFSSAGTKRSIGTAGLSSSAGTEDPSNLPDVDPLDGDAKVCESIDPPASRFISYLENYANKFEINPQFNECVQSAKYDETSGLWRVKTNEVEYICRWLVVATGENAECVTPEIEGLSEFKGEVVYACDYKSGKNFEGKKVLVVGCGNSGMELSLDLSNHHALPSMVVRSSVHVLPREIFGISTFELAVMMLKWLPLWIVDKLLLILTWFILGDMEKYGIKRPSMGPLQLKNTVGKTPVLDIGALEKIRSGDINVVPGIKRINKNGEVELVNGEKLDIDAVVLATGYRSNVPSWLQEGEFFSKNGYPKMPFPHGWKGNSGLYAVGFTKRGLSGASSDAVKIAQDIGKVWKQETKQKKQRTTACHRRCISQF

SEQ ID NO: 54038 - protein, 435 aa, Medicago truncatula
MMNEEDNGESSTRRIQVRFVTSLPEPFKVPSSAIAIPVDLTRFGLSSLVNALLQSKDEDHKSEPFDFLIDGEFVRMSLEDFLLAKGISAERILEIEYIRSVAPRKEEDPSLPDDGVSAVDGSSSRFILTGCYDGFGRVWEGAGLCTHILEGHSDGVTSVSVINPEGVETVTLATASKDRTLRLWKINTEEATNHPARVRAYKILRGHKSSVQSVAAQTNGEMICSGSWDCTINLWQINDTNAENDLVSKKRKVDGRVEDSQLEGEAFTTLVGHTQCVSSVIWPQRESIYSASWDHSIRKWDVEKGKNVTDIFCGKALNCLDIGGESSALIAVGGSDPVVRIWDPRKPGTSAPVFQFASHTSWVTTVKWHDKSLFHLLSASYDGKVMLWDLRTAWPLSTIESHSDKVLCADWWKSDSVISGGADSKLCISSQIPLQ

SEQ ID NO: 54039 - protein, 469 aa, Bacillus halodurans C-125
MVVGDFAKEVDTLVIGSGPGGYVAAIRAAQLGQSVTIVEKGTLGGVCLNVGCIPSKALISAGHRYHNALHSDDLGIKAENVTLDFSKVQEWKASVVNKLTGGVEGLLKGNKVEIIKGEAYFASEDSVRIMDEKNATTYKFKNCIIATGSRPIELPNFKYSKRIINSTGALALEEVPKKLVVIGGGYIGIELTGAYSNLGSDVVVLEGGKQILPGFEKQMAKLVERKLKKNGVSFHTEAMAKGVEETEDGVKVTAEIKGKEEVFEADYVLVTVGRKPNTDELGLEQIGVELTERGLIKVDKQCRTNLSNIYAIGDVIEGPALAHKASYEGKIAAEAIAGEKSEIDYLAIPAVVFSDPELATVGYTETEAKEAGYDVTAAKFPFAANGRALSLNDADGFMKLITRKEDGLVIGAQIAGPNASDMIAELGLAIETGMTAEDIALTIHAHPSLGEITMEAAEVALGTPIHIVK

SEQ ID NO: 54040 - protein, 352 aa, Medicago truncatula
MLSRLHHRNLVKLIGICIEGRRRCLVYELVPNGSVESHLHGDDKNRGPLDWEARMKIALGAARGLAYLHEDSNPRVIHRDFKASNVLLEDDFTPKVSDFGLAREATEGSNHISTRVMGTFGYVAPEYAMTGHLLVKSDVYSYGVVLLELLTGRKPVDMSQPQGQENLVTWARALLTSREGLEQLVDPSLAGGYNFDDMAKVAAIASMCVHSEVTQRPFMGEVVQALKLIYNDTDETGGDYCSQKDSSAQESDFRGELAPSDSSWWNGGGLTPRLTYGQASSFITMEYSSGPLEDMENRPFSTSSFNGDELSLPIRHGNRSGPLRTTRSKLSLYRFSGSRSEHGEVSSKRNWI

SEQ ID NO: 54041 - protein, 426 aa, Bacillus halodurans C-125
MAYEFKLPDIGEGIHEGEIVKWFVKPGDEVKEDDILLEVQNDKAVVEIPSPVDGKILEVKVEEGTVAIVGDVLVTIDAGEGVGAEETEEAPAPEEKAEEAAPAEPAPAKETAPEEDGDEDKRVIAMPSVRKYAREKGVNIKKVKGTGKNGRILREDIDAFLSGDTQAEASEEKAETAAPAAASNVEPTEIPVGEREERVPLKGIRKAIAKAMVNSKHTAPHVTHMDEVDVTALVAHRKQYKEIAAEQGTKLTYLPYVVKALTSALKKYPVLNASIDDVNEEIVYKHYFNIGIAADTEQGLVVPVIKDTDRKSIFELADNINELAIKARDGKLSAAEMKGGSCTISNLGSARGQWFTPIINHPEVAILGIGRIEEKPVVKDGEIVAAPVLALSISYDHRLIDGVTAQNALNHVKRLLNDPQLMLMEG

SEQ ID NO: 54042 - protein, 325 aa, Bacillus halodurans C-125
MAQMTMIQAITDAMRNELKRDENVLVFGEDVGQNGGVFRATEGLQKEFGEDRVFDTPLAESGIGGLAIGLGLTGFRPVMEVQFFGFVFEVFDSVAGQMARMRYRSGGKYHSPITVRSPFGGGVKTPELHADNLEGLMAQTPGVKVVIPSTPYDAKGLLISAIRDNDPVIYLEHMKLYRSFRAEVPEEEYTIPLGKADVKREGKDVSIITYGAMVHSSLKAAEELEKEGISAEVIDLRTISPIDIDTILESVKKTSRVIVVQEAQKQAGIGAHVASEIQERAILHLEAPIMRVSAPDTVYPFAAAEDVWLPDFKDIVEKAKAVIEF

SEQ ID NO: 54043 - protein, 338 aa, Arabidopsis thaliana
MADKKIRIGINGFGRIGRLVARVVLQRDDVELVAVNDPFITTEYMTYMFKYDSVHGQWKHNELKIKDEKTLLFGEKPVTVFGIRNPEDIPWAEAGADYVVESTGVFTDKDKAAAHLKGGAKKVVISAPSKDAPMFFVGVNEHEYKSDLDIVSNASCTTNCLAPLAKVINDRFGIVEGLMTTVHSITATQKTVDGPSMKDWRGGRAASFNIIPSSTGAAKAVGKVLPALNGKLTGMSFRVPTVDVSVVDLTVRLEKAATYDEIKKAIKEESEGKLKGILGYTEDDVVSTDFVGDNRSSIFDAKAGIALSDKFVKLVSWYDNEWGYNSRVVDLIVHMSKA

SEQ ID NO: 54044 - protein, 560 aa, Oryza sativa (japonica cultivar-group)
MVLYADPPPPIKPPEIKIKELANKSTYESSMMEQKTRLHAIERHRSCEVSQAILSEVENRHQHQTLEPIKSPISGCSPSVESTTDTNTVHRHTVADAAWEALKKSIVHFRGQPIGTVAAIDKSQGALNYDQVFMRDFVPSALAFLMKGEPTIVKNFLLETARLQLREKMVDLFKLGQGVMPASFKVHHCNSKHKTESLLADFGETAIGRVAPVDSGLWWIILLHAYTIWTRDNSLAESPECQRAMRLILKLCLSEGFDTSPALLCADGCSMIDRRMGIYGYPIDIQALFFMALRCAVTLLKEDHNDDFVYQISRRIKALSYHLHSYYWLDFQRLNEIYRYKTEEYSETALNKFNVIPESIPDWIFDFMPSRGGYFIGNVSPARMDFRWFCLGNFIAILSSLTTGEQAEAILDLVEERWEELIGEMPMKVCYPAMENQEWQIVTGCDPKNTRWSYHNGGSWPVLLWLLVAVSVKLGRPHIARRAVEVMEKRLVKDEFPEYYDGKAGRYVGKQARKFQTWSVAGYLVAKMLLDDPSNLRAVSLADDCHIRSAPVLKRSNSFP

SEQ ID NO: 54045 - protein, 299 aa, Glycine max
MAIISDFNEEEPKPAHSSPPQPQSSSSSSSFSATFDRSNPIAFLERVFEFVSEQSDFLATQSAEKEIVSLVHAAGKKKRELLKAERENADKKKREDLKVTEERQKVEKRLNEEKELKAEDTNKNESASRVPNKGNGLDLEKYSWTQSLQEVNVNVPVPNGTKSRFVTVEIKKNHLKVGLKGQPPIIEGEFHKSVKPDDCYWSIEDQNSISILLTKHDQMEWWKCLVKGDPEIDTQKVEPENSKLGDLDPETRQTVEKMMFDQRQKSMGLPTSEELQKQEMLKKFMSEHPEMDFSRAKIS

SEQ ID NO: 54046 - protein, 429 aa, Oryza sativa (japonica cultivar-group)
MSSPPPAAAAAMAVDDADDDQLASMSTEDIVRATRLLDNETRVLKDELQRTNLEVESYKEKIKENQEKIKLNKQLPYLVGNIVEILEMNPEDEAEEDGANIDLDSQRKGKCVVLKTSTRQTIFLPVIGLVDPEKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKSPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIIQVQAKKKSSLNYYA

SEQ ID NO: 54047 - protein, 381 aa, Gibberella zeae PH-1
MAPTQQAAWRNAPTAEDLARRQTVGINKETVTNISSTDYPGHHPGEDNEYTLDRFRDAFSVNFHQNDQFLSSFSLVGIDASLANAFRRILLSEIPTLAVENVYIENNTSVIQDEVLAHRLGLIPFKGGREGLHNFLKWHKKPEAGDDPYAGCFDWNTVRLELNVTCTVNEDASPTENDPLKAYHNAHVYARDIVFVPTGRQAEYFSGENAIAPTNPDILIAKLRPRQTINLAMHMHKGIGSDHAKFSPVATASYRLLPTITITQPILGADAEKFAKCFPKGVIGLEKVTAEDAAKTGSGYEGHKGETKAVVVDAMKDTVSREALRHEEFQGKVKLGRRRDHFIFSIESTGQWDSDELFLESVKHLKLKCKKLEQQVINMAR

SEQ ID NO: 54048 - protein, 128 aa, Buchnera aphidicola str. Sg (Schizaphis graminum)
MNVIVNTENAPKPIGPYSQAIKNENFLIISGQIPIDVKSGKIPNNISEQTYIVLKNIKSIIIASKYTIQDIIKITVFTTNLEKIHIINEIYEKFFIDNKSSFPTRSCIEVQKLPKNVKIEMEAMAFKK

SEQ ID NO: 54049 - protein, 425 aa, Pseudomonas syringae pv. syringae B728a
MTQQEFNDPLWRTILSGAQMLFVAFGALVLMPLITGLDPNVALFTAGLGTLLFQIVTGRQVPVFLASSFAFITPIILAKGQFGLAATMGGVMAAGFVYTFLGLAVKIKGTGFIDRLLPPVVIGPVIISIGLAMAPIAANMAMGKSGDGVQLIPYQTAMLISMPALLTTLIVAVFGKGIFRLVPIISGVLVGFALSFYFGVVDTKKIADAAWLALPHFTAPEFNWQAILFIVPVALAPAIEHIGGVIAVGSVTGRDYLKKPGLHRTLFGDGIATTAAGLFGGPPNTTYAEVTGAVMLTKNYNPQIMIWASFFAITLAFIGKFGALLQSIPVPVMGGILCLLFGSIAAVGMNTLIRHKIDLAEARNLVIVSVTLVFGIGGVLIGTGNGPNDFGLKGIALCAVTAIALNLILPGNDSWKNKQLDDQLP

SEQ ID NO: 54050 - protein, 391 aa, Thiomicrospira crunogena XCL-2
MEYIPGLAGVPATESEISYIDGNKGVLTYRGYDIMELAEYSSFEETTLLLLFGNLPTADELADFENKLRNARRVKYNLREIMKNLPATTHPMHMLQVAVASLASFYPSTEYMKGGTENQEYINEVTVNIISHMGTLVAMWEHMRNGFDPIEPRKDLTYAENFLYMVTGEEPDKDWARLLDACLILHAEHTINASTFTTMVTGSTLANPCSVISSAIASLSGPLHGGANQKVIEMLDEIGTPENARPYIEKRLAEKKVIWGMGHREYKTKDPRATILQKLSSELLQNKSDAGSLSKAFETAMEVERVCEELLGHKGVYPNVDFYSGILYKEMGFDAGLFTPIFAVARSAGWMAHWREQLQNNKIFRPTQIYTGAGNSCYLPMEKRSQKKSMP

SEQ ID NO: 54051 - protein, 97 aa, Triticum aestivum
  misc_feature (42)..(42): Xaa can be any naturally occurring amino acid
  unsure (1)..(97): unsure at all Xaa locations
MEGEKLSSAATFVEGGVYACDHTCSICLKAFCDSDSSTVATXSCRCYRAGKHDLHLQCILEWCQRSSQCPMCWQAINTKDPMSALEKMDMRPQPTLA

SEQ ID NO: 54052 - protein, 510 aa, Zea mays
MGILGKGSGWCFCSRGAKLERIKSSLLAAKGAAIAAVSFPSGGGGGGAGGKGGSGFLIHRSLLLTTHGTIPSAAAAGAAEVRLSHGRLLARLVPQRFFITSSILDLTIVGLDVVDDDLSSHGQQPHFLKTCLNPSLDLGSTVLLLGHNRNDLAVGEGKVVIATDNLIKFSIDEVLWHPGSAGFDMHGNLAFMVCDPMKIAPSTPNGYASASSTAICTSKKDVPTQFGIPIPAVCEWLKQHWNGCLEDASKPMMTPARLTTCGERSGCSSLGRLRYIKTAEVEGGDVLSSSQMPPRPTWQHGACSSASAKISHGENDSIGSHSFHGSIRLPLPLKQMLPDDNKDEANSQAPHRTEPSNVQMNCGTLHNVAYHENCWSEVQSSSSPVVISEIGDGRDGFSSGEETMYSAETRESRNIPSPKEKKTGMVGRSQSLVNRSKWDSPKSVESSRGFPSKSQTFIPLRKPHLQAASISQKSQDYFSPTVSSNMKKRNLSQTPMKPRQRAQVTSKWIT

SEQ ID NO: 54053 - protein, 795 aa, Ustilago maydis 521
MADNITLTEDATLEGGNPPKEPGDTPTPSAAAAAAPPPPPPTASKPNGAPAAPAAASNTKPSTILANCEPKPLMATPYSDRIQAAIREGSVRVPTEEREIRARELLVFSDSETESNLSRPPSPDRDRYPKHRLSGLQSKDQTIVKHGLEAEGPDGLAARLELTRENSPYDIRAQLASPSFAQVGGQLDGSAASTNPPSLVSSRRPSAGTSAQANATAAAAAATTAALRPSSPPPRAMSPSKAPASTKLSHNTLSGPTNATFASSPRPQPHAEPTRLPSNSGGENKEKPKEKESKGMFRRMLSGAGGGHSDKDKDKANAEAAVASSPSRERLSPRTAASQQASGHVSPMRSPSLSRGSTPPLSPRNEVDEAALASGFQAMNVTSPPGSQPPSRNVSIKRKDGKSESSSKDAGATEGSRLTVAALRDWDAKAKPDKSSKKSDKGKDGDAKSTASSTLRDMIMGSAPKLSRRGSSASHGNKSDGGSKKGGSTAGGETASLLKKYGVCEKAAIGKGATAVVRLAHKWDRSTEKLYAVKEFRKRRKNETEKEYVKKLTSEFCISSTLHHINIVETVDLVQDENRHWCEVMEYCPGGDLYAAIKRGGMSQAEVECSFKQILNGIFYLHSMGVAHRDIKPENLLLDGHGHIKITDFGVSDVFRMCWEKSTHYSKGLCGSEPYIAPEQFEKKEYDARLVDVWAAAVVFYCMQFQELPWRVAKMSDPTFKEYVQSYLSSPAPSPLSNLSPRDCRPLLKKMLCPDPKGRWTMDEVLKDPWLMSVPICEEGKQNDHTHSSAPTNSS

SEQ ID NO: 54054 - protein, 388 aa, Mycobacterium sp. MCS
MRALCWNGVNKLSVETVDDPEILNPHDVILKVTLTTTCGSDLHFIDGYLPGMREGDIFGHEFMGEIVETGREVRDVKVGDRVVVPSFIGCDRCWYCEHDLYSCCDTTNPNAELQQPLLGYPSGGIYGYTHPFGGYAGSHAQFVRVPFGDTNCFPIPGDITDEQALFLSDAVPTGFMGADFCDVNGGDTVAVWGAGGVGLMAAKSALLLGAERAIVIDRIPERLSLAGEFGLETIDYGAADSVQESLREMTGGRGPDACIDAVGMEGHSTGLQQVYDRAKQLLRLETDRASALRQAILACRKGGVVSVLGVYGLTDKFPMGVVTNKGLTLRSAQQHGQRYMARLFDYVEQGDLDPAKLITHDLPLEQGVRAYDMFKNKQDNCIRVALRP

SEQ ID NO: 54055 - protein, 556 aa, Streptomyces avermitilis MA-4680
METTLRGVGVSHGVAIGEVRHMGTAVLEPPAKQIPAEDAEREQGRAHKAVDAVAADLIARGNLAGGEAQAVLEAQALMAQDPELMADVERRIAVGSTAERAVYDAFASYRALLAGAGEYLAGRVADLDDVRNRIVARLLGVPMPGVPDSDEPYVLIARDLAPADTALLDPTLVLGFVTEEGGPTSHSAILARALGVPAVVALPGAGEIGEGIVIAVDGSTGEIFVNPSPEKKEQLEAAAAERKAALSASTGPGATSDGHKVPLLANVGGPADVPAAVEAGAEGVGLFRTEFLFLDDSKNAPSEEKQVEAYRQVLEAFPEGRVVVRVLDAGADKPLEFLTPADEPNPALGVRGLRILLEHPDVLRTQLTALAKAAEGLPVYLEVMAPMVADRTDAKAFADACREAGLQAKFGAMVEIPSAALRARSILQEVEFLSLGTNDLAQYTFAADRQVGAVSRLQDPWQPALLDLVALSAEAAKAEGKSCGVCGEAASDPLLACVLTGLGVTSLSMGAASIPYVRATLAKYTLAQCERAAAAARAADTAEEARNAAQAVLSGE

SEQ ID NO: 54056 - protein, 394 aa, Prochlorococcus marinus str. MIT 9515
MNIKIPEHVDIAIIGGGMAGLSAAASLSEMGVKNIAVFESEKLAHSEGSSFGESRMYREMYSDPVLCKLAKESNKLWAEQESIAKYSLRKEHGLLFYGESWDEETIEGSIPGAQKVMDEQNIPYEFLTSEKISERFPIKPKEHFVGLFEPSAGSILSDRAIENWIKIIRSNGNQIYEGCKIKRIEEKNNSLEIIGNQSVSFDQLIVASGMWTNELLEPIGLKQDVKIWPMLWAHYLVDEDFINSYPQWFCFQKSRGDDGGLYYGFPVLSRNKNNIPRIKVGIDWTSPKLIGGDEGAMKKPFMEPLIKMLDDFIINNFEGVIVCDETFVSPYTMTNDVNFILDKPKSNITVFSGGSGQSFKFAPIIGKCLAEKALNKNCSFDISCWEFDRFLTTK

SEQ ID NO: 54057 - protein, 333 aa, Xylella fastidiosa Temecula1
MAVSLLQHNHLSDTALIASARRVIEIEREALTLLNERIGAPFVAACRLILNSHGRVISTGMGKSGHIARKIAATLASTGTPAFFVHPGEAGHGDLGMITDSDVILALSYSGESDEVRMLLPVLKRQGNPIIAMTGRPQSTLAQAADVHLDVSVTTEACPLDLAPTSSTTTSLVIGDALAVALLDARGFTAEDFARSHPAGHLGRRLLLHITDVMHSGDDLPAVHEEATLSEALLEMTRKRLGMTAIVDNEGRLQGVFTDGDLRRALDSNIDVRNARINEVMTRHPKTINADQLAAEAARLMEANKINGLIVVDPQQRAVGALNIHDLLHAKIV

SEQ ID NO: 54058 - protein, 831 aa, Streptomyces avermitilis MA-4680
MKAVVMAGGEGTRLRPMTSSMPKPLLPVVNRPIMEHVLRLLKRHGLNETVVTVQFLASLVKNYFGDGEELGMELTYANEEKPLGTAGSVKNAEEALKDDTFLVISGDALTDFDLTELINFHKEKGALVTVCLTRVPNPLEFGITIVDEEGKVERFLEKPTWGQVFSDTVNTGIYVMEPEVFNYVEADVSVDWSGDVFPQLMKDGKPVYGYVAEGYWEDVGTHESYVKAQADVLEGKVDVEIDGFEISPGVWVAEGAEVHPDAVLRGPLYIGDYAKVEADVEIREHTVVGSNVVVKSGAFLHRAVVHDNVYIGQHSNLRGCVIGKNTDIMRAARIEDGAVIGDECLVGEESIIQGNVRVYPFKTIEAGAFVNTSVIWESRGQAHLFGARGVTGILNVEITPELVVRLAGAYATTLKKGSTVTTARDHSRGARALKRAVISALQTSAIDVRDLENVPLPVARQQTARGSAGGIMIRTTPGVPDSVDIMFFDGQGADLSQGSQRKLDRVFARQEYRRAFPGEIGDLHFPASVFDSYTGSLLRNVDTTGISESGLKVVVDASNGSAGLVLPSLLGKLGVDALTINPGLDESRPTETADARRSGLVRLGEIVASARAAFGVRFDPVGERLSLVDEKGRIVEDDRALLVMLDLVAAERRSGRVALPVTTTRIAEQVAAYHGTQVEWTTTSPDDLTRVGGDESTIFGGDGRGGFIIPEFSSVFDGTAAFVRLIGLVARTQLTLSQIDARIPRAHVLKRDLATPWAVKGLVMRRVVEAAGDRFVDTTDGVRVVESDGRWVMVLPDPAEAVTHLWAEGPDDASAEALLDEWAAVVDSAGR

SEQ ID NO: 54059 - protein, 438 aa, Pseudomonas aeruginosa PAO1
MSAKDTPAPQAAEPGRAQPVEVPGGGHWWRRLLAFAGPGYLVAVGYMDPGNWATDVAGGAQLGYLLLSVILLSSLMAMLLQALSARLGIASGLDLAQACRERYSPSTCRLLWLACETAIIACDLAEVIGTAIALKLLFGLPLAWGALLCVGDALLVLVLIGRGQRPLEAFVVALLTLIFACFAVQLLLSRPELGEVLQGFLPSPRVLSDPAALYLAIGIVGATVMPHNLYLHSSLVQSRAYPRSLAGKRKALRWAVADSSLALTLALLVNAAILIVAASVFHRNGHTEVVDIEQAHALLSPLLGLELASLLFAVALLASGLNSTVTTTLAGQIVMEGFLRLRLAPWARRLLTRGVAVLPVLLVTLLYGEDGTARLLIFSQVILSMQLPLAVIPLLQFVSDRRLMGPLAIGAGTRWLAWAVALAIVGLNLQLLADFAFG

SEQ ID NO: 54060 - protein, 345 aa, delta proteobacterium MLMS-1
MKKILCADIGATHSRFAWFTLAEPAPDDFAAPPDSAPPASAASTNPAAGLELQDIRWLPTAPDGSLAAQLRTLYSEGFPLPPEQTAMAVLAVAGPVRRGRYSKLPLAGWEVDLDLIEGEFPFAAATLINDFTAQALAVLTPPGQAAREILPGEPEPAGPLAIVGAGTGLGKALLLPATGPARPAPLVIPSEGGHADFPFAGGREGDYLDFLLQKRGEERISGNTVVSGQGLAYLHWFLGGRKLEPAAVLAELAPDSATMAWAARFYGRVCRNYALETLATGGLYVAGGVAARTPELLDHPEFAREFHHSPTMNELLTRIPVRLINDQNSGLWGAAMQAALLLTTK

SEQ ID NO: 54061 - protein, 322 aa, Ustilago maydis 521
MSSALDSLKQYTAVVSDSGDFESIDAYKPQDATTNPSLILAAVKQEKYARLIDVAVKYAKEQTSDKSKQLDLATDRLLVAFGVEILKIIPGRVSTEVDARLSYNKEATIEKAKHLIALYESLGVKRERVLIKIASTWEGIQAARELESQHNIHCNLTLLFGFNQAVACAEANVTLISPFVGRILDYYKKAEGKEYASHEDPGVLSVQRIYTYYRQHGYKTIVMGASFRNIGEILELAGCDFLTISPKLLEELKNKEGPVEQKLSVEKAKSAEPIAKVSYINDQAAFLLDLAKDPMANTKLAEGIAGFAKDGATMEQMIADKL

SEQ ID NO: 54062 - protein, 80 aa, Arabidopsis thaliana
  misc_feature (60)..(60): Xaa can be any naturally occurring amino acid
  unsure (1)..(80): unsure at all Xaa locations
MASSMLSSATMVASPAQAIMVTPFTGIKSTAAFPSTGNAKKYTTSHQKRTVSRVHCKHVXPPIVKKKFETLSYRPDLTDS

SEQ ID NO: 54063 - protein, 374 aa, Solanum tuberosum
MRPLQPPPPAANSTSSAAASSMPPPSSAGQRSRPRRRTDLTLPLPQRDVALAVPLPLPPTSAPSSSSSSSSSPLPTPLHFSELERVNRIGSGTGGTVYKVLHRPTGRLYALKVIYGNHEDSVRLQMCREIEILRDVDNPNVVRCHDMFDHNGEIQVLLEFMDKGSLEGIHIPLEQPLSDLTRQVLSGLYYLHRRKIVHRDIKPSNLLINSRREVKIADFGVSRVLAQTMDPCNSSVGTIAYMSPERINTDLNHGQYDGYAGDIWSLGVSILEFYLGRFPFSVGRQGDWASLMCAICMSQPPEAPPTASREFREFIACCLQRDPARRWTAAQLLRHPFITQNSPGTHTGPATTSLSNQAHQLLPPPPHFSSSSSS

SEQ ID NO: 54064 - protein, 449 aa, Clostridium symbiosum
SKYVDRVIAEVEKKYADEPEFVQTVEEVLSSLGPVVDAHPEYEEVALLERMVIPERVIEFRVPWEDDNGKVHVNTGYRVQFNGAIGPYLGGLRFAPSVNLSIMKFLGFEQAFKDSLTTLPMGGAKGGSDFDPNGKSDREVMRFCQAFMTELYRHIGPDIDVPAGDLGVGAREIGYMYGQYRKIVGGFYNGVLTGKARSFGGSLVRPEATGYGSVYYVEAVMKHENDTLVGKTVALAGFGNVAWGAAKKLAELGAKAVTLSGPDGYIYDPEGITTEEKINYMLEMRASGRNKVQDYADKFGVQFFPGEKPWGQKVDIIMPCATQNDVDLEQAKKIVANNVKYYIEVANMPTTNEALRFLMQQPNMVVAPSKAVNAGGVLVVGFEMSQNSERLSWTAEEVDSKLHQVMTDIHDGSAAAAERYGLGYNLVAGANIVGFQKIADAMMAQGIAW

SEQ ID NO: 54065 - protein, 94 aa, Nostoc sp. PCC 7120
MSEQFSAEISSRICNHMNEDHANAVVLYAQVFGGVTQAESAQMLAIDAQGMDLTAQVNGESVPVRIHFDHVLADAEDAHHTLIAMVKQARVQAK

SEQ ID NO: 54066 - protein, 630 aa, Mesorhizobium loti
MCGIFGIVLKNEGTPVCAAAVERCADALAHRGPDASGLYINQSVAFAHRRLSIVDAHSRANQPYRDANTGVVVTYNGEIFNYREIKAELRDMGFSFSTVSDTEVLILSYIAWGKSFLNRLDGIFAFALFDPRKSLVLIARDRLGVKPLYYTICDVGLLFASQPNALIRWPGVMHGPDMIGALSFLSYRAVVGARTLFAGISKLEPGHLLEIRNGRHTSERWWNLSARISRSKPDYSDIRRLFGSAVERQLVADVPVAALLSGGLDSSILAYEASARSQIRPVCYTGKVETPDYDETAYAMEVAAEFGLTHRVVPIGEPSDINAVAELVRLRGHPLGMHNETAMFTLAKAISKEHKVVLTGEGADEIFAGYSRLFRTPYDYNRSKIITALPPALAQIARRRLGLGVHCSQLQFFLERYSYFPADEIRSLAIDGQMRTEHEMELFDHFSTQFAEAGGDFFSKISYVLVSTHLPALLEMVDNTTMAAGLEARVPYTDHQLVTAAMAMPGSQRLRWRSPIASAQALWHPVASFSERLDVSKYPLRREYRSVLPKSVLSRKKMGFPLPLGQWAVGEGATEYRRLLFDKDSPLGDLFDPAALRRWFKAGRRNPSDSFGRKFWLLANLGIFFKEVFS

SEQ ID NO: 54067 - protein, 181 aa, Antirrhinum majus
MAAKISSDPLVIGRVIGDVVDHFTSTVKMSVIYNANNSIKHVYNGHELFPSAVTSTPRVEVHGGDMRSFFTLIMTDPDVPGPSDPYLREHLHWIVTDIPGTTDSSFGKEVVSYEMPRPNIGIHRFVFLLFKQKKRGQAMLSPPVVCRDGFNTRKFTQENELGLPVAAVFFNCQRETAARRR

SEQ ID NO: 54068 - protein, 547 aa, Burkholderia vietnamiensis G4
MGKPLLGQMMDMPLLVSSLIAHAARHAGDTEIVSRRVEGDLHRYTYRDCEHRAKRVAQALARLGVEAGERVGTLAWNGYRHLEAYYGIGGMGAVCHTINPRLFPEQIAYIVNHAEDRYVLFDLTFAPLVDAIAPQCPHVKGWIAMTDAAHLPAGSTPYLCYETLVEAEDGRYDWPRLDEQQASGLCYTSGTTGNPKGVLYSHRSTVLHAYGAALPDAMNLSALDAVLPVVPMFHVNAWGLPYAVPLTGGKLVLPGKDLDGKSLYELMEAERVTFSAGVPTVWLGLLNYMREAGVRFSTLNRTVIGGSACPPAMLRTFEDEYGVRVIHAWGMTELSPLGTLATLNWAQSQRPRDAQRRLLEKQGRVICGVDMRIVGDDGRELPWDGVAFGELQVRGPWVIDRYFKSDASPLSDGWFPTGDVATIDHDGFLQITDRSKDVIKSGGEWISSIDIENVAIAHPGVAEAACIACAHPKWTERPLLVVVPRDGANLTRDALLAFFDGKVAKWWVPDDVVFVDALPHTATGKLQKLKLRETFRDYVLPTAVGAQ

SEQ ID NO: 54069 - protein, 294 aa, Gibberella zeae PH-1
MSTRPPSRVVFVGNIPYGLTEEQITEIFSSAGKVERFRLVYDSETGRPKGFGFADYPDTDSASSAVRNLNDHEIMGRKLRVDFSNEQKGSDDDKDPSTSGYSMHASNGAATNYNAQPSTLPPLPSGKELPPGVSCTDSISRTLQTLPPAQLLDILSQMKTLATNDPQRATELLQQAPQLGYAVFQALLLMGLVSPEAIQSVVEPGAPPPAAFPPAPMPGFPGVSNTPPVAAMPYQAPPQQYAAPPPAAPAPVAPDQDALMRAVMELPQAQIDMLPEAERQQILALRATFGGQRR

SEQ ID NO: 54070 - protein, 455 aa, Photobacterium sp. SKA34
MFGMFKPKAHIAPLSNSKVDSTYSRLRWQLFFGIFFGYAGYYLVRKNFSLAMPYLIDEGFSRGELGVALAAVSIAYGLSKFLMGNVSDRSNPRYFLTAGLVMSSLVMLCFGFMPWATGSVAAMFILLFLNGWFQGMGWPACGRTMVHWWSRKERGEIVSVWNVAHNVGGGLIGPMFILGLWAFNDDWRTAFYVPALFALLVAFFVWLTVRDTPQSCGLPPIEEYKDDYPDGYDKSFETEMTAKEIFFKYIFNNKLLWSIAIANAFVYLIRYGVLDWAPVYLKEAKGFSVDKTSWAYFLYEWAGIPGTLLCGWISDKLFKGRRAPAGILFMVLVTLAVLVYWFNPAGNPTIDMLALIAIGFLIYGPVMLIGLYALELAPKKAAGTAAGLTGLFGYLGGAVAANAVLGYTVDLYGWDGGFIILVGSCVTSIVCFIYALLGERAMHERKAKEKAALAQ

SEQ ID NO: 54071 - protein, 181 aa, Antirrhinum majus
MAAKISSDPLVIGRVIGDVVDHFTSTVQMSVIYNANNSIKHVYNGHELFPSAVTSTPRVEVHGGDMRSFFTLIMTDPDVPGPSDPYLREHLHWIVTDIPGTTDSSFGKEVVSYEMPRPNIGIHRFVFLLFKQKKRGQAMLSPPVVCRDGFNTRKFTQENELGLPVAAVFFNCQRETAARRR

SEQ ID NO: 54072 - protein, 489 aa, Oryza sativa (indica cultivar-group)
MVPSFPQPASAAAATRPIPGSYGPPLLGPLRDRLDYFWFQGPDDFFRRRAADHKSTVFRANIPPTFPFFLGVDPRVVAVVDAAAFTALFDPALVDKRDVLIGPYVPSLAFTRGTRVGVYLDTQDPDHARTKAFSIDLLRRAARNWAAELRAAVDDMLAAVDEDLNRAPDPAAASASYLIPLQKCIFRFLCKALVGADPAADGLVDRFGVYILDVWLALQLVPTQKVGVIPQPLEELLLHSFPLPSFVVKPGYDLLYRFVEKHGAAAVSIAEKEHGISKEEAINNILFVLGFNAFGGFSVFLPFLVMEVGKPGRDDLRRRLREEVRRVLGGGDGDGGEAGFAAVREMALVRSTVYEVLRMQPPVPLQFGRARRDFVLRSHGGAAYEVGKGELLCGYQPLAMRDPAVFDRPEEFVPERFLGDDGEALLQYVYWSNGPETGEPSPGNKQCAAKEVVVATACMLVAELFRRYDDFECDGTSFTKLDKRELTPS

SEQ ID NO: 54073 - protein, 349 aa, Yarrowia lipolytica CLIB122
MTETLRTQCTWLGLYFFFNLALTLFNKAVLGSFPFPYTLTGIHTLCGTLGCALLHWRGVFKLTRLSDQENTTLILFSILYTINIAISNVSLQMVTVPFHQVVRATTPFFAMLINVVFLRHSYTVLTYLSLVLVCAGVGFATAGDYYFTAMGFILTILGAVLAAVKTVVTNRIQTGRFRLSPLELLYRMSPLAFVQTLVYAYLAGELDVLGLRLSSPEDVVGATASATSGPLSFLGGIDYTEIEFEYSQKLMLHLLLNGIIAFGLNIVSFTTNKKTGALTMTVAANVKQILTIVLAIFFFNLTVTPLNMMGILVTLLGGAWYAKLELDRKSDNSGAESALPVKEANRSQA

SEQ ID NO: 54074 - protein, 293 aa, Staphylococcus aureus subsp. aureus MW2
MAAQDPRTKFKTTDYEKQEQEVPGLQSEMTPAPDCGETSYQGHQRLQGYKILVTGGDSAIGRAAAIAYAKEGADVAINYLPSEEQDAQEVRQVIEESGQKAVLIPGDIRDEQFNYDLVEQVYQQLGGLDNVTLVAGYQQYHDDIHGFTTEAFTETFETNVYPLFWTVQKALEYLKPGASITTTSSVQGYNPSPILHDYAASKAAIISLTKSFSEELGPKGIRVNCVAPGPFWSPLQISGGQPQSKIPTFGQKTPLGRAGQPVELCGTYVLLASEESSYTTGQVFGVSGGVQID

SEQ ID NO: 54075 - protein, 193 aa, Oryza sativa (japonica cultivar-group)
MYSDVAAGGGGGSGGGGRVSAIETGTKLYISNLDFGVSTEDIKELFSELGDLKKYVIHYDRSGRSKGTAEVVFARRGDAVAAVKKYNNVQLDGKPMKIEILGTNTPTAAAALPANNGGYVRNVAKSAPRGGPAGLPQGRPRPRGGGRRRGGGGGSGGPGGSGGRRGKERSQPKSAEELDADLEKYHADAMQTN

SEQ ID NO: 54076 - protein, 215 aa, Glycine max
GTRDLLTEGDIIPCVPHDLINLHQELNISEQQDAMLLWLEEHGRRLEHGFIKLHDKGNGKSINLFPEEPPLCSMAVTNGVKVRASALVIPELIDLQDDLEKYLFAYSIRLSLEPQGCTINGMSFSSCQLHWRHWIIRANDIVISDVNGEAVIGQYPLLRPGAQEFVYQSRMHLPTPSGSIEGSFTFIPGRLADPKGDPFLATVARFPLQLPDYIF

SEQ ID NO: 54077 - protein, 137 aa, Escherichia coli K12
MLKRYLVLSVATAAFSLPSLVNAAQQNILSVHILNQQTGKPAADVTVTLEKKADNGWLQLNTAKTDKDGRIKALWPEQTATTGDYRVVFKTGDYFKKQNLESFFPEIPVEFHINKVNEHYHVPLLLSQYGYSTYRGS

SEQ ID NO: 54078 - protein, 472 aa, Synechococcus sp. RS9916
MGKTAQDVLNTIKNEGIELIDLKFTDLHGKWQHLTVCTDLLDEDAFTDGLAFDGSSIRGWKAINASDMAMVPDPKSAWIDPFYRHKTLSMICSIMDPRTGEPYERCPRALAQKALNYLSSTGLADTAFFGPEPEFFLFDDVRYESSNGSSSYSVDSIEAPWNTNRVEEGGNLANKIQLKEGYFPVSPNDTSQDIRSEMLLTMGSLGVPIEKQHHEVATAQHELGMKFAELIQAADNVMTYKYVVRNVAKKYGKTATFMPKPIFADNGSGMHVHQSLWKAGAPLFFGEGTYANLSQTARWYIGGILKHAPSFLAFTNPTTNSYKRLVPGFEAPVNLVYSEGNRSAAVRIPLTGPSPKAKRLEFRSGDALANPYLAFSAMMMAGIDGIKNQIDPGDGVDVDLFELPADELAKIATVPASLNGALEALREDHHYLLEGGVFTKDFIDNWIEIKYEEVQQLRQRPHPHEFTMYYDA

SEQ ID NO: 54079 - protein, 495 aa, Ustilago maydis 521
MTARRYTQGVRCSTGDAVDGRVRGRDKKGKAKQMSAEDAVGLQGQMRRPVSSMSGLAWRPTGVVRTASMWSKRRCLVDARWTGWLLSHGVHTFTGAMNAARTSSARSSSVSSTGPSTSPTAPVAPASSSPYSPATPASLAGLGTTQLSPDIMLRCTIFDSTGSATSTSGVFKKSRLCSDHGLEPRDLRKIDSRVPNLVPTILVRRGGILVNILHIRAMIKKDKVLLFDSYGSTDSQLHSAFVYNLQHNLRPPHQNAHQHTSTSSSPGALAYEFRALESILVSVLDALRIELGVVRGWTSEVLEQLDDDVDRDKLRTLLQVSRKLNAFLSRSKAVKNAVVEVLENDEDMQLMHLSSIPPSASTDKGCASSNDAHTSSANTSSSCDATASNDGSQAMDELELLLESFDKQVEEVVAETTQLHSDMTNTQEVVELILDNNRNKLLALDLKTSIATMGISAGTLWAGLFGMNLKSHMEELDWAFAGTRKVAQGGLGHEG

SEQ ID NO: 54080 - protein, 491 aa, Oryza sativa (japonica cultivar-group)
IASASVSYLGASGDPYLQHCVETAVLLANIGANSTVVSAGLLHDTIDDSFIDYDHIFHMFGAGVADLVEGVSKLSHLSKLARDNNTASRIVEADRLHTMLLAMADARAVLIKLADRVHNMKTLEALPLGKQQRFAKETMEIFVPLANRLGIASWKDQLENLCFKHLNPEEHKDLSSKLTKSFDEVLITSAVDKLDRGLRDAGLSYHNLSGRHKSLYSIHNKMLKKNLTMDEIHDIHGLRLVFEKEEDCYRALDVVHELWPQVPGRFKDYISRPKLNGYRSLHTVVMSENVHPFEVQIRTKEMHLQAEYGFAAHWRYKEGTCRHSFVLQMVEWARWVLTWQCEAMNKERPASLGDSDAIRPPCPFPMHSEDCPYSYTRQCDHDGPIFVILLEHDKMSVQEFQANSTVMNLMDRVGTNTPRWSPYRIPMKEDLRPKVNHEPISDLNRKLSMGDVVELTPALPHESLPNYREEIQRMYDRGGFALATRGGSSRR

SEQ ID NO: 54081 - protein, 290 aa, Streptococcus pyogenes M1 GAS
MDKLARIDEAIRRYYKTTSNGVSEELIDAILYSVDSGGKRIRPLILLEMIEGFGVSLQNAHFDLAAALEMIHTGSLIHDDLPAMDNDDYRRGRLTNHKQFGEATAILAGDSLFLDPFGLIAQAELNSEVKVALIQELSLASGTFGMVGGQMLDMKGENQALSLPQLSLIHLNKTGKLLAFPFKAAALITEQAMTVRQQLEQAGMLIGHAFQIRDDILDVTASFEDLGKTPKKDLFAEKATYPSLLGLEASYQLLTESLDQALTIFQTLESDVGFKPQIITKLIEGLRLNA

SEQ ID NO: 54082 - protein, 411 aa, Xylella fastidiosa Temecula1
MSAVSESVLSLSRYYLPVYRPCQVVLVRGQGSRVWDEQGRDYLDLAAGIAVCCLGHCDPDLVAALVEQAGRLWHTSNVFYSEPSLRLAQELVDVSRFAERVFLCSSGTEANEAAIKLVRKWAAAQGRLPEHRTIVTFRGSFHGRTLGAVTATAQPKYQEGYEPLPGGFRYVDFNHIEALEAAMVGGDVAAVMLEPIQGEGGVMPIAPGYLAQVRALCDRYGALLVLDEIQCGMGRTGTLFAYWQEEVVPDIVTLAKGLGGGFPIGAMLAGPKVAEVMQFGAHGTTFGGNPMAAAVARVALRKLASVEIAANVQRQSVALRAGLEEISEAFGGVFTQVRGRGLMLGAVLAPLYAGQASAILEVAAEHGVLLLQAGPDVLRFVPALNVSDEELADGLVRLRAALGDYVSRCRG

SEQ ID NO: 54083 - protein, 667 aa, Schizosaccharomyces pombe 972h-
MKDDQLIDWIHERYEEQKSANRLAGRFRFLGLETKYSIISIISGIFIGLTAALLNALASLLNSFREGYCTVNILFDKQTCCSTLTEDYECQEFFFWRNNHSVFVSCLIYVSVSVGFAFIATTLGYVVAPAARASGIPTIKAILSGYKYPDMNVFFSIKTLCSKSLAVCFSVASGLWVGKEGPFVHIATNIIYLVERIAPSLADSEIFTRQLLAAAMASGIAASFNAPVGGVIFALEQLASSSFPSLFTGSIWYEFLCSASSVVALQLIRSWHTDVGYLSYVSLDRRWSYKDTLPFIFISILCGCLGSVLIYLNMKFASKTKGFSKISNVFFVIFLSLITSLTAYAILGESELLFNPMELFPQVINSCSPSSSTVLCETTFWVTAIVLFTSALLGLLLTSATFGAAIPTGIIVPSLAIGACIGRAVGTLLKSRFPSLAGTSIYGVIGSIAFLSSTTRLVVALVVILFELTGALNIALPLMLATLISKWVSDSIIETSIYDAWIQFRNIPYFPSSNSLKFSIPLNFPVRSPEQLVRLPIRSCSIEELERAMHDSSQSFFVVLKNDTEFFEGFISRNKVSELLNRRPMSSNMQTTDNTGLDPLRSASAPVDSTFDLFDYIHPTTFTLNYDTPPVLMLKLFKDAGITNLALLNHGKLHGVLTKIVCFICTI

SEQ ID NO: 54084 - protein, 203 aa, Xylella fastidiosa Temecula1
MSSPLECAKYLLSAHTPHQLPSDDGSEVAFAGRSNAGKSSVLNTLTRQNALARVSKTPGRTQQLVYFTVTPQRYLVDLPGYGYAKVPKELQIHWQAFIDTYFHHRQSLRGLVVVMDIRHPLKEYDLQMLAYARQRGLPAQALLTKADKLGRGQQAQTLQKVRNELTKHFADHINIQTFSSKSRQGVEQLHTVIETWLGLARSG

SEQ ID NO: 54085 - protein, 865 aa, Oryza sativa
MVPPSAAAAVARARTLLCVPATARAPREMAAELAAAAALGADVAELRLDRLAGFAPRRDLPVLLAQPRPLPALVTYRPKWEGGEYEGDDEPRFEALLLAMEMGAEYVDIELKVADKFMKLISGKKPETCKLIVSSHNFENTPSTEELENLVAQIQATGADIVKIATTATEIVDVAKMFQILVHCQEKQVPIIGLVMNDRGFISRVLCPKFGGYLTFGSLEKGKESAPAQPTVTDLINVYNIKQIGPDTKVYGIIGKPVGHSKSPILHNEAFRSVGLNAVYVPFLVDDLANFLNTYSSPEFAGFSCTIPHKEAAVRCCDEVDPIAKDILEPFNKSRVTFVSNNFVQDIGAVNTIIRKPNGKLVGYNTDYVGAISAIEDGIRASQPTDTTTSPLAGRLFVVIGAGGAGKALAYGAKEKGARVVIANRTFARAQELGNLLGAPALTLAELENYHPEEEMILANTTAIGMHPNVNETPLSKQALKSYAVVFDAVYTPKETRLLREAAECGATVVSGLEMFIRQAMGQFEHFTGMPVVDCKFRALANSLDNPDAMKAAGITAHKARLWLHERSGDLIEFHPRSGRGMQPGHGGALYHFGTSGAAVAAATAVTHPLALGSVRYSSSSVGLGNGSKEIGLQNWGADDSGLVSSIRYVIKVRLQMQLAGQRGNLVGMGTIFTQMVQVEGPRSLYLGLAPALTRSVIYGGLRLGLYEPCKYVCNYAFGSTNFAFKFASGVIAGALATALTNPTEVLKVRSQMSPSRTSTIGVLKKIVAEEGVKALWKGVGPAMARAGCLTASQMATYDEAKQRECKGARVYRNGFHCGYQVVVTEGVTSLYKGGFATFARLGPQTAITFVVCEKLRELAGMTAI

SEQ ID NO: 54086 - protein, 467 aa, Mycobacterium leprae TN
MTHYDVVVLGAGPGGYVAAIRAAQLGLSTAVVEPKYWGGICLNVGCIPSKVLLHNAELAHIFTKEAKTFGISGDASFDYGIAYDRSRKVSEGRVAGVHFLMKKNKITEIHGYGRFTDANTLSVELSEGVPETPLKVTFNNVIIATGSKTRLVPGTLLSTNVITYEEQILTRELPDSIVIVGAGAIGIEFGYVLKNYGVDVTIVEFLPRAMPNEDAEVSKEIEKQFKKMGIKILTGTKVESISDNGSHVLVAVSKDGQFQELKADKVLQAIGFAPNVDGYGLDKVGVALTADKAVDIDDYMQTNVSHIYAIGDVTGKLQLAHVAEAQGVVAAEAIAGAETLALSDYRMMPRATFCQPNVASFGLTEQQARDGGYDVVVAKFPFTANAKAHGMGDPSGFVKLVADAKYGELLGGHMIGHNVSELLPELTLAQKWDLTATELVRNVHTHPTLSEALQECFHGLIGHMINF

SEQ ID NO: 54087 - protein, 578 aa, Magnaporthe grisea 70-15
MPAAAGDSGGYGLALERREAMMGASGPRAILKNFKVFRVALFACIGGILYGYNQGMFSGVLAMPSFQRHMGEWAPLDPEADQAKKGWLTAILELGAWIGTLLSSFIAEILSRKYGILVACAVFMIGVVIQACAVTIDVDLAHNAILAGRFITGMGVGSLAMIIPIYNSEVAPPEVRGALVALQQLSICFGIMISFWIDYGTNFIGGTTVETQLDAAWLTPTTLQLFPALVLFIGMIFMPFSPRWLIHHDREEDGIRVLANLRGLPSDNELIQLEFLEIKAQSLFEKRSVAEQFPQLSNPTAWNTFKLQFVAIGRLFQTRSMWKRIIVATVTMFFQQWTGINAVLYYAPSIFKQLGLSNNEISLLATGVVGVVMFIATIPAVLWIDRAGRKPVLTIGALGMSFCHFVIAIILAKNIDRFDEQKAAGWAACAMVWLFVIHFGYSWGPCAWIIIAEIWPMSVRPYGVALGASSNWMNNFIVGQVTPIMLQKITYGTYLLFAILTLMGACFIYFFVPETKRLTLEEMDLVFGSSGTTQADLERQREINIEVGLDRAAGALGTSERPHSLSDEKEKQKTDAVV

SEQ ID NO: 54088 - protein, 151 aa, Arabidopsis thaliana
MKLSTTDSDLAGDAHNETNKKMKSTEEEEIGFSNLDENLVYEVLKHVDAKTLAMSSCVSKIWHKTAQDERLWELICTRHWTNIGCGQNQLRSVVLALGGFRRLHSLYLWPLSKPNPRARFGKDELKLTLSLLSIRYYEKMSFTKRPLPESK

SEQ ID NO: 54089 - protein, 302 aa, Pediococcus pentosaceus ATCC 25745
MNTVTIIGSINLDRTIRVKQMPKPGETMHTKEIFSAGGGKGANQAVAAKRSEAKTNFIGAVGNDDAGRAMLELLEHENIDMSGIETLDNQSTGQAYIVVDDAGENQIMIHAGANTAFTPEYVQSKADLIKNSDFIIAQFESSLDSVTEAFKIAREAGVKTILNPAPAVEKVPSDLLAVTDMIIPNETETEILTGIEVTDEASMKKASKALHDEGIEAVLITIGSKGTFYDVNGKSGIIPAFKVKAVDTTSAGDTFIGAMSTVLNKDFSNLEDAILYGNKASSLTVQRFGAQPSIPYKKELEK

SEQ ID NO: 54090 - protein, 256 aa, Lentinula edodes
MPETREDSVYLAKLAEQAERYEEMVENMKRVASSDQELTVEERNLLSVAYKNVIGARRASWRIVSSIEQKEESKGNEAQVSMIKGYREKIETELAEICEDILDVLDKHLIPSAASGESKVFYHKMMGDYHRYLAEFATGDKRKESADKSLEAYKAASDVAVTELPPTHPIRLGLALNFSVFYYEILNSPDRACHLAKQAFDDAIAELDTLSEESYKDSTLIMQLLRDNLTLWTSDMQDSADKPAEKDEAADAPADE

SEQ ID NO: 54091 - protein, 447 aa, Pediococcus pentosaceus ATCC 25745
MSEKLDEVDSKSLDEINGSIKVPKNAGFWKTLMAYSGPGFLIAVGYMDPGNWITSIAGGAQFRYTLLSVILLSSLIAMLLQAMSARLGIVTGKDLAQLTRERTSKRVGFLLWIVAELAIMATDIAEIIGSGIALELLFHIPLIIGILITAADVLILLLLMKLGFRKIEAIVATLVAVILIVFAYEVLLSDPSISGIIKGYVPSVEILGNNSMLYLSLGIVGATVMPHDLYLGSSISQTREVDRKDRENVAQAIRFSTIDSNMQLFLAFIVNSLLLILGAALFYGTDSSLGRFVDLFNALSNNQIVGAIASPVLSMLFAVALLASGQSSTITGTLSGQIIMEGFIRLRVPLWVQRLVTRVLSVAPVLIFAIYYHGDEAKIENLLTFSQVFLSVALPFAVIPLVIYTSSKKLMGEFANRAWVKWCAWTATIVLILLNIYLILQTLGLIK

SEQ ID NO: 54092 - protein, 346 aa, Arabidopsis thaliana
MGTSSDPIQDGSDEQQKRSEIYTYEAPWHIYAMNWSVRRDKKYRLAITSLLEQYPNRVEIVQLDESNGEIRSDPNLSFEHPYPPTKTIFIPDKECQRPDLLATSSDFLRLWRIADDHSRVELKSCLNSNKNSEFCGPLTSFDWNEAEPRRIGTSSTDTTCTIWDIEREAVDTQLIAHDKEVFDIAWGGVGVFASVSADGSVRVFDLRDKEHSTIIYESSEPDTPLVRLGWNKQDPRYMATIIMDSAKVVVLDIRFPALPVVELQRHQASVNAIAWAPHSSCHICTAGDDSQALILDISSMGQHVEGGLDPILAYTAGAEIEQLQWSSSQPDWVAIAFSTKLQILRV

SEQ ID NO: 54093 - protein, 241 aa, Nostoc sp. PCC 7120
MRKIVIAGNWKMFKTQAESQEFLKEFLPALEETPQEREVLLCVPFTDLAILSQSLHGSLVQLGAQNVHWAENGAYTGEISGPMLTEIGVRYVIVGHSERRQFFGETDETVNLRLQAAQKYGLTPILCVGETKQQRDSGETESLIVSQLDKDLINVDQTNLVIAYEPIWAIGTGDTCETTEANRVIGLIRSQLKNSDVPIQYGGSVKPNNIDEIMAQPEIDGVLVGGASLEAASFARIVNYL

SEQ ID NO: 54094 - protein, 533 aa, Aspergillus oryzae
MAIGNIYVIAAIAVIGGGLFGFDISSMSAIIGTNTYKCYFNNGGSVTINENGEKECGGPDTMTQGGITAAMAGGSWLGALVSGYLSDMLGRKQSIMVGSVIWCIGCILVCAAQNIPMLIVGRIINGFSVGICSAQVPVYISEIAPPTKRGRLVGLQQWAITWGILIMFYISYGCSFIKGTAAFRIPWGLQMIPAILLFLGMMLLPESPRWLARKDRWEECHAVLTLVHGHGDPDSPFVQSEFEEIKGMCEFERQNADVSFMELLKPNMINRTHVGVFTQIWSQLTGMNVMMYYITYVFAMAGLNGNNLLVSSSIQYVINVFMTIPAILWLDRWGRRPTLLIGAALMAAWLYANAGLMAAHGHAAPPGGLNGTPAESWEITGPPSKAVIACTYLFVASYAITWGPASWVYPPELFPLRVRGKANALCTSFNWAFNFALGWFVPPAFENIKWQVYIVFGVFCTAMFIHVFFMFPETAGKTLEDVEAIFTDPTGIPYIGIPAWKTRNEFSRGATLEQVGFDEEKKIGGTVQHSETA

SEQ ID NO: 54095 - protein, 525 aa, Treponema denticola ATCC 35405
MEWKNLDKCTSFTQLQKAHKEQAENLKLADIFDTENSVKRVKNYSVKMGGNLKYNYAAKPVNDEILKALQSLADEQKLIEKYELLLNGDFINTGENRMVLHQLTRGQLKNDVVYKGVNMRSFYLNELKKIKEFSEAVHSGKIKTSQGKVFTDVVQIGIGGSDLGPRAMYIALKNRAKKKMRAHFISNVDPDDAAEVLNSINLASTLFILVSKSGTTQETLANERFVKSVLEKNGLDCKKQMLAVTSETSPLANNPDYLTSFYMDDFIGGRYSSTSVCGAAVLALAFGMETVEAFLKGAAEGDKLSLNKNIKENASLLDALLGVYERNILGCSATAILPYSQALSRFPAHLQQLDMESNGKTVNRFGEKVSYKTGPVIFGEPGTNGQHSFYQLLHQGSDIIPLQFIGFKKSQIGLDIESEGSTNMQKLNANLAAQIMAFAAGKTDENKNKDFAGNRPASLIYGEELNPENLGALLAHYENKVMFQGFIWNLNSFDQEGVQLGKTLAKKVLSNDMPPALKAFSEFLL

SEQ ID NO: 54096 - protein, 498 aa, Oryza sativa (japonica cultivar-group)
METKLKLSDSKKVRCMIISILGFPDKNLTESLLSRRVKDIMGISSESPNGSQQIVQKETRDETTPLLPVKVEEEGFHEFNGASFSGAVFNLSTTIVGAGIMALPASIKMLGIIPGILMIIVVALLTEASIDMLVRCSHQGKITSYGWLMGEAYGQWGRIALQASVVINNIGVMIVYMIIIGDVLSGTSSTGVHHRGILEGWFGAHLWNSRAIVLLATTLFVFAPLVSFKRLDSLRYTSALSVALAVVFVVITAGIAIIKLFNGTVAMPKLFPELDGLSSIWKLFTAVPVLVTAYICHYNVHSIDNELEDRTQIKPIVRTSLFLCSSVYIATSFFAYLLFGEGTLDDVLANFDANLGIPFSSVFDDIVRVSYAAHVMLVFPIVFFALRLNLDGLLFPTSRHISRDNKRFAIITISLLTVIYLAAIFIPSIWDAFQFTGATAAVLIGFIFPAMVILRDPYGIASKRDKILAVTMIVLAVLSNSVALYSDAMNIFRKEEEA

SEQ ID NO: 54097 - protein, 212 aa, Treponema denticola ATCC 35405
MKIINAEFIKGAVKAEQFPEIGVSEFAFFGRSNAGKSSLINMLVNRKNLVKTGSRPGMTREVNFFLVNRPASLNFNPKTKKFSGPAPKDMFVLTDLPGYGYAKLSGGMTLQIDKMLYEYCTNRPLLKIIFFLMDMRREPTETEKESIGFFHGLNIEVVIVGTKADKIGKNDQIKAKNDWADFFNFDEELIIISSAAKKTGRDNILSLIAKRI

SEQ ID NO: 54098 - protein, 115 aa, Buchnera aphidicola str. Sg (Schizaphis graminum)
MTNIIQEIEQEQLKENIPHFRPGDTVEVKVWVIEGSKKRLQSFEGIVISIKNRSLNSSFTVRKVSNGEGIERVFQTHSYSIDSIFVKRKGKVRKAKLYYLRTRTGKSARIKERIE

SEQ ID NO: 54099 - protein, 363 aa, Ustilago maydis 521
MSFAIPSQQTQIVLRERPTAAIKDSLGENDSTYEKRTVPVPQESELKDGEVLVRVEYVSLDPAMRGWLRDARSYLPPVQIGEVMRAGGVGVIVASKFPGLSKGDQISGTLGWQQYARVPGKSVEKRSIREGSSLLDYLGPLGSSGQTAYWGIFDVAAIKKDDVVVVTGAAGSVGSVAVQLAKLKGCKVIAVAGADDKCQWLKDSLGADEALNYKDPNFKKTYREIVTKKYGYIDAIFENVGGDILDMSLLCMKPHARIALCGAISDYNNPKPNGLKNYQTIIAMRIKLQGFIVFDYAKRYSEAEDDMAKWMKEGKLARKFHVVGEELDAKAREHGKSLEQCPKALNDLFAGKNVGKMVVKVAP

SEQ ID NO: 54100 - protein, 333 aa, Silicibacter pomeroyi DSS-3
MTIKVGINGFGRIGRCTLSHIAASGRDDIEVIKVNATGPLETAAHLIKYDSVHGRFPGEVSLGEGTMNLGRGDMQMFSTYDLNELDWSGCDVVLECTGKFNDGAKAKVHLERGAKKVLLSAPGKNVDKTIVFGVNDDQLTAADTMISNGSCTTNCLAPLAKVLDEAFGIEHGIMTTIHAYTGDQPTLDRRHKDLYRARAAAMSMIPTSTGAAKALGEVLPNLKGRLDGSAIRVPTPNVSAVDLTFRAGRDVTTAEVNAAVEAAAKGPMKGVLGYEPAPLVSTDFNHTPESSIFAPDQTRVVENRMVRVLAWYDNEWGFSVRMADVAVAMGRLG

SEQ ID NO: 54101 - protein, 560 aa, Pseudomonas syringae pv. syringae B728a
MLQTRVLPPADGAYQCPLLIKRLLLSGGRYEKTREIIYRDSVRYTYATLNERICRLANVLTAAGVKAGDTVAVMDWDSHRYLECMFAIPMIGAVIHTVNVRLSPEQIAYTINHADDRLVLVNSEFTGLYQAMSGHLSTVEKTLLLTDLPDKTAELPNLVGEYETLLAAASPEYVFEDFDENSVATTFYTTGTTGNPKGVYFTHRQLVLHTMGVATIMGCIDSTRLLGTDDVYMPITPMFHVHAWGIPYAATMLGLKQVYPGRYDPELLVELWRRENVTFSHCVPTILQMLLNAKSAQNVDFGGWKIIIGGSSLTRSLYQAAKSRGIQLTAAYGMSETGPLISVAHINEELKAGSEDERITYRIKAGVPGMLVEAAIIDQQGNFLPADGETQGELVLRAPWLTGSYFREPEKGAELWAGGWLHTGDVATLDGMGFIDIRDRIKDVIKTGGEWVSSLELEDLCSRHPAVREVAVVGIADPQWGERPFALLVIRDGHQLDAKGLKEHLKPFVEQGHINKWAIPSQIALVTEIPKTSVGKLDKKRMRLDIVEWQSSNSAFLSTL

SEQ ID NO: 54102 - protein, 144 aa, Silicibacter pomeroyi DSS-3
MLVQAILKSKASDGVVTVSAAATVAQAAAILAEKRIGTVVVSDDGETAQGILSERDIVRELAASGSGCLSEPVSTYMTKDLITCGRDAKVQDVLSQMTEGRFRHMPVIEEGKLVGLVTLGDVVKAQLAELAMEKDALEGMIMGH

SEQ ID NO: 54103 - protein, 382 aa, Bordetella pertussis Tohama I
MEAVERVNLLGLDGAALSELVGQWGGKPFRARQLQRWVHQRGADSFDAMTDLARDFRAQLARDCVIEALPVNTEQRSSDGTRKWLFDVGQGNAIETVFIPEDDRGTLCISSQAGCVVNCRFCSTGHQGFNRNLRASEIIGQLWWAKRVLEAAADTARLPGGKAGEDTRVISNVVMMGMGEPLLNYDQVLPALRLMLDDNAYGLSRRRVTVSTSGVVPMMDRLSQDCPVALAVSLHAPNDALRDELVPLNKKYPLNALLAACERYLAHAPRDFITFEYCMLDGINDTDQHARELIQLARQVRCKLNLIPFNPFPASGLKRSPSARVRVFAQRLMDAGIVTTVRKTRGDDIDAACGQLAGEVRDRTRITERNATRTIPIQQVHA

SEQ ID NO: 54104 - protein, 141 aa, Bordetella pertussis Tohama I
MSIERTLSIIKPDAVAKNVVGQIVARFEQAGLKVIAARMQQLSRTDAERFYAVHKERPFFKDLVDFMVSGPVFVQVLEGESAIQKNRDLMGATDPKKAAPGTIRADFADSIDANAVHGSDAPETAAVEVAFFFPEINIHSR

SEQ ID NO: 54105 - protein, 335 aa, Mycobacterium sp. MCS
MRTPATVVAGVDFGDAAFAADVRAGVARIEDLMSTELGKADELMAEAVQHLFQAGGKRFRPLFTVLSARLGPEPDAWQVTVAGAVIELVHLATLYHDDVMDEAQVRRGAPSANARWGNNIAILAGDYLFATASRLVSRLGPEAVRIIADTFAQLVTGQMRETRGAVEGVDEIEHYLKVVYEKTACLIAASGRFGATFSGADETQIERLARLGGIVGTAFQISDDIIDIDSDPDESGKVPGTDLREGVHTLPVLYALRESGPDTDRLRELLARPVDNDDDLAEALRLLRRSPGMEQAKATVARYAQQARDELAALPDMPGRQALASLVDYTITRHG

SEQ ID NO: 54106 - protein, 355 aa, Alternaria brassicicola
MAEFVRAQIFGTTFEITSRYTDLQPVGMGAFGLVCSAKDQLTSQAVAIKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVIQTICSENTLRFVQSLPKRERQPLSNKFKNAEPQAVDLLENMLVFDPKKRVRAEQALAHPYLAPYHDPTDEPIAEEKFDWSFNDADLPVDTWKIMMYSEILDYHNVDAAAQEQENNGS

SEQ ID NO: 54107 - protein, 367 aa, Moorella thermoacetica
MELFKYMETYDYEQVLFCQDKESGLRAIIAIHDTTLGPALGGTRMWMYNSEEEALGDALRLARGMTYRNTAAGLNLGGGKTVIIGDPRKDKNEAMFRAFGRFIQGLNGRYITAEDVGTTVADMDIIYQETDYVTGISPEFGSSGNPSPATAYGVYRGMKAAAKEAFGSDSLEGKVVAVQGVGNVAYHLCRHLHEEGAKLIVTDINKEAVARAVEEFGAKAVDPNDIYGVECDIFAPCALGGIINDQTIPQLKAKVIAGSANNQLKEPRHGDIIHEMGIVYAPDYVINAGGVINVADELYGYNRERAMKKIEQIYDNIEKVFAIAKRDNIPTYVAADRMAEERIETMRKARSQFLQNGHHILSRRRAR

SEQ ID NO: 54108 - protein, 586 aa, Arabidopsis thaliana
MTSFSLTFTSPLLPSSSTKPKRSVLVAAAQTTAPAESTASVDADRLEPRVELKDGFFILKEKFRKGINPQEKVKIEREPMKLFMENGIEELAKKSMEELDSEKSSKDDIDVRLKWLGLFHRRKHQYGKFMMRLKLPNGVTTSAQTRYLASVIRKYGEDGCADVTTRQNWQIRGVVLPDVPEILKGLASVGLTSLQSGMDNVRNPVGNPIAGIDPEEIVDTRPYTNLLSQFITANSQGNPDFTNLPRKWNVCVVGTHDLYEHPHINDLAYMPANKDGRFGFNLLVGGFFSPKRCEEAIPLDAWVPADDVLPLCKAVLEAYRDLGTRGNRQKTRMMWLIDELGVEGFRTEVEKRMPNGKLERGSSEDLVNKQWERRDYFGVNPQKQEGLSFVGLHVPVGRLQADDMDELARLADTYGSGELRLTVEQNIIIPNVETSKTEALLQEPFLKNRFSPEPSILMKGLVACTGSQFCGQAIIETKLRALKVTEEVERLVSVPRPIRMHWTGCPNTCGQVQVADIGFMGCLTRGEEGKPVEGADVYVGGRIGSDSHIGEIYKKGVRVTELVPLVAEILIKEFGAVPREREENED

SEQ ID NO: 54109 - protein, 451 aa, Schizosaccharomyces pombe 972h-
MTSISKRKNQQEHIPAEDLETPKLPKREKIEGTKESNKVRIIILLGYSGYGYHGIQINNPLKTIEGDVVAVLKKLGYLKTNNIDAEHLCIARAARTDKGVHTLRNLISLNLFVDKPLDISLLKTELNEALCSQIRVWSVFPAPKYFNPRISCESRTYEYLIPSFALLPPKPSCPLFKKMQKNLSRKLDNELERNLVYSMNDLISFWNTVKLKQKEIQEMFDTNKDAFTNPFKGMFYEKPIPAGIVIPPQAKLKKALKQAEYYCYMNYRIKEDRLKVLQQLLKKYEGRHNFHNFTVTDDSTSPSNYRFIESVTCGTPFVYENWEWIPVTIKGNSFMLNQIRKMMAHVLMIIRSCAPTGLIDKAFDPNITMNISKSPGHVLLLKDIKFSSYNDSVTDGLEKIQFDCFEEDILSLKIKTIYPDIIKLEQKEKLFFSFLSYIDQHTGHQFDYLFG

SEQ ID NO: 54110 - protein, 140 aa, Agrobacterium tumefaciens str. C58
MAIERTFSMIKPDATKRNLTGAITKVFEDNGLRIVASKRVWMSKREAEGFYAVHKERPFFGELVEGMTSGPTIVQVLEGENAILKNREIMGATNPAQAAEGTIRKSFALSIGENSVHGSDAPETAAQEIAYWFAETEIVG

SEQ ID NO: 54111 - protein, 473 aa, Moorella thermoacetica
MAKEYDVVILGGGTGGYVAAIRASQLGLKTAVVEKGKLGGTCLHAGCIPSKALLRSAEVYAQTKNSEAFGVIVGDVRLDFAKVQARKATIVDQLHKGVQHLMKKGKIDVYAGIGRLLGPSIFSPLPGTVSVEMNDGSENEMLVPKFVVIATGSRPRTLPGLEPDGEFVMTSDEALQMEVLPSSILIVGGGVIGMEWASMLNDFGVEVTVLEYADRILPTEDEDVSKEMEKLLLRRGVNIVTGARVLAETLEKGNGVTIQAEHQGERKTFAADKMLVSIGRQANIEGIGLENTEIVVENGYIQTNEFGQTKESHIYAIGDVIGGLQLAHVAAHEGIVAIEHLAGRNPAPIDYSMVPRCIYTRPEAAAVGLTEQEAKAKGYDVKIGKFLFKAIGKALVFGEAEGFVKLIADRNTDDLLGVHMVGPHVTDLISEAGLARVLDAAPWEVAHAIHPHPTLSEAMAEAALAVDGKAIHF

SEQ ID NO: 54112 - protein, 252 aa, Brassica napus
MDQDLKSTTGTAAIEHRSFARIGFLGNPSDVYFGRTISFTIGNFWASVKLEPSEHVIIKPHPFHDLVQFNSLDHLLNRLENEGYYGGVRLLMAICKVFRNHCKDNAIQLHQRNFTLSYDTNIPRQTGLSGSSAIVSAALSCLLDFYNVRHLIKLQVRPNLVLNAEKELGIVAGLQDRVAQVYGGLVHMDFSKEHMDKLGHGIYTPMDITLLPPLHLIYAENPSDSGKVHSRVRQRWLDGDELIITSMEEVES

SEQ ID NO: 54113 - protein, 1128 aa, Coccidioides immitis RS
MDNLEESGMVVDEFDQYSNDHTDDVVLVSPSGSPSEPEPEFPLADDYESMITRVLPELPDTETLEQTHHTWHIQNWTRMERKEHGPIFECGGSPWRVLFFPFGNQVTEYASFYLEHGYEEAPPEGWSRCVQFALVLWSKNNPSIYVSHVATHRFNASDGDWGFTRFCELRKLFHGPFDENGSPLIENEEACLTVYMRVVKDPTGVLWHSFKDYDSKKETGMVGLKNQGATCYLNSLLQSLYFTNSFRKAVYQIPTEEDSKISNSAWTLQRLFYSLQTSDNPVSTQELTSSFGWESKQIFEQQDVQELCRKLMERLEEKMKGTPVEKALHDLFVGKTKTYISCINVDYESSRIEDFWDIQLNVRGNKTLDDSFKDYIQVETLEGENKYDAGDPYGLQDAKKGVIFESFPPVLHLHLKRFEYDIHRDAMMKINDRHEFPEEFDASPYLSENADRSEPWVYQLYGVLVHTGELNAGHYYAFLRPTKDGYFYRFDDDRVVRATMKQTLEENFGGDWITLPNGNAGMRQAHFARGYSTKRSMNAYMLVYLRKSRVDDILVEVMKNDVPCHIEKKIAEERAELARRKKEREEQHLYMNVSLISDESFKHHHSFDLTSPDLDPNDPAAPKAYRILRATKVGEFAKQVAEEREVAPEQVRLWVMVNRQNKTTRPDQRLRDMEMSMEQAFNEFGTKNNPFRLWLEIGEPGVDGKVSWPDSRGPNAHTLIFLKYFDVHAQTLTGVKHVFVRKHAKVSEISSTILELMNWAPGTSFLLYEEIRHSMIDPMKPKHTFHQSEIQDGDIICFQRSIPESELPPTVIYRNVQQYYDFLLNRILVTFAPIEPNPEQTFTLTLSKKMTYEQFSTKVGEHLKVEPTHLRFAPVIISSGAPKPFIKRNVAQNLGQILTSPYPGTGYSHRSDVLYYEILETSLSEFEMKKNIKITWLSEGIAKEQIHEVLVAKNGVVSDVIESLQKKANIDDETIRNVRLYEAYSGKIYKELYDTYSVAGITDYVTVFAERIPEDELNMQEGEFRINAFNFDKEPQKAYGCPFKFVVKPGEKFKDTKERLSKRTGIKGKQFERIKFALVSRTPYSKPLYLEDDHILADLTTDSEQQLGLDHVNKNRNFWGRSESFFIR

SEQ ID NO: 54114 - protein, 224 aa, Brassica oleracea
MATSSHLFPQALHMIPRNPTQPSKKLGFSSFQSCAPSMNPRLTVSRVSLNHSVSKSGFSLDAKARREVLVRAEGEGEGEAVDANADTEGNVEDVVEAGEVKAPKKTRVKLGDVMGILNQKAIEVSEKLRPVPEIRTGDIVEIKLEVPENRRRLSIYKGIVMSRQNAGIHTTIRIRRIIAGIGVEIVFPIYSPNIKEIKVVSHRKVRRARLYYLRDKLPRLSTFK

SEQ ID NO: 54115 - protein, 209 aa, Nostoc sp. PCC 7120
MQISDYPQLNLSSVPRIASVHRITGETNVQVTVNLDGTGICKAATGIPFLDHMLHQISSHGLIDLDVQAKGDWEIDDHHTNEDVGITLGQALAKALGDRKGIVRFGNFLAPLDEALVQVALDFSGRPHLSYGLQIPTERVGTYDTQLVREFFVALVNHSQMTLHIRQLDGINSHHIIEATFKAFARAARMAIEVDPRRAGTIPSSKGVL

SEQ ID NO: 54116 - protein, 229 aa, Pediococcus pentosaceus ATCC 25745
MAKLVLIRHGQSQWNLSNQFTGWVDVDLSDEGVKQAQNAGKLIKEAGIEFDQAYTSVLTRAIKTLHYALEGSDQLWIPETKTWRLNERHYGALQGQNKAEAAEKWGDDQVHTWRRSYDVLPPLLDADDEGSAANDRRYANLDPRIIPGGENLKVTLERVIPFWEDEIAPKLIDGKNVIIAAHGNSLRALSKYIENISDEDIINLEMATGEPVVYDFNEKLEVQSKTKLN

SEQ ID NO: 54117 - protein, 317 aa, Brassica oleracea
MTMMAMGRDGAPTMAVRCPTGDNASGDHIVFNLQQRSFSSFSFHQKTTDAFTNLVTLGAKSKLMSLMQLSLSCFLIMSSLLHQATTGASLHYQATTGASLLHQATTGASLLHQATTGASLLHQASTGASLMQRIQVQNLLKQKLTERKFVERLVPSSSAFSLLNMAEKVPSFKTGGTLWFTDLTTADTTYILPLLTAITFIIMVEEGMEGNPVAGTMKKFSRIIAFLSLPILMGIEKEEVDSVISDIPRDGPRRPTKNAVWDWAAYRPAVSRPKTNPQRSGTGRENPIDISIHNAFADQPAGHRITNGHMAHERFKT

SEQ ID NO: 54118 - protein, 400 aa, Vibrio alginolyticus
MSNSLSLPTLVCQQVHTLAQQQSQPLCAYVYDLSALEEHIKQLRHVLPRNVELFYAAKANPSGPILKTLAPYVDGFEAASGGELTHLHQQQLDKPLIFGGPGKMLSELQQAIELDVDAFHVESLTELQRIGALTERLNRPASIFLRMNIDIGDITLSKLAMGGKPTPFGLDESELSNALMLLRDFPQVSLKGFHFHLMSHQLDVERHLALMQRYFQVVKTWQQEFKLSELMINLGGGMGINYQNPEQHFPWMEFCDKLEFLIAKEQVQDWTLRFECGRFITAACGYYVMEVLDIKQNLGENFVIARGGTHHFRTPAAQSHDHPFVILKSEQHHEISHPIQHAQATFVGQLCTPKDVLARNQHVAHVDIGDYVVFTLAGAYAWNISHQNFLMHEPPIFHYF

SEQ ID NO: 54119 - protein, 480 aa, Aspergillus oryzae
MSIATVETGYVGNLTQDQEEKLLQLWRIFLRSCDAELYRTDTNRSGQTTSTTSPKQRRRLFSLSWSEDTSKTNDSPPVPAKLLSELEAMKMNAQEIKLIQQVLTKLKPDERRSAFFAMMKQDHPDTFLLRYLRAEKWNVPKGFVKFVSALEWWSKQQQVETEVIRKGELHALQQSQSSTSSNEKKDGEGFIAQLRMGKGFFHGSDKSGRPICVVRARTHKPGAQTEKALNSCILWNIEVMRLLLVPPVETMTLIFDLTNFALSNMEYAPVKFIIECFQENYPESLGYMLFYNAPWFFSGIWKVIRGWLDPVVAAKVHFVNSVEDLEQFIDRSQIVKELGGDEDWTYEYVEPEQDENAQLQDTTTRDSIMAQHQQIGEELFEATSMWLSAKDKGNMGDASQQKDRRADIAMRLRENYWKLDPYVRSRTLLDRIGVIQAHGNIDFYPVKEGQGESKEVNEKDVKAVVDQVEYANGAQVASAA

SEQ ID NO: 54120 - protein, 450 aa, Arabidopsis thaliana
MSIFNPDSINNELSKPTSIFGLKLWVVIGILLGSLIVIALFFLSLCLTSRRRNRKPRHADFASAAVATPPISKEIQEIVRPPAQDHCHPTQPVAAEIQVDIGKTEHRVVFSDRVSSGESRGTVSETASYSGSGCVGPEVSHLGWGRWYTLRELEAATNGLCEENVIGEGGYGIVYSGILTDGTKVAVKNLLNNRGQAEKEFRVEVEAIGRVRHKNLVRLLGYCVEGAYRMLVYDYVDNGNLEQWIHGDVGDKSPLTWDIRMNIILCMAKGLAYLHEGLEPKVVHRDIKSSNILLDRQWNAKVSDFGLAKLLFSESSYVTTRVMGTFGYVAPEYACTGMLTEKSDIYSFGILIMEIITGRNPVDYSRPQGEVNLVEWLKTMVGNRRSEEVVDPKIPEPPTSKALKRVLLVALRCVDPDANKRPKMGHIIHMLEAEDLFYRDVSLIIVLMNI

SEQ ID NO: 54121 - protein, 224 aa, Arabidopsis thaliana
MATTMKGLLKGLRYITQIFDEEKEQEMQIGFPTDVKHVAHIGSDGPTNTTPSWMNDFKTQEHEKGQVVSRGNSNKYNPQGTNQRGAGLKELLPSNTNEKPKQKTRRKPGGAASPNHNGSPPRKSSGNAASSDEPSKHSRHNRSAHGSTDSSNDQEPSVRRRRGGIPAPDTEVPNQIPDGSAPPRKATSRPRKLKGSSAGGEGSIKKSSKGKPENSVDTTCNDII

SEQ ID NO: 54122 - protein, 62 aa, Zea mays
VRKEKLGDRITALQQLVSPFGKTDTASVLHETIEYIKFLHAQVGSLSASYLKNRQQVSHHHK

SEQ ID NO: 54123 - protein, 446 aa, Bordetella pertussis Tohama I
MSTTHVLHRSLRHTPPVAVRGEGVWLYDQAGRAYLDGSGGAAVSCLGHNHPDVRAAMHAQIDALAYAHTGFFSTEIAERLADRLVADAPAGTSHAYFVSGGSEAIEAALKMARQYFVEIGQPQHRHLVARRQSYHGNTLGALAVGGNEWRRAQFAPLLIDVAHVAPCYAYRDQREDESAEQYGERLARELEDTFQRLGPDTVIAFVAEPVVGATAGALTAVPGYFRRIREICDRYGILMIADEVMCGMGRTGTLYAVEQEEIVPDLITIAKGLGGGYQPIGAVMAQGRIVDAMSKGSGFFQHGHTYLGHATACAASLAVQEVIRRDGLLARVRQQGDGLRQRLMQALGAHPHVGDIRGRGLFLGVELVRDRATKATFDPELALHARVKREAMARGLMVYPMGGTIDGRHGDHVLVAPPFIIADDELDQLVERLAGAIDAAIAQTRA

SEQ ID NO: 54124 - protein, 318 aa, Gluconobacter oxydans 621H
MSTVASIIVSIAEEMRTASERGTVANYIPPLARVDLNRFGMAVVGMDGETHTVGDAEVPFSVQSVSKVFSLSMALNAMGDELWGRVRQEPSGSAFNSIVQLENEHGIPRNPFINAGAIVIADILVSRYGRENAQTRLLEFLRPLVSDPSSIDIDTDVARQERETGFRNMALANYMRTFGNIRNVVEDTLDFYFHQCALTMSCHQLAQVGTCLMTGGRNPLTGERIMSERNAQTILALMMMCGHYDGSGAFAIRVGLPGKSGVGGGILAIAPGVASIAVWSPGLNAQGNSLLGTRALERLVQHTGWSVFRANPWVANPT

SEQ ID NO: 54125 - protein, 85 aa, Glycine max
GGNKVLPLEFQRRKGKELPGCFHQKKLEDANRGPFFGFMGKNEITNGRWAMFGFAVGGAPEYAPGSGFVDQKKIPFPNFGKEDLE

SEQ ID NO: 54126 - protein, 366 aa, Geobacillus thermocatenulatus
MELFKYMEMYDYEQVLFWQDKESGLKAIIAIHDTTLGPALGGTRMWMYNSEEEALEDALRLARGMTYKNAAAGLNLGGGKTVIIGDPRKDKNEAMFRAFGRFIQGLNGRYITAEDVGTTVADMDIIYHETDYVTGISPEFGSSGNPSPATAYGVYRGMKAAAKEAFGSDSLEGKVVAVQGVGNVAYHLCRHLHEEGAKLIVTDINKEAVARAVEEFGAKAVDPNDIYGVECDIFAPCALGGIINDHTIPQLKAKVIAGSVNNQLKEPRHGDMIHEMGIVYAPDYVINAGGVINVADELYGYNRERSMKMIEQIFDNIEKVFAIAKRDNIPTYAADRMAEERIETMRKARSQFLQNGHHILSRRRAR

SEQ ID NO: 54127 - protein, 416 aa, Rickettsia heilongjiangensis
DSEFAELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPYTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFAIARTVGWMAQWKEMHEDPEQKISRPRQLYTG

SEQ ID NO: 54128 - protein, 451 aa, Gluconobacter oxydans 621H
MGLNTPLMSDAPSPHTPSPEMRPSLPDAFSSIRVPGADASWFRRFLAFVGPGFMVSVGYMDPGNWATDLQGGSRYGYTLLCVIMLSNLMAILLQALSARLGIATGRDLAQACRDHFSPAVNIVLWLACELAIIACDLAEVIGTAVALQLLFGLPLLGGALLSILDALIVLLLMNRGFRYLEAFVIALLGIIALCFGIQLIAAAPPVHSILAGLLPDPKIVTTPGMLYVAIGIIGATVMPHNLYLHSSIVQTRAYERTPAGRRDAIRWTTWDSTIALTLALFINAAILIVAAAAFHTSDHQDVAEIQDAYRLLSPILGLGMASTLFALALLAAGTNSTITGTLAGQIIMEGFLHLRIPHWARRLLTRGLAIVPVAIVTLIYGNRGVGDLLMASQVILSLQLPFAVIPLVMFVSDRRKMGEFVISTPVRILSWGVAGLILLLNFKLLYDTLAG

SEQ ID NO: 54129 - protein, 476 aa, Geobacillus thermocatenulatus
MAKEYDVVILGGGTGGYVAAIRASQLGLKTAVVEKGKLGGTCLHAGCIPSKALLRSAEVYAQTKNGEAFGVIADGVRLDFAKVQARKAAIVDQLHKGVQHLMKKGKIDVFAGIGRLLGPSIFSPLPGTVSVEMNDGSENEMLVPKFVVIATGSRPRTLPGLEPDGEFVMTSDEALQMETLPSSILIVGGGVIGMEWASMLNDFGVEVTVLEYADRILPTEDEDVSKEMEKLLRRRGVNIVTGARVLAETLEKGNGVTIQAEHQGERKTFAADKMLVSVGRQANIEGIGLENTEIVVEKGYIQTNEFGQTKESHIYAIGDVIGGHASLPHVAAHEGIVAIEHLAGRNPAPIDYTMVPRCIYTRPEAAAVGLTEQEAKAKGYDVKVGKFPFKAIGKALVFGEAEGFVKLIADRNTDDLLGVHMVGPHVTDLISEAGLARVLDAAPWEVAHAIHPHPTLSEAMAEAALAVDGKRFIFKF

SEQ ID NO: 54130 - protein, 331 aa, Kluyveromyces lactis NRRL Y-1140
MVRVAINGFGRIGRLVLRIALSRPNVEVVAINDPFISVDYAAYMFKYDSTHGRFAGEVSHDENSLIIDGKKVLVFQERDPATLPWGEHNVDIAIDSTGVFKELDSAQKHIDAGAKKVVITAPSSTAPMFVVGVNEDKYNGETIVSNASCTTNCLAPLAKVVNNAFGIEEGLMSTIHSITATQKTVDGPSQKDWRGGRTASGNIIPSSTGAAKAVGKVLPELQGKLTGMAFRVPTVDVSVVDLTVKLAKEATYDEIKAVIKKASENELKGILGYTEDAVVSSDFLGDTNSSIFDAAAGIQLSPKFVKLVTWYDNEYGYSTRVVDLVELVAKN

SEQ ID NO: 54131 - protein, 326 aa, Flavobacteria bacterium BBFL7
MKTIQFREAIAEAMSEEMRRDESVYLMGEEVAEYNGAYKASKGMLDEFGAKRVIDTPIAELGFAGIAIGSTMTGNRPIVEYMTFNFSLVGIDQIINNAAKIRQMSGGQFPCPIVFRGPTASAGQLAATHSQAFENWFANTPGLKVIVPSNPYDAKGLLKAAIRDDDPVIFMESEQMYGDKGEVPEGEYILPIGVAEIKREGTDVTIVSFGKIIKEAYKAADELEKDGISCEIIDLRTVRPYDKEAILKSVKKTNRLVILEEAWPFGNVSTEISHMVQAEAFDYLDAPIYKINTQDTPAPYSPVLFAEWLPNHTHVVDGVKKVMYKK

SEQ ID NO: 54132 - protein, 392 aa, Sulfitobacter sp. EE-36
MTMNATATATVNTSAASNYDEAADYIWNNSFDKPTLVVSRARVGVQYDALQAGLGDARIHYAVKANPAPEIIRMLVERGSGFDAASRQEIELCLSQGADPAKISFGNTIKRGVDIAFAHSIGVTMFAADCEAELDKIAEHAPGARVYIRLIVENSMADWPLTRKFGCAGSLLPSLLEYTKSVGLVPYGLSFHVGSQTRRAEYWHPVLDQVAPLWHAAKEAGHDLQLLNIGGGFPAYHGDPVDAPRGYAAAVVAAVKERFGEIPVLMAEPGRGMVAEAGHIAAEVLLVSRKSAEAARRWVYLDIGRFSGLAETEGEAIRYQFVTPHDGKPVGPCVLAGPSCDSADVLYEKNPVDLPLDLRDGDKVMIKNCGAYTSSYSSVGFNGFPPLDVLVL

SEQ ID NO: 54133 - protein, 395 aa, Arabidopsis thaliana
MNSSSPISIDLIAEILSRVPSKSVARFRCVSKPWASMIRRPYFTELFLTRSSPKPCILFATVADGVWSFFSLPQYPYEKSSSASVAASAKFHVKFPPNNMRIGHNSDRRYFSYGYTSGLIYLYGDSSDDRSVICNPYTGEYAILPYLQRYRKTYSFLVFEPIEKQFKILFMAYLSGDRDHKILTVGTGNMKWRTIRCSLRYEIVSEGVSINGVLYYLGETSAWDNKDYDLKYDYAIVCFDIRSEKFIFFEIERFCRLINYKGKLAVIYFEDDVNYQSCLYRKKNYVEPDAINKLNVSVAPTTAAWGDIVFSMCEYTPGQPFYVFYFNPEKSTLQRVEIQGFGEGVCSVYTFVDDVEDLNVKDLKILKPSNAPFEKTEDSEYEEEYEEEDGDDGWS

SEQ ID NO: 54134 - protein, 221 aa, Larix potaninii var. chinensis
KAAGARIIVTQAAYVDKLADLQSDDMIVIAIDGAPKEGCQHISILTEADETQCPSVEIHPDDVVALPYSSGTTGLPKGVMLTHKSLVSSVAQQVDGENPNLYFHSEDVILCVLPLFHIYSLNSVLLCAPRAGAATLIMQKFNLTTLLELIQRYKVTVAPIVPPIVLEISKNPIVSQYDVSSVRIIMSGAAPLGKELEDALRERFPKAIFGQGYGMTEAGPV

SEQ ID NO: 54135 - protein, 415 aa, Magnaporthe grisea 70-15
MSLQVGGSSRGTRFRPLSLDVPKPLFDVAGHPIIWHCLTAISTVPSIHEVYLIGYYDESVFRDFIKDSSTEFPNLSIKYLREYQALGTAGGLYHFRDAILKGRPERLFVLNSDVCCSFPLNEMLKMFTEKDAEAVILGTRVGEEAATNFGCIVSDNHSRRVLHYVEKPESQISNLINCGVYLFSTEAIFPSIRSAIKRRTDRPRLSSYRSSENLEASFIEYADDDEGSKNEVIRLEQDILSDMADTKQFFVYETQDFWRQIKTAGSAVPANALYLQQAWQGGSKELAAPSANIIPPVFIHPSATVDPTAKLGPNVSIGPRATVGPGARVKESIVLEDAEIKHDACVLYSIIGWGSRVGAWARVEGTPTPSTSHTTSIVKQGVKVQAITILGKECGVSDEVRVQNCVCLPFKDLKR

SEQ ID NO: 54136 - protein, 751 aa, Aspergillus oryzae
MADIPRRDEKPQQKEFLQEPSLDIDDSNYSILSDRDAAEILPYEADDSPFPEVRAVVRPVDDVHLPVSTVRMWTIGVIFTIVGSGLNQFFSLRQPSVTISALVAQLVAFPVGCAWAKWLPLGWLNPDRHFNIKEHALITIMANVSFGSAAATQIIEAMVKFYNMPSQGGFEILLCITTQLFGFGLAGMASRWLVGPATMIWPQVLSNAALLSTLHSRANVVADGWSITRLRFFLFVFAGGAIWYFAPGYLFTGLSTFNFICWIVPTNVVVNQLFGQTTGLGMSILTFDWAQVVYANQSPLLVPFWAGLNVIGSFALFFWLICPILYYTNTWYSAYLPMLNSNTFDNTGKSYNTSRVMNHDGTVNVEAYREYSPMFLPAGYAVTYGVAFANLTGIFVHIALYHGTDLWEQWKGRDKKDVHSRLMSSYKDVPWWWFAAVTILMFALSIVTNEVWHTGLPAWAVLLAFVLPMIYFIPVGIIKAVTNITSNQLNLITEFIGGYAFLGRPVANMAFKFYGYVAVSQGLEFVADMKLAHYLHIAPRTLFLAQGLATLIGAVVQCGVTVFMITRIDGVCTPDANGGFTCPHGRVTYSSSLIWGALGPGRNFSPGQIYGNLLWFFLAGPLVVIVTYLIGRRWKQANYISWPVAFGAMSLVPPATGISFSSWWIVNFIFNGLIKRRRPAWWSKYNYVLSAALDCAVAVATVIIFFCITLPAGPLHWWGNTVSARTADGKGTPWKALPESGYFGPRKGTWE

SEQ ID NO: 54137 - protein, 334 aa, Xylella fastidiosa Temecula1
MIPTPTRDAPNIPSFLAADVGGTHVRVSVVAAAPTCASPPQLFDVRTYRCADYPSLSTILNDFLGTRSAVRDCVIASAGFQRSDGTVITTNLPWPLSPHRLRADLNLAEVCLVNDFEALAYATEDMEPAQLLHLTGPAKAQDGPRLLLGPGTGLGAALWIPNNGRPIVLPTEAGQAALPSTTELEMQLVRHMLNNRTHVPIEHALSGPGILNVYRALCALQSVLPQHASPDAISHAAAAGTDMLSSQTLEVFCDFLGSIVGDLVMMYGAQGGVYLAGGILPQLREPLLRSHFVERFLNKGPMGEALQHVPVRLIEHGQLGIVGAARWYLNKKAT

SEQ ID NO: 54138 - protein, 221 aa, Larix potaninii var. chinensis
KAAGARIIVTQAAYVDKLADLQSDDMIVIAIDGAPKEGCQHISILTEADETQCPSVEIHPDDVVALPYSSGTTGLPKGVMLTHKSLVSSVAQQVDGENPNLYFHSEDVILCVLPLFHIYSLNSVLLCALRAGAATLIMQKFNLTTLLELIQRYKVTVAPIVPPIVLEISKNPIVSQYDVSSVRIIMSGAAPLGKELEDALRERFPKAIFGQGYGMTEAGPV

SEQ ID NO: 54139 - protein, 219 aa, Buchnera aphidicola str. Sg (Schizaphis graminum)
MNLNELKKKAAWAALDYIYPGTVIGVGTGSTVFYFIQALSTVKHLISGAVSSSNSSTVLLKKNGIRVLDLNTFDFLEIYVDSADEINNDMQMIKGGGAALTKEKIIAAMSKKFVCIIDESKKVNILGTFPLPIEIIPIAFSYISKEILKIGGQPKLRENIITDNGNVIIDVYNLFINDPISVEKKINSLPGVVSVGLFASRVADVVLIGTQKGVEIIKN

SEQ ID NO: 54140 - protein, 968 aa, Arabidopsis thaliana
MELTSFQKSPSSNDVVSFSVSLVRNSMARRRRSSAAESLKRRNDGYESLCQVVQQDSDRRLITIFVIFFIVIPAVSIAVYKVKFADRVIQTESSIRQKGIVKTDINFQEILTEHSKASENSTRHYDYPVLAYITPCQGSGLVLEGRHNADKGWIQELRSRGNALSASKGLPKLYNSCIFHALKRMNFFTLELVNFNTYLVIMFALNSREMEYNGIVLESWSRWAAYGVLHDPDLRKMALKFVKQLGDALHSTSSPRNNQQHMQFMYVVGPPRSEKLQMYDFGPEDLQFLKDSVDGFSLMTYDFSNPQNPGPNAPVKWIDLTLKLLLGSSNNIDSNIARKVLLGINFYGNDFVISGGGGGAITGRDYLALLQKHKPTFRWDKESGEHLFMYRDDKNIKHAVFYPTLMSILLRLENARLWGIGISIWEIGQDKGHFGKYAEASLEASSIFSGHTFDMQFRTNPRQLSRNGSMLLSLTLFFHFFFIIFNRWEKFDDTEWTILGVEGESERERVMEALKTATFSPMSVLSEKRSEPRKPFSLPNLFPPKSQRPISQESFLKRFNGGLALLTSVLSSATAPAKSLTYEEALQQSMTTSSSFDSDGLIEGISNFVTDNPLVIAGGVAALAVPFVLSQVLNKKPKSWGVESAKNAYTKLGTDDNAQLLDIRATADFRQVGSPNIKGLGKKAVSTVYNGEDKPGFLKKLSLKFKDPENTTLYILDKFDGNSELVAELVALNGFKSAYAIKDGAEGPRGWLNSSLPWIEPKKTLSLDLSSLTDSISGVFGESSDGVSVALGVAAAAGLSVFAFTEDRKQTLKQVDEFLNTKVAPKELVDELKEIGKALLPQSTSNKALPAPATVTAEAESATATTTTVDKPVPEPETVAATTTTVDKPVPEPEPVPEPVPVPAIEAAVAAQVITEPTETEAKPKPHSRPLSPYASVMFLLSHKEALLVGNKETFKLFIIIIWTSVDP

SEQ ID NO: 54141 - protein, 266 aa, Capsicum annuum
MGIKIREVWADNLESEFELISTVIDQYPYISMDTEFPGVVIKPDRRRLSLRSEDQYKLLKANVDVLNLIQLGLTLSDVDGNLPDFGSNGDGYIWQFNFSDFDVARDLYAPDSIELLRRQGIDFETNREVGIDSARFAEVMMSSGLVCNESVSWVTFHSAYDFGYLVKVLTRRELPGRLEDFLEILRVFFGNKVYDMKHMMRFCNSLYGGLDRVAKTLSVDRAVGKCHQAGSDSLLTWHAFQKMRDIYFVKDGAERHAGVLYGLEVY

SEQ ID NO: 54142 - protein, 434 aa, Buchnera aphidicola str. Sg (Schizaphis graminum)
MSKILKIIGREIIDSRGNPTIECEVLLEGGFVGLASVPSGASTGSFETWELRDQDKNRFMGKGVQKAVEIINNKIFYSLKNKNAIDQFDIDQTMINLDGTENKSNLGSNSILSVSLATAKAAASSKGMPLYQHIAEINNTPGVFSMPLPMINIINGGKHANNNIDIQEFMIQPISAKSITEAIRIGAEIFHSLGNLLKDKGMSTTVGDEGGYAPNFKSNEEALNVIQDAVHKTKYKLGKDITLAIDCAASELYNKTRKKYQFIGEGTEFSSQELTHYLKKLSNKYPIISIEDGQDESDWEGFLYQTKELGNSLQLVGDDLFVTNKNILKKGIKKGVANAILIKLNQIGTLTETIETIKIAKKFNYGVIISHRSGETEDTSIADLSVGTASGQIKTGSMSRSDRTSKYNQLIRIEEILNKKRAPFYGLKEVKSSF

SEQ ID NO: 54143 - protein, 767 aa, Ustilago maydis 521
MGLPVTVSTCSLNQWALDFDGNRDRILESIRLAKSVGSRLRVGPELEIPGYGCFDHFLEPDTVLHSWQVLAEILSSDATNGILCDVGMPVLHRSTLYNCRVLLLDGKILHIRPKMWLANDGNYREMRYFSPWTRTNHTDSFPLPRIVSSITDQHEVPFGDAVVKTRDTVLGVELCEELFTPNSPHIRQGLDGVEIFTNSSASHHELRKLYRRVELIKEATLKLGGIYLYANQQGCDGDRLYYDGCPLIAVNGSIVAQGSQFSLDDVQVVSATVDLDDVRAHRSAKSRGMQAVSHSLGSGYPRIHVDFEVGESEEYSSKTPGTSTPVAVGSAVAPVDGQRDDAERLYKRYLTPLSQPIEVHYHSPEQEIALGPACWLWDYLRRSRTQGYFVPLSGGIDSCATATIVFSMCRLVIAAIDAPSSSSPASKATSSLTTDTRTQVLQDVRRICNEKPSSTWIPASPQELCNRIFVTCYMGTENSSAETRQRAKDLAADIGAYHIDLNMDIVVRAIIALFSTVTGSTPRFRVHGGTPAENLALQNIQARLRMLLAYMFAQLTPWVRGSWGGLLVLGSANVDESLRGYLTKYDCSSADINPIGGISKTDLKAFIAYARDAFSLPILHSFLTAVPTAELEPITESYVQADEADMGMTYDELSVFGRLRKNLKCGPYSMFNKLLQQWGPTMGPERVAEKVKLFWFEYARNRHKMTTLTPSYHAESYSPDDNRFDLRPFLYPSRFPFQFRKIDELVKRLQAFQAIPPPSRDENRKQV

SEQ ID NO: 54144 - protein, 393 aa, Oryza sativa (indica cultivar-group)
MGDAAAGGRKAAASGGGARLHVAMLALQLGYAGFHVVSRLALDMGVSKLVFPVYRNLIALFLLAPFAYFLEKKERPAMTASLAVQFFFLALCGITANQGFYLLGLENTSPTFASAIQNSVPAITFAMAAALRIERVRLSSRDGLAKVAGTLLCVAGASVITLFKGPAIFNTHHNHQPQPQQLAVAVAAGNKSWTLGCVFLLGHCVSWSGWLVLQAPVLKRYPARLSVTSYTCFFGLIQFLAIAAFLERDAAAWAVRSGSELFTILYAGFVASGVAFAVQTWCIHRGGPVFVAVYQPVQTLLVAVMASLLLGEQFHLGGIIGAVLIVAGLYLVLWGKSQERAIAAAKEASAAAAIADHQQQPASAAAADSCLKQPLLPASTVASENMHAGTTCG

SEQ ID NO: 54145 - protein, 599 aa, Synechococcus sp. RS9916
MINAPVSQMTVDAAATSKGAGNGKLAMAGQPLPKAEQRKLDSGHLKQPLLDELANELPYFSEDALQLLKFHGSYQQDDRDKREKGKDKTWQMMLRLRSPGGRIPTGLYLAMDELADRLGDGTLRATTRQAFQMHGVPKADLKEVIGTIVRNLGSTLAACGDINRNVMAPAAPFDKGGYPAARQLADEIADVLSPETAEGSYLDLWVDGDLSYRIKPSRKVKKVRSRQLEGGVFSGDEAEPLYGDTYLPRKFKVAVTVPGDNSVDLLTQDIGLVAFTETTGELRGCNVYVGGGMGRTHNKEETFARIADPLGYVPADQVLDLVQSVLALQRDHGDRKLRRHARMKYLLHDKGIQWFRDELTRTYFQGDLKPLRNEPKAKLHDYLGWHRHRAGMWFVGLPLLCGRLEGEFKAGLRKIVETYQLEIRLTPNQDLLLCNIGTPQRASIRAALAELGVETPEMPAPLARHAIACPALPTCGLAITESERILPAVLDRLDHQLQRLEIAKPVLIRMTGCPNGCARPYMAELALVGSGVEQYQLWLGGSGNLQRLAKPYLQKMPLDQLETTLEPLLVSWKEAGGRRSLGDHVHKLGDEAVAELLNV

SEQ ID NO: 54146 - protein, 221 aa, Triticum aestivum
MGEEANCDAVMEAGNGNGKAKVNGHATAVLAMPDVKADDAVVAPADPRLQGISDAIRVVPHFPKPGIMFNDITALLLRPGVFKDAVDMFVERYRGMGIAAVAGIEARGFIFGPAIALAIGAKFIPLRKPGKLPGEVISENYTLEYGTDCLEMHVGAVEPGDRVVVVDDLVATGGTLSAAIKLLERAAADVVECACLIGLPKFKDFYKLDGKPVYILVESRK

SEQ ID NO: 54147 - protein, 341 aa, Oryza sativa
  misc_feature (153)..(153): Xaa can be any naturally occurring amino acid
  misc_feature (248)..(248): Xaa can be any naturally occurring amino acid
  unsure (1)..(341): unsure at all Xaa locations
MEKLLSSSGAAAAVASQGQLPDCFVFPADRRPPASTAAVSLPVIDLSGPRDAVRRAVLDAGKELGFFQVVNHGVPPETMREMAAVCEEFFRLPAEDKAAFYSDAEENPNRLFSSTIYEVGDQRYWRDCLRLACGFPVADDTNTHWPDKPHHLXGDVTEKFFVATRGLGIELLRLLCEGMGLRPDYFERDLTAGDVIINVNHYPPCPDPSLTLGLPPHCDRNLITLLLQGDVFGLQVSYNGDWINVDPXPTPFVVNFGHLLEIATNGVLKSIEHRAMTNSAVARTSVATFMMPPMDCLVGPAKELVGDGGQPQYRTVTFREFMRIYKTVGARRDSVEKAFKI

SEQ ID NO: 54148 - protein, 506 aa, Arabidopsis thaliana
MASISLLQVSVAILCFLILHYFLFKKPHGRYPRNWPVLRMLPAMLKALHRIYDYSVEILETSDLTFPFKGPRFTGMDMLLTVDPANIHHIMSSNFSNYIKGPEFQDVFDVLGDSFITTDSELWKNMRKSYQAMLHSQEFQRFSMSTMTSKLKYGLVPLLNHFAEEGTTLDLQSVFGRFTFDTIFILVTGSDPRSLSIEMPEDEFAKALDDVGEGILYRHFKPRFLWKLQNWIGFGQEKKLTEANATFDRVCAKYISAKREEIKRSQGTSNGGSQDLLTSFIKLDTTKYKLLNPSDDKFLRDNILAFILAGRDTTATALSWFFWLLSENPHVVAKIHQEININTDLSRTGNSQENVDKLVYLHGALCEAMRLYPPVSFGRKSPIKSDVLPSGHKVDANSKIIICLYALGRMRAVWGEDASQFKPERWISENGGIKHEPSFKFLSFNAGPRTCLGKHLAMTQMKIVAVEILRNYDIKVLQGQKIVPALGFILSMKHGLQITVTKRCSA

SEQ ID NO: 54149 - protein, 185 aa, Triticum aestivum
KYPYIAGMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDKNRSIG

SEQ ID NO: 54150 - protein, 464 aa, Silicibacter pomeroyi DSS-3
MAAQSYDVIVIGAGPGGYVAAIRAAQLGLKACVVEREHLGGICLNWGCIPTKALLRSSEVFHLMERAKEFGLKADNIGYDLDAVVKRSRGVAKQLSGGIGHLMKKNKIDVVMGEATIPAKGKVSVKTDKGTQELTAKNIILATGARARELPGLEADGDLVWTYKHALQPVRMPKKLLVIGSGAIGIEFASFYNTLGADTTVVEVMDRVLPVEDAEISAFAKKSFVKQGMKIMEKSMVKQLDRAKGKVTAHIETGGKVEKLEFDTVISAVGIVGNVENLGLEALGVKIDRTHVVTDAYCRTGVEGLYAIGDIAGAPWLAHKASHEGVMVAELIAGKHAHPVKPESIAGCTYCHPQVASVGYTEAKAKELGYDIKVGRFPFIGNGKAIALGEVEGMIKTIFDAKTGELLGAHMVGAEVTEMIQGYVVGRQLETTEEDLMHTVFPHPTLSEMMHESVLDAYGRVIHM

SEQ ID NO: 54151 - protein, 346 aa, Schizosaccharomyces pombe 972h-
MGKPLIALGLEGSANKLGVGIILHDTNGSAKILANVRHTYITPPGQGFLPSDTAKHHRAWIIPLIKQAFAEAKISFKDIDCICFTKGPGIGAPLNSVALCARMLSLIHKKPLVAVNHCIGHIEMGREITGAQNPVVLYVSGGNTQVIAYSEKKYRIFGETLDIAIGNCLDRFARIIGLSNAPSPGYNIMQEAKKGKRFIELPYTVKGMDCSFSGLLSGVEAAATELLDPKNPSSVTKQDLCYSLQETGFAMLVEITERAMAHIRADSVLIVGGVGCNERLQQMMAEMSSDRGADVFSTDERFCIDNGIMIAQAGLLAYKTGDRCAVAESTITQRYRTDDVYISWRD

SEQ ID NO: 54152 - protein, 185 aa, Synechococcus sp. RS9916
MSSSVHWPQLIAGWSLPAFVHPWLLRSLPRLGLTALLSLLAIGVSDRSVAAQPQDSGVQSSVAEANGAETPGPTASGGLITIESDTQSADNLTGVVTAAGNVRIVYPSRGMVATARQVQYFSREGRLVLSGDVDVTQEGGNALRAERVIYLLDQERAEADPTPGQQVFSQMVIGPDRKVPTPLAP

SEQ ID NO: 54153 - protein, 99 aa, Arabidopsis thaliana
  misc_feature (43)..(43): Xaa can be any naturally occurring amino acid
  misc_feature (65)..(65): Xaa can be any naturally occurring amino acid
  misc_feature (76)..(76): Xaa can be any naturally occurring amino acid
  unsure (1)..(99): unsure at all Xaa locations
RRKRDSSMLYSANMVASPAKATRVAPFKGVRSCAAFQGSREAXNNDITFIKSNGGRVNCMRVWPXIGKKKFETLSXASDLSDSELDREVDYLIETVDSV

SEQ ID NO: 54154 - protein, 359 aa, Streptococcus pyogenes M1 GAS
MKPSIYSLTRDELIAWAVERGQKQFRATQIWDWLYKKRVQSFEEMTNISKDFVSILNDSFCVNPLKQRVVQESADGTVKYLFELPDGMLIETVLMRQHYGHSVCVTTQVGCNIGCTFCASGLIKKQRDLNSGEITAQIMLVQKYFDDRKQGERVSHVVVMGIGEPFDNYKNVMCFLRVINDDNGLAIGARHITVSTSGLAHKIRDFANEGVQVNLAVSLHAPNNDLRSSIMRVNRSFPLEKLFSAIEYYIEKTNRRVTFEYIMLNEVNDSIKQAQELADLTKTIRKLSYVNLIPYNPVSEHDQYSRSPKERVLAFYDVLKKNGVNCVVRQEHGTDIDAACGQLRSKTMKKDREKVTATK

SEQ ID NO: 54155 - protein, 62 aa, Brassica napus
MRGILVDWLLEVHVKFELNLETLYLTVNIIDRFLSVKAVPKRELQLVGISALLIASKYEEIY

SEQ ID NO: 54156 - protein, 126 aa, Glycine max
MNARRDGRNNRVALFDGIEEGGIRASSLYSSTSSHEIDEHDNEQALDGLQDRVNLLKRLSGDINEEVDSHNRMLDRMGNDMDSSRGVLSGTMDKFKMVFETKSSRRMFSLVASFVVLFLIIYYLTR

SEQ ID NO: 54157 - protein, 606 aa, Borrelia burgdorferi
MVQGGSSISIRKKNFCIIAHIDHGKSTLADRFIQKAKIISDRDFKSQMLDSMDIERERGITIKSQAVTITYKSNDGDFYELNFVDTPGHVDFSYEVSRAISSCEGALLLIDASQGIQAQTVSNFYMAFEHDLEIIPVINKIDLPNANVDFVKKQIKNDLGLNEEIAISISAKNGIGIDDLLEAICKYVPSPRGSIKDPLRALIFDSHYDSYRGVVVHFRIFEGQIKMGDKIRLMHTNSEHLIEEIGIFKISLERKDTLEAGDVGYFIAGIKNISDVKIGDTVTLCDFPALSPLEGFKEVKPVVFSSVYPVDANQYDDLLKAMDRLKLNDASLTFEKDSSSALGHGFKCGFLGLLHLEVIQERIEREFNLNVILTSPSVRYKIIPKKGESYFIETPEQFPGNEAIESVLEPYIKANIIVPTEFLGNIMSVCLLKRGVQTNLIYLDTKRVELIYKMPLSEILFDFYDKIKSVSRGYASFDYELLDYEYTDLVRLDILVNGDRVDALSQLVFKDSARTKAIGICKKLKDEIARQQFRIAIQGAIGSNVIARETISPVRKDVTAKCYGGDITRKRKLLEKQKEGKKRMKMVGNVEIPQSAFLAVLKSNDN

SEQ ID NO: 54158 - protein, 292 aa, Erwinia carotovora subsp. atroseptica SCRI1043
MFTGSIVALVTPMDAKGAVDRASLKKLIDYHVASGTSAIVSVGTTGESATLSHDEHGDVVLLTLELSDGRIPVIAGTGANATAEGVSLTKRFHGTGVVGCLTVTPYYNKPTQEGLYQHFKAIAEHTDLPQILYNVPSRTGCDMLPETVARLSEVKNIVAIKEATGNLSRVSQIQELVSEDFILLSGDDASGLDFMQLGGKGVISVTANIAAREMAELCRLAAQGNFVEARRLNQRLMPLHQKLFVEPNPIPVKWACKELGLMATDTLRLPMTPLTDSGRTVMGQALKQAGLL

SEQ ID NO: 54159 - protein, 221 aa, Larix potaninii var. potaninii
KAAGARIIVTQAAYVEKLADLQSDDVIIITIDGAPKEGCQHISVLIEADETQCPSVEIHPDDVVALPYSSGTTGLPKGVMLTHKSQVSSIAQQVDGENPNLYFHSEDVILCVLPLFHIYSLNSILFCALRAGAAILIMQRFNLTTLLELIQRYKVTVAPFVPPIVLDITKNPIVSQYDVSSVRIIISGSAPLGKELEDALRERFPKAIFGQGYGMTEAGPV

SEQ ID NO: 54160 - protein, 221 aa, Larix potaninii var. potaninii
KAAGARIIVTQAAYVDKLADLQCDDMIVIAIDGAPKEGCQHISILTEADETQCPSVEIHPDDVVALPYSSGTTGLPKGVMLTHKSLVSSVAQQVDGENPNLYFHSGDVILCVLPLFHIYSLNSVLLCALRAGAATLIMQKFNLTTLLELIQRYKVTVAPIVPPIVLEISKNPIVSQYDVSSVRIIMSGAAPLGKELEDALRERFPKAIFGQGYGMTEAGPV

SEQ ID NO: 54161 - protein, 221 aa, Larix speciosa
KAAGARIIVTQAAYVEKLAELQSDDVIVITIDGVPKEGCQHISVLTEADETQCPSVEIHPDDVVALPYSSGITGLPKGVMLTHKSQVSSVAQQVDGENPNLYFHSEDVILCVLPLFHIYSLNSILFCALRAGAAILIMQRFNLTTLLELIQRYKVTVAPFVPPIVLDITKNPIVSQYDVSSVRIIISGSAPLGKELEDALRERFPKAIFGQGYGMTEAGPV

SEQ ID NO: 54162 - protein, 221 aa, Larix speciosa
KAAGARIIVTQAAYVDKLADLQSDDMIVIAIDGAPKEGCQHISILTEADETQCPSVEIHPDDVVALPYSSGTTGLPKGVMLTHKSLVSSVAQQVDGENPNLYFHAEDVILCVLPLFHIYSLNSVLLCALRAGAATLIMQKFNLTTLLELIQRYKVTVAPIVPPIVLEISKNPIVSKYDVSSVRITMSGAAPLGKELEDALRERFPKAIFGQGYGMTEAGPV

SEQ ID NO: 54163 - protein, 221 aa, Larix speciosa
KAAGARIIVTQAAYVEKLADLQSDDVIIITIDGAPKEGCQHISVLIEADETQCPSVEIHPDDVVALPYSSGTTGLPKGVMLTHKSQVSSVAQQVDGENPNLYFHSEDVILCVLPLFHIYSLNSILFCALRAGAAILIMQRFNLTTSLELIQRYKVTVAPFVPPIVLDITKNPIVSQYDVSSVRIIISGSAPLGKELEDALRERFPKAIFGQGYGMTEAGPV

SEQ ID NO: 54164 - protein, 213 aa, Candida tropicalis
ISLLNILVAGRDTTAGLLSFVFFELARTPRVANKLREEIEDKFGLGQDARVEEISFESLKSCEYLKAVLNECLRLYPSVPQNFRVATRNTTLPRGGGKDGLSPVLVRKGQTVMYSVYAAHRNKQIYGEDALEFRPERWFEPETKKLGWAFLPFNGGPRICLGQQFALTEASYVTVRLLQEFSHLTMDPNTEYSPKKMSHLTMSLFDGANIQMY

SEQ ID NO: 54165 - protein, 450 aa, Gibberella moniliformis
MPLRPHIGLGFPAHAYQKRHVEPHDRSTGYQPKVRITDRYRIIGFISSGTYGRVYKAVGRNGKPVGEFAIKKFKPDKEGEQISYTGISQSAIREMSLCSELHHINVIRLCEIVLEDKCIFMVFEYAEHDLLQIIHHHTQQPRHPIPPATIKSIMFQLLNGCQYLHINWVLHRDLKPANIMVTSSGEVKIGDLGLARRFDKPLHSLFSGDKVVVTIWYRAPELILGSYHYTPAIDMWAVGCIFAELLSLRPIFKGEEAKMDSKKTVPFRRNQMQKIIEIMGVPTKDKWPLLSTMPEYNQLNTLANSMASSHHNHHSHHHPHHHHGHYGSRNPPPPGGSNLEKWYYSTINHTSAPGGTPPLASLGSEGYKLLAGLLEYDPSKRLTAAQALQSPFFSTGDRVSANCFEGCKNEYPCRRVSQDDNDIRTSSLPGTKRSGLPDDSLIRPAKRQKE

SEQ ID NO: 54166 - protein, 317 aa, Arabidopsis thaliana
MGNKRNLGFVIFFWALVVAVVATAIEHRRNERTKGVNGLDKIIIRDRRGRSAEVYLYGGQVSSWKNENGEELLVMSSKAIFQPPTPIRGGIPVLFPQYSNTGPLPSHGFVRQRFWEVETKPPPLPSLSTAHVDLIVRSSNEDLKIWPHKFEYRLRVALGHDGDLTLTSRVKNTDTKPFNFTFALHPYFAVSNISEIHVEGLHNLDYLDQQKNRTRFTDHEKVITFNAQLDRLYLSTPDQLRIVDHKKKKTIVVHKEGQVDAVVWNPWDKKVSDLGVEDYKHFVTVESAAVAKPITVNPGKEWKGILHVSVVPSNRKA

SEQ ID NO: 54167 - protein, 201 aa, Buchnera aphidicola str. Sg (Schizaphis graminum)
MIILNYNKTFFLKSISNISDIQIEHGIEIAFIGYSNSGKSSAINALTNQKKLARFSKTPGRTQLINLFQVTSDFRIVDLPGYGYAKAPLLIKIKWQNMIYSYLKNSRSLKGLVLLMDIRYPLKILDQDIISMALNCKIPILLLLTKCDKFTINNQKIQFQKVYEKLDKFLNELHIQLFSSLKKIGIEKLKSKLNFWYEKYR

SEQ ID NO: 54168 - protein, 394 aa, Rhizobium leguminosarum bv. viciae 3841
MSKTWRPATQLVHGGTLRSQYGETSEAIYLTQGFVYETSEAAEARFKGETEGFIYARYGSPTNDMFEKRMCLLEGAEDARATASGMAAVTAAILCQLKSGDHIVAARALFGSCRWVVETLAPKYGIDCTLIDGRDLANWEKAITPKTKVFFLESPTNPTLEVIDIAGVAKLANQIGAKVVVDNVFATPLFQKPLELGAHIVVYSATKHIDGQGRCLGGVVLSDKEWIDENLHDYFRHTGPAMSPFNAWTLLKGIETLPLRVRQQTENAAKIADFLAEQGKVAKVIYPGRKDHPQADIIAKQMTGGSTLVAFELKGGKDAAFALQNALEIIKISNNLGDSKSLITHPATTTHKNLTDEARAELGISPGTVRLSAGIEDTDDLIEDFARALAKVSA

SEQ ID NO: 54169 - protein, 415 aa, Buchnera aphidicola str. Sg (Schizaphis graminum)
MPELLNKTKTNLNFENIKILIKKFQSPFWVYDSNIIHKKINLLKEFDIVRFAQKACSNIHILRLMKQKNIKVDAVSLGEIERALVAGFKPNSNEIIFTADLFDEETLSKVIDFKIPVNAGSIDMLEQLGKLSPGHHVWLRINPGFGHGHSKKTNTGGENSKHGIWNPRLAIPIIKKYKLKLIGLHMHIGSGVNYKHLKKVGQAMIEKAMEINEKILFISAGGGLPIPYTFNEKPIDTKKYFIIWDEARKKISRFLNTPIQLEIEPGRFLVAESGILISQVRAIKKMGDKNFVLIDAGFNDLMRPTMYGSYHHVSVVTKDDRNIHETETIDTIIGGPLCESGDIFTQKEGGNITTRKLPILKIGDYLIFHDVGAYGASMSSNYNTRPLIQEILLENNTFRTIRRRQKINELLNLEK

SEQ ID NO: 54170 - protein, 444 aa, Burkholderia vietnamiensis G4
MHRIIIVGGGAGGLELATRLGDRYGASGNRPARALVTLVDRNPTHIWKPLLHEVAAGSMDPFTQELEYAAQARWHGFEFQQGELTALDRTAKRIALAPVNDSDGAELLPARNLEYDTLVVAIGSTTHFFGVQGAAENAIALDTVGEAERFRKRLIAACMRAEHQAPAEPAPGAAAEPRIQVVIVGGGATGVELSAELRNTAQVLSVYGLHKLDPRHDVGIVLIESGPRILPALQERVSSATAELLEKLGVRLLLAERVTEVAPGFVHTASGKAVRADLTVWAAGIKAPAVLGQLDGLQVNKLGQLDVRRTLQTVIDDNVFALGDCAACAWPGHERNVPPRAQAAHQQASFLLKAIGCRLDGRPLPEFTYRDFGSLVSLGHFSAVGNLMGGLIGGNMLIEGLFARFMYMSLYRLHVAALHGYPRMVLDTVAHWLRRTTLPRVKLH

SEQ ID NO: 54171 - protein, 500 aa, Arabidopsis thaliana
MVNFLLVLCYCRLILIHCKTIQLTQWLSKSFLTDVLVTKVPNCVLWQYFVDADDSVPQKIVVHKDGPRGIHFRRAGPRQKVYFESDEVHACIVTCGGLCPGLNTVIREIVSSLSYMYGVKRILGIDVSFCDCNLLLTKTNTGGYRGFYAKNTVSLDSKVVNDIHKRGGTILGTSRGGHDTTKIVDSIQDRGINQVYIIGGDGTQRGASVIFEEIRRRGLKVAVIGIPKTIDNDIPVIDKSFGFDTAVEEAQRAINAAHVEAESIENGIGVVKLMGRYSGFIAMYATLASRDVDCCLIPESPFYLEGEGGLFEYIEKRLKESGHMVLVIAEGAGQDLMSKSMESMTLKDASGNKLLKDVGLWLSQSIKDHFNQKKMVMNLKYIDPTYMIRAVPSNASDNVYCTLLAQSAVHGAMAGYTGYISGLVNGRQTYIPFYRITEKQNHVVITDRMWARLLSSTNQPSFLGPKDVFDNKEKPMSALLDDGNCNGVVDVPPVTKEITK

SEQ ID NO: 54172 - protein, 62 aa, Glycine max
  misc_feature (11)..(11): Xaa can be any naturally occurring amino acid
  unsure (1)..(62): unsure at all Xaa locations
MTQECTATEPXLNCKPVIGILTHPGDGACGRLSNATGASYITDSYVKYEDPGGARVIPLRYN

SEQ ID NO: 54173 - protein, 560 aa, Rhodopirellula baltica SH 1
MSVEHNAPVRLVIVGGVAGGASAATRARRMNEQAEIILFEKDEDVSFANCGLPYHIGEEIKNRDALVVASADFLRRRFQLDVRTREEVVSINREKRCVTVVRHGATSEKDKTYEQPYDKLILAPGASPIVPALPGVDASNVLTLRNLVDMDRIKARVDSGSVRRAVVVGAGYIGLEMVEQLRRREMDVDLIELREQVLPLLDHEMARPIEDALRRNNVGIHLGVGLESIQLDGDRATSVRLSDGTELSTDLVILGIGVRPNSELAKEAGLEIGSTGGITIDEFSRTSDSDIYAVGDASEPVYGPTGTPMRVPLAGPANRSGRLAGEHAVTGQSAAATPVWGTSVVRVFDVSVGMTGLTRASAKRFGKDATSVTIVAKHHAGYFPGAEVMTLKLAFEPATGKVLGAQCVGGEGIDKRIDVIATAMHFGGTVRDLAGLDLAYAPPFGSAKDPVHMAAFAACNALDEIESFRDSDDSLDEVQVVDVRGAGEIEKTPLREASGAIHIPVDELRERLSELDRSKPTVVSCAVGVRGHIAARILRQNGFDVQNLSGGATVRNRCFE

SEQ ID NO: 54174 - protein, 286 aa, Ustilago maydis 521
MASSNATNSTSAASAANTNSSAFKSAELAALSGVEAAKRAAAYAAVDNHVKPQHEIIGIGSGSTVPYVVERIAQQGPAVNAKRWFVPTGFQSRELIINAGLRLGDVDSFPSIDVTIDGADEVDNALNCIKGGGACHLREKVLAEAANEFVVVADYRKNGSQLGTKWLQGVPIEVAPFAYAKVLQNLKKMGSDKAVLRMGKAKAGPVVTDNGNFCIDAPFPEAQMKDPSDLLKRIKLLTGVLEVGLFCNICKSAYFGNDDGTITIKTAAGDVQEGVHFDVSKAPATA

SEQ ID NO: 54175 - protein, 215 aa, Brassica napus
MNALAATNRNFRLASRLLGLDSKLEKSLLIPFREIKVECTIPKDDGTLASFVGFRVQHDNARGPMKGGIRYHPEVEPDEVNALAQLMTWKTAVANIPYGGAKGGIGCDPSKLSISELERLTRVFTQKIHDLIGIHTDVPAPDMGTGPQTMAWILDEYSKFHGYSPAVVTGKPIDLGGSLGRDAATGRGVMLGTEALLNEHGKSISGQRLVIQGFG

SEQ ID NO: 54176 - protein, 398 aa, Silicibacter pomeroyi DSS-3
MGWKTLDDMDLTGKRVLVRVDINVPIVDGVVTDSTRIRRLMPTIRDILAAGGRPILLAHFGRPGGERRKNLSLGQLVPTLERAFETKVLFADDCVGPAAEEAAEALQPGQVLLLENTRFHASETKNDPDLAAGMARLGDIYCNDAFSAAHRAHSSTEAIARLLPSCAGRLMQAELEALEKALGKPERPVTAVVGGAKVSTKLELLGNLIEKVDYLVIGGGMANTFLVAKGLPVGKSLAERIMKDTAAEILAKAEAAGCTIVLPSDVVVAEKFESHAPHQILPNDRCPDEGMILDAGPDSLAAIKAIFEKSRTLIWNGPLGAFELEPFDAATNAAALKAAALTRAGKLISVAGGGDTVAALNASGAAGDFTYISTAGGAFLEWMEGKTLPGVAALIQAG

SEQ ID NO: 54177 - protein, 509 aa, Solanum tuberosum
MTLRISELFAAALIYIIVHIIISKLIATVRERGRRLPPGPTGWPVIGALSLLGSMPHVALAKMAKKYGPIMYLKVGTCGMVVASTPNAAKAFLKTLDINFSNRPPNAGATHLAYNAQDMVFAPYGPRWKLLRKLSNSHMLGGKALENWANVRANELGHMLKSMFDASHVGECVVIADMLTFAMANMIGQVMLSKRVFVEKGVEVNEFKNMVVELMTVAGYFNIGDFIPKLAWMDLQGIEKGMKSLHKKFDDLLTKMFNEHEATTYERKENPDFLDVVMANKDNSEGERLSTTNIKALLLNLFTAGTDTSSSVIEWALAEMMKNPQIFKKVQEEMDQVIGKNRRLIESDIPNLPYLRAICKETFRKHPSTPLNLPRVSTEPCTVDGYYIPKNTRLSVNIWAIGRDPDVWENPLEFNPERFLSGKNAKIEPRGNDFELIPFWAGRRICAGTRMGIVMVEYILGTLVHSFDWKLPNDVIDINMEESFGLALQKAVPLEAMVTPRLSLDVYCC

SEQ ID NO: 54178 - protein, 221 aa, Larix decidua
KAAGARIIVTQAAYVDKLADLQSDDMIVIAIDGAPKEGCQHISILTEADETQCPSVEIHPDDVVALPYSSGTTGLPKGVMLTHKSLVSSVAQQVDGENPNLYFHSEDVILCVLPLFHIYSLNSVLLCALRAGAATLIMQKFNLTTLLELIQRYKVTVAPIVPPIVLEISKNPIVSKYDVSSVRIIMSGAAPLGKELEDALRERFPKAIFGQGYGMTEAGPV

SEQ ID NO: 54179 - protein, 381 aa, Carboxydothermus hydrogenoformans Z-2901
MKRDYYEILGVARNATPEEIKKAYRKLARKYHPDVNKDDPNAAEKFKEINEAYEVLSDPEKRARYDQFGHAGVDGNFAGQGGFGGGAGINFEDIFSGFGGFGDLFDMVFGSGRKARQGPVPGDDIEAVLELTLEEAVFGGEKELRVTRTETCGHCHGNGAEPGTPIITCPTCQGRGQIHQEVKTLFGRMVRSQVCSTCRGEGKIPKTPCRECGGSGLVRKTRSITVKIPPGIDHGHRLRIAGGGEAGRFGGPPGDLYVYIKIKPHKLFKREDIHLKLEKEISFVQAALGAKVEIPTIDGGTEILEIPEGTQTGTVFTIKGKGVPVVNGSGRGNLYVTVKVVTPTKLTERQKQLLREFEEISKQKEETFKEKFNKFKNKFAL

SEQ ID NO: 54180 - protein, 221 aa, Larix decidua
KAAGARIIVTQAAYVEKLAELQSDDVIVITIDGVPKEGCQHISVPTEADETQCPSVEIHPDDVVALPYSSGTTGLPKGVMLTHKSQVSSVAQQVEGENPNLYFHLEDVILCVLPLFHIYSLNSILFCALRAGAAILIMQRFNLTTLLELIQRYKVTVAPFVPPIVLDITKNPIVSQYDVSSVRIIISGSAPLGKELEDALRERFPKAIFGQGYGMTEAGPV

SEQ ID NO: 54181 - protein, 221 aa, Larix gmelinii var. gmelinii
KAAGARIIVTQAAYVEKLAELQSDDVIVITIDGVPKEGCQHISVLTEADETQCPSVEIHPDDVVALPYSSGTTGLPKGVMLTHKSQVSSVAQQVDGENPNLYFHSEDVILCVLPLFHIYSLNSILFCALRAGAAILIMQRFNLTTLLELIQRYKVTVAPFVPPIVLDITKNPIVSQYDVSSVRIIISGSAPLGKELEEALKNRFPKAIFGQGYGMTEAGPV

SEQ ID NO: 54182 - protein, 221 aa, Larix gmelinii var. gmelinii
KAAGARIIVTQAAYVDKLADLQCDDMIVIAIDGAPKEGCQHISILTEADETQCPSVEIHPDDVVALPYSSGTTGLPKGVMLTHKSLVSSVAQQVDGENPNLYFHSGDVILCVLPLFHIYSLNSVLLCALRAGAATLIMQKFNLTTLLELIQRYKVTVAPIVPPIVLEISKNPIVSQYDVSSVRIIMSGAAPLGKELEDALRERFPKAVFGQGYGMTEAGPV

SEQ ID NO: 54183 - protein, 291 aa, Buchnera aphidicola str. Sg (Schizaphis graminum)
MSNKDTQGTDKINRKGFFSILLNQIFHDEPKNREELLVLIRDSEQNELIDQDTCDMLEGVMHIAKKRIKDIMIPRTQMITLKLNYNLNKCLDIIIESAHSRFPVMSRDQNYVEGFLIAKDLLPFMKHPEDAFCIKNILRSAVVVPESKSVDTMLKEFRLKRSHMAIVIDEFGAVSGLVTIEDILELIVGEIQDEYDDEEKVNIRKLKKCIFSIKALTEIKEFNDTFETNFSDEEVDTIGGLVMKAFGHLPSRGDHININGYNFKVSIADSRKVIQIHVTVPENKIPKKLEK

SEQ ID NO: 54184 - protein, 704 aa, Arabidopsis thaliana
MSENCNSRHFSWLMKSCLPNPSDAKSLVQIHQPSSTAANSSATIASLPDDLLLECISRVPSSSIPSLAVVCRRWSRLLHSPYFLHLRRRLGLLRHSLFAISTVDSGLFAADLQFQSEIASWKVSLAVSSRSVGVDGSYGSLSHARAAAIGPRVYVVSRNAVLRYDSWMGTLNLRSPMIFPRKKFAIAVVSGKIYVAGGGGGSEVAAAVEEYDPELNRWEVVTQSARKRYGCIGAAVDGVFYVIGGLKIGNETSRAVAARAYASSMDLFDVESRQWLRSRSVPGGGCVVAACAAVGYVYVLTSHAVELSFWRFDARRRGGNSGFGEWQRLKSPPLPAQVRLDGTVRFSCVGVEDKVAVVQVVGCIDDLLRRSGRGSNLYFSILINYKQLFIKNIKSISNIIWKYYNFTILYNPEPCVSYTIILRKKTKLSVRNQTCFKKSSLSSSSTAKKTTNLSMREQTMFKKALELSTLCNIDVCVIYYGRDGKLIKTWPDDQSKVRDMAERFSRLHERERCKKRTNLSLFLRKKILDDTKLSEKVLEMEDSLESGLRVLQDKLLLLQPEKNQTEFGQTRAVSSTTNPLSPPPSLIEDHRHQQRTEPLMSGVSNTEQDLSTSSLSQNQSKFSVFLYNHDNCSFYQVPDSVSSFDSLTSTGLLGEQGSGLGSSFDLPMVFPPQMQTQTPLVPFDQFAPWNQAPSFADPMMFPYN

SEQ ID NO: 54185 - protein, 475 aa, Ralstonia metallidurans CH34
MYQDLALYIDGEFIKGGDRREQDVINPATQELLGKLPHATTADLDRALSAAQRAFETWKKTSPLERSQILRRVAELTRTRAKEIGRDITLDQGKPLAEAVGEVMICAEHAEWHAEECRRIYGRVIPPRNPAVRQIVVREPIGVCAAFTPWNFPFNQAIRKIVAALGAGCTLILKGPEDSPSAVVALARLFHDAGLPPGVLNIVWGVPSEVSTYLIESPIVRKISFTGSVPVGKQLAAMAGAHMKRVTMELGGHSPVLVFGDADIEPAAEMLARFKLRNAGQVCVSPTRFYVQEKAYDKFLARFTEVIGSIKVGNGLDDGTQMGPLAHERRIASMEQFLDDASHRGGKIVAGGSRIGDKGFFFAPTVVTDLPDDAKLMVDEPFGPVAPVTRFKDAEEVLRRANSLPFGLASYVFTNSLKTANLVSNGLEAGMVNINHFGMALAETPFGGIKDSGIGSEGGQETFDGYLVTKFITQV

SEQ ID NO: 54186 - protein, 203 aa, Escherichia coli K12
MLTEQQRRELDWEKTDGLMPVIVQHAVSGEVLMLGYMNPEALDKTLESGKVTFFSRTKQRLWTKGETSGNFLNVVSIAPDCDNDTLLVLANPIGPTCHKGTSSCFGDTAHQWLFLYQLEQLLAERKSADPETSYTAKLYASGTKRIAQKVGEEGVETALAATVHDRFELTNEASDLMYHLLVLLQDQGLDLTTVIENLRKRHQ

SEQ ID NO: 54187 - protein, 113 aa, delta proteobacterium MLMS-1
MPEDCLFCKIVNDEIPARKIYEDDQMLAFWDVSPQAPTHFLVIPKKHVNGPGALAPEDDDLIGALIRKGAELGRENQIPDCRLVLNNGAGAGQTVFHLHLHVLGGRPLSWPPG

SEQ ID NO: 54188 - protein, 272 aa, Escherichia coli K12
METYAVFGNPIAHSKSPFIHQQFAQQLNIEHPYGRVLAPINDFINTLNAFFSAGGKGANVTVPFKEEAFARADELTERAALAGAVNTLMRLEDGRLLGDNTDGVGLLSDLERLSFIRPGLRILLIGAGGASRGVLLPLLSLDCAVTITNRTVSRAEELAKLFAHTGSIQALSMDELEGHEFDLIINATSSGISGDIPAIPSSLIHPGIYCYDMFYQKGKTPFLAWCEQRGSKRNADGLGMLVAQAAHAFLLWHGVLPDVEPVIKQLQEELSA

SEQ ID NO: 54189 - protein, 472 aa, Pseudomonas aeruginosa PAO1
MDGQHPHSGELKRGLKNRHIQLIALGGAIGTGLFLGSAGVLKSAGPSMILGYAIAGFIAFMIMRQLGEMIVEEPVAGSFSHFAHKYWGGFAGFLSGWNCWVLYILVGMSELTAVGKYIHYWWPEVPTWATAALFFVVVNAINLTNVKAFGEAEFWFAIIKVVAIIGMILLGCYLLFSGSGGPQASVSNLWAHGGFFPNGVSGLVMAMAIIMFSFGGLEMLGFTAAEADKPRTVIPKAINQVIYRILIFYIGALVVLLSLTPWDSLLQTLNASGDAYSGSPFVQIFSMIGSGTAAHLLNFVVLTAALSVYNSGTYCNGRMLLGLAEQGDAPRALARVDKRGVPVRALVVSALVTFLAVVVNYVIPHQALELLMSLVVAALVINWAMISMAHLKFRAQMDRQGTRTHFRAFWYPYGNYLCMAFVVFILGVMLLIPGIQVSVYAIPVWLLVMWACYRLKGAPRPMPGLRVKPVTE

SEQ ID NO: 54190 - protein, 152 aa, Brassica napus
  misc_feature (11)..(11): Xaa can be any naturally occurring amino acid
  misc_feature (29)..(29): Xaa can be any naturally occurring amino acid
  misc_feature (100)..(100): Xaa can be any naturally occurring amino acid
  unsure (1)..(152): unsure at all Xaa locations
FEWSAVKFLWXLFFMYFSIMYFTFYGMMXTAITPNHNVASIIAAPFYMLWNLFSGFMIPYKRIPLWWRWYYWANPVAWTLYGLLVSQYGDDEREVKLSDXGVHKVMVKQLLEEVMGYKHDFLGVSAIMVVAFCLFFSVVFAFSIKTFNFQRR

SEQ ID NO: 54191 - protein, 324 aa, Bacillus halodurans C-125
MLQQKQSLLEHKPVLSKELEKLVNHYRTLSLNGQCAQYIPALREANQTYLGLYVVHSNGIEIKSGDWQVPFTLQSISKIINFIAACLDRGITYVLDRVDVEPTGDPFNSMVRLEMRKTGKPFNPMINAGAITVASLLSGKSPTEKLESVYSLVEKMLGRRASANEAVFHSEWQTAHRNRSLAYYLKDTGYLESEVDDALHVYFTLCAIEVATKDIAKIGLILANNGYDPLSHQQIFPKEVAKLTKALMLTCGMYNASGTFAAHIGIPAKSGVSGGIMAAVPARGRSDEAMGIGIYGPAIDDFGNSVAGVALLKHLSHMWDLSIF

SEQ ID NO: 54192 - protein, 430 aa, Bacillus halodurans C-125
MTILKEPQRTQVDEIKEITELSLLQSTQSVIKEALDLLGYSEATYELLKEPIRMLTVRIPVRMDDGNVNIFTGYRAQHNDAVGPTKGGVRFHPDVNENEVKALSLWMSLKCGIADLPYGGGKGGIICDPRTMSFGELERLSRGYVRAISQIVGPTKDIPAPDVFTNSQVMAWMMDEYSRIREFDSPGFITGKPIVLGGSLGRESATAKGVIICIEEAAKRNQLDLKGARVIIQGFGNAGSFLAKFLHDAGALIVGISDAYGALYDQAGLDIEYLLDKRDSFGTVTNLFKKTISNQELLISDCDILVPAAISNQITKENAHDIKAKVVVEAANGPTTLEATRILTERGIFLVPDVLASSGGVTVSYFEWVQNNQGYYWNEEEIDQKFRNMIVGSFEKVCTFSNQHQVDMRLAAYTVGVKRMAEASHFRGWV

SEQ ID NO: 54193 - protein, 211 aa, Brucella melitensis 16M
MPMKNDHSPDQRTLSELFEHNRQWAAEKQEKDPEYFSRLSSSQRPEFLWIGCSDSRVPANVVTGLQPGEVFVHRADLNLLSVLEFAVGVLEIKHIIVCGHYGCGGVRAAMDGYGHGIIDNWLQPIRDIAQANQAELDTIENTQDRLDRLCELSVSSQVESLSRTPVLQSAWKDGKDIIVHGWMYNLKDGLLRDIGCDCTRNALQFACQPAE

SEQ ID NO: 54194 - protein, 885 aa, Carboxydothermus hydrogenoformans Z-2901
MTKYVYLFHEGRADMKDLLGGKGANLAEMTNIGLPVPPGMTITTEACREYYRLGGKFPEGLMEEVKEKLVYIEEKTGKKFGDPQNPLLVSVRSGAKFSMPGMMDTILNLGLNEETVEGLAQNTQNPRFAYDAYRRFIQMFGDVVLEIPKHEFEHILDRQKEKEGVTFDQELSAEALKEVITRYKELVERKTGKPFPSDPMVQLTMAIEAVFKSWNNDRAIVYRNLNKIPHDLGTAVNIQSMVFGNMGNDSGTGVAFTRNPSTGEKVLYGEYLTNAQGEDVVAGIRTPSPISKLKEEMPEVYEQFVSIAKLLESHYKNMQDIEFTIERGKLYILQTRNGKRTAQAAVKIAHDMVEEGLITKKEAILMVEPGQLDQLLHRQIDPSAKVEVIAKGLPASPGAASGIVVFDADEAEKLGKEGKKVLLVRTETTPDDIHGIVAAQGVLTSRGGMTSHAAVVARGMGKPCVCGCEAIKIDYEKKLFTVDNITVKEGDYLSIDGSTGRVILGTVPMKDPELSPEFIKLLEWADELKRLEVRANADTPEDAQKAREFGAKGIGLCRTEHMFMGPERLPHVQRMILAETKEEREEALSHLLPMQEEDFYGILKAMEGYPVCIRLLDPPLHEFLPSLEELLVETTELRVRGDNPELLAEKEALLKKVKSLHEFNPMLGHRGCRLGITYPEVYEMQIRAIFNAAARLTKEGYKVYPEVEIPLTIDVNEMKFFKERIDAIAREVMEREGVTFHYTTGTMIELPRAALLADELAEVAEFFSFGTNDLTQTTLGFSRDDAEGKFLTHYLDMKILKENPFIVLDRKGVGKLMKIAVEGGRKTRPDLLVGICGEHGGEPSSVEFCHQIGLDFVSCSPYRVPIARLAAAQAAVAEGEIVGTK

SEQ ID NO: 54195 - protein, 221 aa, Larix gmelinii var. principis-rupprechtii
KAAGARIIVTQAAYVEKLADLQSDDVIVITIDGVPKEGCQHISVLTEADETQCPSVEIHPDDVVALPYSSGTTGLPKGVMLTHKSQVSSVAQQVDGENPNLYFHSEDVILCVLPLFHIYSLNSILFCALRAGAAILIMQRFNLTTLLELIQRYKVTVAPFVPPIVLDITKNPIVSQYDVSSVRIIISGSAPLGKELEEALKNRFPKAIFGQGYGMTEAGPV

SEQ ID NO: 54196 - protein, 456 aa, Carboxydothermus hydrogenoformans Z-2901
MYDVAILGGGPGGYVAAIRAAQLGLSVVVVEKDELGGTCLNRGCIPTKALVSTAERLHQIKNSAAFGIEVTGYNFNFQKAAERKNQVVERLVKGIHYLFKKSKITLIKGTGKLTGKNEITVETSDGLEKVEAKNIILATGSKPALISALGYDGERVITSDEALNLEKLPAEMVIIGGGVIGSEFATIFSEMGVKVTIVELLPSILANTDKEVSRYLTTLFKKRGIQVKTKVAVKEVKKGEKVTVVLENGEELVTDMVLISIGRVLNTKDIGLEEVGVALGPKGEVLVDEYLRTNVENIYAIGDITSKMQLAHVASAQGIRVVENLVGEPQPMSYDVVPGCIFTLPEIAMVGLTSQEAEEKGIKIITGKFPFQASGKAVAMEETEGFVKIIADFYTHRILGGHIVGPHATDLIGEIALAVQKGLTLEEVAHTIHAHPSLPEAVMEAAEAALNRAIHI

SEQ ID NO: 54197 - protein, 264 aa, Arabidopsis thaliana
TLTLVLDPFFWMYFSWTWLFWPWFIAVGLAGYGIYCFRKHWLGEANAFEQLGIVTSVFTWLTLVPPAYFNGYLEGWPYVFFLAYHYFFFFNVSVRKRLYGDFYARTHDPKWDVNTPLWSRILFGVGIMVGHWLAAFEGPELHRLPGGWANVGIWILIVITMLMHYDSTLYLARYSEKVVVPTAVVQFGPYRWVRHPIYASTMLLFAAYCTALRAPLSLLFLLAVCLVYYNKKAKMEEELMVESFGQSYSDYADKVRHKFIPFVY

SEQ ID NO: 54198 - protein, 221 aa, Larix gmelinii var. principis-rupprechtii
KAAGARIIVTQAAYVEKLADLQSDDVIVITIDGVPKEGCQHISVLTEADETQCPSVEIHPDDVVALPYSSGTTGLPKGVMLTHKSQVSSVAQQVDGENPNLYFHSEDVILCVLPLFHIYSLNSILFCALRAGAAILIMQRFNLTTLLELIQRYKVTVAPFVPPIVLDIAKNPIVSQYDVSSVRIIISGSAPLGKELEEALKNRFPKAIFGQGYGMTEAGPV

SEQ ID NO: 54199 - protein, 291 aa, Triticum aestivum
  misc_feature (65)..(65): Xaa can be any naturally occurring amino acid
  misc_feature (78)..(78): Xaa can be any naturally occurring amino acid
  misc_feature (94)..(94): Xaa can be any naturally occurring amino acid
  misc_feature (196)..(196): Xaa can be any naturally occurring amino acid
  unsure (1)..(291): unsure at all Xaa locations
MGRKFFVGGNWKCNGTVEQVESIVNTLNAGQIASTDVVEVVVSPPYVFLPTVKAKLRPEIQVAAXQNCWVKKGGAFTXGEVSAEMLVNLGVPWXVILGHSERRSLMGESSEFVGEKVAYALAQGLKVIACVGETLEQREAGSTMEVVAEQTKAITGKIKDWTNVVVAYEPVWAIGTGKVATPAQAQEVHANLRDWXLKTNVSPEVAASTRIIYGGNVYPLFEHKCLLVYTFTAEVILIYDGYARLVAIGSVTGASCKELAGQPDVDGFLVGGASLKPEFIDIINAATVKSA

SEQ ID NO: 54200 - protein, 161 aa, Cucumis sativus
AAIGKGFAIGSAALVSLALFGAFVSRAGVVVVDLLTPKVFIGLIVGAMLPYWFSAMTMKSVGSAALKMVEEVRRQFNTIPGLMEGTAKPDYATCVKISTDASIKEMIPPGALVMLTPLIVGILFGVETLSGVLAGSLVSGVQIAISASNTGGAWDNAKKYI

SEQ ID NO: 54201 - protein, 446 aa, Burkholderia vietnamiensis G4
MNPLHALPASASATAQRTRVRWLVLAVLFAVTTINYADRAAIAIAGPAIARAMHLSHVQMGFIFSAFGWSYVIAQLPGGWLLDRFGSRIVYAFSIFFWSLFTLLQGGIGFIGGAAAFGLLFALRFLVGAAEAPSFPANSRIVSTWFPAAERGTASAIFNAAQYAATVVFAPLMGWLVHAFGWQWVFAVMGVLGFAFVLVWNRTMYDPSAHPRINRAEFDYLAEGGALVNIDRAAGARDGGPSMHHVKALLRSRMLVGVYVAQYCINALTYFFITWFPVYLVQARGMSILNAGLVASIPAVCGFLGGILGGIVSDALLKQGRSLSVARKVPIVIGMLLSMSMIVCNYTDSHVLVVLFMALSFFGKGLGALGWAVNADTAPRQIAGLSGALLNTCGNLSSITTPIAIGYIVDRSGSFNGALVYVVAHALVAVICYLFVVGEIRRVELK

SEQ ID NO: 54202 - protein, 1561 aa, Oryza sativa (japonica cultivar-group)
MAAASRARRWSLAGKTALVTGGTKGIGRAIVEELAGFGVRVHTCSRHDADLQDCLRRWNAAGEGGGAAALVTGSVCDVSVRGDREALVAAARAALGGRLDMLVNNAGQVVVGPAAETAPEEYARLMATNLESCFHLAQLAHHLLRDAAAGGGAAASVVNISSTAAFYAAPHLAVYSATKGGMNQLTRCLAAEWARDGVRVNAVAPGATRTDICDTSGVALGEKTRRRLADAGAMDRVPIRRIGEPEEVAAAVVFLCMPAASYITGQAQGLWGAVEPEGDDLVDYRQDRQALAAILRAVPAEMLATLAVKETAQEAWEAIKTRRIGVQRVREANAQQLAENSVISSSRTVVPEHLQQIAISIETLLDVNELSLEEVTGRLRSVEQRKQRKTAAASSRVDANGRLLFTEEEWLAKFRKAASLQDAAHSSGGNGDRRGRGRGKKDDGAPKEAQPKPANPGGRNLGNCKNCGKRGHWAKDCRSKPKAQQAYVAQEEDEEPALLLAKVQLDPPRPRVAAPTNVVSPPSAPRALSPMGELAVVEAKVFAQLDGGGEHDPAMWILDTGATNHMTGSRSAFAELDTAVTGTVRFGDGSVVRIEGRGTILFSCRFGEHRGIAGVYYIPRLTANIVSLGQLDRSGSKVLIHHGVLRVWDPRGHLLVRVRRSDDCLYTIKLDIDRPVCLAARSAEPAWRWHARYDHLNFPTLRKLAQQEMVRGLPLLQQVTQVCDGCLLRKQRRAAFPTQSKYRADEHLELVHGDLCGPIEPATPAGNRYFLLLVDDMSRYMWLTLIRSKDESANAIKHFQARAEVESGRKLRALRTDRGGEFTSIEFGEYCANLGVGRQLTAPYSPQQNGVVERRNQTIIATARSMMKAKGVPGRFWGEAMSTAVFLLNRSPTKSLDNQTPYEAWYGQRPAVHFLRTFGCVGHVKITKPGLKKLDDRSAPMVLLGYEQGSKAYRLYDPVSERVHVSRDVVFDEDAAWDWGPVVTTTIGTAPASSPTPPSPPSPAPSAPTTPAPPSPPSPEAVEFVTPPTQDSILDVDADDDVVPRYRLVDNLLGNASPPGHAPRVLEQLELHVVSANEPASLAEAEADPNWRGAMQDELNAIVDNDTWSLTDLPHGHRAIGLKWVYKLKRDEQGAIVRYKARLVAKGYVQRQGVDFDEVFAPVARLESVRLLLVVAVHQGWQVHHMDVKSAFLNGELLEEVYVSQPPGFVDDNHKNKVYRLHKALYGLRQAPRAWNAKFDSSLLSLGFHRSSSEHGVYTRTRGGRRLTVGVYVDDLIITGDHDDEIRSFKGEMMKLFKMSDLGALRYYLGIEVTQDSDGITLGQAAYASKILEKAGLKDCNPCQTPMELGWESALSRQHATRPGILCWVCQSLHGVTQGRPSCCRSTHTALCGARCALPMLVGYSESDLAGDPDERKSTSGQIFFINGGPVTWQSSKQKVVALSSCEAEYIAAAAATCQGVWLARLLAEVLGDEIATPLLKVDNQSTISLIKNPVHHDRSKHIDVKYHYIRECAEKKLIEMMFVGTAEQLGDIFTKSLGRTRFQELRSKIGVCSLDKSSQT

SEQ ID NO: 54203 - protein, 398 aa, Zea mays
MAANGKSSLANGASTGGKPIKCKAAVAWGPGEPLVMEEVEVAPPGRLEVRVKLLFTSICHTDLSFLKGENELHRKFPRILGHEAPGVVESVGDGVEDLAAGDHVIPIFNGECGACAYCESDRTNLCGTYRVDASKSTMVSDGGTRFSVADRVSGRTVPVYHFLNTSTFAEYTVLDAACAVKVNPEAPLQKMCLLSCGISTGVGAVWNTANVSAGSTVAIFGLGAVGLAVAEGARLRGAARIIGVDINPEKFTKGREMGVTDFVDSRASDKPVHEVIREMTHGGVDYSFECTGINGVLREAFVSTHDGWGLTVVLGIHATPKMLPLHPMELFDGRRITACVFGDVKGKSQLPAIVDKCVNGDLDINLDGFITHRMPFSDINKAIQLLEEGKSLRCVLNL

SEQ ID NO: 54204 - protein, 391 aa, Rhodopirellula baltica SH 1
MATKTCYYEVLKVERTATKQQVDRAYRKLAIKYHPDSNRDDGSATAKFKEATEAYEVLSDANKRARYDQYGHAGVEGATQQYGDVEDIFEAFGDLFGGGFGDFFGGGSRRGGGRRRVRRGADVRCDVTLTLEEAARGCHKDIVFRRRVSCDTCDGSGAAAGSEPVTCTMCGGQGQVIQSAGILRVQTTCPTCKGAGKQIGEPCGKCRGTGTQNEKAEMNVEIPAGVDDGMRVRLQGEGEPSPDGGPNGDCYCFISVKEHNLFKREGQHLILQMPISYAQAALGATINVPTLDGPHELTVPAGTQTGHVFTVRGQGIVDPRSGRTGDLLVQIFIEVPKKLSDKQQKLLRELAELDHDSVLPERTSFLDKLRHFFDPEPEEAGTGSTDTEKDS

SEQ ID NO: 54205 - protein, 316 aa, Photobacterium sp. SKA34
MSTKLEQLRALTTVVADTGDIKDIKKYQPEDATTNPSLILKAAQIAEYAPLIDASIAYAKAQGDDKAQQVQDTCDMLAVSIGKEILNVVPGRISTEVDARLSYDTEGSVTKARQLIKMYNDAGISNDRILIKLASTWEGIRAAEILEKEGINCNLTLLFSFAQARACAEAGVFLISPFVGRIMDWYKAKEGRDFAPQEDPGVISVTNIYNYYKEHGYNTVVMGASFRNTGEILELAGCDRLTISPQLLQELEEAQGDVVEKLKATTDLKDRPAAMTHAEFLWEHNQDPMAVEKLAEGIRNFAIDQGKLEAMIAERL

SEQ ID NO: 54206 - protein, 401 aa, Helianthus annuus
MATKKSVSSLTEGDLKGKRVFVRVDLNVPLDDTFKITDDTRIRAAVPTIKYLMSHGARVILSSHLGRPKGVTPKFSLKPLVPRLSELLGIEVKMADDCIGPDVEKLVAEIPEGGVLLLENVRFYKEEEKNDPEFAKKLASLADLYVNDAFGTAHRAHASTEGVAKHLKPAVAGFLVQKELDYLVGAVSNPKKPFAAIVGGSKVSSKIGVIESLLEKVDILVLGGGMIFTFYKAQGLAVGSSLVEEDKLDLATTLLEKAKSKGVSLLLPSDVVIADKFAADANSKIVPASSIPDGWMGLDIGPDSIKSFSEALDTTKTVIWNGPMGVFEFDKFAVGTEAIAKKLAELSGKGVTTIIGGGDSVAAVEKVGLADKMSHISTGGGASLELLEGKPLPGVPALDEA

SEQ ID NO: 54207 - protein, 660 aa, Photobacterium sp. SKA34
MLANAIRALSMDGVQQANSGHPGAPMGMADIAEVLWRGHMNHNPQNPKWADRDRFVLSNGHGSMLIYSLLHLTGYDLSIDELKNFRQLHSKTPGHPEYGYAPGIETTTGPLGQGITNAVGMALAEKAMAAQFNREGHDVVDHYTYSFLGDGCLMEGVSHEACSLAGTLGLGKLIAFWDDNGISIDGHVEGWFTDNTPERFESYGWHVIPAVDGHDAAAINAAIEAAKAETGKPTLICCKTIIGFGSPNKSGSHDCHGAPLGADEIKAAREFLGWTYGSFEIPAEIYAEWDAKEAGKVKEAAWDEKFAAYAAAYPELAAEFKRRMNGELPANWDQVTSEIIADLQANPANIASRKASQNALEAFGKILPEFMGGSADLAPSNLTMWSGSKSITPTDASGNYIHYGVREFGMTAMINGMALHGGFVPYGATFLMFMEYARNAMRMAALMKIQNIQVYTHDSIGLGEDGPTHQPVEQIASLRLTPNMSTWRPCDQVESAVAWKYAIERKDGPTSLIFSRQNLTQQDRDAAQVANIARGGYILKDCEGKPELILIATGSEVGIAAEAYAQLTTEGRKVRLVSMPATDLFDKQDAAYRESVLPSDVTARIAIEAGIADFWYKYVGFDGRIIGMTTFGESAPADELFKMFGFTTDNIVETAKDLLA

SEQ ID NO: 54208 - protein, 519 aa, Triticum aestivum
MGSSTENRSRMGSIKPMGIQLIECVRGGPLSFRSSQALVLVLTFLSYASYHATRKTTSIVKSVLDPKTTNLGLLHWPSHMYLQELKGAANNTALESGWAPFNGEDGSQLLGEIDLAFLGVYAIGMFFAGHLGDRVDLRILLTIGMVGTGLFTAAFGAGYWLNIHSFYYFLGVQMIAGLFQSSGWPSVVAVVGNWFGKSKRGLIMGIWNAHTSVGNISGSLIAAAMLKFGWSWSFAVPGAMIALVGLAVFLFLPVDPEVIGVEEDRHVKDYEKNGTDVPLLEGHSSGRDEAVGFIQAWRIPGVAPFALCLFFCKLVAYTFLYWLPFYLSHTEIGGEYLSDSAAGILSTLFDVGGVVGGILAGHISDRLDARALTAATFTFSAIPALFFYRIYGSISLTWNVALMFVTGVLVNGPYALITTAVSADLGTHSSLNGNSRALATVTAIIDGTGSIGAAVGPLLTGYISAKSWSGVFTMLMASALVAGLLLSRLVVAEITAKMAAPQRPVELASDLPVSSLEEP

SEQ ID NO: 54209 - protein, 251 aa, Carboxydothermus hydrogenoformans Z-2901
MRKPFIAGNWKMYKTPVEAAGFVRELIDSLKDVSGVDVAVCPPFPALWPVKEALEGSNIALGAQNMHFEKEGAFTGEVSPAMLQDIGVKYVILGHSERRAYFGETDELINQKIKAAFTWGLNPIFCVGETLEERERGITKAVVEIQVLKGLAGVTAEQAENLTIAYEPVWAIGTGKTATPDDAQEVCQFIRELLVKLFGREIADKVRIQYGGSVKPENIKELIAKPDIDGALVGGASLKVESFTAIVKGSI

SEQ ID NO: 54210 - protein, 484 aa, Oryza sativa
  misc_feature (388)..(388): Xaa can be any naturally occurring amino acid
  unsure (1)..(484): unsure at all Xaa locations
MMGENNERRGLEDAPPSNSNLTGDQLLGDLLSAAFSWQSCRSRHEALQVRCGPGTAPYEKALRQPKSGDGAIAADGDDDDCRYVVSIVYDRGLGNRVIPIISAFLYAVLTERALLVAPYNGDVDALFCEPFPGTTWIHPGGRRFPLRRLRDLDGKSRESLGTLLKSNAVSVDAGGNGTSSWSGRPPPYVYLHLDGGADYHDKLFYCDEQQRLLRGTPWLLMKTDSYLVPGLFLVPSLRGELERMFPEKDAVFHHLSRYLLHPANAVWHAITAYHRDHLAGAGHLVGIQIRVYHEETPPVSQVVLDQVLSCARREKLIPFPTAGTTTNTSSSDQAVLVTSLNSWYSDRIRDELGGGGGVHQPSHEGWQRMGDTAHDMRALSEMYLLSTXDALLTTGFSTFGYDAQGLAGERPWLMPRRPVWDKEPATEVPEPPCVRAASPEPCFHSPSYYDCAARRNYEDIGKAVPYIRRCEDVSWGIQLVKGSS

SEQ ID NO: 54211 - protein, 221 aa, Larix gmelinii var. principis-rupprechtii
KAAGARIIITQAAYVEKLADLQSDDVIVITIDGVPKEGCQHISVLTEADETQCPSVEIHPDDVVALPYSSGTTGLPKGVMLTHKSQVSSVAQQVDGENPNLYFHSEDVILCVLPLFHIYSLNSILFCALRAGAAILIMQRFNLTTLPELIQRYKVTVAPFVPPIVLDITKNPIVSQYDVSSVRIIISGSAPLGKELEEALKNRFPKAIFGQGYGMTEAGPV

SEQ ID NO: 54212 - protein, 221 aa, Larix gmelinii var. principis-rupprechtii
KAAGARIIVTQAAYVEKLADLQSDDVIVITIDGVPKEGCQHISVLTEADETQCPSVEIHPDDVVALPYSSGTTGLPKGVMLTHKSQVSSVAQQVDGENPNLYFHSEDVILCVLPLFHIYSLNSILFCALRAGAAILIMQRFNLTTLLELIQRYKVTVAPFVPPIVLDITKNPIVSQYDVSSVRIIMSGSAPLGKELEEALKNRFPKAIFGQGYGMTEAGPV

SEQ ID NO: 54213 - protein, 653 aa, Carboxydothermus hydrogenoformans Z-2901
MGKSFYITTPIYYPSDNLHIGHAYTTVAADTMARFKRMTGYDVWFLTGSDEHGQKIERKAKSQGLSPKEYVDPIVDSFKHLWKLLDISYDDFIRTTEERHKKVVQAIFQKLYDQGDIYKSAYEGWYCTPCEAFWTEGKLIDGKCPDCGRPVEWTREESYFFKMSKYADRLLKHIEENPEFIVPESRRNEMINFIKQGLEDLCVSRTTFNWGIPVPFDKKHVVYVWVDALTNYISALGYGTDDDHLFQKYWPADVHLVGKDIVRFHTVIWPIILLALGIELPKKVVGHGWFVLEGGKMSKSKGNVVDPVKLVEKYGVDAVRYFLVREMPLGLDAVYSEEALINRINVDLANDLGNLLNRTLSMLEKFLGGEIPLPSEYEEIDREVIELALALPAETEKLMDKFDLAGALANIWRLVTRLNKYIDEVAPWSLNKEGKIERLKTVLYVVLEGYRFITVLLKPVMPNFPAKVSAQLGVNDESLFTWESLSNWGRLPAGVKIKKGEPLFPRLDPEILLKTTDDQPLTTINAGTAATDKKEEKTVTEQGEEKSLITIDEFSQIDLRVARVLEAERVPKTDKLLKLKVTLGDEERTIVAGIAQYYEPEALIGKQLVIVANLKPAKLRGIESQGMVLAASGNGNLQVLFVDDQIPPGSKVK

SEQ ID NO: 54214 - protein, 221 aa, Larix kaempferi
KAAGARIIVTQAAYVEKLAELQSDDVIVITIDGVPKEGCQHISVLTEADETQCPSVEIHPDDVVALPYSSGTTGLPKGVMLTHKSQVSSVAQQVDGENPNLYFHSEDVILCVLPLFHIYSLNSILFCALRAGAAILIMQRFNLTTLLELIQRYKVTVAPFVPPIVLDITKNPIVSQYDVSSVRIIISGSAPLGKELEDALRERFPKAIFGQGYGMTEAGPV

SEQ ID NO: 54215 - protein, 442 aa, Arabidopsis thaliana
MAIIQLGSTCVAQWSIRPQFAVRAYYPSRIESTRHQNSSSQVNCLGASKSSMFSHGSLPFLSMTGMSRNMHPPRRGSRFTVRADADYYSVLGVSKNATKAEIKSAYRKLARNYHPDVNKDPGAEEKFKEISNAYEVLSDDEKKSLYDRYGEAGLKGAAGFGNGDFSNPFDLFDSLFEGFGGGMGRGSRSRAVDGQDEYYTLILNFKEAVFGMEKEIEISRLESCGTCEGSGAKPGTKPTKCTTCGGQGQVVSAARTPLGVFQQVMTCSSCNGTGEISTPCGTCSGDGRVRKTKRISLKVPAGVDSGSRLRVRGEGNAGKRGGSPGDLFVVIEVIPDPILKRDDTNILYTCKISYIDAILGTTLKVPTVDGTVDLKVPAGTQPSTTLVMAKKGVPVLNKSNMRGDQLVRVQVEIPKRLSKEEKKLIEELADMSKNRTANSTSR

SEQ ID NO: 54216 - protein, 185 aa, Triticum aestivum
  misc_feature (65)..(65): Xaa can be any naturally occurring amino acid
  misc_feature (162)..(162): Xaa can be any naturally occurring amino acid
  misc_feature (169)..(169): Xaa can be any naturally occurring amino acid
  misc_feature (173)..(173): Xaa can be any naturally occurring amino acid
  unsure (1)..(185): unsure at all Xaa locations
RVPREWTAQVEPGVHITFVSIPGGAGNDLKRIRFSREMFNKWEAQRWWGENYDRVVELYNVQTFXRESPVVLPPPSATAASRERPITRTTSYKAACHPSTAVPDPSDHVWAHHFNMLNSAAGAGASSMPSSAGAPAPYDPSRATTSSLDEASVSVSNASDLXAAEWVEXDEPXVHITIRELGDGT

SEQ ID NO: 54217 - protein, 299 aa, Arabidopsis thaliana
MMKKGTKRKIEIKKRETKEQRAVTCSKRRQTVFSKAADLCLISGANIAVFVTSPSDSSDVVYSFSGYSSAYEIADCYLNRKPPPKIVNPAGSKLGFWWEDPDLYHSCDDLSELSIIEDRLQRMKKHVMACLEKEEKSQLVSSFDQNPNSTCSLDVEDCDGSSYSQIASTFTPNSVNEYCSDQTFSSFHGDQNPNLSSPSFDQDCYSSLYQICGESSSQVASFDQNPSSEIQGFETEEEINQINLLLQETQTEANVNLDDEICFWNDLSNDDVFGLNSYFGLDNTNAMINFGDSDFRRHV

SEQ ID NO: 54218 - protein, 381 aa, Daucus carota
MATSQSSRPPHNFQHSYEDNNHHSQVVFDASIIQKETTIPKEFIWPDHEKPSLNTQELKVPLIDLGAFLSGDPSAAKESSILIGQACQEHGFFMVVNHGVDTNLISDAHKFMNLFFDLPLYVKQKAQRKLGENFGYASSFTGRFASKLPWKETFSFQYCADERMSSTTVKDYFTNKLGPDFAKLGKVYQDYSHAMSTLSLKIIDLLEISLGVSRSHFKNLFEDHDSIVRLNYYPPCQKPELTLGTGPHSDPTSLTILHQDHVAGLEVLVDDQWRCILPNTSAFVINIGDTLMAMTNGRYKSCLHRAVVNNETARKSIAFFLCPRKDKVVIPPAELVDQKNPRLYPDFTWAELLQFTQMHYRADMNTLDAFSTWLLTKNNRE

SEQ ID NO: 54219 - protein, 437 aa, Bordetella pertussis Tohama I
MSNTYFPRWRLADDTVPGAVIAPDERLSWPKNIAMGAQHVVAMFGSTVLAPLLMGFDPNVAILMSGIGTLIFFLFVGGRVPSYLGSSFAFIGGVVAVTGYVAPGANANIGVALGAIIACGLVYALIGLVVWAASARGNGARWIEAMMPPVVTGAVVAVIGLNLAPIAAKGAMGSSGFEASMALMTILCVGGIAVYTRGMVQRLLILVGLVLACVIYAVCANGLGLGAPMDFAKVAAAPWFGLPSFAAPVFEPQAMGLIVPVAIILVAENLGHVKAVAAMTGQDLDRYVGRAFVGDGVATMVSGAVGGTGVTTYAENIGVMAVTRIYSTLVFVVAAVIALVLGFSPKFGALIQTIPGPVLGGMSVVVFGLIAIAGARIWVVNQVDFSDNRNLIVAAVTLVLGAGDFSVKLGDFSMNGIGTATFGAIILYALLGLARRR

SEQ ID NO: 54220 - protein, 383 aa, Daucus carota
MAASTFLYHRHQQPFYPKSLVFDPSIIKNELNIPQEFIWPDHEKPSSHTPQLDVPLVDVGGFLSGDPVAAEKASKLVGQACREHGFFLVTNHGVDGNLISDAHKSMDLFFELPLMEKQKAQRKLGEHCGYASSFTGRFSSKLPWKETLSFEHSTKKTSSTLVEDYFASALGKDYAKLGKVYQDYCNAMSRLSFGIMELLAISLGIDRSHFKNFFEENNSIMRLNYYPTCRRPELTLGTGPHCDPTSLTILHQDDVGGLEVFVDNQWQSIPPNPSSFVVNLGDTFMALSNGKYKSCLHRAVVNKQNPRRSLAFFLCPQKDKVVRPPTELVDQDNPRLYPDFTWSALLEFTQKHYRADMNTLQAFSSWLTTFNNKEHLGEGHVIN

SEQ ID NO: 54221 - protein, 344 aa, Daucus carota
MLTEESYQTQYLDLNSIKELPESHTWTSLQDDCTDCLSNESESLPIIDLNDPDVLALVRHACETWGVLQVKNHGVSLRLLEDMEAATTKLFSLPIEQKLKVSLSSSNDISGYRLPKISPFFPKFMWREGFTIFGSPVEHAVKLWPQDYKPFCDLVEEYGKEMKNLAERLMWLMLKSLGITEEDINWSSLGGAAIQLNSYPVCPDPDRAMGLAEHTDSSLLTILYQNNTTGLQIFREGTGWLTVQPHTGVLVVNIGDLMHILSNGLYPSVLHRALVNRKQQRISVAYIYRPPANVLISPLPKLVDHYHLCLFRPITWTEYLELKSKHFTNTLSLIRISGSPNVVS

SEQ ID NO: 54222 - protein, 621 aa, Ustilago maydis 521
MPTVGVDKEHFYKALGRTYTTQEFDELCFQFGIELDDDTTEEVAKAGLGERAQLKIDIPANRYDLLCHEGISRALNVFLGNIAQPQIKLSQPENMIEIKLSKDVARIRPYFAGAVLRNVSFTAESYAHFIDLQDKLHQNLARRRTLVAIGTHDLDTISAPFSYEALPPKHIKFAPLNKEQEYDASQLMELYESDKHLSRYLHIIRDSPVYPIIYDSNRQVLSMPPIINSNHSKITLDTKNVFIDTTAIDETKLGIVINIIVAMFSQYCAEPFTVEPVKVVYPDGKVKVTPDLSNVRLPASVDYINRCTGLQLSPQQMIEYLKKMGHSATVDADAPTEKLIVDVPPTRPDILHECDLMEDVAVAFGFDNLPKTFPATNTVAAPLPINKLADIVRRECAYSGWIEVLPLILCSHDENFGWLKRKDDGTSAIVLENPKTAEYQVVRTSLLPGLLKTVRENRKHALPLRTFEVSDIALKDADELERCARNQRHVGAVYCDKTASFEVVHGLLDRLMLSLDIARIPACSTVADKGYWIQQDVDNPTFLPGRAATIHVRLPATTYNPGSATHHAHALDTIKHDLESSLPSHTDHVLGHIGVLHPHVLNNFSIDYPCSALEFILDPLL

SEQ ID NO: 54223 - protein, 292 aa, Streptococcus pyogenes M1 GAS
MSERLSGHTLLVSLLATPIRHSLSPKMHNEAYAKLGLDYAYLAFEVGTEQLADAVQGIRALGIRGSNVSMPNKEAILPLLDDLSPAAELVGAVNTVVNKDGKGHLVGHITDGIGALRALADEGVSVKNKIITLAGVGGAGKAIAVQLAFDGAKEVRLFNRQATRLSSVQKLVTKLNQLTRTKVTLQDLEDQTAFKEAIRESHLFIDATSVGMKPLENLSLITDPELIRPDLVVFDIVYSPAETKLLAFARQHGAQKVINGLGMVLYQGAEAFKLITGQDMPVDAIKPLLGDE

SEQ ID NO: 54224 - protein, 476 aa, Brucella melitensis 16M
MSADTTEKKATRTPRRRTPAYVKSLRGVKNWKQATEWLAWRDIEDIECITPDQAGVARGKMMPSKKFTSNTSLALPSAVFMTTISGAYPEDGYGFHYPEDDGDLKLLPDLTTLSAVPWETDSTAQVICDLVYQDGRAVEFTPRNVLRNVIAAYSKRGLKPVVAPEIEFYLVRKNPDPDYPLTPPVGRSGRAIGGGQGYSIAGVNEFDELIDDIYHFSEGQGLEIDTLIHEEGAGQLEINLRHGDPVELADQVFMFKRTIREAALKHDMYATFMAKPIQGQPGSAMHIHQSIVDKKTGRNIFTNEDGSESQAFHHFLGGMQRHVPNALVMFAPYVNSYRRLTPDASAPVNVKWGYDNRTTAFRVPRSDPSARRVENRIPSSDANPYLALAASLACGLIGLVNKIEPEQPATTSVNTKEVELPRGLIDAVELFEEDAELRNLFGSSFMTTYAAIKRAEFETFMEVISPWEREFLLLNV

SEQ ID NO: 54225 - protein, 398 aa, Carboxydothermus hydrogenoformans Z-2901
MVLEIKARSRFFYKFTAFMGPAFLVSIGYIDPGNWAANFAGGSRYGSIMLITVLLCNFLAILFQSLVAYLTLKTGKSLAENIVEKLPKPLVAFYGVLAVTGAMATDVAEFVGAALGFSLILGLDLLKSVIIAVVFVVCGYFFERQGNRKVEFLIMGFLAAIGFTYLMELLILKPKIYNLINLGVKLDGDFLFVVLSMLGATVMPHNLFLHSDLIAEKLKQRIITTKDFPVVFLENLIALNLAFLVNSAMIVVAKDMFYDCGVAVDSLRLAYHTLEPVLNGWAALIFGLALVLCGLSSSLTGTIAGQNLLEKFLPVNLSALSRKMIIITPALYFFLKGLGEIELLLLSQVVLSFVLPFVLIVLLWFLNNIANKYLLILGWFLTAIIGSCNVILLWTAIF

SEQ ID NO: 54226 - protein, 287 aa, Arabidopsis thaliana
MAKLRHSRFQARKWSTLMLVLFMLFMLTIVLLMLLAFGVFSLPINNDESSPIDLSYFRRAATERSEGLGKRGDQWTEVLSWEPRAFVYHNFLSKEECEYLISLAKPHMVKSTVVDSETGKSKDSRVRTSSGTFLRRGRDKIIKTIEKRIADYTFIPADHGEGLQVLHYEAGQKYEPHYDYFVDEFNTKNGGQRMATMLMYLSDVEEGGETVFPAANMNFSSVPWYNELSECGKKGLSVKPRMGDALLFWSMRPDATLDPTSLHGGCPVIRGNKWSSTKWIHVGEYKI

SEQ ID NO: 54227 - protein, 471 aa, Arabidopsis thaliana
MASLLIFPHLHHFDSSLDRREVLVVRHSQASRRFLTPKASINGSGITNGAAAETTSKPSRKGRKKKQTSTVIEKDNTETDPELNPELADYDDGIEFPYDDPPLVCCFGAVQKEFVPVVRVHDNPMHPDMYSQWKMLQWDPPEFGRAPGGPPSNVAISHVRLGGRAAFMGKVGEDDFGDELVLMMNQERVQTRAVKFDENSKTACTRVKIKFKDGKMMAETVKEPPEDSLFASELNLAVLKEARIFHFNSEVLTSPTMQSTLFTAIQWSKKFGGLIFFDLNLPLPLWRSRNETRKLIKKAWNEANIIEVSQQELEFLLDEDYYERRRNYTPQYFAEDFDQTKNRRDYYHYTPEEIKSLWHDKLKLLVVTDGTLRLHYYTPTFDGVVIGTEDVLITPFTCDRTGSGDAVVAGIMRKLTTCPEMFEDQDVMERQLRFAVAAGIIAQWTIGAVRGFPTESATQNLKEQVYVPSMW

SEQ ID NO: 54228 - protein, 1475 aa, Sorghum bicolor
MDGEQAARWAAAQEGVPVGADLVAAALRQLKFLAAVDRRRWLYDEGPLLHRAIRRYKACWLPLLDKHTKAAVVDGPLVVPLDCEWIWHCHRLNPVHILTMMILCNSQLSVLIIQAHIFQVQYIRDCKKVYGRILNNNNVESSTQTKSILQSEKIWKELYPEEPFKLEFTKTSDVVMDVNPGVAEDITYDLVSAVKRQSSFYYQVGTPTMHDSRFLQEALARYKAFLYLIKMNQEKGLQRFRVPTYDVDLLWHTHQLHPVTYRNDMVKLLGKVLEHDDTDADRSEGKKLDVGFTETTEQFENTFGVRYWKAGCMYRGNMPSPVTSTPQIFSTEVGTGSDICKAQKDLNALDITAVELYLQIVDINNLPSAVRKENVYVRFTKNQPDTFISDGGKLDISTVTGKNAGVCLQCEPTGELILVVMVDQVSKKPEPIGKVSFPLQDLIGPDSKLSFEKWFELKAHGGHATSPPVSLRVAASATVPSSFQKVFSMVMMEPFSLKSCLLPHSIKDQNMSSWTRFVYDCGTELIRLQIREQKAKNGMAAVRELVGVLKSPKKQFQLAEFKENKWTLKDSMLSITHGTDGSLLDLKGDNQLIKLYQGRKLEYERKCCSAHSEDVSAVTAVKFCAEHPYGKAVALLDTESQLIMVNEDWFLLPWITTSVLFMDADGKDSMKLIGGAVVQKGAVFGSDTSMVLETQAVGAGSVATAPAQCGTCSTAFSGDKVVAGFKAEHASSGASRTVVVSGENSHTESASGCGGGCGSSCGPMVAEDSKADNAKSGGCGSGCGGGCGGGGGCGTMLKASTMASEGQSRSGGCGSGCGGGCGGGGGCGTMLKASTMASEGQSKSGGCGGGCGSGCGGGCGSGMAIEGSKTANHAKSGGCGSGCGGGCGGGGGCGTMLKASTMASVGQSKSGGCGGGCGSGCGGGCGGGMAIEGSKTANHAKSGGCGSGCGSGCGGGCGTLFSSSTAADQGHSRSSGGCGSGCGGGGCGSGSMVAEGSTGRHAKSGGCGSSCGGGCGGGGGCGTIFNVSTKAGGEGKHSVSGGCGSGCGVLHAVLRVELSRRGISAASGEKSRADATRAARREDRDASGQTRRERADGGQSGGSLAARLKIARVSILKIARVDGRRESREDRLVRPSLYLSTSPWTTPSSSVGTPLFSGNVVSAQLQEDVVESQSPDVTVGGRRAKKGTSHRQKKFDIEEDKVICSAWLNVSKDPINGANQGRSTFWGRIRAFFEKHKDKKTAVCVRTESSIMHRWLTIQRDVNKFCSCYEKIERRNASGATIQDMINAALETYIGADEENKPFTLMHCYLKLKEEDKWKSLRIELAQKNKKQKTTKESTPSNVEASNNDEIPEVAAPDSEERKRPKGQKQVKQARRDDASLAVLEKMLEKKEARELERDKAREASLEIERASLEIEKAALEIEKKRLSNEEKKIEAELMKEEKDIMLADKTSLDEEQLQWLQIMKNKILARHTGN

SEQ ID NO: 54229 - protein, 221 aa, Larix gmelinii var. olgensis
KAAGARIIVTQAAYVDKLADLQSDDMIVIAIDGAPKEGCQHISILTEADETQCPSVEIHPDDVVALPYSSGTTGLPKGVMLTHKSLVSSVAQQVDGENPNLYFHSEDVILCVLPLFHIYSLNSVLLCALRAGAGTLIMQKFNLTTLLELIQRYKVTVAPIVPPIVLEISKNPIVSQYDVSSVRIIMSGAAPLGKELEDALRERFPKAIFGQGYGMTEAGPV

SEQ ID NO: 54230 - protein, 362 aa, Triticum aestivum
SICRLFSYEELKLATSNFSPDMLIGKGGTSHVYKAPDAGGALYAAKILKPSVDALQEFITEIETVTSLQNENMVSLRGFSFDNYFLVWVYDYMHQGSLDKALHGKCEHSLSWEKRNKIAIHIAKALEFLHHGGVTESVIHGDVKSANILLSEDFEAQLCDFGLAKKVSASTPHLTCTDITGTFGYMAPEYFSHGKVNKKIDVYAFGVVLLEIIPGRKPIITGCAKGQESLVGWARPLLSSGEIKQLVDSALGNDYDCDEMERMTLAASLCTRTSSDSRPETPLVLKLLEGDDETVQWARSQMCAGSDVSDEEAMTPRSNMQSHLNLALLGVDEEDTLSRCSTEQTADTSADGGYWSRSSSFD

SEQ ID NO: 54231 - protein, 252 aa, Prochlorococcus marinus subsp. marinus str. CCMP1375
MSIFVGNLPFRAEQEDVIQLFAPYGEVANCSLPLERDTGRKRGFAFIEMADEAAEAAAIEALQGAELMGRPLRINKAEPRGGGGGGRGGGYGGGGRGGYGGGGGYGGGGGYGGGGYGGGGGQGGYGGGGQGGYGGGGQGGYGGGGQGGYGGGGQGGYGGGGQGGYGGGGQGGYGGGGQGGYGGGGQGGYGGGGQGGYGGGQDTEQRASGAQGWEDRSYGSSDSSERDDTRSKRRRGASSEADQDADYGGAEG

SEQ ID NO: 54232 - protein, 221 aa, Larix gmelinii var. olgensis
KAAGARIIVTQAAYVEKLAELQSDDVIVITIDGVPKEGCQHISVLTEADETQCPSVEIHPDDVVALPYSSGTTGLPKGVMLTHKSQVSSVAQQVDGENPNLYFHSEDVILCVLPLFHIYSLNSILFWALRAGAAILIMQRFNLTTLLELIQRYKVTVAPFVPPIVLDITKNPIVSQYDVSSVRIIISGSAPLGKELEDAPRERFPKAIFGQGYGMTEAGPV

SEQ ID NO: 54233 - protein, 331 aa, Neurospora crassa
MSSVKQSAQAATSDVVDTAKNATAETVTAATDFLHTPAVRAALPFINGGLSGMVATTVIQPIDMIKVRIQLAGEGKAGGPKPTPLGVTRDIIASGKAMDLYTGLSAGLLRQAVYTTARIGCFDTFMSRLSARAKEKGQSVGFKERASAGLAAGGLAAMIGNPADLALIRMQSDGLKPVAERKNYKSVIDALGGIARNEGVAALWAGAAPTVVRAMALNFGQLAFFSEAKAQLKARTQWSSKVQTLSASAIAGFFASFFSLPFDFVKTRLQKQTRGPDGKLPYNGMVDCFAKVAKQEGVFRFYRGFGTYYVRIAPHAMVTLLVADYLGWLTK

SEQ ID NO: 54234 - protein, 378 aa, Prochlorococcus marinus subsp. marinus str. CCMP1375
MADFYDTLGVNRNADADSLKRAYRRLARQYHPDINKEAGAEERFKEIGRAYEVLGDPEKRARYDQFGEAGLGGSAGMPDMGDMGGFADIFETFFSGFGGPGSSGARTQRRGPQQGDDLRYDLTIDFNQAVFGQEREIKIPHLETCDVCRGTGAKPGTGPTTCSTCGGAGQVRRATRTPFGSFTQVSDCPTCSGSGQVISDSCQSCGGQGVKQVRKKLRINIPAGVDTGTRLRVSGEGNAGPRGGPSGDLYVFLKVKSHARLKRDGLNIHSEVNVSYLQAILGDTIEVDTVDGPTTLQIPSGTQPSAVLILDNKGIPKLGNPVARGNHCISVNIKIPSRLTDDEKILLEKLAIYYSAKGPQNHHHNSGLFSRLFKSNAS

SEQ ID NO: 54235 - protein, 655 aa, Rhodopseudomonas palustris CGA009
MANAIRFLAIDGVEKAKSGHPGMPMGMADVATVLFTRFLKFDPADPAWADRDRFVLSAGHGSMLLYALLHLTGYPDVTIDQLKSFRQWGSKTPGHPEYGHTQGVETTTGPLGQGLATSVGMALAERMMNARYGDALVDHHTYVIAGDGCLMEGVSHEAISLAGHLKLNKLIVLWDDNHISIDGDTSLSCSDDQLARFAASGWATTRVDGHDPEAVAAAIEQAKKSDRPSLIACRTTIGFGSPKVAGTEKAHGAPLGADEVEKTRAALNWPHPPFEIPDPILARWREAGGRGKAAHEAWTQRLAAADAATRTGFTDALAGKLSADYEGALQGLIAKFDADKPTIATRQASQLTIDAIVPASPNILGGSADLTHSNLTHAKGTASVKPGAFGGSYLHYGIREFGMAAAMNGIALHGGFVPFGGTFLVFADYSRPAIRLAALMGVRVIHVMTHDSIGLGEDGPTHQPVEHVPSLRAIPNVLVFRPADAIETAQAWDCALKQTSRPSVLALSRQGLPALPRPNGATGNPVARGAYVVVDPGQRDVTLIATGSEVSLALDAASKLEAEGIKAAVVSAPCFELFADQDDAYRASVLGTAPRIGIEAARDTDWRRWIGDTGAFVGMTGFGASAPAPVLYQKFGITADAVVDAAKGAIARGKH

SEQ ID NO: 54236 - protein, 221 aa, Larix sibirica
KAAGARIMVTQAAYVEKLADLQSDDVIVITIDGVPKEGCQHISVLTEADETQCPSVEIHPDDVVALPYSSGTTGLPKGVMLTHKSQVSSVAQQVDGENPNLYFHSEDVILCVLPLFHIYSLNSILFCALRAGAAILIMQRFNLTTLLELIQRYKVTVAPFVPPIVLDITKNPIVSQYDVSSVRIIISGSAPLGKELEDALRERFPKAIFGQGYGMTEAGPV

SEQ ID NO: 54237 - protein, 223 aa, Pseudomonas syringae pv. tomato str. DC3000
MTQDQLKQAVAQAAVDFILPKLDDKSIVGVGTGSTANCFIDALAKHKGAFDGAVASSEATAARLKGHGIPVYELNTVSDLEFYVDGADESDEHLNLIKGGGAALTREKIVAAVAKTFICIADGSKLVPVLGAFPLPVEVVPMARSHVARQLVKLGGDPVYREGVLTDNGNIIIDVHNMSITNPVELEASINAIVGVVTNGLFAARPADLLLLGTAEGVKTLTR

SEQ ID NO: 54238 - protein, 468 aa, Pediococcus pentosaceus ATCC 25745
MVVGTQAINVDTLIIGSGPGGYVAAIRAAELGQKVVIVERDYIGGVCLNVGCIPSKALIQAGHLYSTLQHGNPFGVSVSESKIDFTKTQEWKQNQVVNKLTGGVELLLKKHKVAIVRGEAYFNDNETVNVINGDDSHVYRFKRALIATGSRPVEIPHFKFSGRVIDSTGALNLKDVPEHLIIIGGGVIGAELAGAYMNLGSKITIIEGLDHILNGFDGELIQPVLNNFKKNGVEIVTEATAVEANQTDKDVTVTYEADGTTKTVNGDYCLVSVGRRPNTDQLGLNNTNIKLSKRGLIEVNDSMQTSVKHIYAIGDVVAGPALAHKASFEAKVAAAAMGGEDAHDTHYVLPAVAYTNIELATVGETPQSIAEKKLDAKSSKFPFAASGRAMTMDQTEGFIRLITDNPTGGIIGAQIVGPEASNLISELTLAIENGLTIKDIELTIHPHPTLGEEIMDAAELAAGLPIHV

SEQ ID NO: 54239 - protein, 343 aa, Rhodopseudomonas palustris CGA009
MDQGQTLSVLLDSYAVDPQKKAVAAAVGAIAAGSIEISELIGQGALAGITGAAHGGSNADGDVQKDLDVKAEQIIVKSLKDVPYAALASEESDTLLDGDPNAPISIAYDPLDGSSNIDTNMTVGTIFSIIPNQPGVKPFTAAGSCQIAAGFVVYGPQTSLVLTLGDGVNIFTLDRKAKVYRLIRERVKVPADTAEYAVNASNHRHWEQPIRDFVDECIAGADGPRAKDFNMRWIGSLVAEVYRILTRGGVFLYPGDNRPGYGNGRLRLLYETHPMSFVMEQAGGAASTGRERVLDLTAKTIHQRSPLIMGSIDKVKRIELLHTDPSAASRSAPLFARRGLFRV

SEQ ID NO: 54240 - protein, 429 aa, Pediococcus pentosaceus ATCC 25745
MTEIFKMPDIGEGMAEGEIANWLVKVGDTIKEEDAVAEVQNDKLLQEILSPYGGKITKLFVEAGTVVKVGEPLIEFDGDGSGAGAESEVPKETPASTEPEPESSAPVDQTAPEVTKVGAEYTSNGQLLAMPSVREYARKNDIDLTQVPATGRHGHITMADVENFKASPAPAASVPETESEKAPSAPVTPAAPAEVKAGRVPLSPVRKVIAKTLTNQVQTIPHVTIMDEVEVSKLMDLRNQFKEQAKQKGYKLTYMPFIAKALAGAAHKYPELSAMVDIEKQEIVYYEDTNVSFAVDTDNGLFVPNVKNVKSKSIMEVAQEIDDMAIRGRAGDLKPNELKGGTVTITNIGSESGSGFFTPIINPGESAILGIGRIRKTPVVNEDGELAVGNTLKLSLSFDHRLIDGALAQKIMNELKALLSNPAYMLMEV

SEQ ID NO: 54241 - protein, 208 aa, Zea mays
FIAHIGDSCAVLSRSGQIEELTDYHRPYGSSRAAIQEVKRVKEAGGWIVNGRICGDIAVSRAFGDIRFKTKKNDMLKKGVDEGRWSEKFVSRIEFKGDMVVATPDIFQVPLTSDVEFIILASDGLWDYMKSSDVVSYVRDQLRKHGNVQLACESLAQVALDRRSQDNISIIIADLGRTEWKNLPAQRQNVVVELVQAATTIGLVTVGI

SEQ ID NO: 54242 - protein, 172 aa, Clostridium perfringens str. 13
MSLKDKIRVIEDFPKKGISFKDITTLIADGEGLRDSVDQMAEFFKDKNIDVVVGPEARGFIFGVPVAYALGVGFIPVRKPGKLPGDTVRVEYDLEYGKDALEIHKDAIKPGMRVAIVDDLLATGGTIAAVAKLVEQAGGEVAGLAFTIELTELKGRDKLKGYEVTSLVDYDV

SEQ ID NO: 54243 - protein, 107 aa, Neisseria gonorrhoeae FA 1090
MDNCIFCKIAAKEIPAQTVYEDGEMVCFKDINPAAPLHLLLIPKVHFDSLAHAAPEHQPLLGKMMLKVPEIAKASGLTDGFKTLINTGKGGGQEVFHLHIHIMGTPV

SEQ ID NO: 54244 - protein, 632 aa, Ustilago maydis 521
MSSTSSTIAGPSQSKVEINSRGIPHAPFISNVQEYLGGPDEEVEPTLKKFQETMSKYKFMELNTAQRRRGLEEKIPDIRKTLQMVNFLKDKKDDPEPIETTFELNDTLYAKATLDPTDTVHLWLGANVMLEYPLDEAISLLTSKLNGAEKSLTTSKEDLDFLREQITIMEVNTARVHNWDVKRRRERREELERGGLAERAATGSKTSQASNQAFNERLQESHHCCCRNQEVSVTETSPCLLCLPFWHSTSGGGWLFDDRDKSETGAGKNETGAVFQESAKGGAKPRDGTNAAVDPPASSKTTAQLDGVGGSRRLSTDVVLTESQVASEAATTHLSANSMLTTPNDVPLPSQTGNHSDPIALTKLAPTSAPPPHSTLPASPLSLPHATDPLSSTTLIVPPLNFAMVSRGIYRSGHPNERNFEFLRRLSLKTVLYLGTEDYRSNMTNWTASQNITTHHLRLAINKEPTAEMDHADVVKALQLILKPENWPILIHCNKGKYRSWSHTSIFEEYSSFDDAGSLPLPHFDLACGAWTTDKFHQQTTTTTAAAAAVVGRPSHVADDRRLNIIVDVIAKRRTCRLARGRCGWGKEVERITMDIGVGIIQSIVNRIGRTHYISLRVPCMPLRKPTSCCLA

SEQ ID NO: 54245 - protein, 410 aa, Pseudomonas putida
MANHVAIIGNGVAGFTTAQALRAEGYEGRISLIGEEQHLPYDRPSLSKAVLDGSFEQPPRLAEADWYSEASIEMLTGSEVTDLDTQKKMISLNDGSTISADAIVIATGSRARMLSLPGSQLPGVVTLRTYGDVQLLRDSWTPNTRLLIVGGGLIGCEVATTARKLGLSVTILEAGDELLVRVLGRRIGAWLRGLLTEQGVQVELKTGVSGFSGEGQLEKVMVNDGRSFIADNALICVGADPADQLARQAGLECDRGVVVDHRGATSAKGIFAVGDVATWPLHSGGKRSLETYMNAQRQATAVAKAILGKEVSAPQLPVSWTEIAGHRMQMAGDIEGPGEYVLRGTLGIGSALLFRLLDGRIQAVVAVDAPRDFALANRLVEAQVIIEPEKLADVSNNMRDIVRANEGNQK

SEQ ID NO: 54246 - protein, 353 aa, Daucus carota
MPSRVSDSLALHPVFQHNHNQYLDLNSLEELPDSHAWSSELDKLSSSPDDHGESNLPVIDLSDSINGPKHLVHACKTWGAFQLINHGISNQLIDSMEAATRKLFSLPIEQKLKAERQEGGCGYGPFRISSFFPKRMWSEGFTIVGSPLQHARLLWPEDYSVFCDVTEEYQKEMKKLAGKIMWIMLEALGITKEDIIWAGPNGEFEASGAALQLNSYPVCPDPDRAMGLADHTDSTLLSILHQSNQSGLQVFQEEMGWVTVPPVEGALVVNIGDLLHILTNGSYPSVLHRVTVNRERHRYSMAYLYGPPHSAEISPLSKLVDHQHPPLYRPVTWSEYLGMKAILFYNALSSLRL

SEQ ID NO: 54247 - protein, 536 aa, Arabidopsis thaliana
MNPPVDLPYIPDDLLLNCLARVSRLYYPILSLVSKRFRSLVASLELYEIRKLLGHREKCLYLNLRFSSESEPRWFTLCRRPTRSPNPNFNSGWFASCFIPHTMKKEKKSSDNNLMVPVPTSNFITPPSELTRITNGSNIYIVRVFTNGAFSSRFLFMDCRSHTLHEVPRMDKTKKKPFMIRVLDGKIYVIEGCKNPDYSNLIERFDLKTQTWEHVPSPSAEIRGSYITGSLVYDGKLYLFGDKRVVYKPKENKWDVVGLEMPLRWTPSYISCVVDNVIYSYGRSRVLMWYNTEERLWRYLKGLKKLPKLPKDCTCVRLLGYSGKVVVLWEKNVGGGDPQKKMIWCAEIALERRSANKIYGKIEWCDVVLTLPSLAIDGKLYLFGDKNLVYKPKEKTWDVVGFEINFHWIPHDSFCVIDKVIIYYYNRHSRLLEWYDPEGSSWGILNGLEELLPKLPRVLVSRHVRLVDYGGKVAIFWEKEVRPLIGYNKITIWCAEIALERRNAQEIYGKIEWCNVVLTLPSSCSIDELNAVSIIV

SEQ ID NO: 54248 - protein, 266 aa, Clostridium scindens
MRLKDKVILVTASTRGIGLAIAQACAKEGAKVYMGARNLERAKARADEMNAAGGNVKYVYNDATKEETYVTMIEEIIEQEGRIDVLVNNFGSSNPKKDLGIANTDPEVFIKTVNINLKSVFIASQTAVKYMAENGGGSIINISSVGGLIPDISQIAYGTSKAAINYLTKLIAVHEARHNIRCNAVLPGMTATDAVQDNLTDDFRNFFLKHTPIQRMGLPEEIAAAVVYFASDDAAYTTGQILTVSGGFGLATPIFGDLSERSDARG

SEQ ID NO: 54249 - protein, 607 aa, Candida albicans SC5314
MSYKGNDIEKQQSASTATGFNDKQIASTSEDATDRSHNIHGDTSSLDSRYTYETVDQEKNYFKRVYNSFKPMNLEEQGIDTSQLTPVERTIIASAKHPLARRLKARHLQMIAIGGSIGTGLFVGSGYALANGGPGAVLIGYVIVGYALLTVVNALGELSVQFPVSGSFNAFFSRFLEPSFGGTFGILYAASWCISLPSELIAAAMTIQYWNTEVNPAVWVAVFWVVIVVINLFGVKGYGEMEYFLSIIKVLAVVGFIILGICITCGVGDQGYIGGKYWHNPGAFNHGLKGVTSVFISAAFSFGGIELVALAASETANPRISLPAAVKSTFWRIFIFYILTAIIIGCLVPYTNDDLLNGTGIAASPFVIAVSQGGIRVVPHIMNAVVVIAVISVGNSSVYGCSRTLASLAVQGLLPKSMGYIDRGGRPLIAILFTSAIGLLGFLVVVDNEGDVFTWFFSICSLSSFFTWGAINVVHLRWRFALAAQGRSTDEIIFRSPLGTFGSWTGILVLILIVIGEVWVSIWPIGSPADVQQFWKNCLSLPLMIVMWAGFKTYHRSWNMLWVKLEDIDLDTGRREIDVELLKQELAEERQIIKSKPFVYRIYKFFF

SEQ ID NO: 54250 - protein, 816 aa, Oryza sativa (japonica cultivar-group)
MAILTVLPLVLVMLLLPLAAIASGDPPWQHYCGSSGNYTAGSKYQANLQALAATLPSTASSSSPALFAKDAAGGGDAEPDRVFALTLCRGDTASANASSSSCADCASRAFRDAQSVCPYSKEVAVYYDPCLLYFSGDDFLSSPANPAQVRLYDVDRSTRRGGGGADFVTLVRALLSYTMQWAVPYNSTGGGAAAVRWYTTVRMDVVTPPLFSLMQCTPDMSGGDCRQCLQDLVGNTTFNGSVSGVRNIGARCGYRYDTYKFYGGEPKLKIGSLSEINSTAPSSPPPPPPVTETRSGRKKVLTVALLVPLIALCPVVIFCFAWIRRLRNHKSMLRKKDTMAREEVLKLWRLEESDSEFMLFDFSQIEDATSNFSEDKKLGEGGFGSVYKGQLPNGLEVAVKRLAAHSSQGLVEFKNEIQLIAKLQHTNLVNLRGCCIQGEENLLIYEYMPNKSLDFFIFDLKRAALLNWKTRLNIIEGITQGLLYLHKHSRLCIIHRDLKASNILLDRDMNPKISDFGLAKIFDSNDVQRNTKRVVGTYGYMAPEYASEGCFSLKSDVFSFGVLVLEIISGKRNAGFHQYGDFFNLLGYAWQLWKDGSWHELVDPSLVSEGQMMEIKKCMKVALLCVQENAVDRPTMSAVVKMLSSELKILPEPKQPAFFNVRVKHGELSNTAPSSINDVTITIVNGREMSIRRREIFLQSSSMRQMVATRRSRLRPCRRGCLWNGVARCYPMCRALYFAAPEIEPSPEWKHEYTGSAAARSNKSTANLGGAPRSHKATNLFAAPVRIDNYSMCAITRVHDAIYGSGRISSGSMSRR

SEQ ID NO: 54251 - protein, 932 aa, Nocardioides sp. JS614
MTEDPTPASGPTPGTDTKRSGAIPTVIHEGLPTQLPDTDPDETTDWIDSFDSLVGERGRERARYVMLRLLERAREMQVGVPALRSTDYINTIPPEREPWFPGDEETERRIRAFIRWNAAVMVSSANRKGLEVGGHIATYQSSASLYEVGFNHFFRGKDHPGGGDQVFIQGHASPGIYARAFLEGRLTETQLSRFRQEVQHGPHAGLSSYPHPRLMPEFWEFPTVSMGLTSLNSIYQARFNRYLHNRGIKDTAQQRVWAFLGDGEMGEPESLGAIRVAAREELDNLVWVVNCNLQQLDGPVTGNGKIIQELEANFRGAGWNVIKVVWGREWDQLLARDVDGVLVNRMNSTPDGAFQTYSVESGEYVRESFFGADPRLRKMVEHMSDDQIRKLPRGGHDYRKVYAAFDAATKHVGQPTVILAKTVKGWTIDALEGRNATHQMKKLTQDDLKKFRDRLYLPISDRDLERTYEETGAAPFFHPGMESPEIEYMLERRRQLGGSIPQRVQRAKPLQLPGDAMYADLKQGSGKHAIASTMALVRLLKDWMKDPEIGKRIVPIAPDEYRTFGMDSMFPSAKVYNPGGQQYESVDRKLLLSYKESAQGQLLHEGISEAGGVASATAAGSAYSTHGEHMIPFFIFYSMFGFQRTGDSIWAMSDQLARGFLIGATAGRTTLTGEGLQHADGHSPLLAASNPAVVHYDPAFAYEISHVMRSGLERMYGPDAEDVIFYITVYNEPVQQPAEPEDVDVEGILKGIHHVSSADGEGPRAQLLASGVGFPWIKEAQQILADEWGVRADTWSVTSWNELARDGAAAEEWNLLHPGETPRTAYVTDKLAGASGPVVAVSDYMRAVPLQIARWVPADYRVLGADGYGFADTRPAARRFFHIDAQSVVVQTLQALADAGQIDRSKVEEAFAKYRIDDPTAVAGVKQEGGDA

SEQ ID NO: 54252 - protein, 534 aa, Oryza sativa (japonica cultivar-group)
MEEATGMEVGVSLEAGKPAAAPWGMLYYGVPALLVLGALYRAAERCWLGPRRVAGALQGQGLRGTAYRFPAGDLPENARRSKEARAKPMPPCHDIVPRVAPLLQDIVKEYGNVCITWFGTTPRVVIAEPELVKDILSNKFGHFEKFTLKSLGKLIALGLASYEGEKWARHRRILNPAFHLEKLKHMLPAFSTCCSEMIDRWDSKLAGSDGPFELDIWQEFQNLTGDVISRTAFGSSFMEGRRIFQLQEEQADRIIKTIQYIYIPGYLYFPTENNRRMKENSREIEGLLRGIIEKRSRAVENGELSGDDLLGLMLKSNMDSGEPSNLRMSTEDVIEECKLFYFAGMETTSVLLTWTLVVLSMHPEWQHRAREEVLSAFGRDKPNFDGLSRLKTVTMILHEVLRLYPPAVTLSRRTFKEIQIGGITYPAGVGLELPIILIHHNTDVWGKDAHEFKPERFADGISKATKTNQQAFFPFGWGPRICIGQNFAMLEAKMALCVILQNFEFQLSPSYTHAPYASVTLHPQHGAQIILTRL

SEQ ID NO: 54253 - protein, 432 aa, Carboxydothermus hydrogenoformans Z-2901
MPLKIDRSIEAFSEAKKVIPGGVNSPVRAFKSVGLNPVFIERGEGSKIYDIDGNCYIDYVGSWGPLILGHRHPKVEEALANCLKKGTSFGAPTLLETEMAEIIVNAFPAMDMVRMVNSGTEATMSAIRLARGFTGRNKIVKFEGCYHGHADSLLIKAGSGALTLGVPTSPGVPANIANNTITAQFNDLALLEEIFAQEGNDIAAVILEPVAGNMGVVPPKPGFLEGVRELTRKYGALLIMDEVMTGFRVHWGGAQVLYNVEPDITTLGKIIGGGLPVGAYGGRREIMEMVAPAGPVYQAGTLSGNPLAMTAGIATLTVLKEEGVYEQLEEKSSYLESGLKEAARAAGLKLWFNRVGSMLCTFFTSEEVVDYKTACTSDTQKFAVFFKTLLENGIYIAPSQFEAMFVSLAHSKDDLDKTIEASYKAFKAAAEN

SEQ ID NO: 54254 - protein, 221 aa, Larix occidentalis
KAAGARIVVTQAAYVEKLTDLQSDDVIVITIDGVPKEGCQHISVLTEADGTQCPSVEIHPDDVVALPYSSGTTGLPKGVMLTHKSQVSSVAQQVDGENPNLYFHSEDVILCVLPLFHIYSLNSILFCALRAGAAILIMQRFNLTTLLELIQRYKVTVAPFVPPIVLDITKNPIVSQYDVSSVRIIMSGSAPLGKELEEALKNCFPKAIFGQGYGMTEAGPV

SEQ ID NO: 54255 - protein, 221 aa, Larix occidentalis
KAAGARIIVTQAAYVDKLADLQSDDMIVIAIDGAPKEGCQHISILTEADETQCPSVEIHPDDVVALPYSSGTTGLPKGVMLTHKSLVSSVAQQVDGENPNLYFHSEDVILCVLPLFHIYSLNSVLLCALRAGAATLIMQKFNLTTLLELIQRYKVTVAPIVPPIVLEISKNPIVSQYDVSSVRIIMSGAAPLGKELEDALRERFPRAIFGQGYGMTEAGPV

SEQ ID NO: 54256 - protein, 249 aa, Triticum aestivum
MASTNGGFVSPLAATVPVEAVLFDIDGTLCDSDPLHHVAFQELLLAIGYNNGVPIDDEFFINNIAGRSDAEAAQNLFPDWPLEKGLKFLEDKDVKYRSLAMERLEPVKGLHKVVQWVKDHGYKRAAVTNAPRINAELMIKLLGLSDFFQAVIVGGECEKPKPAPFPYLKALKELEVSAAHTFIFEDSASGTRAGVAAGMPVVAVSTRNPEKSLQEAGAALIISDYEDQKLWNTLEEIDREEAKLKTGGA

SEQ ID NO: 54257 - protein, 340 aa, Prochlorococcus marinus subsp. marinus str. CCMP1375
MTLRVAINGFGRIGRNFMRCWLSRGENTGLDLVGVNVTSDPKTNAHLLKYDSILGQIKDAEIDYTDDTFVINGKTIKCFSDRNPMNLPWREWGIDLVIESTGVFNTFEGASKHLQVGAKKVILTAPGKGEGVGTFVVGVNADQYRHDDFNVLSNASCTTNCLAPIVKVLDQSFGINKGLMTTIHSYTGDQRILDNSHRDLRRARAAAMNIVPTSTGAAKAVALVYPEMKGKLTGIAMRVPTPNVSAVDLVFESGRSITADSINAALKSASEGSMKGIIKYGDTPLVSSDYAGTNDSTIVDTALTMAIGDNLGKVVAWYDNEWGYSQRVVDLAEVVAKNWK

SEQ ID NO: 54258 - protein, 221 aa, Larix occidentalis
KAAGARIVVTQAAYVEKLTDLQSDDVIVITIDGVPKEGCQHISVLTEADETQCPSVEIHPDDVVALPYSSGTTGLPRGVMLTHKSQVSSVAQQVDGENPNLYFHSEDVILCVLPLFHIYSLNSILFCALRAGAAILIMQRFNLTTLLELIQRYKVTVAPFVPPIVLDITKNPIVSQYDVSSVRIIMSGSAPLGKELEEALKNCFPKAIFGQGYGMTEAGPV

SEQ ID NO: 54259 - protein, 354 aa, Carboxydothermus hydrogenoformans Z-2901
MKALILSGGQGTRLRPLTYSIAKQLVPVANKPILHFVIEDIINAGITDIGVIIAPETGEEIKKSITNAGFPAKFTFILQEKPLGLAHAVKVAKDYLEDDDFIMYLGDNLINSGIKEFVEEYKENRYDATILLKEVQDPTRFGVAVVDENFKVQRLIEKPKEPPSNLALVGIYIFSPKIFSAIDRIKPSWRGELEITDAIQELINQGGMVKAHKITGWWLDTGKKDDLLEANRVVLDDLIQRDIRGKIDEQTKINGRVVIEGGAEIENSIIRGPAVIGKNTKVKNSFIGSYTSIGNNCLVENSAIEFSVILDHSEIIGVERLDESLIGRKTRVIKDGSVNKAVKLMIGDDAEVRL

SEQ ID NO: 54260 - protein, 378 aa, Medicago sativa
MAIHHHHQQHTCSLFDALYCDEEKWEDDEGEVVDEGEQSDVTTTNYDILDSTSLLPLLLLEQNLFNEDEELNTLFSKEKIQQETYYEDLKNVINFDSLSQPRREAVEWMLKVNAHYGFSALTATLAVNYLDRFLLSFHFQKEKPWMIQLVAVTCISLAAKVEETQVPLLLDLQVQDTKYVFEAKTIQRMELLILSTLKWKMHPVTTHSFLDHIIRRLGLKTNLHWEFLRRCENLLLSVLLDSRFVGCVPSVLATATMLHVIDQIEQSDDHGVDYKNQLLNVLKTSKEKVDECYNAILHLTNANNYGHKRKYEEIPGSPSGVIDAVFSSDGSNDSWTVGASSYSTSEPVFKKTKNQGQNMNLSPINRVIVGILATATSP

SEQ ID NO: 54261 - protein, 221 aa, Larix laricina
KAAGARIIVTQAAYVDKLADLQSDDMIVIAIDGAPKEGCQHISILTEADETQCPSVEIHPDDVVALPYSSGTTGLPKGVMLTHKSLVSSVAQQVDGENPNLYFHSGDVILCVLPLFHIYSLNSVLLCALRAGAATLIMQKFNLTTLLELIQRYKVTVAPIVPPIVLEISKNPIVSQYDASSVRIIMSGAAPLGKELEDALRERFPKAIFGQGYGMTEAGPV

SEQ ID NO: 54262 - protein, 525 aa, Acidovorax sp. JS42
MAIDDVDGNAPAPSANFDCGSFAAGIFDLDGVVTRTARVHAASWKRLFDDYLRQRAECTGEAFEPFNDADYRRYVDGKPRYEGVGSFLRSRGIELDYGTPADPPERETVCGLGNRKNILFQEQLAQTGVEVYDTSVAFLRRLRERGLKTALVSSSKNAAAVLEAAGLTGLFDACVDGIEAARLGLKGKPNPDIFLRACELLEVSAADAFAVEDALSGVEAAHAAGFGRVIGIDRTGERAALLAHGADLVVGDLAELEPVAALPDALESYEEIRQRLRAKRAAVFLDYDGTLTPIVARPELAVLSEEMRATVRELAQVCAVAVVSGRDRADVERLVGLDTLVYAGSHGFDIAGPGGLHMQHERAAEFLPALDRAESRLRKATKSVPGALVERKRYAIAVHYRLVAPDDLPVLEAAVDAALAETTDKLRKTGGKKVFELRPKLTWDKGRAVCWLLEALDLDGPEIVPLYLGDDETDEDAFEALGELHGIGLLVARAPQATAAQYGLEDPAAVARFLRTLITTLKAST

SEQ ID NO: 54263 - protein, 222 aa, Medicago sativa
MAIHHHHHNHQQLQQHTSSLFDALYCDEEEKWEDDEGEVVDEGEQSDVTTTNYDILDSTSLLPLLLLEQNLFNEDEELNTLFSKEITQQETYYEDLKNVINFDSLSQPRREAVEWMLKVNAHYGFSALTATLAVNYLDRFLLSFHFQKEKPWMIQLVAVTCISLAAKVEETQVPLLLDLQVQDTKYVFEAKTIQRMELLILSTLKWKMHPVTTHSFLDPGNS

SEQ ID NO: 54264 - protein, 423 aa, Chromobacterium violaceum ATCC 12472
MTSFNAVLARNSENAPSGMGRYSQTVAFSHYNNLSAQLPVDPATGRLVAGGVKEQAERCFQNIQAIVKSIGHELSDVVRITIFLQNIADMHVVNEVYATFFTDYMPTLTTVAVAALPMGALLQVEALLSNGEGTIPNAPQAGDLVKIASNTMNAPTSHLSTQSVAFSHYNNLSAQLPIDPKSGKLVAGGAREQAAQCLQNIKAILESIAVPFDDIVKINVFLKNLSDIDSVDAAYRAFFPDSAIARAVAYVPARTVVEVAALPMDALVQIEAVVSHGDGTPPQAVEDRHGIVIWANNTDRAPRCALATQTVAFSHYNHLSAQLPLHPETQAVVPGGVKAQAEQCLKNIKAIVESIGHTLDDVVKVNIFVKNIEDMGAVDEVYLAFFPGGIPARRTVGVSALPHGAMIQIDAVVANAEGTPPKA

SEQ ID NO: 54265 - protein, 107 aa, Neisseria gonorrhoeae FA 1090
MGDSVLSAIQQTIIQRKSADPSESYVAQLLHKGEDKILKKVIEEAGEVLMASKDKDPSHLVYEVADLWFHTMILLTHHDLKAEDVLDELSRRQGLSGLAEKAARTES

SEQ ID NO: 54266 - protein, 354 aa, Neisseria gonorrhoeae FA 1090
MKAARFYNKGDIRIEDIPEPTVAPGTVGINVAWCGICGTDLHEFMEGPIFIPPCGHPHPISGESAPVTMGHEFSGVVYAVGEGVDDIKVGQHVVVEPYIIRDDVPTGEGSNYHLSKDMNFIGLGGCGGGLSEKIAVKRRWVHPISDKIPLDQAALIEPLSVGHHAYVRSGAKAGDVALVGGAGPIGLLLAAVLKAKGIKVIITELSKARKDKARESGVADYILDPSEVDVVEEVKKLTNGEGVDVAFECTSVNKVLDTLVEACKPAANLVIVSIWSHPATVNVHSVVMKELDVRGTIAYCNDHAETIKLVEEGKINLEPFITQRIKLDKLVSEGFERLIHNNESAVKIIVNPNL

SEQ ID NO: 54267 - protein, 398 aa, Streptococcus pneumoniae TIGR4
MAKLTVKDVDLKGKKVLVRVDFNVPLKDGVITNDNRITAALPTIKYIIEQGGRAILFSHLGRVKEEADKAGKSLAPVAADLAAKLGQDVVFPGVTRGAELEAAINALEDGQVLLVENTRYEDVDGKKESKNDPELGKYWASLGDGIFVNDAFGTAHRAHASNVGISANVEKAVAGFLLENEIAYIQEAVETPERPFVAILGGSKVSDKIGVIENLLEKADNVLIGGGMTYTFYKAQGIEIGNSLVEEDKLDVAKALLEKANGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 54268 - protein, 448 aa, Streptococcus pneumoniae TIGR4
MPITAADIRREVKEKNVTFIRLMFSDILGTMKNVEIPATDEQLDKVLSNKVMFDGSSIEGFVRINESDMYLYPDLDTWTVFPWGDENGSVAGLICDVYTTEGEPFAGDPRGNLKRALRHMEEVGFKSFNLGPEPEFFLFKLDENGDPTLEVNDKGGYFDLAPTDLADNTRREIVNVLTKMGFEVEASHHEVAVGQHEIDFKYDEVLRACDKIQIFKLVVKTIARKHGLYATFMAKPKFGIAGSGMHCNMSLFDAEGNNAFFDPNDPKGMQLSETAYHFLGGLIKHAYNYTAIMNPTVNSYKRLVPGYEAPVYIAWAGRNRSPLVRVPASRGMGTRLELRSVDPMANPYVAMAVLLEVGLYGIENKIEAPAPIEENIYIMTAEERKEAGITDLPSTLHNALKALTEDEVVKAALGDHIYTSFLEAKRIEWASYATFVSQWEIDNYLDLY

SEQ ID NO: 54269 - protein, 265 aa, Rhodopseudomonas palustris CGA009
MTTKLVRPSDQATSNQVPVPGALVPHLDQCALLLDIDGTLLDLAPTPREVWVPPELEQTLTNLLVRTSGALALVSGRSINDIDLIFAPMRLPAVGGHGAEMRLSGEGEAIATHAPPLDSELKSRLAAIARISPGILLEDKGYSLALHYRLAPHTEKAIYEAVAAIRAENPEAPLEVLPGKSVCEIKHSGFTKATGVLELMTRAPFKGRRPIFIGDDVTDETVFAIMPELRGLAFSVGRYSELTSGHFDEPRDVRNWLARLLEPAN

SEQ ID NO: 54270 - protein, 1530 aa, Schizosaccharomyces pombe
MNQNSDTTHGQALGSTLNHTTEVTRISNSSDHFEDSSSNVDESLDSSNPSSNEKASHTNEEYRSKGNQSYVPSSSNEPSPESSSNSDSSSSDDSSVDRLAGDPFELGENFNLKHYLRAYKDSLQRDDIITRSSGVCMRDHSVYGVGSGYEFLKTFPDIFLQPYRAITEKQVVEKAILSHCHALANAGELVMVLGQPGSGCSTFLRSVTSDTVHYKRVEGTTHYDGIDKADMKKFFPGDLLYSGENDVHFPSLTTAETLDFAAKCRTPNNRPCNLTRQEYVSRERHLIATAFGLTHTFNTKVGNDFVRGVSGGERKRVTISEGFATRPTIACWDNSTRGLDSSTAFEFVNVLRTCANELKMTSFVTAYQASEKIYKLFDRICVLYAGRQIYYGPADKAKQYFLDMGFDCHPRETTPDFLTAISDPKARFPRKGFENRVPRTPDEFEQMWRNSSVYADLMAEMESYDKRWTETTPASSEAPEKDNFGSDISATTKHELYRQSAVAEKSKRVKDTSPYTVTFSQQLWYCLARSWERYINDPAYIGSMAFAFLFQSLIIGSIFYDMKLNTVDVFSRGGVLFFSILFCALQSLSEIANMFSQRPIIAKHRASALYHPAADVISSLIVDLPFRFINISVFSIVLYFLTNLKRTAGGFWTYFLFLFIGATCMSAFFRSLAGIMPNVESASALGGIGVLAIAIYTGYAIPNIDVGWWFRWIAYLDPLQFGFESLMINEFKARQFECSQLIPYGSGYDNYPVANKICPVTSAEPGTDYVDGSTYLYISFNYKTRQLWRNLAIIIGYYAFLVFVNIVASETLNFNDLKGEYLVFRRGHAPDAVKAAVNEGGKPLDLETGQDTQGGDVVKESPDNEEELNKEYEGIEKGHDIFSWRNLNYDIQIKGEHRRLLNGVQGFVVPGKLTALMGESGAGKTTLLNVLAQRVDTGVVTGDMLVNGRGLDSTFQRRTGYVQQQDVHIGESTVREALRFSAALRQPASVPLSEKYEYVESVIKLLEMESYAEAIIGTPGSGLNVEQRKRATIGVELAAKPALLLFLDEPTSGLDSQSAWSIVCFLRKLADAGQAILCTIHQPSAVLFDQFDRLLLLQKGGKTVYFGDIGEHSKTLLNYFESHGAVHCPDDGNPAEYILDVIGAGATATTNRDWHEVWNNSEERKAISAELDKINASFSNSEDKKTLSKEDRSTYAMPLWFQVKMVMTRNFQSYWREPSILMSKLALDIFAGLFIGFTFYNQGLGVQNIQNKLFAVFMATVLAVPLINGLQPKFIELRNVFEVREKPSNIYSWVAFVFSAIIVEIPFNLVFGTLFFLCWFYPIKFYKHIHHPGDKTGYAWLLYMFFQMYFSTFGQAVASACPNAQTASVVNSLLFTFVITFNGVLQPNSNLVGFWHWMHSLTPFTYLIEGLLSDLVHGLPVECKSHEMLTINPPSGQTCGEYMSAFLTNNTAAGNLLNPNATTSCSYCPYQTADQFLERFSMRYTHRWRNLGIFVGYVFFNIFAVLLLFYVFRVMKLRSTWLGKKITGTG

SEQ ID NO: 54271 - protein, 456 aa, Francisella tularensis subsp. tularensis SCHU S4
MSSQIKQVFARQILDSRGNPTIEVEVVLESGAFGRAAVPSGASTGIREALELRDGNKALFLGKSVYKAVENVNTKIAQAVKGLDALDQRLIDKTMIELDGSENKKNLGANAILGVSLATARAAASHLRKPFYRYLMDVKEYLMPVPMMNVINGGSHADNNVDMQEFMIVPAGFDTFSEALRCGTEVFHILKKVLIADGYSVAGVGDEGGYAPDLPSNEAAIEAILKAVKEAGYEPGKHVFIALDPASSEFYKDGKYELKSENKSLTSEEMIDYYAAWVEKYPIVSIEDGLAEEDWAGWKLLTEKLGNKVQLVGDDLFVTNPSILAKGIEKGIANSILIKLNQIGTLTETFEAMAMAGQAGYTCVVSHRSGETSDTIIADLAVATCSGQIKTGSLSRSDRIAKYNQLLRIEEELGENAIYPGIKAFVFNSDEEVEEVVQEIIVEDSEAEKVVVQVEE

SEQ ID NO: 54272 - protein, 256 aa, Bifidobacterium longum NCC2705
MGARGCRLNRMTYKLVLLRHGQSAWNKTNQFTGWVDVPLTEQGEAEAKRGGELLKEKNVLPDIVFTSLLRRAINTANIALDAADRLWIPVQRDWRLNERHYGALQGKNKTEIREEYGDEKFMLWRRSYATPPPEIDPNDQYAQNNDPRYAGDPVPEAECLANVVERVKPYFESAIEPELKAGKTVLIAAHGNSLRAIVKMLDNLSEEEIAKVNIPTAIPLLYELDENFKPIKPRGEYLDPEAAAAGAAAVAAQGQK

SEQ ID NO: 54273 - protein, 372 aa, Medicago truncatula
MSFVRNFQAEDCNLNGGYRSTYDGNNTDRKRSRNHYNQRNYNNYYDNHNQANFGYYGGNFNQCNADYANYANVASSSLKKRKYSAPVRGESQKFTLPATVYDSIPSSRNFQAYPARSIAYNSTSASLKPDFSIFDDDKPIFMSRDDIDRNSPSRKDGIDVLHETHLRYSYCAFLQNLGTRLEMPQTTIGTSMVLCHRFFVRRSHACHDRFLIATAALFLAGKSEESPCPLNSVLRTSSELLHKQDFAFLSYWFPVDWFEQYRERVLEAEQLILTTLNFELGVQHPYAPLTSVLNKLGLSKTVLVNMALNLVSEGLRSSLWLQFKPHQIAAGAAYLAAKFLNMDLAAYKNIWQEFQATPSVLQDVSQQLMELF

SEQ ID NO: 54274 - protein, 355 aa, Bordetella pertussis Tohama I
MAAKHRIAVIAGDGIGKEVMPEGLRVLEAAATRFGIDFQWDHFDWSCDYYARHGKMMPDDWAAQIGGHEAIFFGAIGWPDAVPDHEALWGSLFRFRRDFDQYINLRPVRLMPGVPTPLANRKPGDIDFFIVRENTEGEYSNSGGRLFAGTEREVVIQESVFTRVGADRVLKFAFELARKRGKHLTAATKSNGISISMPWWDERVAEMAASYPDVRWDKYHIDILCAHFVQHPDWFDVVVASNLFGDILSDLGPACTGTIGIAPSANLNPERKFPSLFEPVHGSAPDIYGKGIANPIGQIWSGALMLDFLGYPQAAAAVVAAIEQVLVDGPRTPDMQGKATTTEVGSAIAALVAAG

SEQ ID NO: 54275 - protein, 323 aa, Thermosynechococcus elongatus BP-1
MTSVTSLFSPVEADLCVLTENLKALIGAQHAVLSAAAEHLFAASGKRIRPAIVFLVSRATLPDQGITPRHCRLAEITEMIHTASLFHDDVVDQAQLRRGVPTVNSVFGNRVAIQAGDFLFAQASWYLADLDNLQVVKLLSQVIKDFAEGEIRQGFNRFDTSITLDDYLLKTYYKTASLIANSAKAAAVLSEAPPETIEAMYTYGKNLGLAFQIVDDILDFTRSTAELGKPAGSDLRDGNLTAPVLFALPKAPYLHTLIEREFSEEGDLETALNLVRQSGAIEDARNLAKEYAQAALPALEVLPPSEPRQALSQLTDYVLERLY

SEQ ID NO: 54276 - protein, 123 aa, Brucella melitensis 16M
MSRKQVFGASHVPLSPAVRVGDMVYVSGQVPVGPNGQIVEGGIEAQTRQVLENIKAALALAGAAMEDVVKTTVWLEDARDFGRMNAVYGTYFPKEPPARTTVESRLMIDIKIEIEAVAYAPQK

SEQ ID NO: 54277 - protein, 287 aa, Thermosynechococcus elongatus BP-1
MNQRLSSRLTSAVAAIAIVLLVLLLNAVVIINPGQAGVLSILGKAQDTPLLEGIHWKPPFIASVDVYDVTVQKFEVPAESATKDLQDITASFAINFRLDPMAIVDVRRTQGTLENIVAKIIAPQTQEAFKIAAARRTAEEAITKRDELKQDFDHALEERLSKYHILVLDTSVVNLDFSEEFSKAVEDKQIAEQRAQRAVYIAQEAAQQAQAEINRAQGKAEAQRLLAETLKAPGGQLVLQKEAIEAWREGGAQVPQVIVINGQEGLPPFLLNWSSEQSVRERSPKSP

SEQ ID NO: 54278 - protein, 450 aa, Thermosynechococcus elongatus BP-1
MISTSLAANQQILPLTAQTNARGHLTIGGCDVVELVAQFGSPLYILDEFTFRTACRQYQETLQRAYGGESLVLYASKAWNCLATCALAHSEGLGIDVASGGELYTALSAGVPASHIYFHGNNKSPQELLYALEVNCTIVADNWLELERLAAYVEEHDLSTPPRVMLRLTPGIECHTHEYIRTGHLDSKFGFDPQQFPELLQFAKAHPELDWVGLHAHIGSQIFEEQPHLDLCDVLVDWLAQARAAMLPMRELNVGGGLGIRYVESDNPPAIAHWIKAISHQLSQACQQRHLPLPKLICEPGRSIVGPAAVTAYTVGSRKVIPELRTYIAVDGGMSDNPRPMTYQAQYTALCANRMTTAATETVRVAGKHCESGDILLAHATLPPLQANDILVVASTGAYNYSMASNYNRVPRPAAVIVCDGEANLILQRETYADLVAHDVLPLRLSTPTP

SEQ ID NO: 54279 - protein, 221 aa, Pseudotsuga menziesii
KAADARIIVTQAAYADKLADLQRDDVTVITMDGAPKEGCQHISVLTEADETQCPSVEIHPDDVVALPYSSGTTGLPKGVMLTHKGLVSSVAQQVDGENPNLYFHSEDVILCVLPLFHIYSLNSVLLCALRAGAATLIMQKFNLTTLLELIQRYKVTVAPIVPPIVLDITKNPVVSQYDVSSVRMIISGGAPLGKKLEDALRDRFPKAIFGQGYGMTEAGPV

SEQ ID NO: 54280 - protein, 554 aa, Erwinia carotovora subsp. atroseptica SCRI1043
MCSIFGVLDLKSDPVELRKKALELSRLMRHRGPDWSGVYASDKAILAHERLSIVDVNTGAQPLYNAERTHILAVNGEIYNHQALRQQYGDRYAFQTGSDCEVILALYQEKGPEFLDELRGMFAFALYDSEKDAYLIGRDHLGIIPLYMGYDEHGNLYVASEMKALVPVCRTIKEFPAGSYLWSKDGEIREYYQRDWFDYDAVKDNETDKVALHDALEEAVKSHLMSDVPYGVLLSGGLDSSVISAITKKYAARRVEDDARSEAWWPQLHSFAVGLEGAPDLKAAQEVAKHLGTVHHEIHFTVQEGLDAIRDVIYHIETYDVTTIRASTPMYLMSRKIKAMGIKMVLSGEGSDEVFGGYLYFHKAPNAKELHEETVRKLLALHQYDCARANKAMSAWGVEARVPFLDKNFLDVAMRINPRDKMCGNGKMEKHILRECFESYLPHSVAWRQKEQFSDGVGYSWIDTLKEVAANQVTDQQLETARFRFPYNTPGSKEAYLYREIFEELFPVSSAAECVPGGPSVACSSAKAIEWDESFKTLDDPSGRAVGVHQSAYK

SEQ ID NO: 54281 - protein, 221 aa, Pseudotsuga menziesii
KAADARIIVTQAAYVDKLADLQSDDVIVISIDGAPKEGCQHISVLTEADETQCPSVEIHPDDVVALPYSSGTTGLPKGVMLTHKSLVSSVAQQVDGENPNLYFHSEDVILCALPLFHIYSLNSVLLCALRAGAATLIMQKFNLTMLLELIQRYKVTVAPIVPPIVLDITKNPIVSQYDVSSVRINMSGAAPLGKELEDALRERFPKAIFGQGYGMTEAGPV

SEQ ID NO: 54282 - protein, 688 aa, Oryza sativa
  misc_feature (179)..(179): Xaa can be any naturally occurring amino acid
  unsure (1)..(688): unsure at all Xaa locations
MAASRLVAAAAIVVVVLVLAGAGAAGAAGAGEVRALLDLAAGLDPTGRLLPSWAPGRDPCGREGGGGFEGVACDGATGAVANVSLQGKGLAGTLPPAVAGLTALTGLYLHYNRLTGALPRELAALSRLTDLYLNVNNFSGPIPPEIAAMPSLQVVQLCYNQLTGGVPTQLGLLKRLTVXELQSNHLSGAIPASLGELPQLVRLDLSFNNLFGSIPVRLALLPRLLVLDVRNNTLTGSVPSELAKLQGGFQYANNTDLCGTGLPALRPCTPGELISPDMPQPFSAGISPQITPGSSSDGHGHCSGTHCPPSTKALAAVVVVADLLAVSGAGMFAFSWYRWRKQRVVAGSPVAVGGQCSTDAAGKDSFRKSASSTLVSLEYSNGWDPLADGRGGIGFSQEVAQSFRFNMEDVESATQYFSELNILGKNGNFAATYRGTLRDGTSVVVKRLGKTCCKQEEAEFLKGLKLLAELQHENIVGLRGFCCSRARGECFLVYDFVPNGSLSQFLDIDADDVARSNGRVLEWSTRISIIRGIAKGIEYLHSTRANKPPLVHQNISADKVLVDYTYRPLISGSGLHKLLVDDLVFSTLKASAAMGYLAPEYTTTGRFSEKSDVYAFGVIVFQILTGKSKIMQLPLESSNDEDLIDGNLRGCYSAAEAAKLAKIASACTSENPDHRPTMEELIQELCTF

SEQ ID NO: 54283 - protein, 221 aa, Pseudotsuga menziesii
KAADARIIVTQAAYVDKLADLQSDDVIVISIDGAPKEGCQHISVLTEADETQCPSVEIHLDDVVALPYSSGTTGLPKGVMLTHKSLVSSVAQQVDGENPNLYFHSEDVILCVLPLFHIYSLNSVLLCALRAGAATLIMQKFNLTMLLELIQRYKVTVAPIVPPIVLDITKNPIVSQYDVSSVRIIMSGAAPLGKELEDALRERFPKAIFGQGYGMTEAGPV

SEQ ID NO: 54284 - protein, 455 aa, Pseudomonas syringae pv. tomato str. DC3000
MSANNNPQTLEWQALSSEHHLAPFSDYKQLKEKGPRIITRAEGVYLWDSEGHKILDGMSGLWCVAIGYGREELADAASKQMRELPYYNLFFQTAHPPVLELAKAISEIAPQGMNHVFFTGSGSEGNDTMLRMVRHYWALKGQPNKKTIISRVNGYHGSTVAGASLGGMTYMHEQGDLPIPGIAHIPQPYWFGEGGDMTPDEFGVWAAEQLEKKILELGVENVAAFIAEPVQGAGGVIVPPESYWPKIKEILSRYDILFAADEVICGFGRTGEWFGSDFYGLKPDMMTIAKGLTSGYVPMGGLIVRDEIVAVLNEGGDFNHGFTYSGHPVAAAVALENIRILREERIVERVKSETAPYLQKRLRELNDHPLVGEVRGVGLLGAIELVKDKVTRERYTDKGAGMICRTFCFENGLIMRAVDDTMIIAPPLVISFAQIDELVEKARTCLDLTLAALQS

SEQ ID NO: 54285 - protein, 452 aa, Pseudomonas syringae pv. tomato str. DC3000
MSTNLDQLTDWLKEHKITEVECMVSDLTGITRGKISPTNKFIAEKGMRLPESVLLQTVTGDYVEDDIYYELLDPADIDMICRPDQNAVYLVPWAVEPTAQVIHDTYDKQGNPIELSPRNVLKKVLKLYADQGWQPIVAPEMEFYLTKRSDDPDYPLQPPIGRSGRPETGRQSFSIEAANEFDPLFEDVYDWCELQNLDLDTLIHEDGTAQMEINFRHGDALSLADQILVFKRTMREAALKHDVAATFMAKPMTGEPGSAMHLHQSIIDIETGKNIFSNEDGTMSELFLNHVGGLQKFIPELLPLFAPNVNSFRRFLPDTSAPVNVEWGEENRTVGLRVPDAVPQNRRVENRLPGADANPYLAIAASLLCGFIGMVEGINPSAPVVGRGYERRNLRLPLTIEDALERMENSKTIEKYLGKKFIIGYVAVKRAEHENFKRVISSWEREFLLFAV

SEQ ID NO: 54286 - protein, 794 aa, Neisseria gonorrhoeae FA 1090
MADNYVIWFENLRMTDVERVGGKNASLGEMISQLTEKGVRVPGGFATTADAYRAFLAHNGLNERISAALAKLDVEDVSELARVGKEIRQWILDTPFPEQLDAEIEAAWNKMITDADGADISVAVRSSATAEDLPDASFAGQQETFLNINGLDNVKKAMRHVFASLYNDRAISYRVHKGFEHDIVALSAGVQRMVRSDSGASGVMFTLDTESGYNQVVFVTSSYGLGENVVQGAVNPDEFYVFKPTLKAGKPAILRKTMGSKHIKMIFTDKAEAGKSVTNVEVPEEDRNRFSITDEEITELAHYALTIEKHYGRPMDIEWGRDGLDGKLYILQARPETVKSQEEGSRNLRRYAINGEKTVLCEGRAIGQKVGQGKVRLIKDASEMDSVEAGDVLVTDMTDPDWEPVMKRASAIVTNRGGRTCHAAIIARELGIPAVVGCGNATELLENGQEVTVSCAEGDTGFIYAGLLDVQITDVALDNMPKAPVKVMMNVGNPELAFSFANLPSEGIGLARMEFIINRQIGIHPKALLEFDKQDDELKAEIIRRIAGYASPVDFYVDKIAEGVATLAASVYPRKTIVRMSDFKSNEYANLVGGSVYEPHEENPMLGFRGAARYVAESFKDCFALECKALKRVRDEMGLTNVEIMIPFVRTLGEAEAVVKALKENGLERGKNGLRLIMMCELPSNAVLAEQFLQYFDGFSIGSNDMTQLTLGLDRDSGLVSESFDERNPAVKVMLHLAISACRKQNKYVGICGQGPSDHPDFAKWLVGEGIESVSLNPDTVIETWLYLANELNK

SEQ ID NO: 54287 - protein, 713 aa, Bacillus thuringiensis serovar konkukian str. 97-27
MLKVKRPFDAYLDEMNKITILLPHAYGTSRTFRLQEGSNVKDLPIAHTIALPDATKYECFIEEPLDVGKYYTVRDERNEETDLQIGAVIRTEIFDEKYYYEGTDLGAVYQEEATTFKVWAPTARLAKVRIYKSDKEYTDHEMHREENGVWAHTLQGDLAGEKYTFLVCINLIWNEAVDPYAKSVTVNGKYGVVIDLEKTNVTKQEQLPPLQAMTDAILYELHIRDATIHEGSGVSKKGTYKGLMEEGTKGQNGTLTGLSHIKDLGVTHVELLPLYCFGGVDEANPSSAYNWGYNPLYYNAPTGFYATNPSDPYNRIVECKELIETFHEHGIRVIIDVVYNHVYERELSSFEKLVPGYYFRHGENGMPSNGTGVGNDIASERKMMRKFIVESILYWLTEYNVDGFRFDLMGILDVDTINIIEKEVRNIKRDALLLGEGWDLQTPLPLEEKATLNNANKMPHIAQFNDQFRDGIKGSTFHINKRGFAFGGHVDRNHLQYIVSGSLLSMKETGLFLEPVQSINYVECHDNMTMWDKLMRSNEESEEILKKRHVLATAMAILSQGIPFLHAGQEFYRTKQGNENSYNANDEINQLDWDRKEKEIETVNYIKGLIAIRKEHGAFRLQNADLIKKHMTFLQTSPEVLAYHLEHVESFGPWKEIVVLFNSSLEAKTVQLPKEETWHVLVNEKQAKIEPISSFRGKELRLSPISTYILTIM

SEQ ID NO: 54288 - protein, 351 aa, Francisella tularensis subsp. tularensis SCHU S4
MKALAKLKKQPGIWIINDAPIPEYGYNDVLIKIKKTAICGTDLHIYNWDKWSQNTIPVPMITGHEFAGEVVAKGDGVTSVDIGDRVSGEGHLVCGQCRNCRAGKRHLCRKTIGIGVNVQGAFAEYLVMPAVNVFKIPDSISDDIASTFDPMGNAIHTALSFNLTGEDVLITGAGPIGLMAVKIARFCGARRIVITDINEYRLQMARDFGATVALNVAPFKNQDELVKQMRKVMSDIGMTEGFDVGLEMSGINSAISMMLDVMNHGGKLSLLGISAGDISVDWGAILFKGLTLKGIYGREMFETWYLMTSMLQAGMDMNPIITHRLHIDEFQKGFEIMKSGQCGKVILDWSS

SEQ ID NO: 54289 - protein, 464 aa, Oryza sativa (japonica cultivar-group)
MAASPAAAAAAATVSSFVSPSSFSSVKASKPDRLRPARRAAAVNVRCVSSPPATETSFKTKVPRNANMAKLQAGYLFPEIARRRAAHLLKFPDAKIISLGIGDTTEPIPDVITNAMAERAHALSTVDGYSGYGAEQGEKKLRAAIAATYYADLGIEETDIFVSDGAKCDISRLQVLFGSNVKIAVQDPSYPAYVDSSVIMGQTGLYQEDVQKYGNIEYMKCSPENGFFPDLSSVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNISQAGGLGCLSPEGLKAMSDVVGFYKENTKIIVDTFTSLGFNVYGAKNAPYVWVHFPGRNSWDVFAEILEKAHVVTTPGSGFGPGGEGFVRVSAFGHRENIIEAARRLKQLYK

SEQ ID NO: 54290 - protein, 243 aa, Citrus sinensis
MGRGRVQLKRIENKINRQVTFSKRRAGFLKKAHEISVLCDAEVAVIIFSHKGKLFEYSTGSCMEKILERYERYAYAERQLIAPDPESQRNWPLECNNLKAKIDLLQKDQRHYLGEDLESLSLKDIQQLEQQLDTALKHIRSRKNQLMQESISELQKKEKSIEEQNNLLVKQIKEREKAAAQQAQWGNQIQNQVPNTLSFLLPQPPPCLRLGGAYQEQASEMRRNELNLTLEPVCSCSLGCFAG

SEQ ID NO: 54291 - protein, 424 aa, Bordetella pertussis Tohama I
MDNAELTRRKEAATPRGVGVMCNFYADRAENAELWDTEGRRYIDFAGGIAVLNTGHRHPQLMQALQAQMSRFTHTAYQIVPYASYIQLAERINQLAPGDFAKKTALFTTGAEAVENAVKIARTATGRPAVVAFGAAFHGRTLLGMALTGKVVPYKVGFGPFPADIYHVPYPNALHGVSTDDALAALGTLFKTDVDPRRVAAIIIEPVQGEGGFNICPPAFMQALRALCDDHGILLIADEVQTGFGRTGKLFAMEHYGVAADLTAMAKSLAGGMPLSAVCGRAEVMDAPPPGGLGGTYAGNPLAVAAALEVIRIIETEDLLARGTRLGHQLRDHLEAQRHDAPEIAEVRALGAMVAVEFRQPGSDAPSPEFARQVQARALEQGLLLLTCGSDGNVIRFLFPLTIPEAVMREALDILARTLRGQNA

SEQ ID NO: 54292 - protein, 521 aa, Nocardioides sp. JS614
MIVPFSVSDFIDRAVQVYGERVGVVDEPDQPASPLGAGGQLTYGELGSLARRQAARLDELGLDVGDRVAIVSHNSARLLTSFFGVSGFGRVLVPVNFRLRPDEVHYIVKHSGARVLLIDPELEETLEDVPAEFKFVLGRDEDMFAAAPADGGVEPRPWEPDENATACINYTSGTTARPKGVQITHRNIWVNAATFAMHAGVTDRDVYLHTLPMFHANGWGMPYAMTGLGVKQVVIRKIDGAEILRRVRDQGVTVMCAAPAVAAAVLDAAQTWEGEIPGRDRVRIIMAGAPPPTKTVIRVQEELGWEFIQIYGLTETSPLLTINRTREEWDDLSAEERAIRLTRAGAPALGVRLAISDHEENSGEVLARSNVVLDGYWQQPEETERALADGWFHTGDGGSLGDDGYLTISDRKKDVIITGGENVSSIEVEDVLFSHPAVAEVCVIGVPSDKWGETIKALVVLAEGASATEAELIAWCKEKAAGYKAPTSVEFRDELARTATGKLQKFKLRAPYWEGRDRQVN

SEQ ID NO: 54293 - protein, 497 aa, Bordetella pertussis Tohama I
MSTLPPLSHWESLAAGLTLRNQAFIDGRWHDGQAGPLAAINPATGQLLAEVTACSQADIDQAVAAARRAFESGVWSRMPRRERKQCMLRLAALIREHAEELALIETLNMGKPIGDTMAFDIPETAHTYAWYAETIDKQYDEIAPTDADALATITREPLGVVAAVVPWNYPLLMASWKVAPALAAGNSVILKPAEQSSLSALRLAELALQAGIPAGVLNVVPGAGPVAGRALGLHMDVDCLAFTGSTATGKRFMEYSGQSNLKQVWLECGGKSPHIIFDDCPDLDRAALAAAIGIFNNQGEVCIAGSRLYVQAGIYDTFVSKVEACARAMQPGNPLDPASPMGAMVDERQMARVLEYVESGRREGARLRMGGERVRADSGGYYIEPTIFECARPDLTIVREEIFGPVLAVTRFDGEDEVVAQANASAYGLGSGLWTADLSRAHRVSRRLRAGLVWVNCYFDGDVTVPFGGVKQSGFGRDKSLHALDKYTSLKTTWIRL

SEQ ID NO: 54294 - protein, 429 aa, Bordetella pertussis Tohama I
MGPRIITHGEGVYVFDDQGNRYLEGMAGLWSVAVGFGEQRLVEAAARQFQELPYYHTFTHKSHPSVIALAERLIGYTDGRMAQAFFTNSGSEANDTVVKLVWYYNNALGRRDKKKIIARQRGYHGVTVASASLTGLPGNHKDFDLPLPQIRHTACPHYYRYGLPGETEEDFATRMAGELEAMILREGPDTVAAFIGEPVMGAGGVIVPPRTYWQKIQAVCRKYDILVIADEVITGFGRLGQRFGSQVFDIEPDIMVLSKQITSSYQPLGAVLLNTRVADVVAEHSGRLGTFGHGYTASGHPVATAVALENLRLIDERGLIEHAAEMGALLHQELQALSSHPLVGEVRGVGLIAGVELVADKATRQPFDPLGKAGGYAYERAHDHGLIVRGIQDTVAFCPPLIITAEQVRDMVARFARTLDDVAAHVAQG

SEQ ID NO: 54295 - protein, 346 aa, Glycine max
  misc_feature (184)..(184): Xaa can be any naturally occurring amino acid
  misc_feature (228)..(228): Xaa can be any naturally occurring amino acid
  unsure (1)..(346): unsure at all Xaa locations
MNTLSEAYKAHPLHLSHIIPLDFSSAHSLPDSHAWSHSQPNDDDYVSFNDDASSSSFIPIIDLMDPNAMEQIGHACEKWGAFQLKNHGIPFCVIEDVEEEAKRLFALPTEQKLKALRSPGGATGYGRARISPFFPKFMWHEGFTIIGSPSHDAKKIWPNDHAGFCDLMENYEKQMKVLAERLTXMMFSLMDISEEKTKWVGASNISGAVQLNFYPSCPEPNRAMGLSXHTDTSLFTILHQSRITGLQIFKEGKEWVPVHPHPNTLVVHTGDLLHIISNARFRSALHRVTVNSTRERYSVAYFYSPPLDYVVSPLVDSVARFRDVTVKEYIGIKAKNFGEALSLIST

SEQ ID NO: 54296 - protein, 528 aa, Prochlorococcus marinus subsp. marinus str. CCMP1375
MSDPKVTTQRNPSIVILDFGSQYSELIARRIRETEVYSMVLGYNSSVEELKKLSPQGIILSGGPSSVYEEKAPLCDPSIWDLDIPILGVCYGMQVMVKQLGGLVGEAIGKAEYGKALLQVDDPTALLTNVENGSTMWMSHGDSVKQLPAGFVRLAHTTNTPDAAIACHDRRFYGVQFHPEVVHSTDGMVIIRNFVHNICRSKPDWTTNTFIDEAINDVQEKVGKKRVLLALSGGVDSSTLAFLLKKAIGNQLTCMFIDQGFMRKGEPEFLMEFFDKKFHINVEYINARDRFLDKLQGVSDPEKKRKIIGTEFIRVFEEESLRLGPFDYLAQGTLYPDVIESSGTNIDPKTGERIAVKIKSHHNVGGLPKDLQFKLVEPLRTLFKDEVRKVGRSLGLPEEIVNRHPFPGPGLAIRILGEVTKEKLNCLRDADLIVREEIADAGLYHQIWQAFAVLLPVRSVGVMGDQRTYAWPIVLRCVSSEDGMTADWSRLPNSLLEKISNRIVNEVNGVNRVVLDITSKPPGTIEWE

SEQ ID NO: 54297 - protein, 491 aa, Arabidopsis thaliana
  misc_feature (17)..(17): Xaa can be any naturally occurring amino acid
  unsure (1)..(491): unsure at all Xaa locations
MESMIMIILLCSIIFIXTILFFKKQKRGKKSNTPPSPPRLPLIGNLHQLGRHPHRSLCSLSHRYGPLMLLHFGRVPVLVVSSADVARDVLKTHDRVFASRPRSKIFEKLFYDGRDVALAPYGEYWRQMKSVCVLHLLSNKMVRSFRNVRQEEISLMMEKIQKSSSLQVNLSELLGSLTNDVISRVALGRKYGGETDFKELMKRLTKLLGEFSVGSYVPWLAWIDWIRGLDGQLKKTGNDLDEFLERVVQDHVDGDGQRTDFVDVLLRIQREKSVGFEIDRLSIKAIVLDVFVGGTDTSYALMEWAMTELLRHPECLNRLQEEVRTICKGNSSVSEEDIQDMNYLKAVIKETMRLHPPLPLMVPHESTQDVRLGDYHIPAGTQVMINAWAIGREAATWGPDAEKFRPERHLDSSVDFRGHNFELIPFGAGRRICPAISFAVVLIEVALANLVHRYDWRLPEESKEDQTNVAESTGMVIHRLFPLYAIASSTT

SEQ ID NO: 54298 - protein, 392 aa, Oryza sativa (indica cultivar-group)
MSDKCGNCDCADKSQKKGTSYGVVIVEAEKSHLEEVAAGEVMGGLPMDQAFVQAPEHRAKPSVAEADGIPVIDLSPLFAADGVDVDALAAEVGRASQDWGFFVVVRHGVPEEVVARAAEAQRAFFALPPARRAAVARSEAAQMGYYASDHTQNVRDWKEAFDLVPTRHSLLPPPSAVVLDNKWPDDLPGFREAMEEYGEAVEELAFKLLELIARSLGLRPDRLHGFFEDHQTTFIRLNHYPPCPSPDLALGLGHHKDAGALTVLYQDAVGGLDVRRRCDGEWVRVRPIPQSFIINIGDIIQVWSNDRYESVEHRVVVNVEKERFSIPFFFYPASYTMVEPLEEVMSEESPARYNPYSWGEFFSARKNGNFKKLDVDYVQITHFRKNTPVHVQ

SEQ ID NO: 54299 - protein, 443 aa, Lactobacillus johnsonii NCC 533
METIKNIIIGFGKGGKTLAKFLAQKGEEVLVIEKSNKMYGGTCINIACLPSKRLIIEAANGVSYVDAVNGKNEMTAQLREKNYHMLADEKTVTVLDGEAHFIADHEIEVKLPNGKKVQYKGDRIFINTGAVPVMLPIPGLKESKYILDSTQAMDEKKMPKNLTIIGAGYIGLEFASMFAKYGSKVTVLDHNKEFLAREDEDISNAVRKDMEDAGIKFELGADIEKITDETSDAKITYQINEERKTINADRILVATGRKPNTENLGLENTAIETTDRGAIKVDDFLRTTVDNVWAIGDVKGGLQFTYISLDDFRIIKDQLFGTGARMVSDRKVVPYSVFISPALSQVGLNEKQANKLGKEYKLFKLPVTAIPKAKVAKDNRGLFKALVDPETEKILGATLYGIESYELINMISLAMKAHLSYTVLRDQIYTHPTMSEAFNDLFK

SEQ ID NO: 54300 - protein, 362 aa, Bradyrhizobium japonicum USDA 110
MKAAVLYEVNKPLVIEDVSLPKPGPREVLIRTSVAGLCHSDLHFMEGLYPHPLPAVLGHESAGVVEQVGSDVTYVKPGDHVVTCLSVFCGTCDNCTTGRTVLCTDTTVKLLPGVSDRMQWSRSEKLHQFLNLSSFAEQMLVHENAIVKIRKEMPLDLAALIGCGVITGYGAVVNTAKVTAGETVAVIGCGGVGMAAINGAQIAGAGRIIAIDTNPAKLQLATKLGATDIINPADGDVVKQVRDLTNGGVHHSFEVLGRKETAEQAFAMLASGGTATIVGMIPFGQKIELHGFDFLRERKIQGSSMGSNHFRVDMPRLVDFYLRGRLHLEDWISAKLKLSEINEGFANMKAGKTLRSVIVFDS

SEQ ID NO: 54301 - protein, 116 aa, Arabidopsis thaliana
TLLLCGTIQLAICRSEEKSTEKTMMLGGVHDLRGNQNSGEIESLARFAIQEHNKQQNKILEFKKIVKAREQVVAGTMYHLTLEAKEGDQTKNFEAKVWVKPWMNFKQLQEFKESSS

SEQ ID NO: 54302 - protein, 540 aa, Wolbachia endosymbiont strain TRS of Brugia malayi
MEQFENFYITTPIYYVNDKPHIGHAYTSLICDVTARFMKLAGKNVKFTTGTDEHGQKIEKAAKTKGMHPKEFTDKVSVSFRKLAEFIDFQYDDFIRTTEERHEKAVVALWDRLEERGQIYLDSYSGWYSVSDEAFYQESELIDGKAPTGAEVEWVKEESYFFRLSSWQNKLLELYKNQPNFIFPESRKNEVISFVKSGLTDLSISRISFNWGIKVPRNDKHIIYVWVDALTNYLTSIGFPNTENEEYKKFWAESQSVIQVADTWIQKEIQISASRARMTSNLADNSFNIHVIGKDILRFHAVYWPAILLAADLPLPKQIVVHGWWLNEGKKISKSLGNVIDPIALAKEFGVDQLRYFLLREASFGQDGNFSKKNMISRINSELANNIGNLVQRTISFLHKRCFGVVPTVDKSLLKGEEGLPNYRAIFNQVMDHLSKYEFNHIILLIINISSEANAYIDKSAPWILSKTDRERMNLVIYKLLEYIRIIGILLQPIVPRPAEVILDQLQIPKEQRDLKSLCGAYVSSGTTLHKPTPVFLRIE

SEQ ID NO: 54303 - protein, 457 aa, Clostridium tetani E88
MRESLKLSLFYFNKKERNKMNYTTQMDAAKRGIVTKEMETIAKKEGIDVKKIIECVAKGSVAIPANKNHKSLSAEGVGQGLRTKINVNLGISKDCCNVDRELEKVKKAIDMKAEAIMDLSCFGKTQEFRKRLIEMSPAMIGTVPMYDAIGFYDKELKDITAEELLDVIETHAKDGVDFMTIHAGLNREAVEIFKRNERLTNIVSRGGSLLYAWMELNNKENPFYEHFDKVLDICEKYDVTISLGDACRPGSIHDSTDASQIKELMTLGELTKRAWERNVQIIIEGPGHMSLDEIETNMKLEKKLCYNAPFYVLGPIVTDIAPGYDHITSAIGGAIAATYGADFLCYVTPAEHLRLPDLDDMKEGIIATKIAAHAADIAKGIKGAREWDNKMSVARKELDWEKMFDLAIDNEKARKYRKNSTPEVNDSCTMCGKMCAVRNMNKVMQGKDINILRNEDK

SEQ ID NO: 54304 - protein, 378 aa, Streptococcus pneumoniae TIGR4
MNNTEFYDRLGVSKNASADEIKKAYRKLSKKYHPDINKEPGAEDKYKEVQEAYETLSDDQKRAAYDQYGAAGANGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRSKGAPSLRGGAVGDQYVTVNVVTPTGLNDRQKVALKEFAAAGDLKVNPKKKGFFDHIKDAFDGE

SEQ ID NO: 54305 - protein, 131 aa, Neisseria gonorrhoeae FA 1090
MDKNLLEAVKFDEKGLVCAIAQDAETKRVLMVAWMNAEALQKTVETGFAHYYSRSRQKQWMKGEESGHTQKVRELRLDCDGDTIVMLIAQNGGIACHTGRESCFYKKWNGGAWETADAVLKDEKEIYGSTH

SEQ ID NO: 54306 - protein, 438 aa, Francisella tularensis subsp. tularensis SCHU S4
MNFLKPAKALPLLAKEQIQKAYPHWRLRMFLVAYIGYFIYYFGRSSFDVSKQYITTLTPDELGLIGAGLGIAYGISKFLMGNISDRSNAKVFLAIGLFITGLINLLLPSLLSLGVLVMFIAMLVNGWVQGMGWPACARIMTHWFCANERGTKMGIWNTAHNVGAGFLAIAVVPIGLLLFHDDWHGLFYVAGAMCIFVSILVLIFGADTPQSVGLPAIEVYKGYTTAEAHHEQEFSAKEIFLKYVLNNKWVWLIAIANAFVYCARYGLLSWSTYYLVNVKHMSTTTGLLGFALFELPAIPGTIIIGWITDKYFGSRRAPMGVICMLLFICALFVYWYSDTAWVLLLSLSAMGVLIYGPVALIGILALDLVPKKAGGTAAGFTGLFGYFLGTVGAQAVIGIIATMLGWDAVFIFLLGSCIIAIALLAVCWNLSYNQAFSD

SEQ ID NO: 54307 - protein, 366 aa, Oryza sativa (japonica cultivar-group)
MDSGAAAVCAEKASEIIKIGQVDDVQELQRRLCSATTVPERYIRDGDDRPDHAVVDDERAQERIPVIDVGELQRGSEDELDNLRLACEQWGFFQVVNHGVEEETMEEMEKAAREFFMLPLEEKEKYPMEPGGIQGYGHAFVFSDDQKLDWCNMLALGVEPAFIRRPNLWPTTPANFSKTLEKYSVEIRELCVRLLEHIAAALGLAPARLNGMFGEAVQAVRMNFYPPCPRPELVLGLSPHSDGSAVTVLQQDAAFAGLQVLRGGGGWVAVHPVPGALVVNVGDTLEVLTNGRYKSVEHRAVASGEHDRMSVVTFYAPAYDVELGPLPELVADGEPRRYRTYNHGEYSRHYVTSRLQGKKTLEFAKI

SEQ ID NO: 54308 - protein, 510 aa, Pseudomonas syringae pv. tomato str. DC3000
MTATPKPLVLIILDGFGHSESHEGNAILAAKMPVMDRLYKTMPNGLISGSGMDVGLPDGQMGNSEVGHMNLGAGRVVYQDFTRVTKAIRDGEFFENPTICAAVDKAVSAGKAVHIMGLLSDGGVHSHQDHLVAMAELAVRRGADKIYLHAFLDGRDTPPRSAKKSLELMDETFARLGKGRIATIIGRYFAMDRDNRWDRVSTAYNLIVDSSAEFHAATGVAGLEAAYARDENDEFVKATRIGEPANVEDGDAVVFMNFRADRARELTRVFVEDDFKDFERARQPKVNYVMLTQYAASIPAPSAFAAGSLKNVLGEYLADNGKTQLRIAETEKYAHVTFFFSGGREEPFPGEERILIPSPKVATYDLQPEMSAPEVTDKIVDAIEHQRYDVIIVNYANGDMVGHSGIMEAAIKAVEYLDVCVGRITDALEKVGGEALITADHGNVEQMTDDATGQAHTAHTSEPVPFVYVGKRQLKVREGGVLADVAPTMLQLLGMEKPQEMTGHSILVEE

SEQ ID NO: 54309 - protein, 143 aa, Clostridium perfringens str. 13
MRLEKSLVLIKPDAVERNLIGKILEVYEGAGLKIKAMEMKQINKEFAEKHYEEHRDKQFFNSLIKYITRSPLVALILEGEDAINKIRSLNGATNPEKAEFGTIRRRFALSGTENSVHASDSIESAEKEIKLWFPKVFYEEICG

SEQ ID NO: 54310 - protein, 479 aa, Streptomyces sp.
MVPAAQQTATAPDAALTFPEGFLWGSATASYQIEGAAAEDGRTPSIWDTYARTPGRVRNGDTGDVATDHYHRWREDVALMAELGLGAYRFSLAWPRIQPTGRGPALQKGLDFYRRLADELLAKGIQPVATLYHWDLPQELENPGGWPERPTAERFAEYAAIAADALGDRVKTWTTLNEPWCSAFLGYGSGVHAPGRTDPVAALRAAHHLNLGHGLAVQALRDRLPADAQCSVTLNIHHVRPLTDSEADADAVRRIDALANRVFTGPMLQGAYPEDLVKDTAGLTDWSFVRDGDLRLAHQKLDFLGVNYYSPTLVSEADGSGTHNSDGHGRSAHSPWPGADRVAFHQPPGETTAMGWAVDPSGLYELLRRLSSDFPALPLVITENGAAFHDYADPEGNVNDPERIAYVRDHLAAVHRAIKDGSDVRGYFLWSLLDNFEWAHGYSKRFGAVYVDYPTGTRIPKASARWYAEVARTGVLPTA

SEQ ID NO: 54311 - protein, 784 aa, Bacillus cereus E33L
MKGVILAGGKGRRLRPLTCNTPKPMLPLLEKPVLEYNIELLRQHGIREIAITVQYMSTAIKQYFGDGSKWGVNLYYFEDSPPLGTAGSIKQAEKFLDETFVVISGDALTDFQLSKGITFHEQQKRMVTMFVKEVENPLSFGLVVMNKEQEVTRYIEKPSWNEVVSNIVNTGIYIMEPEIFSYIPPREFFDFSQDVFPLLANKNALFAYLSEGYWLDIGTFDQYRQAQFDLLTKKLQVPIPYTEVLPMVWMGEGVTIGKGTKIHGPSFIGEGAKIGAGAVIEPYSIIGKNSIVSSYSHLQKSIVFANVHIGQYCELLETTIGEHTMVEDDVTLFQKSIVADHCHIGKSTVIKQKGKLWPYKAIDSYSVVGSAGVQESEKSAGWLQKSRIVGRGNVEITPQFIVKVAMAYGSLFTKGESILIGSQEHIETTSYKNLFLHAIHGIGIHTMECKEMNESLFQYSIQDLQCAGGVFIQVENEKEVIIKLYGQDGAQLTYKQQKAIEQVYMSESFYYVCEKEMGRNKLVHVSLHDYIEAVLERIDIEKIQKQKFHLLINKRNDMLQHLLMLFLQRLGCTVTWIYAGEQKNHVKALMKSSKANMALMFSEQGNYFELYDNHSNIYQGTDFEEVDIPDLLLESAGNIYPMSLKLGECYLLFYTQDEKKSFQARWKRDILYRIGKLFELIALQGKTFLSIVEQSPPLYLLCDEVVCSWNEKGKVMRKLLADMERKEEGIFEGVQFKYTEKEWSYIVSDTKQPKFLVYSHARNPVIARENMKNLIEKIRQYQKV

SEQ ID NO: 54312 - protein, 600 aa, Aquifex aeolicus VF5
MEQKNVRNFCIIAHVDHGKSTLADRLLEYTGAISEREKREQLLDTLDVERERGITVKMQAVRMFYKAKDGNTYKLHLIDTPGHVDFSYEVSRALAACEGALLLIDASQGIEAQTVANFWKAVEQDLVIIPVINKIDLPSADVDRVKKQIEEVLGLDPEEAILASAKEGIGIEEILEAIVNRIPPPKGDPQKPLKALIFDSYYDPYRGAVAFVRIFDGEVKPGDKIMLMSTGKEYEVTEVGAQTPKMTKFDKLSAGDVGYIAASIKDVRDIRIGDTITHAKNPTKEPVPGFQPAKPMVYAGIYPAEDTTYEELRDALEKYAINDAAIVYEPESSPALGMGFRVGFLGLLHMEIVQERLEREYGVKIITTAPNVIYRVKKKFTDEVIEVRNPMDFPDNAGLIEYVEEPFVLVTIITPKEYVGPIIQLCQEKRGIQKNMTYLDPNTVYLEYEMPLSEIIVDFHDKIKSISRGFASYDYEFIGYRPSDLIKLTVLINKKPVDALSFIVHADRAQKFARRVAEKLRETIPRQLFEVHIQVAKGGKVIASERIKPLRANVTAKCYGGDVTRKKKLLENQKEGKKRMKQFGKVQLPQEAFLSVLKVE

SEQ ID NO: 54313 - protein, 306 aa, Arabidopsis thaliana
MPSSDSTMMKKGTKRKIEIKKRETKEQRAVTCSKRRQTVFSKAADLCLISGANIAVFVTSPSDSSDVVYSFSGYSSAYEIADCYLNRKPPPKIVNPAGSKLGFWWEDPDLYHSCDDLSELSIIEDRLQRMKKHVMACLEKEEKSQLVSSFDQNPNSTCSLDVEDCDGSSYSQIASTFTPNSVNEYCSDQTFSSFHGDQNPNLSSPSFDQDCYSSLYQICGESSSQVASFDQNPSSEIQGFETEEEINQINLLLQETQTEANVNLDDEICFWNDLSNDDVFGLNSYFGLDNTNAMINFGDSDFRRHV

SEQ ID NO: 54314 - protein, 364 aa, Aquifex aeolicus VF5
MSQAVKDYYEILGVNRDATKEEIKKAYRKLVRIYHPDINPDPSAQEKFKEINEAYHVLIDDERRSEYDAILSRNDVGKFRDFLEYIQEFVESIIQGEKGKKRRPRKGQDIKMKLPLTLEEAGLGCEKEIIYSRWMDCPVCEGMGVKGEAETVVCHACNGEGRRVSGIFNFPRPCSVCKGKGFIVKNPCPTCYGRGRVSAQHKIKVHIPPGTEEGEVLKVPEKGHLGYFGGKPGDLYLKVVLKEHPIFKKVGKDLHMEKVVSFPLAVLGGTVKVPTLEGEEIDVFIQPGTECGATKVVKEKGYPYENGRGDLIIHIRIGVPKNLSKSERKLLEKLAESIKEEGEEVYREGGSLVEKLSSLFKKNA

SEQ ID NO: 54315 - protein, 149 aa, Oryza sativa (japonica cultivar-group)
MEQSFIMIKPDGVQRGLIGDIISRFEKKGFYLRGMKFMNVERSFAQQHYADLSDKPFFPGLVEYIISGPVVAMVWEGKDVVATGRRIIGATRPWEAAPGTIRADYAVEVGRNVIHGSDSVDNGKKEIALWFPEGLAEWRSNLHPWIYES

SEQ ID NO: 54316 - protein, 333 aa, Xanthomonas campestris pv. campestris str. ATCC 33913
MAVSHLPSATVSDASLVASGQRVLEIEQAALAALGARIGAPFAAACRLVLASRGRVVATGMGKSGHIARKIAATLASTGTPAFFVHPGEAGHGDLGMITEADIVLALSYSGESDEVRMLLPVLKRQGNPIIAMTGRPASTLAQAADVHLDVSVSAEACPLHLAPTSSTTASLAMGDALAVALLDARGFTADDFARSHPAGSLGRRLLLHITDVMHGGDELPRVREDASLSEALMEMSRKRLGMTAVVDAQERLIGLFTDGDLRRALDSDIDVRSAGIAEVMTRNPKTIGADQLAAEAARLMEDYKINGLIVVDAQQRAVGALNIHDLLRAKVV

SEQ ID NO: 54317 - protein, 420 aa, Dechloromonas aromatica RCB
MTHFALNNGVLHAESVALPAIADQFGTPAYVYSRAALEASLREFHDVLGGHVAGQGALVCYAVKANSNLAILNVFARLGAGFDIVSGGELQRVLAAGADPKKVVFSGVGKTADEMKLALDVGIFCFNVESAAELERLNEVASQCGKKAPISLRVNPNVDPKTHPYISTGLKGAKFGVAYDNALDLYRRAAALPSIEVTGIDCHIGSQLLDPSPFVEALDRILALVDQMAAEGIHIHHLDLGGGLGIKYNAEQAQPTVASYLTPLLDKLAGRGLQVVLEPGRRLVGNAGLLLTRIEYLKQGEAKNFAIIDAAMNDLMRPALYEAWHDINPVVPRSGVATEYDVVGPVCETGDFLGQARPLVVEAGDLLAVMSAGAYGMAMASNYNTRPRAVEVMVDGDKIHVIRQRETVEQLYAGESILPQ

SEQ ID NO: 54318 - protein, 889 aa, Wolbachia endosymbiont strain TRS of Brugia malayi
MDTVYVKYVCQEKPETMEEKLIYYFSQDKCEGNAEMKSLLGGKGANLAEMCNIGIPVPPGFTISTSACKSYYQGNGLSDDLCSTIKEYMTMLENDIGCKFGDSNNPLLVSIRSGSVNSMPGMLDTILNAGLNDTTVIGLAKKSGERFAYDSYCRFIMMYSNVVLQLDHQLFQSIIDNERQKNGAKSLADLNVDVLKRIVCDFKKIVHEKTEKHFPQDIEEQLLSSVNAVFASWQNERAVSYRKIHNIPENLGTAVNVQAMVFGNLNNNSATGVIFTRNPSTGEKKCFGEFLVNAQGEDVVSGVYTPIPINGKQENTMEKLMLSVYQELCEVCKKLEVHYKDMQDIEFTVQGGKLWILQTRSGKRTAEATVRITVDMVNEGTITKEEGILKIDPKIFDNLLHPVLEARGDQKVIGKGLPASPGVASGYVVFSASDAEKAAEQGKKIILVRLETSSEDINGMNAASGIITARGGMTSHAAVVTRGMGKPCICSVNGLHIDKNGNFFSVGDTTVNKGEPITINGGTGEVMLGILPTILPELSQEFKTIINWIDETKMIKVRANADTPKDAKIAKEFGAEGIGLCRTEHMFFASNRIEFIQRLIIADDKTERASALSKLEEMQKSDFKEIFSIMGGREVTIRLLDPPLHEFLPDNQSTIEKIAKSLNKSVESVKNKIVQLSEKNPMLGHRGCRLAISHPEIYSMQTRAILSAVDELKKEKKAEVKPEIMIPFIMSEKEFILICELLKKEAKNFDVNYSIGTMIELPRAALIADKLAKYAEFFSFGTNDLTQTTMGLSRDDSVSFLNSYKENNIFENDPFEVLDVEGVGELIKIAIERGKKTRKEIKLGVCGEHGADPRSIEFLIKSGVSYISCSPYRVPIAKLVAAQKSKCVG

SEQ ID NO: 54319 - protein, 168 aa, Nicotiana benthamiana
ANGKNYLHKRNPPIVHRDLKSPNLVVDKKCTVKVCDFGLSHFKANTFLSSKTAAGTPEWMAPEVLRDEPSNEKSDVYSFGVILWELATLQQPWSDLNAPQVVAASGFRGKRLDIPSGLNPQVATIIEACWANEPWKRPSFSTIMDMLRPNLKSPLTPQSGHTDMQLLS

SEQ ID NO: 54320 - protein, 199 aa, Brassica napus
  misc_feature (124)..(124): Xaa can be any naturally occurring amino acid
  misc_feature (137)..(137): Xaa can be any naturally occurring amino acid
  misc_feature (153)..(153): Xaa can be any naturally occurring amino acid
  misc_feature (166)..(167): Xaa can be any naturally occurring amino acid
  misc_feature (174)..(174): Xaa can be any naturally occurring amino acid
  misc_feature (182)..(182): Xaa can be any naturally occurring amino acid
  misc_feature (185)..(185): Xaa can be any naturally occurring amino acid
  unsure (1)..(199): unsure at all Xaa locations
MDPIHGFMSTSNISHNTNLMIAAAAATTTTTSSSSSSSGGSATNQLSRYENQKRRDWNTFGQYLRNHRPPLSLSRCSGAHVLEFLRYLDQFGKTKVHMQICSFFGHPNPPAPCTCPLRQAWGSXDALIGRLRAAFEXNGGSPETNPFGARAVXLYLREVRDSQAKXXGISYEKXKRKRPPQXPLXPPHQPVISNSPNLQ

SEQ ID NO: 54321 - protein, 514 aa, Francisella tularensis subsp. tularensis SCHU S4
MYVLRIHRVIMDFLTEKQNREIEEYAVSQGLNLIENASDEIVKLICNKFDKQSKVLVIAGSGNNGSDGIAAAIKLFNKGYDVDIYRVFPKGNRDNQNYYAKFSNLKDPLRELTNISDYDVVIDAIFGIGLDRNIDGYILEIINAINQNSKYTLAIDVPSGLGAFNAKVYGQAIQANETITFLADKQGLHTGDGLDYAGKVTVKELIDSSNIKLSQSEYQVYKNHIQDINLANILRKKKNTNKGTYGNLAIIGGNVGMNGALQLAGKSALYSGCGKVSMISLDRGFRADISIPELMTKPLEIISKNLAIFSALAIGVGFDTTDESQQILELIIGNITQPIIFDADALNIIETNQQIREKFIQLENKIITPHPAEAARLLGCTIQKIQNDRFDAVRALAKKYNATVVLKGVGSLICKDDEIYINTTGNQGMAVAGQGDVLSGIIGAFLAQGLDILSASRLAVYIHGLAGDNLAKKLGGYIGIFPSGVAEEVCEVLNLFIWKLCYTHKFSLQANHFF

SEQ ID NO: 54322 - protein, 510 aa, Arabidopsis thaliana
MVRKRETNPGVRVVGKRIYDSQNGKSCHQCRQKTLDFAAPCKAMRRKKLCPIKFCYKCLSIRYGENAEEVAKLDDWICPLCRGICICSVCRKAQGLEPTGILAHEAKARGYSSVYALLEAEGHDKFAYQKKPELVLKKIIQIVVLVSACNEDVPKEKKKVVDKRKRAKPSDKLKEEIQLEAQLPEGISLTCVSRIDIPTEEAGNVCQLFEFCSAFGKALALKEGHAETIVRELFICGRNTRRQQYCSITQMMIQLLDLISKDREMSLSLSATDSSWFTAIGEILSKSEVLSDELPLETFVGGVAAYEKMNASRKLKLLNFLCDESLSTWAMRNYINSQTEECGERKKEAKQKAAAAKQKEKQLKQKMQGEVAKSIMEKNGAPLSIEEHNSIVSQIRDEAKEAHEEMMEAKGMKSKMTLICDARRTEPIMLDDNGFVLWKLKCFEEEQFFLLQDLGTFDDLCPHERWLAFKPEQKPEIENISLVREAMKMYVKVYGWMNPNRNRNRNYNSL

SEQ ID NO: 54323 - protein, 149 aa, Carboxydothermus hydrogenoformans Z-2901
MERTFIMVKPDGVQRGLVGEIISRFEKRGFKLVGLKLMQISRELAETHYGEHKGKPFFEGLLNFITSGPVVAMVWEGKEVIATAREMMGATNPLKAQPGTIRGTYGIDVGRNVIHGSDSPESAAREIALFFKEEELLSYEKTLDTWIYE

SEQ ID NO: 54324 - protein, 428 aa, Erwinia carotovora subsp. atroseptica SCRI1043
MADKKATLTLEGKDPIELNVLSGTLGYDEIDIRPLGSKGYFTFDPGFTSTASCESKITYIDGDEGILLHRGFPIAQLAEKSNYLEVCYILLFGEPPTAEQYETFKTTVTRHTMIHEQITRLFHGFRRDSHPMAVLCGVTGALAAFYHDSLDISIERHREIAAYRLLSKMPTVAAMCYKYSLGQPFVYPKNNLSYAGNFLHMMFSTPCEEYVVNPVLERAMDRILILHADHEQNASTSTVRTAGSSGANPFACIAAGIASLWGPAHGGANEACLRMLEEISSVEHIPAFIERAKDKNDSFRLMGFGHRVYKNHDPRATVMRETCHEVLKELGRKDDLLEVAMELEHIALNDPYFIEKKLYPNVDFYSGIILKAMGIPSSMFTVIFAMARTVGWIAHWSEMHADGIKIARPRQLYTGYDKRDFASNLKHD

SEQ ID NO: 54325 - protein, 285 aa, Mycobacterium sp. JLS
MVDSAPTPDGVIPYPGETSKMSERPSDEMTDYVGRDLLAGKRALITGGDSGIGRAVAVAFAKEGADVSIAYLEEHADAEHTAALVERCGRRSLLLPGDLAEAEQCRTVVKRTVAEFGGLDIVVNNVAYQNPTESFTDISDEQWRRTFAVNIDSFFRVTKAALEHLPDGGAIINTSSINGLRGNKTLIDYSATKGAVLALTYSLAQSLADRKIRVNCVAPGPVWTPLIPATMDAEKTESFGEQTPMGRAAQPDEIAPSYVFFAAGRMSSYYSGEVLAPIGGETLPG

SEQ ID NO: 54326 - protein, 497 aa, Chromobacterium violaceum ATCC 12472
MSTGTINWQKKAEQLHFEGRAYIDGAYRKALSGKEFTTINPATGKVLASIEWCGKEDVELAVCAARRAFDGGAWSELATRSRMEILKRFASLIQDNIEELALLESLDVGKPIANSLSVDISNTAYCISWFAELIDKAPGEVVPVDPALLGMVTREPVGVVAAIVPWNFPLMMASWKFAPALAAGNAVILKPSEKSPLTAIRVAALAEAAGIPPGIFQVLPGAGDVGQALASHLDVDCVAFTGSTAVGKQIANYAAQSNLKRVWLELGGKSPNIILADCKDLKEAAKAAAGAICYNAGQMCTAGSRVLVAREIREAFLSELKVAMADYRPGDPLSPETNLGAVVDQRQFDKILSYITQGQNEGAKLLQGGAAVQTVHPNGLFIEPAIFDCPQPNLTICREEIFGPVLSVITFDDVDEAVRIANDSQYGLGAAVWTQNVSTAHKVARRLRAGTVWVNCYEEGGDMNLPFGGYKQSGNGRDKSLHALEKYTELKSTLIKL

SEQ ID NO: 54327 - protein, 197 aa, Pseudomonas syringae pv. tomato str. DC3000
MAERKAYVERNTLETQIKASINLDGTGKARFDIGVPFLEHMLDQIARHGLIDLDIECKGDLAIDDHHTVEDVGITVGQAFSQAIGDKKGIRRYGHAYVPLDEALSRVVIDFSGRPGLQMHVPYTRATVGGFDVDLFQEFFQGFVNHANVTLHIDNLRGTNTHHQIETVFKAFGRALRMAVELDERMAGQMPSTKGVL

SEQ ID NO: 54328 - protein, 166 aa, Glycine max
RIEPVTVPLVDLPEISEPSVLLSDSIRNVLYVSLPPLIHGRKWLLLYSTWRHGISLSTLYRRSMLWPGLSLLVVGDKKGAVFGSLVEAPLRSSSKKKYQGTNKTFVFTNISGQPVIYRPTGVNRFFTLCNTDYIAIGGGGHFALYLDGDLLPSINNMISLSFVFVF

SEQ ID NO: 54329 - protein, 276 aa, Auxenochlorella protothecoides
CFAYSFSSILVEIQDTLRQPPKAAKTMSKATNVSVTASFAFYFVVAIGGYASLGNDVPSYILGGLQGPEWVIFVANLCVLLHMWSAYQIYAHPMFDTLESHVKAFKLRQAKAKGDAELPAKVEELKRMSLAARQGSAAGTKTMDDTAPAAPPAANPLCRLSRVSAMAGEKLQRLSQNAAMYRVSTGFADTSVPSNDDHFVLPWWQRLITRRMYVVRTTLIAAIMPFFGAMAGLVGALAFFPLTSSSPSAAGAPCTSPLGGSITCCTSSSSAWRWCA

SEQ ID NO: 54330 - protein, 129 aa, Neisseria gonorrhoeae FA 1090
MSKTVIHTDKAPAAIGAYSQAVRAGGTVYMSGQIPLDPATMTVVGNGDFHTEARQVFQNLQAVAEAAGGSLDDIVKLNAYLTDLGNFAVFNEVMAEFITEPFPARAAVGVASLPKGVQVEAEAVLVLNA

SEQ ID NO: 54331 - protein, 145 aa, Gossypium hirsutum
MAHFQNQYSAPEVTQTDAYGNPTRRTDEYGNPIPTQETGRGILGIGGHHHGGHHGLHRTGSSSSSSSSSEDEGTGKKKKGLKERLKEKIPGNKEHQSQATSTTTPGQGPTYHQHHREERSDGQDQGEAPWSPQPLISCLWSAISY

SEQ ID NO: 54332 - protein, 130 aa, Solanum lycopersicum
MAQYGNQDQMRKTDEYGNHVQETGVYQGTGTGGMMGGTGTGGMMGGTGGEYGTQGMGTGTHHHEGQQQLRRSDSSSSSEDDGEGGRRKKGLKEKIMEKMPGQHEGEYGQTTGEEKKGMMDKIKDKIPGMH

SEQ ID NO: 54333 - protein, 305 aa, Clostridium perfringens str. 13
MKNFLESLIENNRQYVEHGKLASYIPELEKANKEDLGIYIVTLDGKEVGAGEYDKKFTIQSISKVITLMLAILDNGKDRVFSRVGVEPTGDSFNSIVSLERKPSKKPFNPMVNSGAILTTSLIEGDSEEEKFERILEFTRKVTGNDDIQLNEDVYLSEKETGDRNRALAYFMKSNGVIEGNIDDILDLYFKQCSLEVNAKDLARFGAMLANDGVLPWNGERVISREICRIIKTIMVTCGMYDDSGKFAVHIGIPAKSGVGGGIMAAVPRRMGIGIFGPSLDDKGNSIAGTHVMKDLSEELDLSIF

SEQ ID NO: 54334 - protein, 576 aa, Xanthomonas campestris pv. campestris str. ATCC 33913
MSLRLRGHAASRGNALGRARVRQSHTLEVAEQRVPANQVETQLQRLHAAIAAARTEMQQLRDRLHGALAREVGEFLELHALLLDDPELLQGLDDLIRTHRYSADYALRVQRDRLAAVFDGMEDAYLRSRMDDLDHVIGRIHAFLHKRAPDLKGVAGEILVCDNVAPSELAQLQAQGVVGIVTTAGSALSHSAILARSLHLPLVVGVADAVQRVNDGDVLIVDAGSGQVIVDPTPEHLRDYRERLRTLAKEQRELGRLRSKPTRTRDNVDITLLANAESLEDVAKAHALGASGLGLYRTEFLFLQRNELPDEDEQFHTYRDTVLGMSGRPVTIRTLDLGADKADRTGLTLSDEDNPALGLRGVRLSLARPAVAQAQLRAILRASGYGPVRILVPMVSGREEILLVRKQLKKLTAQLRDEGHEIAEHIPLGAMIEVPAAALALDCFIDDIDFLSIGTNDLVQYLLAVDRNNEALGELYSPLHPAVLRLIAQVIATGRAHNKPVAVCGEIAGDPRFVAMLLALGLTEFSLHPATLLEVRRAVRDLHLGQLRVHGEKLLRARDRKSIEKWLASVAQGLLH

SEQ ID NO: 54335 - protein, 205 aa, Betula pendula
MPCSTEAMEKAGHGHASTPRKRSLSNSSFRLRSESLNTLRLRRIFDLFDKNSDGIITVDELSRALNLLGLETDLSELESTVKSFTREGNIGLQFEDFISLHQSLNDSYFAYGGEDEDDNEEDMRKSILSQEEADSFGGFKVFDEDGDGYISARELQMVLGKLGFSEGSEIDRVEKMIVSVDSNRDGRVDFFEFKDMMRSVLVRSS

SEQ ID NO: 54336 - protein, 689 aa, Aquifex aeolicus VF5
MVVQLDQIHFFIFHEVLKIFKTMPQLFKTSKKIDELVINTIRFLSVDMVERAKSGHPGMPLGASHIVYLLYDRIMKYNPKNPNWFNRDRFILSAGHGSAMLYAAFYMFGFDLTLEDLKAFRQLNSKTPGHPEYGLTPGVEVTTGNLGQGFGNAVGMAMAEKFLSHYFNREGYPVIDHYTYVLVSDGDLMEGVSYEAASLAGHFKLNKLIAIWDNNHITIDGDTKLTWTEDVLKRFEALGWEVYHLEDGYNLDLLEETILKAKESDKPTFISVRTHIGYGTPLQDTPEVHGKPMGKEIVEETKKKFGWPLEEFYVPEEALNYTRRKVEEGKALEEEWNKLYAEYREKYPDLAQTLEKALNKEWSLDWLEKVEEFKEDMPTRKASGKVLNVMADYIPTMIGGSADLSESVNTVLKKYGDFEADTPTGRNVHYGVREHAMGTILNGMAYHGGILPYGGTFLIFSEYMRPAIRTAALANLQVIFVYSHDSIGLGEDGPTHQPVEQLWSLRSIPNLWVVRPADANEVKYAWEIALKRKNGPTAIILTRQKVKTIDRSKYASPEGVRKGAYVIADTEGKPDVVIIATGSEVQVALGAKEILEQKGIKTRVVNMACCELFEEQPEEYKREVLPPEVTKRVAVEAGRDTGWYKYVGSDGLVISLNEFGKSAPGSVLFEYYGFTPENVANKVIEKWFS

SEQ ID NO: 54337 - protein, 461 aa, Xanthomonas campestris pv. campestris str. ATCC 33913
MPLPTDPVAETASSAAPALRHALKPRQLMMMGLGTAIGAGLFLGSGVGIHAAGPAVLVSYLIAGALVIIVMNALGEMAAAKPASGAFSVYAADAMGPTAGATVGWLWWLQIVVVIAAEAVGAASLLATVWPALPVPMLASVFMATFTVINLLGVRNFGEFEFWFAILKVVAILIFLMIGGALLAGLLPGVASPGLSNFTQHGGFAPKGLAGIGTALLVVVFAFGGTEIVAVAAAETADPGRSLARTIRTVAWRILVFYIGSISVIVAVVPWTSDALSSPFAAVLEVARIPGAATGITLVAVVALLSALNANLYGASRMIFSLAQRGEAPRWLGNTSRQQVPLVAVIASVLFGFAAAVLELLYPGKVLPMLLNIVGATCLLVWTISLLSQLILRARADRAGIALPFRMRGYPVLTLLALAILAVIFVLLALSADTRAQFLSMVGLTAGIALVSELARRMRKR

SEQ ID NO: 54338 - protein, 309 aa, Saccharomyces cerevisiae
MSAVFNNATLSGLVQASTYSQTLQNVAHYQPQLNFMEKYWAAWYSYMNNDVLATGLMFFLLHEFMYFFRCLPWFIIDQIPYFRRWKLQPTKIPSAKEQLYCLKSVLLSHFLVEAIPIWTFHPMCEKLGITVEVPFPSLKTMALEIGLFFVLEDTWHYWAHRLFHYGVFYKYIHKQHHRYAAPFGLSAEYAHPAETLSLGFGTVGMPILYVMYTGKLHLFTLCVWITLRLFQAVDSHSGYDFPWSLNKIMPFWAGAEHHDLHHHYFIGNYASSFRWWDYCLDTESGPEAKASREERMKKRAEKNAQKKTN

SEQ ID NO: 54339 - protein, 681 aa, Nocardioides sp. JS614
MDFYSAYAHGFARVAACTVPIRVADPATNARAVLEQAQACSDEGVAVAIFPELCLSGYALDDLFLQDVLLDAVADEIAGLVAASEGLLPVLVVGAPVAHGSRVLNAAVVIHRGRILGVAPKSYLPTYREFYERRWFAPGDDVRGSMVLAGQEVPVGPDLLFEAEDVRGLVLHVEVCEDMWVPVPPSAEAALAGATVLANISGSPITVGRASDRHLLARSASSRCLAAYLYAAGGQGESTTDLSWDGQTMVYEHGELLAETERFPDGPRAAIVDLDLDRTRLERLRTGTFDDNRRTIGPEFRTVDFELGPPTKDIGLRRKVDRFPFVPDDAERLAQDCYEAYNIQVSGLEQRLSAIGEGHVGQPKVVIGISGGLDSTHALIVAAKAMDRLGRDRSEILGFTLPGFATGEATKGYAWALADSLGITMQEIDITDAARAMLTDLDHPYAKGEEVYDITFENVQAGLRTDYLFRLANHRGGIVLGTGDLSELALGWCTYGVGDQMSHYNVNAGVPKTLIQHLIRWVISTGQFDESTNAVLLDVVGQEITPELIPTREDHLPQSTEESVGPYSLQDFTLFHVLRYGYAPSKIAFLAWHAWHDADAGEWPPNYPDDRRIEFDLATIRRWLEVFVRRFFASQFKRSALPNGPKVSHGGTMSPRGDWRMPSDASPAAWLAELEANVPTS

SEQ ID NO: 54340 - protein, 250 aa, Leptospira interrogans serovar Lai str. 56601
MRKTIIAGNWKMNLSLKEAVFLAHSIREKIPSISKDKVSMVFPSTLHLENVSKILEGSSVIVGAQNCYHSGLAAFTGETSPDQLKEIGVKVVMVGHSERRQFLGESNFFCNDKIRFLLKNEFTVLYCVGETLSERESGKTLEVLSSQIREGLKGIDSVFFSNLILAYEPVWAIGTGKVATPSQAQEVHSFIRKEISGLFVGASSISESISILYGGSVKPDNIQDLLKEKDIDGGLVGGASQKISSFAELF

SEQ ID NO: 54341 - protein, 455 aa, Nocardioides sp. JS614
MGSSPDSLCRMGKQEDFVLRALEERDVRFVRLWFTDVLGFLKSVAVAPAELDGAFSEGIGFDGSAIEGFARVYEADMLAMPDPSTFQILPWRGEGPSTARMFCDIMMPDGSSSYADPRHVLKRTLGKAADQGFTFYTHPEIEFYLFKDTPEAGADPEPVDRSGYFDHTATSSGADFRREAITMLESMGISVEFSHHEGGPGQQEIDLRYADALTTADNVMTFRTVIREVALGQGVWATFMPKPFTTHPGSGMHTHVSLFEGDRNAFFEAGAEYQLSKTGRQFIAGVLRHANEISVVTNQWVNSYKRLMFGGEAPSYICWGHNNRSAMIRVPMYKPNKGQSTRIELRTIDAACNPYLAFAVVLAAGMKGIAEGYDLPREAEDDVWALTERERQSLGIEPLPKSLSEAIAVAEHSELLAETLGEHVFDYFLRNKRAEWEEYRGQVSAFERDRMLPVL

SEQ ID NO: 54342 - protein, 190 aa, Glycine max
  misc_feature (2)..(2): Xaa can be any naturally occurring amino acid
  misc_feature (5)..(5): Xaa can be any naturally occurring amino acid
  misc_feature (7)..(12): Xaa can be any naturally occurring amino acid
  misc_feature (15)..(16): Xaa can be any naturally occurring amino acid
  misc_feature (18)..(20): Xaa can be any naturally occurring amino acid
  misc_feature (23)..(23): Xaa can be any naturally occurring amino acid
  misc_feature (26)..(26): Xaa can be any naturally occurring amino acid
  misc_feature (30)..(32): Xaa can be any naturally occurring amino acid
  misc_feature (36)..(36): Xaa can be any naturally occurring amino acid
  misc_feature (38)..(38): Xaa can be any naturally occurring amino acid
  misc_feature (40)..(40): Xaa can be any naturally occurring amino acid
  misc_feature (44)..(45): Xaa can be any naturally occurring amino acid
  misc_feature (47)..(47): Xaa can be any naturally occurring amino acid
  misc_feature (52)..(52): Xaa can be any naturally occurring amino acid
  misc_feature (58)..(58): Xaa can be any naturally occurring amino acid
  misc_feature (66)..(68): Xaa can be any naturally occurring amino acid
  misc_feature (72)..(73): Xaa can be any naturally occurring amino acid
  misc_feature (77)..(77): Xaa can be any naturally occurring amino acid
  misc_feature (79)..(79): Xaa can be any naturally occurring amino acid
  misc_feature (81)..(82): Xaa can be any naturally occurring amino acid
  misc_feature (85)..(85): Xaa can be any naturally occurring amino acid
  misc_feature (87)..(87): Xaa can be any naturally occurring amino acid
  misc_feature (91)..(91): Xaa can be any naturally occurring amino acid
  misc_feature (94)..(94): Xaa can be any naturally occurring amino acid
  misc_feature (96)..(97): Xaa can be any naturally occurring amino acid
  misc_feature (109)..(109): Xaa can be any naturally occurring amino acid
  misc_feature (115)..(115): Xaa can be any naturally occurring amino acid
  misc_feature (126)..(126): Xaa can be any naturally occurring amino acid
  misc_feature (128)..(129): Xaa can be any naturally occurring amino acid
  misc_feature (131)..(132): Xaa can be any naturally occurring amino acid
  misc_feature (136)..(137): Xaa can be any naturally occurring amino acid
  misc_feature (141)..(141): Xaa can be any naturally occurring amino acid
  misc_feature (144)..(144): Xaa can be any naturally occurring amino acid
  misc_feature (173)..(174): Xaa can be any naturally occurring amino acid
  unsure (1)..(190): unsure at all Xaa locations
EXGGXRXXXXXXNEXXEXXXKKXDLXNGVXXXGGWXVXGXYLDXXGXIFKKXLEKNDXGDYFLLIXXXLGGXXVIRXVXEXXDIXEXFNGXSLXSXXILWKEGNGKGNXFERFCXDLLKKVKKDCXLXXNXXYGIXXGKVXYNXKLFEFFEILEKFEDRDGKIFVLKGRGRKXXENVKLWKKEENDIEWG

SEQ ID NO: 54343 - protein, 156 aa, Thermosynechococcus elongatus BP-1
MTALVRDYMTPNPFTISADAPISEAVRLMEEKQVRGLPVVDDKGKLVGLVSEADLIVREAPLEPPLYITFLGSIIYFESPESFHQHLKKTLGQQVQDVMTPNPHTINVDAPISEAARLMVNHHISRLPVLNDQGELVGIISRHDLLRALHAQEASA

SEQ ID NO: 54344 - protein, 241 aa, Triticum aestivum
  misc_feature (209)..(209): Xaa can be any naturally occurring amino acid
  unsure (1)..(241): unsure at all Xaa locations
LNDKRNNIQVLMDSHLEGNYSTDEATTLVDLASQCLQYEPRDRPNTKKLVSVLEPLQIKSEVPSYEMLGIPRYEEEASPPPQPQHPLSPMGEACSRMDLTAIHQILVSTHYRDDEGSNELSFQEWTQQMRDMLEARKRGDFAFRDKDFKAAIDCYTQFVDVGTMISPTVYARRSLCHLMCDQPDAALRDAMQAQCVYPDWPTAFYMQAXVALSKLNMQSDATDMLNEASQLEEKRQKNTKP

SEQ ID NO: 54345 - protein, 526 aa, Oryza sativa
  misc_feature (165)..(165): Xaa can be any naturally occurring amino acid
  unsure (1)..(526): unsure at all Xaa locations
MPPQAPSPAPAPSGSVGGAAWRHLLLLLTGLPLALAALAFALQWRGGGVDDPTARWPPHAFPGMGMTDPTPPSLPSSACGEVLIASSGPSFPYLRGWSFPFDSDSDAALHPKVCVQTSTSAGLDQILPWLFYHKVVGVAQFLLFVEGRAAKPQVAGVLESIPVGXVKVVYRTQELEEQQARSRIWNETWLAGFFYKPCNYELFVKQSLNMEMAIVMARDAAMDWIIHLDTDELLYPGGGAEYSVRHLLADVPGDVDMVIFPNYESSVERDDIKDPFSEVSMFKKNYDHLPKDTYFGMYKEATRGNPNYFLTYGNGKSAARVQDHLRPNGAHRWHNYAKSPNEIKLEEAAVLHYTYTKFSDLTSRRDRCGCKPTKDDVKRCFMLDFDRAAFIIASTASEEEMLRWYNERVVWNDKQLNLKLLRKGVLTRIYTPMAIVQGLRESGVFTSSIAAAQSLVNDKVSLKENNVQNKNHTKLEKVSRKFIRANSQASARKILHAVEPASHDSNVSAVPPLSPPSLDNHLLELS

SEQ ID NO: 54346 - protein, 545 aa, Dechloromonas aromatica RCB
MVNPYTVGLERNPANYVPLSPLSFLERSAFIYPKRISVIQGARQYTWKESYDRARQLASALKSRGIGKGDTVAVMLPNTASMFECHFGIPMIGAVLNTLNTRLDAEAIAFMLAHGEAKVLITDPEFSKVVKPALELLEGPKPLVIDSLDPDYTEGESLGEKDYESFLNEGEPDFAWQLPEDEWDAIALNYTSGTTGNPKGVVYHHRGAYLNSASNIISWGMPPHSVYLWTLPMFHCNGWCFPWTLAANAGTSVCLRRVDPVLIFGLIKEHKVSHMCGAPIVYGMMINAPETLREGIAHTVNGLIAGAAPPAAIIEGAQRMGFNITHVYGLTETYGPASVCAKQPEWDRLPIDLQAARNGRQGVRYHMQEAIAVLDPVSMEPVPWDGETMGEIMFRGNLVMKGYLKNEKASEEAFAGGWFHTGDLAVVHSDGYVKIKDRSKDVIISGGENISSLEVEDVLYRHPAVIAAAVVAKPDEKWGEVPAAFIELKTDAKCTEAEIIEHCRAHLARFKVPKQVVFGELPKTSTGKIQKYVLRQHANSALAIE

SEQ ID NO: 54347 - protein, 335 aa, Arabidopsis thaliana
MNVLCRVFTSSRVLSSNVTFSFSQIPNNTKKPLLEKRRLSPRVCLRAMASEKQKQHAQPGKEHVMESSPQFSSSDYQPSNKLRGKVALITGGDSGIGRAVGYCFASEGATVAFTYVKGQEEKDAQETLQMLKEVKTSDSKEPIAIPTDLGFDENCKRVVDEVVNAFGRIDVLINNAAEQYESSTIEEIDEPRLERVFRTNIFSYFFLTRHALKHMKEGSSIINTTSVNAYKGNASLLDYTATKGAIVAFTRGLALQLAEKGIRVNGVAPGPIWTPLIPASFNEEKIKNFGSEVPMKRAGQPIEVAPSYVFLACNHCSSYFTGQVLHPNGGAVVNA

SEQ ID NO: 54348 - protein, 221 aa, Platanus x acerifolia
RGDGDDSDVEASGGAENGTAEVKKPKQKKPKKPKVSVAEAASKIDASDLSAFLLDVTASYESQQDIQLMRFADYFARSFSLVTASQFPWTKIFKESPVAKIADIPLSHISEAVYKASTDWINQRSSDALVSFVLWSLDSILADLANQQGALKGKKVVQQVSSKSQVAIFVVLAMVLRRKPDVLISVLPTLRENPKYQGQDKLPIIIWVISQACEGDLVVGM

SEQ ID NO: 54349 - protein, 125 aa, Wolbachia endosymbiont strain TRS of Brugia malayi
MTNLLKKFNEQQMQVLAKEVPEFRPGDDLKVTFKVVDSTSERIQIFEGVCISKRNRGLHSSFAVRKVSHGESIVSQFFIYSPALVSVQVTRRGKVRRAKLYYLCKLFGKAARIKERATYKNNKSN

SEQ ID NO: 54350 - protein, 658 aa, Salmonella enterica subsp. enterica serovar Paratyphi A str.
MTQLAIGEATPHGATYDGHGVNFTLFSAHAERVELCVFDSRGNERRYDLPGRRGDVWHGYLAGARPGLRYGYRVHGPWQPAQGHRFNPAKLLLDPYARRVEGELKDHPLLHGGHDEPDYRDNAAVAPKSVVISDHYDWEDDAAPRTPWGKTVIYEAHVKGLTYLHPELPQEIRGTYKALGHPVMVAYFKQLGITALELLPVAQFASEPRLQRMGLTNYWGYNPMAMFALHPAWASSPETALDEFRDAVKALHRAGIEVILDIVLNHSAELDLDGPTFSLRGIDNRSYYWIRDDGDYHNWTGCGNTLNLSHPDVVEYACECLRYWVETCHVDGFRFDLASVMGRTPTFRQDAPLFAAIKACPVLSTVKLIAEPWDIGEGGYQVGNFPPPFAEWNDHFRDAARRFWLPRNLTTGEFACRFAASSDVFKRNGRAPGASVNLLTAHDGFTLRDCVCFNQKHNEANGEENRDGTNSNYSDNHGKEGLGGPLDLMERRRDSIHALLATLLLSQGTPMLLAGDEHGHSQHGNNNAYCQDNALTWLDWQQANRGLTTFTAALIRLRQQIPALTGNSWWEEGDGNVRWLNKNAQPLSADEWQNGPKLMQILLSDRFLIAINATLEVTDIVLPEGEWRAVPPFAGEDNPVITAVWQGPAHGLCVFQRG

SEQ ID NO: 54351 - protein, 426 aa, Neisseria gonorrhoeae FA 1090
MENSLKEAALKFHELPVPGKISVTPTKSLATDKDLALAYSPGVAAPCMEIHADPQNAYKYTGKGNLVAVISNGTAVLGLGDIGALAGKPVMEGKGVLFKKFAGVDVFDIEIDEKDPQKLVDIIAALEPTFGGINLEDIKAPECFYIERELRKRCKIPVFHDDQHGTAIITAAAVLNALRYTGRKIEEATLVCSGAGAAAIACLNQLLDLGLKRENVTVCDSKGVIYQTREDKDRMDESKKFYAVEDNGRRVLADAVKGKDIFLGLSGANLLTPEMLNTMNEKPIVFAMANPNPEILPPLAKETRPDVVIGTGRSDFPNQVNNVLCFPFIFRGALDVGATTINEEMKRACVYALADLAMEEVTEEVVAAYGKKFEFGAEYLIPTPFDSRLLPRVATAAAKAAMESGVATRPIADLEAYAAKLGEWKL

SEQ ID NO: 54352 - protein, 284 aa, Burkholderia vietnamiensis G4
MSRPSFLIGLIGQGIGGSLSPAMHEEEGFRQGYGYVYRRIDLDALGVNADALPQLLDAAQQMGYNGLNITHPCKQRVIEHLDALSDDARALGAVNTVLFKDGKRIGHNTDWSGFARSFRRGLPDASLARVVQLGAGGAGAAVAHAALQMGAAELTIFDVDGARAIALAGELQQRFPAARVAAGDDLAAAMRAATGLIHATPTGMAKHPGLPLPAELLHAGMWVADIVYFPLETELIRAARAVGCATLPGGGMAVYQAVDAFELFTGRTPDDERMFEHFQSLVAR

SEQ ID NO: 54353 - protein, 139 aa, Hordeum vulgare
MEYQGQHGHATDKVEEYGQPVAGHGGFTGGPTGTHGAAGVGGAQLQATRDGHKTDGVLRRSGSSSSSSSEDDGVGGRRKKGMKEKIKEKLPGGAHKDAAGQQQQTAMAGEYAGTHGTEATGEKKGVMDKIKEKLPGGQH

SEQ ID NO: 54354 - protein, 168 aa, Zea mays
MEYGQQGQRGHGRTGHVDQYGNPVGGVEHGTGGMRHGTGTTGGMGQLGEHGGAGMGGGQFQPAREEHKTGGILHRSGSSSSSSSEDDGMGGRRKKGIKEKIKEKLPGGHKDDQHATATTGGAYGQQGHTGSAYGQQGHTGGAYATGTEGTGEKKGIMDKIKEKLPGQH

SEQ ID NO: 54355 - protein, 463 aa, Pseudomonas syringae pv. tomato str. DC3000
MSSTANSSELEQGLKPRHITMLSIAGVIGAGLFVGSGHAIAEAGPAVLLAYAAAGTLVVLVMRMLAEMAVASPDTGSFSTYADRAIGHWAGFTIGWLYWWFWVLVIPLEANAAATILHAWFPDIAIWMFTLVITLLLTATNLFSVKNYGEFEFWFALIKVVAIIAFVVLGVAAIFGLLPTSSVSGVSHLFDTGGFLPNGMGAVLAAMLTTMFSFMGTEIVTIAAAESRNPGKQITKATNSVIWRIFLFYLVSIFIVVSLVPWNDPRLAEVGSYQTVLDAMGIPNAKLIVDLVVLVAVTSCLNSALYTASRMLFSLGKRGDAPALSKRTSKGGTPYWAVIMSTAAAFLTVFANYVAPAAVFDFLLASSGAIALLVYLVIAVSQLRMRQKRIAAGETIDFKMWLFPWLTWAAIAFIVAVLTIMLIQQEHRVEIIATGVLSLLVIGAGLIVSRRRKAGPVGAAALG

SEQ ID NO: 54356 - protein, 143 aa, Hordeum vulgare
MEYQGQTGHATTDKVEEYGQPVAGHGGATGGPTGTHGAAAAAAGTGQLQPTRDDHKTDGVLRRSGSSSSSSSEDDGVGGRRKKGMKEKIKEKLPGGAHKDAAGQQHTPAAGEYAGTGTHGAEATGEKKGVMDKIKEKLPGGQH

SEQ ID NO: 54357 - protein, 389 aa, Arabidopsis thaliana
MTKISDLPRDLAEEVLSRVPVTYLRAIRFTCKKWNTLTKRRSFTKKLIGQEKAEAKVKEFHAIMTLNSRLHLMSVNLDGIHKDENVESSIKQKGKLISLTVADPDRIVISQVYHCDGLLLCITNEINSRLVVWNPYSGQTRWIEPRTSYREWDIYALGYESKNNAKRSYKILRYLDAYEDMGDMSVEPRTRVCEFEIYSLDTNSWKVIEVTTDWDLCFLHRGVTLKGNTYWFAREKIPPPPRERVIEDIPLEKFGSRLPLPFRPCVDDTITLSSVREEKLAVLYQRWDITWTGIWISNKIEPNAVSWSKLFFPMGRIRPLEAASGTFFVDEENKLVVLFDKGESILNPTRNTAYIVGEDGYIKPVDLGESVHKYCFPLACSYVPSSVQI

SEQ ID NO: 54358 - protein, 161 aa, Hordeum vulgare
MEHGHATNRVDEYGNPVAGHGVGTGMGAHGGVGTGAAAGGHFQPTREEHKAGGILQRSGSSSSSSSEDDGMGGRRKKGLKDKIKEKLPGGHGDQQQTGGTYGQHGHTGMTGTGEHGATATGGTYGQQGHTGMTGTGAHGTDGTGEKKGIMDKIKEKLPGQH

SEQ ID NO: 54359 - protein, 1708 aa, Bifidobacterium breve
MAVRRFSSLAKRLAVTGIAVAMSATTLVALPASADETEANAQARTSVGAPGDVIAIAFQTNWNSVAKECTEAYGPEGVGYVQVSPPMESIQGTEWWTSYQPVSYKLDSKLGTEAEFKTMIATCNAAGVEIIADSVINHTTGADQGEGTGVAGSKYDGEGNFPAIPYTKENFHDCTKNIGDYTNADEVQNCRLTSLQDLDTSQEYVQDKLADYMNRLLDLGVYGFRVDAVKHIATADVAAIKAKLAEKSGRNADDIFFEQEVIGNASEAAEIQPSNYVANGKVSEFNFTNHLSVAFAGDITDASKGLAKVGGDGWVSSDKAAVWVTNWDTERGSSITYKKGSKYLLANAFMLAYDYGQPHIYSGYYFDNSDDGAPGATETSVPDMECPTDGSMTSGTWQCAERWTAIRGMIGFHNAVNGTDVTNWKAYDTNVLGFGRGDVGYLALNNSADDSKQTFQTSLPAGEYCNVYATGDCSATVTVKDDGTFDATLAKNSAIAIYAGATKDSWTGTTKSDPSDPDLSVNDETKKAAADTSRTIYYKLPDGWKQAYLHYGIDGWAEQGHELMADAGNGWVKFTVDPKGKSFEYVFTDGGDNWDNPNGGGNYTAQGHWTAVADHEASAGVPSDVQSYQPKTKVIVHYKPAEGDAVADRGVYMWGTDKNGATLNGAWHAFTGEDSYGKVFETTIDGAYDAAKIGVIVTTEGWDKVGGDRTIDGSTGTAEIWVDGANPDETLTEAPDGYKKAANQIDVTIHYHRLADDYTSEDGMKAWDIWGWADGVNGAAYPFTEHDDYGLIAKYTLKGSGMSTPQFIVRYGGDSWEAKDPNDENRTIPQSAITVNADGTASAEIWLVQGDTTIYTNGTLYDAKGMIVSAEMTDFNTITVKLNKALTIDKPADAVSVEGVKIKDVKASGNTVTITTADNLDVTKAYKVTIEDYGTQNVSLGAVVRSDAFDKKYAYDGDDLGVTYKAEKSTFKLWAPTATKVTLRLYADSTDPKAAQTDAVTLEKSGKKGVWTFAVDKDLKDYAYDYELTFADGTVNTSADPYATAAVANGERSVVLSDKEKGDAGKRMASFSKPTDAIITEANVRDMTINPNSGVSEANRGKYLGFVEEGTTVDGKQGAASTGIDYLKSLGVTHVQIMPVYDYGSVDETGDLSYGAQYNWGYDPENYNVPEGSYSSDPSDPSARVKEMKQMVSGLHKNGLYVVMDVVYNHVYNASEHAFNKTVPGYYFRYDANGNLTNGSGCGNDVASERAMARKYIVDSVKYWATEYNVDGFRFDLMGLIDQTTMNQVRAALDEIDPSILVIGEGWDMTDAIGNQETTQPNASKVKGVAFFNDSLRDAIKGSVFSDEDTGFIAGKADKENLIATNVLGCNNKREGIDENGHCNNGTADTNYGGADQVVQYVEIHDNLTLYDKLVKSAPNDSEETRLARAKLADSLILLSQGIADMQFGQEFLRTKGGNGNSYNAGDAVNAIDWNRTVEQAGSVNYVKGLIALRKSIKNLHLSSYDDIAKNMTVLQQSDGVVAYQLKDGGDTYVVVFNANESAATVEAVPAGKYTVLAADGKVTETQDKNAATTVGADGYQAGALAAAVLKAGADDDSTKPDGGKDDSSKPGNNDGKDDNQSGGTATPGTPGDSGNGNGQTGDGNASNGASDTAAGQSQQFGAAALPNTGVALSVMAVAVLVMTAAGMLLQRFSKGSNVVNSKEGSEQ

SEQ ID NO: 54360 - protein, 225 aa, Hordeum vulgare
MEYQGQQHGRVDEYGNPVAGHGVGTGMGTHGGVGTGAAAGGHYQPMRDEHQTGRGILHRSGSSSSSSSEDDGMGGRRKKGIKEKIKEKLPGGHGDQQHNAGTYGYGQQGTGMAGTGGTYGQQGHTGMTGMGATDGTYGQQGHTGMAGTGAHGTAATGGTYGQQGHTGMTGTGMHGTGGTYGQQGHTGMTGTGMHGTGGTYGQHGTDTGEKKGIMDKIKEKLPGQH

SEQ ID NO: 54361 - protein, 232 aa, Bacillus cereus E33L
MIYSCYPIIIFRENREMTNNNQIGENKEQTIFDHKGNVIKTEDREIQIISKFEEPLIVVLGNVLSDEECDELIELSKNKLARSKVGSSRDVNDIRTSSGAFLDDNELTAKIEKRISSIMNVPASHGEGLHILNYEVDQQYKAHYDYFAEHSRSAANNRISTLVMYLNDVEEGGETFFPKLNLSVHPRKGMAVYFEYFYQDQSLNELTLHGGAPVTKGEKWIATQWVRRGTYK

SEQ ID NO: 54362 - protein, 640 aa, Oryza sativa (japonica cultivar-group)
MVGVLLLLSIMPLAAGELLAQLCGNGGNYTANGTYQSNLARLAAALPSNASSSPDHFATATAGQAPDAAYALALCRGDVANATACGDCVAASFQDARRTCPSDKSATIYYDDCLLRFAGDDFLAAPNITENATLFQAWNQQNITGDAAVAAANVRELLTVTARTAAAAARRFATGFMDGSSESKQTLYSLAQCTPDLAAGDCLACLQRLIAMVNSTTSVRLGGRVLLLRCNLRFEAFVFYAGEPTRRVSPPGSTPAPDSIAPTKNRKKSKSWVIAAIAAPVAAVVLCLIVCYYCRWSRRFRKDRVRLREKRSRRFRGDELICEMEGEISEFSVFEFREVIKATDNFSEENKLGEGGFGPVYKGLFSEGLEIAVKRLASHSGQGFLEFKNEVQLIAKLQHRNLVRLLGCCSQGEEKILVYEYLPNKSLDFYIFDERKKDLLDWNKRLVIIEGIAQGLLYLHKHSRLRVIHRDLKPSNILLDSEMNPKISDFGLAKIFGSNSNEGTTRRVVGTYGYMAPEYSSEGLFSPKSDVFSFGVIILEIISGKRNASLDQCEDFINLLGYAWKLWSEERWLELLDASLVTNWQSSCMLRCINIALLCVQENAVDRPTMSNVVAMLSSESMVLDEPKHPAYFHINENIL

SEQ ID NO: 54363 - protein, 365 aa, Yersinia pestis CO92
MRLAMKKTYRIAAIPGDGIGHEVMPEGINVLQAAALRWDLDISFENIEWASCEYYQHHGQMMPNDWQRQLQCFDAIYFGAVGWPATVPDHISLWGSLLKFRRDFQQYVNLRPVRLFPGIPCPLVGKQPGDIDFYVVRENTEGEYSSVGGRLFEGTEQEMVLQASIFTRRGVDRILKYAFELAQMRPRKRLTSATKSNGLAFSMPYWDERFEVMAAQYPQISADKQHIDILCARFVLNPERFDVVVASNLFGDILSDLGPACAGTIGIAPSANLNPERDFPSLFEPVHGSAPDIYKRNIANPIAMIWAGAMMLDFLGQGDERYHAAHNGILNAIEQVIAQGPKTPDMCGDASTQQVGSAIVQVLSH

SEQ ID NO: 54364 - protein, 223 aa, Brassica napus
MDPCSFVRIILGNLTVRFPATSPSSSSSEPSVSGINPSTPNCYCKIRFKNFPRQIASVPVMFRTESESETRSSGNISTVAACFSLSKAQIQVALKKPNWSVLSIETYSRVGDGVSGASCGLASGSEKLLGRFDVSIDLKSAETKTSLAHNGWVALRRSQKGGMSGSDPELHVTVRVEPDPEIPCFSSTASPECSPQVFQVQGNTKTAVFTCQFGARSFNFGDR

SEQ ID NO: 54365 - protein, 226 aa, Oryza sativa
MKLEVMPKQRAMEAEQREEAMEMSGLELWKHEKPASMVVFLPPPPPPPPLVPAAAAAVAAACGEEATLVPPLNFAMVDDGIFRSGFPAAANFRFLKSLNLRSIVYLCPEPYPETNAEFLAKNGIKLHQFGIEGRKEPFVNIPDDKIREALKVVLDVKNQPLLIHCKRGKHRTGCVVGCLRKLQKWCLSSVFDEYQRFAAAKARSTDQRFMELFDISSLKHLTASHC

SEQ ID NO: 54366 - protein, 273 aa, Gloeobacter violaceus PCC 7421
MTAQSPATQATPISWVFVGFMAFIHLGALAALWQFSWSALALAIFLHWALGCLGITLGFHRLLSHRSFTVPKPLEYFLALLGTLCLQGGPVLWVAHHRLHHAHSDTEADPHDSNRGFWWSHWGWMFYMPEERLNFDHYSRYAKDLARDPVHRFLNRNMIPLQLAFAALLYLLGGWPFVLWGIFVRLVVVFHCTWLINSACHQWGYRSHQTDDHSTNLWWAAILAYGEGWHNNHHAMPRSARHGLAWWEIDVTWSVIWILSKLGLARNVQLPTS

SEQ ID NO: 54367 - protein, 332 aa, Saccharomyces cerevisiae
MVRVAINGFGRIGRLVMRIALSRPNVEVVALNDPFITNDYAAYMFKYDSTHGRYAGEVSHDDKHIIVDGKKIATYQERDPANLPWGSSNVDIAIDSTGVFKELDTAQKHIDAGAKKVVITAPSSTAPMFVMGVNEEKYTSDLKIVSNASCTTNCLAPLAKVINDAFGIEEGLMTTVHSLTATQKTVDGPSHKDWRGGRTASGNIIPSSTGAAKAVGKVLPELQGKLTGMAFRVPTVDVSVVDLTVKLNKETTYDEIKKVVKAAAEGKLKGVLGYTEDAVVSSDFLGGSHSSIFDASAGIQLSPKFVKLVSWYDNEYGYSTRVVDLVEHVAKA

SEQ ID NO: 54368 - protein, 333 aa, Saccharomyces cerevisiae
MSEPSEKKQKVATSSLEQLKKAGTHVVADSGDFEAISKYEPQDSTTNPSLILAASKLEKYARFIDAAVEYGRKHGKTDHEKIENAMDKILVEFGTQILKVVPGRVSTEVDARLSFDKKATVKKALHIIKLYKDAGVPKERVLIKIASTWEGIQAARELEVKHGIHCNMTLLFSFTQAVACAEANVTLISPFVGRIMDFYKALSGKDYTAETDPGVLSVKKIYSYYKRHGYATEVMAASFRNLDELKALAGIDNMTLPLNLLEQLYESTDPIENKLNSESAKEEGVEKVSSINDEPHFRYVLNEDQMATEKLSDGIRKFSADIEALYKLVEEKM

SEQ ID NO: 54369 - protein, 114 aa, Listeria monocytogenes EGD-e
MNKLIDEITKSQLNPDVPNFRPGDTVRVHAKVVEGTRERIQLFEGVVIKRRGAGISETFTVRKISNSVGVERTFPVHTPRIAKLEVIRRGKVRRAKLYYLRNLRGKAARIKEIR

SEQ ID NO: 54370 - protein, 546 aa, Dechloromonas aromatica RCB
MLPKLSSFPGVQGPVVIIVMDGYGLPKTDVGSAIAAARKPTLDRLFASYPNVRLRAHGTAVGMPSDDDMGNSEVGHNAIGAGQVYSQGASLVSNAIASGAIWQGEAWQQIVAGAKAGRGVVHFMGLFSDGNVHSHIDHLKAMVVQAKAEGIKTVRIHALLDGRDVPETSALDYVVPFEAFLAEISSDGFDARIASGGGRQYITMDRYDANWAMVDKGWQTHVLGRGTQFANATAAVNGLREQNPGTIDQDLPEFVVAENGKAIGTIEDGDSVVFFNFRGDRAIEITRAFEEAAFDKFDRVRFPKVTYAGMLQYDGDLKLPARFLVAPPAIKDTTGEWFAKSGIAQFACSETQKFGHVTYFWNGNRSGKFDGETWQEVPSDVVPFEQRPWMKAAEIADAMIAALQSGQYRTLRCNFANGDMVGHTGNFSAATLAVEAVDLSLARVLQAIDAAGGVALITADHGNADEMFELDKKTKQPAMNKDGSFKAKTAHTLNPVPLILYDNVSGGKLGLKQTETAGLSNIAATVANLLGLEKHAAWDESLLEIR

SEQ ID NO: 54371 - protein, 231 aa, Glycine max
  misc_feature (198)..(198): Xaa can be any naturally occurring amino acid
  misc_feature (203)..(203): Xaa can be any naturally occurring amino acid
  misc_feature (211)..(211): Xaa can be any naturally occurring amino acid
  unsure (1)..(231): unsure at all Xaa locations
MGTKEGKWVGAIFFNCKFWFFGVADFEAKIMGKKRKHSETTQSVAQPKKEDAAPERPARTLLGWKDKNQVEDNNNADSPIFRNKEKLLVTCSRRINYRYRHLMLNLVTLLPHCKKDNKVESKETKGATLNELVELKNCSSCLFFECRKHKDLYLWMAKCPNGPSVKFLVSAVHTMEELKLTGNHLQGSRPILTFQQFXKRCHXNYLREMCXVFEPKDTEASLWGWVAIVDQ

SEQ ID NO: 54372 - protein, 247 aa, uncultured bacterium
MAQRIALVTGGMGGLGEAICMKLEKMGIKVVVTYSPGNTKHKDWLKEMEAQGHKFVAYPCDVADFDSCQKAIAEVVKGVGPIDILINNAGITRDMTFKKMTKVDWDAVMKTNLDSVFNVTKPVVDGMVERGWGRVINVSSVNGQKGAFGQTNYSAAKAGMHGFSKALALEVARKGVTVNTISPGYIGTKMVLAIPKDVLDSKIIPQIPMGRLGKPDEVAGLCAYLASDEAAFLTGANIAINGGQHMQ

SEQ ID NO: 54373 - protein, 66 aa, Platanus x acerifolia
AGIVVGTPPKTPYCSLIEGLVDLEAAVCLCTAIKAKILGINLNVPVSLSLLLNYCGKKVPNGFQCV

SEQ ID NO: 54374 - protein, 122 aa, Wolbachia endosymbiont strain TRS of Brugia malayi
MSNKYYDSNNIFAQILRGELPCKKVYEDEDVLAFYDKYPDAPVHILVVPKSQYISYDDFIFKASAEEIVGFFKTVREITYKYNLEKTGYRLVTNCGENGEQVVPHFHMHILGGKRLGKHVNL

SEQ ID NO: 54375 - protein, 68 aa, Platanus x acerifolia
NLVLAMLWRHPENVELEKVKVVHYCAFGSKPWRFTGKEANMDREDIKMLVEKWWEIYNDASLDFKAEV

SEQ ID NO: 54376 - protein, 500 aa, Beta vulgaris
MSMPIPSRQLFIDGEWREPIKKNRIPIINPSNEEIIGDIPAGSSEDIEVAVAAARRALKRNKGREWAATSGAHRARYLRAIAAKVTERKDHFVKLETIDSGKPFDEAVLDIDDVATCFEYFAGQAEAMDAKQKAPVTLPMERFKSHVLRQPIGVVGLITPWNYPLLMATWKIAPALAAGCTAVLKPSELASITCLEFGEVCNEVGLPPGVLNIVTGLGPDAGAPLAAHPDVDKVAFTGSSATGSKVMASAAQLVKPVTLELGGKSPIIVFEDVDIDQVVEWTMFGCFWTNGQICSATSRLLVHESIAAEFIDRLVKWTKNIKISDPFEEGCRLGPVISKGQYDKIMKFISTAKSEGATILCGGSRPEHLKKGYFIEPTIISDISTSMQIWREEVFGPVLCVKTFSSEDEALELANDTEYGLASAVFSKDLERCERVSKLLESGAVWVNCSQPCFVHAPWGGIKRSGFGRELGEWGIENYLNIKQVTSDISNEPWGWYKSP

SEQ ID NO: 54377 - protein, 497 aa, Spinacia oleracea
MAFPIPARQLFIDGEWREPIKKNRIPVINPSTEEIIGDIPAATAEDVEVAVVAARRAFRRNNWSATSGAHRATYLRAIAAKITEKKDHFVKLETIDSGKPFDEAVLDIDDVASCFEYFAGQAEALDGKQKAPVTLPMERFKSHVLRQPLGVVGLISPWNYPLLMATWKIAPALAAGCTAVLKPSELASVTCLEFGEVCNEVGLPPGVLNILTGLGPDAGAPLVSHPDVDKIAFTGSSATGSKVMASAAQLVKPVTLELGGKSPIVVFEDVDIDKVVEWTIFGCFWTNGQICSATSRLLVHESIAAEFVDKLVKWTKNIKISDPFEEGCRLGPVISKGQYDKIMKFISTAKSEGATILYGGSRPEHLKKGYYIEPTIVTDISTSMQIWKEEVFGPVLCVKTFSSEDEAIALANDTEYGLAAAVFSNDLERCERITKALEVGAVWVNCSQPCFVQAPWGGIKRSGFGRELGEWGIQNYLNIKQVTQDISDEPWGWYKSP

SEQ ID NO: 54378 - protein, 534 aa, Coccidioides immitis RS
MRWQLWGFLTALLAINGLANDVELNQDDSRRQQCSGMYGKKAWGGDVDPFIHVALEKLPPKEPSPLMSLIIFEWKDEGLIGRFAPGDKEKFQKETICDRHNVEAGLCDEQSLGAFILEPNATSRAQSALISMAVNLTSAKPIKYPIKKTGFYCVSTYAFTGDDYKGIVTFRNAYGELSAPQIPKLAFYGGLTILYAVIGIFWAFLYVQHRHDILPVQNYITAILVFLVVEQLMTWGFYDYQNRHGMNAMAKVLMFIVAVLNAGRNSFSFFLLLIVCMGYGVVKPSLGRKMIYVRFLAIGHFVFGVIYAVASLSIAPESAGPLVLLVVLPLAATLTAFYVWTLNSLSATMKDLVERKQRVKAMMYKKLWWCILGSIMVIFGFFFINSFLFASKRVVDYIPEHWKTRWFVLDGWLNIVYLFDIAFIAYLWRPTMNNRRFAMSDEIAQDDDGFEIRSLTSSLDDEERVGSNANNRPIGGAHAEHSPAPAAAESLSHPQQARHSIDADHFAVGEEDRWSDDESPRNSTERKGLMHKDD

SEQ ID NO: 54379 - protein, 497 aa, Emericella nidulans
MSDLFTTIETPVIKYEQPLGLFINNEFVKGVEGKTFQVINPSNEKVITSVHEATEKDVDVAVAAARAAFEGPWRQVTPSERGILINKLADLMERDIDTLAAIESLDNGKAFTMAKVDLANSIGCLRYYAGWADKIHGQTIDTNPETLTYTRHEPVGVCGQIIPWNFPLLMWSWKIGPAVAAGNTVVLKTAQQTPLSALYAAKLIKEAPFPAGVINVISGFGRTAGAAISSHMDIDKVAFTGSTLVGPTILQAAAKSNLKKVTLELGGKSPNIVFDDADIDNAISWANFGIFFNHGQCCCAGSRILVQEGIYDKFVARFKERAQKNKVGNPFEQDTFQGPQVSQLQFDRIMEYINHGKKAGATVATGGDRHGNEGYFIQPTVFTDVTSDMKIAQEEIFGPVVTIQKFKDVAEAIKIGNSTDYGLAAAVHTKNVNTAIRVSNALKAGTVWINNYNMISYQAPFGGFKQSGLGRELGSYALENYTQIKTVHYRLGDALFA

SEQ ID NO: 54380 - protein, 408 aa, Yersinia pestis CO92
MILNVYVVISIFIMNAMSLLSVEVSNFTFVGLFKNDNVNIVSIHRVLLLLEELMSQLPEKMSAVVCHGPQDYRLEHVPTPVPKAKELVIKVKGCGICAGDCKCKNGAKMFWGETPWVKPPVVPGHEFYGHIVALGEGTESKYKLGERVIAEQIVPCWDCRYCNSGSYWMCETHNIYGFQKDVAEGGMAEYMRFSENAIVHKIPESLSHEDAVLIEPMACAIHTVARGDIQLDDVVVLAGAGPLGLCMVPVARLKTPKKLIVIDTIEERLALAKAFGADVVINPLKEDADKIVKSLTGGYGCDVYIEATGAPIGVTQGLQMIRKLGRFVEFSVFGQETTVDWSIIGDRKELDIRGAHLAPYSYEIATDLFERGLVTSKGIVTHSYSLDDWEKAFELADSTNSIKVILVP

SEQ ID NO: 54381 - protein, 876 aa, Clostridium perfringens str. 13
MEKKQYVYLFNEGNASMKNLLGGKGANLSEMTILGIPVPQGFTVTTEACNKYYEDDKKISQDIIEEIENKMSELEKITGKKFGSLENPLLVSVRSGARVSMPGMMDTILNLGLNDESVEAMAKLTNNPRFAYDSYRRFIQMFADVVMGVEKRLFEDLLDEVKEEKGYKIDTDLTAEDLKDLVVKFKALYKKEKGEDFPSNPKEQLIEAVTAVFRSWNNPRAIVYRRLNDIPGEWGTAVNVQEMVFGNKGETSGTGVAFSRNPANGDNELYGEYLMNAQGEDVVAGIRTPEPISHLEAQNPTIYKQFTDIVNTLEKHYRDMQDMEFTIEDGKLYFLQTRNGKRTAQAALKIAVDLVEEGMLTKEEAILKVEPKQLDTLLHPAFASDGLKEAKIVAKGLPASPGAACGKIAFTAEEAKERKANGEKVVLVRLETSPEDIEGMIAAEGILTVRGGMTSHAAVVARGMGTCCVAGCGELKVNEEARTLEVNGQVLTFDDYISIDGSTGHIYAEQVKTVSPEITGHFATFMGWADEIRKLKVRTNADTPRDTKQAVEFGAEGIGLCRTEHMFFAEDRILAVREMILAKNEDSRRVALEKLLPMQREDFIGIYEALEERPATIRFLDPPLHEFLPSEEEDINALAKEIGVSPAEIKNVVAELHEFNPMMGHRGCRLAVSYPEIAEMQTRAVIEAAIEVKKNKGYNIVPEIMIPLIGEIKELKYVKNVVVETAKTVMEEKGVQLDYKVGTMIEIPRAALTADKIAEEAEFFSFGTNDLTQMTFGFSRDDAAKFLKDYYEKGIYEQDPFAKLDQEGVGELMRIACEKGKATRPDIKLGICGEHGGDPSSVEFCHNLGLNYVSCSPYRVPLARLAAAQAQVKNKR

SEQ ID NO: 54382 - protein, 335 aa, Borrelia burgdorferi
MKLAINGFGRIGRNVFKIAFERGIDIVAINDLTDPKTLAHLLKYDSTFGVYNKKVESRDGAIVVDGREIKIIAERDPKNLPWAKLGIDVVIESTGVFSSATSDKGGYLDHVNHAGAKKVILTVPAKDEIKTIVLGVNDHDINSDLKAVSNASCTTNCLAPLAKVLHESFGIEQGLMTTVHAYTNDQRILDLPHSDLRRARAAALSIIPTSTGAPKAVGLVLPELKGKLNGTSMRVPVPTGSIVDLTVQLKKKDVTKEEINSVLRKASETPELKGILGYTEDPIVSSDIKGNSHPSIVDGLETMVLENGFAKILSWYDNEFGYSTRVVDLAQKLVK

SEQ ID NO: 54383 - protein, 182 aa, Triticum aestivum
  misc_feature (161)..(161): Xaa can be any naturally occurring amino acid
  unsure (1)..(182): unsure at all Xaa locations
TRGALRNLVSAVSPDNLVSLGVLPRLAHVLRDGSVGAQQAAAAAICKISSSPEMKRLVGDHGCMPLLVRLLEAKSNGAREVAAQATATLMSCPANARDVKKDEKSVPNLVQLLDPSPGNTAKKYAISCLLALSASKRCKKLMIAQGAIGYLKKLSEMDVAXGAKKLLEKLERGKLRTLFTRK

SEQ ID NO: 54384 - protein, 393 aa, Borrelia burgdorferi
MSIKTVKDFSSFAGKRALVRCDFNVPLKEGSISDDTRIRAALSTIEYLKERGARIVLVSHLGRPDGKKNPKYSLKPVANRLSELLGQDVKMLSDCIGSEVVNSTLQMKDGDVVLLENVRFYAEEEKNDKNFAKKLSENGDVFVNDAFGAAHRAHASTVGVADYSPSVGGFLMEKEDNSLGGILKNPERPSVSIIGGSKVSSKIAVLESLLSKSNVVVIGGGMAYTFLHSEGYSIGKSLLEDEYIGIASSFLKKAKELGVKVILPLDHIVADDFNKNSIPEYIDSFNIPENKIGMDIGANTLKEIENVVKTAKTIIWNGPLGVFEFDSFSKGTAKVAEMVASCSGLTVVGGGDSVAAVNKFNLSDKITHVSTGGGASLEYLEGRILPGIKVLEN

SEQ ID NO: 54385 - protein, 253 aa, Borrelia burgdorferi
MRKTFLAGNWKMHYTSAEASIVAKKIATEVKTLKDDVVIMITPPFTALSKVSECIKGSNILLGAQNMSYMESGARTSEISPSMLLEFGVEYVILGHSECRLYLAETDEIINKKILAGLKHPFKYLILCVGETLDERDSGKTLEVVLNQVKKGLNCVSESDIQRIILAYEPVWAIGTGKTATKEEAEEVHKAIRLEITKLYTKSASDNIIIQYGGSVNSNNVKELMNEPNIDGALIGGASLKAESFLSIINNVL

SEQ ID NO: 54386 - protein, 67 aa, Glycine max
MSRAQDANQSFFPFGNPFRMISPKSPKISSQLLLILHAFEATLEERLKKLIPKSKDEILSLSWMTLA

SEQ ID NO: 54387 - protein, 366 aa, Arabidopsis thaliana
MTTISDLPEDVVEEILPRVPLTSLSAVRSICKTWNTLSKNRVLCKAAVKKQFLGFIMMDYRVCSMKFHLRNDEGGDLVDDLSIKQVGILDQIEISEVLHCDGLLLFVTKDNSSLVVWNPYLGQTRLIQPSNNFHCSDRYAIGYDNNRNLKILRNFSDYGSSGSNKRGVSFKGNTYILAQGKIRVDSRWKIEAILLSFDFTTERFGPRLQLPFGFYYPQDLFSLSCVREEQLVVLHQSWMVSGELEIWITNKIDPGVVSWTKFLRSISCCRISIQAGSFFINEENQVAVVFDLDEYKGSETCRNQTAYIIGQDEYFKSVNIGEAPNLGRPEKYAPHIYCRPLVCSSYVPSLVPLQINQPDTRKESDD

SEQ ID NO: 54388 - protein, 347 aa, Oryza sativa (japonica cultivar-group)
MASGEEADLEAFQRHVAAHLADLRGGEDELLSIEWIRRLLEAFLLCQEEFRVVVALARRRGALSAAAEKMVGDFYERAVKALDVCNAARDGVDQVRRWERLAGIAASVLLAPGEIHEGQLRRARKALSDLSVLLIDDAAAAAGGGGVASFLSSHRNRSFGRARASPSRSATLASSSSSSSSSSSSSHFRSLSWSVSRNWSAARQLQAIGSGLAAPRAHEGGLVAPAHHLPAAPPRAAFPWAPPLLALQERLTEEGKRKDRRNSCGLLKEIHALEKCTQRLAEAIDAAPVPLSGEREAEVREAAAELAAVCAAMRAGLEPLERQVREVFHRIVRSRMEGLDSPMLNAD

SEQ ID NO: 54389 - protein, 145 aa, Glycine max
RNSNIRQEILIVNTHLIFPHDSTLSLVYKILQYVESYQNDFQLKPMPIVLCGDWNGSKRGHVYKFLRSQGFVSSYDTAHHYTDADAHKWVSHRNHRGNICAVDFIWLLNPDKYRKLLKASWSEAVFGMFKYLLRRAILTESDAFA

SEQ ID NO: 54390 - protein, 110 aa, Ehrlichia ruminantium str. Welgevonden
MTNNIMDRIKHDIETNDVVLYMKGDANMPQCGFSSVVVTILKKMNISFKSINVLEDQELREAIKEFTNWPTIPQLYVKGEFIGGCDIVKEMYHTGELQELFVKNNLITAN

SEQ ID NO: 54391 - protein, 286 aa, Burkholderia vietnamiensis G4
MDASEFSKFLKAALPAEARAGAALTVADVEIPGYAQDIALRLYRRADKTGLPVVLYFHGGGFVRGTLDDADFAARFLAERLPALVVSVDYSLAPAFPFPAAPEDAYRAAVWAATRARAFGGNPKKIGVAGHDAGGQLANCLAFIARDRGEVPIAAQALFGPMLDPSMTRIGDADRLSSDITARECAACYRAYLPQAAQRMHPYAAPLESVRLAGLPPTLIVTAQNDVLHVEAEKYAGCLISSGVLTQVIRYPDVTHAALATHAAALEEAVRFFQCRFQARQPNRSE

SEQ ID NO: 54392 - protein, 327 aa, Francisella tularensis subsp. tularensis SCHU S4
MEISMTSHINNAVETFRLEIETLEKLKNSIDENFEKACEIILENNRDKSRVIITGMGKSGHIGKKMAATFASTGTPAFFVHPGEAGHGDFGMITKNDVLIAISNSGTSSEIMGLLPMIKHLDIPIIAITSNPKSILARNSNVTLNLHVDKEACPLNLAPTSSTTATLVLGDALAIALLKAKNFSEKDFAFSHPNGALGRKLILKVENIMRKGNEIPIVKPTDNIRKAILEISDKGVGNTLVAENNTLLGIFTDGDLRRMFEAESFNSQRAISEVMTKNPKSISKEEMAITALEKMEKYEITSLAVVDNGHNILGIVTMHDLIKLELR

SEQ ID NO: 54393 - protein, 433 aa, Synechococcus elongatus PCC 6301
MVTSSPFKTIKSDEIFAAAQKLMPGGVSSPVRAFKSVGGQPIVFDRVKDAIAWDVDGNRYIDYVGTWGPAICGHAHPEVIEALKVAMEKGTSFGAPCALENVLAEMVNDAVPSIEMVRFVNSGTEACMAVLRVVRAYTGRDKIIKFEGCYHGHADMFLVKAGSGVATLGLPSSPGVPKKTTANTLTTPYNDLEAVKALFAENPGEIAGVILEPIVGNSGFIVPDAGFLEGLREITLEHDALLVFDEVMTGFRIAYGGVQEKFGVTPDLTTLGKIIGGGLPVGAYGGKREIMQLVAPAGPMYQAGTLSGNPLAMTAGIKTLELLRQPGTYEYLDQITKRLSDGLLAIAQETGHAACGGQVSGMFGFFFTEGPVHNYEDAKKSDLQKFSRFHRGMLEQGIYLAPSQFEAGFTSLAHTEEDIDATLAAARTVMSAL

SEQ ID NO: 54394 - protein, 103 aa, Arabidopsis thaliana
  misc_feature (36)..(36): Xaa can be any naturally occurring amino acid
  misc_feature (83)..(83): Xaa can be any naturally occurring amino acid
  unsure (1)..(103): unsure at all Xaa locations
RKANNDITSITSNGGRVNCMQVAPPIAKTMFETRSXLPDFIASELANEVDYLICNKWTPCIEFELLHGFVYREHGNSPGYYDXRFWTMSQLLLFRCTVSAHVF

SEQ ID NO: 54395 - protein, 179 aa, Brassica napus
KVPSFKTGGTLWFTDLTTADTTYILPLLTAITFIIMVESNMQEGMEGNPVAGTMKKFSRIIAFLSIPILMGIEKALFCYWLTSNLFTLGYGLALRRPDVRKLLNLPDAVTSSSSGQPKPPSPIPFSFEQPKDQSVVGHEDPPMSSSEDPSTSSSESSSSVPERKISRSSVLNQRIRTLE

SEQ ID NO: 54396 - protein, 352 aa, Oryza sativa (japonica cultivar-group)
MESGSEFYAGEGLQIDPKWLIDPKLLFVGPRIGEGAHAKVYEGKYKNQNVAIKIVHKGDTPEEMVKREGRFLREVTMLSRVQHKNLVKFIGACLEPVMVVVTELLVGGSLRKYLVGLRPRSLEPRVAVGFALDIARAMECLHAHAIIHRDLKPENLLLTADQRTVKLVDLGLAREETLTEMMTAETGTYRWMAPELYSTVTLRHGEKKHYNHKVDVYSFAIVLWELLHNRLPFEGMSNLQAAYAAAFKNIRPSADNLPEELSEILTTCWKEEPNERPNFTQIVQMLLHYLSTLSPPEPLAPPRTFSSENAILPPESPGTSSLMASRGDLGDTPKGKMEDKPRGFFFCFSQCY

SEQ ID NO: 54397 - protein, 186 aa, Platanus x acerifolia
MGEKPQSGGVWPTVKPFLNGGASGMLATCVIQPVDMIKVRIQLGQGSAASVTKTMLRNEGIGAFYNGLSAGLLRQATYTTARLGSFRALTNKAVAANDGKPLPLYQKALCGLTAGAIGACVGSPADLALIRMQADATLPAAQRRHYKNAFHALYRTVGDGGVLALWKGAGPTVVRAMALNMGMLAS

SEQ ID NO: 54398 - protein, 360 aa, Pseudomonas aeruginosa
MSKQILVLPGDGIGPEIMAEAVKVLELANDRFQLGFELAEDVIGGAAIDKHGVPLADQTLQRARQADAVLLGAVGGPKWDRIERDIRPERGLLKFRSQLGLFANLRPAILYPQLAAASSLKPEVVAGLDILIVRELTGGIYFGQPREQRVLENGERQAYDTLPYSESEIRRIARVGFDMARVRNNRLCSVDKANVLASSQLWREVVEEVAKDYPDVELSHMYVDNAAMQLVRAPKQFDVMVTDNMFGDILSDEASMLTGSIGMLPSASLDANNKGMYEPCHGSAPDIAGQGIANPLATILSVSMMLRYSFSQATAADAIEQAVSKVLDQGLRTGDIWSEGCRKVGTREMGDAVVAALKNL

SEQ ID NO: 54399 - protein, 197 aa, Synechococcus elongatus PCC 7942
MRLVVRSLVSLAAIASLASGLPARAQSGSSVPAPERVTTQSNLNYDSVMRIMAEGDAAVAAQKFPVALDKYDLARKSFGALVQFHQGLAGSFSGIDVKIANDQRQRAAQAAQGRDQAGYKLALLYRRLNQPEVAIPLLVQVVQSQNPTTDLGKQAYAQLYELGFTSLPYPRSVDGTQPAPQQSPAPQTPPAQQPPAR

SEQ ID NO: 54400 - protein, 845 aa, Ralstonia solanacearum GMI1000
MNPSTAPKTMKFGFIAHPTSVALKRHVKIVDLLERTIAEQDRGYRDDRWQWRNLVPFADFGRIVSAQGAVCEGILHYMPLTAEEMLSQPRAIAQRVVDAVESLKDQGAQVVGLGGFTAIVGNRGLQTLERTGIPVTTGNSLTAYAAYRNVLESMDRLGVEPADTEVAVVGYPGSIALVIAKLLAGHGCRLCLVHRGSEAQGRQGLAYLPEPMHAQVRLSNDIEHCYEHVQFYVAATSTGGLIDPYRLRPGSVVVDAALPRDVKPYRKDRNDILIIDGGLVSASSALRFGAESMGLAPKKFLNGCLAETLILGLEGRAEAFSIGRELPEDKVLEIGRIAELHGFSPSPMASYGEPVKDRHFAALRPFHRPRTQSPAGLEGESLREHALRSFGEHINPILRDFYAFNHIERVFQHGRGCTLTDINGQAFLDFVAGYGCLNTGHNHPRIKAALLDYLQREHPTFVQYVSVPLQTSQLAQRLSELAPGRMERVFFSNSGTEAVEAALKLALAAMSKPRVLYCDNGYHGKTLGALSVTGRDKHRTPFKPLLPRCDAIPFGDADALEAALQTGDVGAFIVEPIQGEGGVIIPPDGYLAKVRQLCSAYDCILILDEIQTGLGRTGKMFACEWEGVEPDILILSKSLSGGAVPIGATLSRKAIWDRAYGNIDTFALHTSTFGGGNLAAAAGLATLDVLAEEDLAGNAARVGESLRHQLTAATRDYPFIREVRGRGLMIAIEFRHSYAGGIEAFIREFANRMPGDAAATYRMLSGKARQHIRAAIEEVEKSFEEMFVLRFVTKLSQEYGILTFVTANNNRVMRIQPPLVLNEDQAQSFVDAFARVCHDMSTFLD

SEQ ID NO: 54401 - protein, 240 aa, Platanus x acerifolia
EKKYKEEAAELKSIVSGQLPAGWEKALPTYTPESPADATRNLSQQCLNALAKVLPGLLGGSADLASSNMTLLKMFGDFQKDTPEERNVRFGVREHGMGAICNGIALHSPGLIPYCATFFVFTDYMRAAIRISALCEAGVIYVMTHDSIGLGEDGPTHQPIEHLASFRAMPNILMLRPADGNETAGAYRVAVLNSKRPSILALSRQKLPQLPGTSIEGVEKGGYVISDNSSGNKPDVILIG

SEQ ID NO: 54402 - protein, 200 aa, Arabidopsis thaliana
MFSPHDGTLCSKKRDHMKVFGESFHGSFKRSKQGDQKQTKFEKNTTTLFFQRSKSDSAMLIKPDVQLHLEAKTQSETFEDHRTDLDLNLNLYSSSSSSVKKTIMEKDECSKGGTVIISPSKKVRSGDIGLSRSPSWLAFEGDDDDNQKKQEMITTVCMKCHMLVMLCKSTLVCPNCKFMHHDDHSSTKQFQTLNLFKLLC

SEQ ID NO: 54403 - protein, 130 aa, Pyrococcus abyssi GE5
MTLLDPLANALSHITNSERVGKREVYIKPASKLIGEVLRVMQKYGYIGEFEFIDDGRAGVYRVQLLGKINKAGAIKPRFPVKARDYERWEKRFLPAFEFGILIVSTSQGVMSHKEAREKGIGGRLIAYVY

SEQ ID NO: 54404 - protein, 294 aa, Magnetospirillum magnetotacticum MS-1
MIYVPLGNIDSDQLDALHDIAVRAGVTRLSTTRDQKLALLDVAKDKVDEVTRAVRAIGLDIPATALDVPDVVSCPGTTTCRIGITNSQSFGIQVEKEAQGAPDAKGVSVHVSGCQNSCGLHHVADIGLHGMGKKIDGKPAPHYQLHFGGDAYAGRVGLEGPVVPARLANQAVALLRREIQAARLGGESTRAWAERLGKDGINEVLKPLAAAEGDDLFTDWGDKDVFLGPPKAKGECAAPQVSTTYYTDLADDGLINLDRFLARGRWPRGSEGWRGGECLRPASAAGHPRGGDRG

SEQ ID NO: 54405 - protein, 427 aa, Burkholderia vietnamiensis G4
MKNADLHARKNAATPRGVGVMCDFYAARAENAELWDVEGRRFIDFAAGIAVLNTGHRHPKIVKAIADQLNCFTHTAYQIVPYASYVELAEKINARAPGDYPKKTAFFTTGAEAVENAIKIARAATGRPGVIAFAGGFHGRTMMGMALTGKVAPYKLNFGPFPGDVFHAPYPNPLHGVTTADSIKAIEMLFKADIDPKRVAAIIFEPVQGEGGFNPAPADFVRALRKICNEHGIMLIADEVQTGFARTGKLFAMQQYDVLADLITMAKSLAGGMPLSGVVGRADVMDAAAPGGLGGTYAGNPLAVASAHAVLDIIDEEKLCERATQLGDALKAKLNALRADIAPIADVRGPGAMVAVEFVNPATGEPDADFTKRVQARALERGLLLLVCGVYSNVVRFLFPLTIPQAVFDEALTILEEVLKETVGVPA

SEQ ID NO: 54406 - protein, 421 aa, Rhodopseudomonas palustris CGA009
MRHFDYRDGVLHAEGVSLASIAQDVGTPFYCYSSATLERHYRVFTEAFAGLDALVCYAMKANSNQSVLRTLAKLGAGADVVSGGELQRALAAGIPPSKIVFSGVGKTEAELRAALDHDIKCLNVESEPELEQLSRIAVETGRTARISLRVNPDVDSGTHAKISTGKSENKFGIPIRHAREVYARAAKLPGIQVTGVDVHIGSQIIDLAPMEAAFRKVAEFIHVLRGDGHTVNHVDFGGGLGIPYYEDRDAPPEPFAYAEMVKRVTHNLGCTLLFEPGRMIVGNAGILVAKVIYVKHGDGKTFVIIDAAMNDLIRPTLYEAYHEILPVAAPAPGVATMVADVVGPVCETGDYLALDRKLPELKAGDLIAIMTAGAYGAVQACTYNTRALVPEVLVKDDQVAVVRPRIEVEQLIAMDKPAPWL

SEQ ID NO: 54407 - protein, 487 aa, Burkholderia vietnamiensis G4
MSTENLALKDPSLLRQQAYINGEWQSAANGESFEVRNPATGGLLGTVPAMGAAETRQAIDAANAAWPAWRKKTAKERAAILRKWHDLMMENADDLALILTTEQGKSLAEAKGEIGYAASFLEWFAEEGKRVYGDTIPTPASDKRIVVTKEAIGVCAAITPWNFPAAMITRKVGPALAAGCPIVVKPAEATPFSALAMAVLAERAGVPAGVFSVVTGDPKAIGGELTSNPIVRKLSFTGSTPVGRLLMSQCAATVKKVSLELGGNAPFIVFDDADLDAAVQGAIASKYRNSGQTCVCTNRFYVHEAVYDAFAQKLAAAVGQLKVGRGTEPGVTQGPLINEAAVLKVEAHIEDALAKGATVVTGGKRHALGHGFFEPTVLTGVTPAMKVAKEETFGPLAPLFKFGSDDEVIRLANDTEFGLAAYFYSRDIGRVWKVAEALEYGMVGVNTGLISNEVAPFGGVKQSGLGREGSHYGIDDYVVIKYLCLAV

SEQ ID NO: 54408 - protein, 463 aa, Streptomyces clavuligerus
MSRSAHPAGPPHADVLPEGHYTAPPADLNRLDAKIWSRTVDRNEDGVATVGGIDVTRLAEEFGTPGYILDEDDFRDRARAWATALGHEADVFYAGKAFLSRAVVRWLHEEGLNLDVCSGGELLTALDAGMPADRIAFHGNNKSLEEIERAVRAGVGRIVLDSSQEIVRVAHVAQALGVRQRGLIRITVGVEAHTHEFIATAHEDQKFGLPLAGGQAAEGVRRALGLDGLELIGLHSHIGSQIFDTSGFEVAAHRVVGLLQQVRDEHGVELPEIDLGGGLGIAYTPDDDPREPRHIAKALHEIVTRECEDAKLRPPRMSVEPGRAIVGPTAFTLYEVGTIKPLPGLRTYVSVDGGMSDNIRTALYDAEYSVALVSRASDAAAMLSRVVGKHCESGDIVVKDAFLPRDLAPGDLLAVPATGAYCRSMARNYNHALRPPVVAVRDGAARVIVRRETEEEILRLDVG

SEQ ID NO: 54409 - protein, 554 aa, Corynebacterium glutamicum ATCC 13032
MAHERAGQLAQPEDLIDVAELVTAYFTRKPDVNNPDQQVAFGTSGHRGSALDSAFNEDHILATTQAIVDYRNQQPKNWVGPLFIGRDTHALSEPAMISALEVLIANDVEVLVDADGRYTPTPAVSHAILRHNDGIILGTAGPSRPYADGIVITPSHNPPRDGGFKYNPANGGPADTDATDWIANRANDILRGDLADVKRVPVSGVLDERTTAYDFKGIYIADLPNVVNIDAIREAGVRIGADPMGGASVDYWGAIAETHGLNLTVVNPHVDSTFRFMTLDTDGKIRMDCSSPHAMASLIDNRDKFDVATGNDADADRHGIVTPDAGLMNPNHYLAVAIEYLFAHRPGWSADTAVGKTLVSSSMIDRVVAQLGRTLVEVPVGFKWFVPGLISGEIGFGGEESAGASFLRMDGTTWSTDKDGLILDLLAAEIIAVTGKTPSQRYAELAEEFGAPAYARTDAEANREQKAILKALSPEQVTATELAGEAITAKLTEAPGNGAAIGGLKVTTENAWFAARPSGTEDKYKIYAESFKGEEHLAQVQKEAQALVSEVLGQ

SEQ ID NO: 54410 - protein, 382 aa, Arabidopsis thaliana
MPATDFQGSFGRSLLSLRRDQVDSSTVVSGSSSHHEPSTMEVELDSFQRQVAEKFIDLNASSNDLLSLEWIGKLLDSFLCCQEEFRAIVFNHRSQISKSPMDRLISDYFERSIKALDVCNAIRDGIEQIRQWEKLADIVISALDSHRPIGEGQLRRAKKALIDLAIGMLDEKDHPSGTNLAHRNRSFGRVKDSHHRSIGHFRSLSWSVSRSWSASKQLQALASNLATPRPNDVVASNGLAVPVYTMTSVLLFVMWVLVAAIPCQDRGLQVNFFVPRHFQWAAPVMSLHDKIVEESKRRDRKNCCGLLKEIDRIEKSSRLMNELIDSIHFPLNDDKEVEVKQRVDELVQVREALRNGLDPFERKVREVFHRIVRSRTESLDSL

SEQ ID NO: 54411 - protein, 407 aa, Bifidobacterium longum NCC2705
MENEAAQQPQSPAASPVMSRRAREANPFRAMVFGEQADKMIAQGTSVIKLSLGEPDFGAPPAVRDAMREQYDGRALPYTAAMGLPELRQAIADFYRERHDLDIDPKRICVTAGGSAALLLATALTVDPGDDVIVADPSYPCNRELVRSFEGRVIDVPTSAATRFHLTADLCSQYWTSKTKAVMITSPSNPTGTTIDFNVLDEVCKLAASRGAWRIVDETYLDLADREPDGTEVKSVLACDPDAIVCNSFSKFFGMTGWRLGWAILPDEPTVLEAVDDLATNYYLCAHTPTQHAALACFTPESLAECEARRQELLARRRIVIDGLKRIGLPVEVEPNGAFYAYFDISRTGLDAWTFCERALDEAHVALTPGRDFGAATADTHVRLSYAASREALTEGLERLGTFVESL

SEQ ID NO: 54412 - protein, 433 aa, Solanum commersonii
MDPQAFIRLSIGSLGLRLSGTTLNGTKSGISALSSPCVCEIRLRGFPVQTSSVPLISSPEATVDNYNIASSFYLEESDLKALLEPGCFYAPHACLEIVVFTGHKGGHCGVGIKRQQVGTFKLILRPSWSGVMESQSLCLNGWIGIGKNKQDTGKPGAELHLRVKLDPDPRYVFQFEDKTKLSPQIVQLQGNIKQPIFSCKFSHDRVSPVDPLNNFWSNSVDGSELDVEKRERRGWKVKIHDLSGSAVAAAFITTPFVPSTGCDWVAKSNPGAWLIVHPDVCRPGCWQPWGKLEAWRERGIRDTICCRFHLLSEGQENGGDLLMSEILISAAEKGGEFYIDTDRQVRAATSPLPSPRSSGDFAALSPVAGGFVMSCRVQGEGKCSKPLVQLAMRHVTCVEDAAIFMALAAAVDLSIEACRPFRRRLRRSSRHSW

SEQ ID NO: 54413 - protein, 184 aa, Triticum aestivum
  misc_feature (42)..(42): Xaa can be any naturally occurring amino acid
  unsure (1)..(184): unsure at all Xaa locations
AYLGDTLEQVCTKKQARTGPEFPGYRRPTRPHLSPLAEACSXKDLTAIHEHLETAGYKDDEGTANELSPRRCRNQMQATIDSKKKGDTAFRQKDFSMAIDCYSQFIDVGTMVSPTIYARRCLSYLMNDMPQEALDDAVQALAIFPTWPTTFYLQAAALFSLGKENEAREALKDGSAVETRSKGH

SEQ ID NO: 54414 - protein, 171 aa, Arabidopsis thaliana
GSHMSINIRDPLIVSRVVGDVLDPFNRSITLKVTYGQREVTNGLNLRPSQVQNKPRVEIGGEDLRNFYTLVMVDPDVPSPSNPHLREYLHWLVTDIPATTGTTFGNEIVSYENPSPTAGIHRVVFILFRQLGRQTVYAPGWRQNFNTREFAEIYNLGLPVAAVFYNSQRES

SEQ ID NO: 54415 - protein, 510 aa, Arabidopsis thaliana
MGSKKKCFDGSRDGISGLPDAMICHILSFLPTKVAASTTVLAKRWKPLLAFMPNLDFDESFRFDPRMTCEERRKGSESFMLVVDSIPSSRGFGSNSTFYPLPSEIFVSKTLVRLKIQFQDGANVNVEGDVSLPMLKTLHLDYVKMDTRMLQKLLSGCHTLEELLLMNLIWKESSEPEPCFVSVSVRTLKILKFSRFENFMKAKDFKPIVLLSFDIPNLVYLEYLDTIADKYEQVRFDSLVKASIGLCKTSKQIENDNNNVTKLFMGICNVTILYLTEDTLKVLGCCRETMPVFENLIHLTIRTGVHIGWKSLPHLLKNCPNLQTLVFEGMHHIYRKGRACGDVDEDGTCMCKNLDNMRVKKDIDACLSSSPVKVIKILNFGELCGFCEFCDVEEDVAGQIKQVKQFLETMPDLEKVILYYNTPEDEDVMKVFKKLKKLPRVASAKCEPWTCFRQSSCYKFAKNSKLCFFLLLFPFSSLYWLLSYKPVNVLCSFVGFSNEFVFFYVFNLTC

SEQ ID NO: 54416 - protein, 394 aa, Schizosaccharomyces pombe
MKTHLLANKLYQKGLRRQNYLQICKLICHARTVLSDVSNVGKNNADEKDTKKAKRSFDESNLSTNEEADKPVESKFVKKLKVYSKNADPSVETLQKDRALMLMNHLSSNPLMAEEYAPEIFEYIRKLDLKCLPNPKYMDQQKELTWKMREILNEWLVEIHSNFCLMPETLYLAVNIIDRFLSRRSCSLSKFQLTGITALLIASKYEEVMCPSIQNFVYMTDGAFTVEDVCVAERYMLNVLNFDLSYPSPLNFLRKISQAEGYDAQTRTLGKYLTEIYLFDHDLLRYPMSKIAAAMYLSRRLLRRGPWTAKLVESSGGYEEHELKEIAYIMLHYHNKPLEHKAFFQKYSSKRFLKASIFVHQLVRQRYSVNRTDDDDLQSEPSSSLTNDGQRTLL

SEQ ID NO: 54417 - protein, 362 aa, Geobacter sulfurreducens PCA
MAQVFKVAVLPGDGIGPEVMAEALRVLDAVEAKYDVKFERTHANVGGAGIDIEGKALPETTVNICKAADAILFGSVGGPKWESLPPDEQPERGALLPLRKIFGLYANLRPAIIFPSLTGASSLKEEVIAGGFNVLVIRELTGGIYFAQPKGIEGEGRDRVGFDTMRYSVPEIERITHVAFQAARKRGKKVCSIDKANVLSSSVLWREVVTGIAKEYPDVELSHMYVDNAAMQLVRWPKQFDVILCENMFGDILSDEAAMLTGSLGMLPSASLAEGTFGMYEPSGGSAPDIAGQGIANPIAQILSMGMMLKFSFGMVDAADAIDNAVATVLDQGFRTRDIYQQKDGEKLVNTKEMGDAIIAAL

SEQ ID NO: 54418 - protein, 362 aa, Oryza sativa (indica cultivar-group)
MAAPPPSSPSPPPAAAAAATQQTQPHPQTPFYELVKGNSGIEKVLLRGTRGFSAEVSDPFSPANPNPTLASVPLSLLPFVVYLYGAQVTSWKNDHAEELLFVSSKAIFKPPKAIRGGIPICFPQFGTHGNLEQHGFARNRLWTIDDNPPPLPVNPAIKSFVDLILRPSDEDLKIWPHSFEFRLRVALGPNGDLSLTSRIRNTNTDGRSFSYTFAYHTYFSVSDISEVRVEGLETMDYLDNLKGKERFTEQGDAIVFESEIDKVYLAAPSKIAIIDHEKKRTFVLTKEGLPDAVVWNPWDKKAKAMQDFGDGEYKHMLCVEPAAVEKPITLKPGEEWKGRLALSAVPSSYCSGQLDPLKVLQG

SEQ ID NO: 54419 - protein, 437 aa, Zea mays
  misc_feature (325)..(325): Xaa can be any naturally occurring amino acid
  unsure (1)..(437): unsure at all Xaa locations
MNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRGVLFATEALLAEHGKGIAGQRFVIQGFGNVGSWAAQLISEAGGKVIAISDVTGAVKNVDGLDIVQLVKHSAENKGIKGFKGGDAIAPDSLLTEECDVLIPAALGGVINKDNANDIKAKYIIEAANHPTDPEADEASPXLKTNRLLSAMFSDPLCIPFHPQILSKKGVLILPDILANSGGVTVSYFEWVQNIQGFMWDEEKVNAELRTYMTRAFGDVKQMCRSHSCDLRMGAFTLGVNRVARATVLRGWEA

SEQ ID NO: 54420 - protein, 211 aa, Oryza sativa (japonica cultivar-group)
MDITYKALQETDIGRHVNGLRKHPSGEVRLLVKQLIRKWKEIVDDWVRLHNSSGDASNSIITDGNSPEKIQGKNQQSSQVSEFKYSPSPSRHNNSSSERVSNGIASIAATKHRASPAPAHHNARQINNTHHSTTSSSAPAWRMVKEQKDSHLDLERLDSARKRLQENYQEAQNAKKQRTIQVMDINEIPKPKNRNAFIRKGNGGGFPARHR

SEQ ID NO: 54421 - protein, 1000 aa, Arabidopsis thaliana
MAHIWLLPLIFLVCILLAVFNHKKHPKYRQFPCPPGFPIIGNLHQIGELPHQTLWKLSKKYGPVMHLMLGRVPTVVVSSSDTARQVLRVHDLHCCTRPSLSGPRELSYNYLDIAFSPYDDYWKEVRKLCVQELFSTKQVHSIQPIKDEEVKKMIDSIAESASQKNPVNLNNKCLELTVSVVCRTAFGVSFEGTVLNSDRFNKIVREALEMLGSFSAADFIPYVGWIIDVLTGLQGRRERSKRDLNAFFEQMFDLHKEGKKEGNEDFVDLLLRLEKEEAVLGNDKLTRNHIKAILLDVLLAGIDTSAITMTWAMTELARNPRVMKKVQSEIRTQMGNRSMISFEDMDQLEYLKMVIKETWRLHPTTPLLLPREAMSEFDINGYTIPVKTRLHVNVWAIGRDPDTWKDPEVFLPERFMDNNIDAKGQHFELLPFGGGRRICPAIYMGTTMVEFGLANLLYHFDWKLPEGVEVKDIDVEEAPGLTVNKKNELLLVPEMRRSCEMTNIWLLSLIFVICILVAVFNHKNRRNYQRTPPSPPGCPIIGNLHQLGELPHQSLWKLSKKYGPVMLLKLGRVPTVIVSSSETAKQALKIHDLHCCSRPGFAGARELSYNYLDIAFSPYDDYWKEVRKLAVQELFSSKQVHSIQPIKDEEVKKLIDSISESAAQKTPINLNKTLLALTVSVVCRTAFSVNFEGTVLNSERFNNIVREALEMLGSFSASDFIPYVGRIIDLLTGLQGRRERSMRDLDAFYEQMFDLHKQKKEEGSEDFVDLLLRLEKEEAVLGNDKLTRNHIKAILMDVLLAGMDTSAITMTWAMAELAKNPRVMKKVQSEIRSQIKNKERISFDDTDKLEYLKMVIKETWRLHPTTPLLIPREAMSEFEINGYTIPVKTRLHVNVWAIGRDPDTWKDPEVFLPERFTDNNIDAKGQHFELLPFGGGRRMCPAVYMGTTMVEFGLANLLYHFDWKLPEGMKVDDIDMEEAPGLTVNKKNELILVPTKFLDP

SEQ ID NO: 54422 - protein, 323 aa, Arabidopsis thaliana
MTPVNEEKDDFSRNDSTSFRMPSQKCLKANTFQHNKSRYLFSSSKVRSATFSFALLSIPPKDRLSKFKPKALHLFRRRDPSQRDSNPAPPPGRFTTGPTTLLIKLFRHLPTFESVSHELNTREWDDLIEKSDIRNKTLPNEDVEPIQSLPPIQFLTHASKTKRVPKDFMVQCTDCKKWRLIPSMQHYNIIKETQLQTPFVCGTTSGWTPNMSCNVPQDGTTCDTWPSIPPIPTGWSRSVHIRSESTKFADVYYFPPSGERLRSSAEVQSFLDNHPEYVREGVNRSQFSFQIPKPLDDNYVKKRTRPVKRRKSSKDNNCEKGKK

SEQ ID NO: 54423 - protein, 652 aa, Oryza sativa (japonica cultivar-group)
MDFFLTVTDSSIGPPGAAQYANGLLGLDARGAAHCWKTRIGRGEGGKWVAARRRGGAAGRGGRWPISPALVERSGVGEASPAAGRRRGGWEAVMETAHEVAIYIDRFHNLDLFQQGWYRLKISAAWEEDEYRAPVSPARVVQYEVPDIGSKGAFGLWKIDDVDNSFYTQPFQIKYSRQDIYLSVMVSFYIPNTEDEGPATSSVILKFELIYVPTLEDRTEIEDPSDIYVPVHEFRIPYKALLGLHAYFPVHFDAFHPVLVDLTMHIVYLKAGVTKSSQKASEQGLCSKSCYIIKALLSSREILLEEVMKMSAGIGKTLEDLDDADLTLGKHEPIDSSKAGLPKYSKGLYIPTKCIGHLTGVLHDLIERSDNVVRSTNDILLYTLSKEDLLELFQAPVQNSSSRAELHRRSIAQMKVGSQSMLKTETICITPKKRILTQIILQINARFIQDMQIYANPSEIPVVHIEQHVMVVPQHGSSKRLGHHLDLRLIRNQWILCDPGAECLLSQTNEDRTCGDFKEMGRRLSNEVVAFLKRKIDRYSRNGGCKDLKLSFVGHSIGNIIIRSALADPKMQPFLKNLYTYMSISGPHLGYWYSSNSLFNSGLWLMKRLKGVQCMHQLTFSDEQDPQNTFFYKLCKVDLLYVPSVTKLNYKN

SEQ ID NO: 54424 - protein, 376 aa, Burkholderia mallei ATCC 23344
MAKRDYYEVLGVAKNASDDEIKKAYRKLAMKYHPDRNPDSKDAEEHFKEAKEAYEMLSDGQKRAAYDQYGHAGVDPNVGAAGAQGFGGFADAFGDIFGDIFGQAAGGGRARGGPQVYRGADLRYSMEITLEQAAHGYDTQIRVPSWAACGVCHGSGAKPGTKPETCPTCHGQGTVRMSQGFFSIQQTCPKCHGTGTYIPEPCAHCHGSGKVKETKTLEVKIPAGIDDGMRIRSAGNGEPGINGGPSGDLYVEIHIKPHAVFERDGDDLHCQMPIPFTTAALGGEIEVPTLAGRASFTVPEGTQSGKTFRLRGKGIKGLHSSIAGDLYVHVQVETPVKLTDQQRDLLKQFEKSLAEGGPRHSPQSKSWFDRVKSFFE

SEQ ID NO: 54425 - protein, 159 aa, Triticum aestivum
MATPTPTPTSPASIRASGGPGAGDRWVVRAQPAAAELVERSVTTIRFLAVDAVEKAKSGHPGLPMGCAPLGHVLFDEFLRFNPANHAWFDRDRFVLSAGHGCMLHYALLHLAGYQGVTIDDLKAFRQWGSRTPGHPENFETEILRSTRRGPTKRCYFQD

SEQ ID NO: 54426 - protein, 178 aa, Yersinia pestis CO92
MSGKCIIVMGVSGTGKSCVGQALALALGAKFIDGDDLHPRANIQKMAAGQPLNDQDRAPWLERLSDVAYSLQQKNEVGFLVCSALKKQYRDRLREGNEGIRFLWLTGDYDLVLHRMQQRAGHFMPESLLKSQFATLEAPGSDEPDVIPIDISSSIADVVEHCIAALSLENHVSAILSE

SEQ ID NO: 54427 - protein, 142 aa, Xanthomonas campestris pv. campestris str. ATCC 33913
MQTVRQLLGMKQVEVFSVAADAAVIEAIRLMADKSIGAVLVMEGERLVGIVSERDYARKVVLRDRSSSSTSVAEIMSHAVVTVSPADSVEHCMQLMTDGRFRHLPVVDNGRVQGVISIGDLVKAVIEAQQHDIDQLQRYIAS

SEQ ID NO: 54428 - protein, 66 aa, Solanum commersonii
EFGTRVIDGRPGTIVIESFVVDIPDGNTKDETCFFVEALIRCNLKSLADVSERLAVQGHTEPIDRM

SEQ ID NO: 54429 - protein, 280 aa, Streptomyces collinus
MTDTPQQAPAGTPRQTLVSGTTRLYAVLGDPVGQVQSPGLLNPLFARLGIDAVLVPVHVRPADLEPVVRGLQRVGNLDGLFVTVPHKTAAALLADRRSPTVEITGSANALRREPDGTWLAENFDGSGFVAGLAQAGHQPKGARVALVGAGGAGSAIAAALLAAGADRLTLTDPDTPRLTALVDRLAAHWPGRVRAAGEPPLADSEIAVNATPLGLRPRRPAALPAARAATGRRCCRIIMKPRETRLLGEADAHGIHTHHGRHMLTGQIDSYRAFFGLHTP

SEQ ID NO: 54430 - protein, 231 aa, Streptomyces collinus
MTVHSPDRPLAPAGLLTATRRAVVFDLDGVIVDSFAVMREAFAVAYAEVVGDGPAPFEEYVRHQGRYFPDIMRIMGLPLEMEEPFVRESYRLAHRVEVFDGVLELLLTLRVRGLRLAVATGKAGDRARSLLDGLGLLPFFAHVIGSDEVPRPKPAPDIVQRALELLDVPPEQAIMVGDAPTDLASARDAGVASAAALWVGPDEEELLAAGPDAVLRRPCDLLALCPAVPGA

SEQ ID NO: 54431 - protein, 235 aa, Solanum lycopersicum
MRVIRSRAILIVLFLVSAFGLSEQGKSGGFCSEEMATLGGVHDSHGSSQNSDEIHSLAKFAVDEHNKKENAMIELARVVKAQEQTVAGKLHHLTLEVMDAGKKKLYEAKVWVKPWLNFKELQEFKHVEDVPTFTSSDLGVKQVEQNSGLKSVPVHDPVVEEAAEHAIKTIQQRSNSIHPYKLQEIVHANAEMADDSTKLHLVIKTSRGGKEEKFKVQVQHNNEGAFHLNRMEPDN

SEQ ID NO: 54432 - protein, 340 aa, Arabidopsis thaliana
  misc_feature (296)..(296): Xaa can be any naturally occurring amino acid
  misc_feature (337)..(337): Xaa can be any naturally occurring amino acid
  unsure (1)..(340): unsure at all Xaa locations
MFSCIACTKADGGEEVEHGARGGTTPNTKEAVKSLTIQIKDMALKFSGAYKQCKPCTGSSSSPLKKGHRSFPDYDNASEGVPYPFMGGSAGSTPAWDFTNSSHHPAGRLESKFTSIYGNDRESISAQSCDVVLDDDGPKEWMAQVEPGVHITFASLPTGGNDLKRIRFSREMFDKWQAQRWWGENYDKIVELYNVQRFNRQALQTPARSDDQSQRDSTYSKMDSARESKDWTPRHNFRPPGSVPHHFYGGSSNYGPGSYHGGPPMDAARTTTSSRDDPPSMSNASEMQAEWIEEDXPGVYITIRQLSDVRRVRFSREQFGEVHVKTWWEQNRERIQXQYL

SEQ ID NO: 54433 - protein, 347 aa, Agrobacterium tumefaciens str. C58
MKTHRIALIPGDGIGQSVTDAAWQVLNAVAKTSGFVLEGTEFPWSCAFYKETGAMMPKDGIETLRGFDAIMLGAVGWPAEVPDSVSLHGLLLPIRKAFVQYANIRPHRLLSGVQGPLKADGFDILCIRENTEGEYSGAGGRVHQGTEDEVAVETSIFTRKGVERILRFGFEQAQKRRGKLASITKSNAQKYSMVFWDEVTHKLAAEYPDVEVSSYHIDAMAARMVMAPESLDVVVASNLFGDILTDLGAAIQGGLGFAASANINPDRSAPSMFEPVHGSAPDIAHLGIANPIAAIWSGAMMFEHLGEKDAAAKIMAALETATGRGIGTVPGKDKTDTITAAVLAALA

SEQ ID NO: 54434 - protein, 94 aa, Solanum lycopersicum
GGIREAGGSENSLEINDLARFAVDEHNKKQNALLEFGKVVNVKEQVVAGTMYYITLEATEGGKKKAYEAKVWVKPWQNFKQVEDFKLIGDAATA

SEQ ID NO: 54435 - protein, 1084 aa, Burkholderia sp. 383
MPKRTDIKSILIIGAGPIIIGQACEFDYSGAQACKALREEGYKVVLVNSNPATIMTDPNTADVTYIEPITWEVVARIIEKERPDAILPTMGGQTALNCALDLHHHGVLEKFGVELIGASPEAIDKAEDRQKFKDAMTKIGLGSAKSGVAHSMEEATQVHAEIMALTGGSGYPVVIRPSFTLGGSGGGIAYNREEFEEICKRGLDLSPTRELLIEESLLGWKEYEMEVVRDRADNCIIVCSIENLDPMGVHTGDSITVAPAQTLTDKEYQILRNASLAVLREIGVDTGGSNVQFSINPKDGRMVVIEMNPRVSRSSALASKATGFPIAKVAAKLAVGYTLDELKNEITGGLTPASFEPTIDYVVTKIPRFAFEKFREADSRLTTQMKSVGEVMAIGRTFQESFQKALRGLEVGVDGLDEKSTNRDEIAIEIHEPGPDRIWYVGDAFRIGMTAQEIYAETAIDPWFLEQIEQIVLKEKALGGRTLASLSFDELRYLKQSGFSDRRLAKLLGASPEDVRKRRVELNVRPVYKRVDTCAAEFATKTAYMYSTYEEECEAQPTTNKKIMVLGGGPNRIGQGIEFDYCCVHAALAMREDGYETIMVNCNPETVSTDYDTSDRLYFEPLTLEDVLEIVDKEKPVGVIVQYGGQTPLKLALDLEAHGVPIVGTSPDMIDAAEDRERFQKLLQDLGLRQPPNRTARAEDEALALAEEIGYPLVVRPSYVLGGRAMEIVHEPRDLERYMREAVKVSNDSPVLLDRFLNDAIECDVDCICDGEAVFIGGVMEHIEQAGVHSGDSACSLPPYSLSKETVAELKRQTGAMAKALNVVGLMNVQFAIQQVPQADGSKQDIIYVLEVNPRASRTVPYVSKATSLPLAKIAARAMVGQKLAQQGVTKEVEPPYFSVKEAVFPFVKFPSVDPVLGPEMRSTGEVMGVGQTFGEALFKSQLAAGSRLPESGTVLLTVMDADKPKAVEVARMLHDLGYPIVATKGTAAAIEAAGVPVKVVNKVKDGRPHIVDMIKNGEIALVFTTVDETRQAIADSRSIRMSAQAHKVTYYTTMSGARAAVEGLRYLKDLEVYDLQGLHARLN

SEQ ID NO: 54436 - protein, 156 aa, Solanum lycopersicum
AHLEYVENLNVKEQLVAGTLYYITLVATDAGKKKIYETKIWVKEWEDFKKVVEFKLVGDDSPNPGGITNVPFPNLPQFKDLARFAVQDYNKKENAHLEFVENLNVKEQVVAGIIYYITLVATDAGKKKIYETKILVKGWENFKEVQEFKLVGDATK

SEQ ID NO: 54437 - protein, 384 aa, Burkholderia mallei ATCC 23344
MPTTPTLLSRLPEVGTTIFTVMSALAAEKGAVNLGQGFPDFDCDPRIVDAVAHAMRDGRNQYPPMAGVAPLREAIADKIERLYGRRYDAATEITVTAGATQALLTAILCAVHPGDEVIVIEPTYDSYLPSIELAGATPVFVTLNAPDYAIPFDKLAAAITPKTRAILINTPHNPTGTVWREADMRALEDIVRGTGLLIVSDEVYEHMVYDGARHESVARYPELAARSIIVSSFGKTFHVTGWKIGYVAAPAPLTAEFRKVHQFNVFTVNTPMQFGLADYLRDPEPYLTLPAFYQQKRNFFRAGLANTRFALLPCAGTYFQCVDYSAISDLPEAEFAKWLTTEIGVAAIPVSAFYHEPHESGVVRFCFAKREDTLATALERLARL

SEQ ID NO: 54438 - protein, 367 aa, Triticum aestivum
  misc_feature (144)..(144): Xaa can be any naturally occurring amino acid
  misc_feature (151)..(151): Xaa can be any naturally occurring amino acid
  misc_feature (183)..(183): Xaa can be any naturally occurring amino acid
  misc_feature (192)..(192): Xaa can be any naturally occurring amino acid
  misc_feature (208)..(208): Xaa can be any naturally occurring amino acid
  unsure (1)..(367): unsure at all Xaa locations
MARHHLLLFLPLLALAFSFVIAAPERQGDAAAFIDGASHRYLRDQPEDQATSMSLGEVSAAVSVLLGFAPPAILPAPSSAKLNKLLLPNPFDRPRSVFLMQLDGSHDYVNGFISDAGSIYKTKIDGAKSAAIELSDKDELIVIXSDESSGXMFLDNELRQLGNLGWRDPIKKADSKLNIPLEXSGNSLTLFXTKEADVDFASSLISLXKTIQRGIQVHEDFSGGMVSPAELLVCHFTGIKALEDEYGSAEIVKQGAEVVQTALTKAFDQLQGAYNGKIVGLVISAKEASTSLASIIDAPSSLHISRRLAEASKTNATASIAAIYLVRLSLAWITGIILLVSTLIGICLLMNMPLTRDTLLYSNAKID

SEQ ID NO: 54439 - protein, 432 aa, Enterococcus faecalis
MSIITDIYAREVLDSRGNPTIEVEVYTESGAFGRGMVPSGASTGEYEAVELRDGDKARYLGKGVTKAVDNVNNIIAEAIIGYDVRDQMAIDKAMIDLDGTPNKGKLGANAILGVSIAVARAAADYLEVPLYHYLGGFNTKVLPTPMMNIINGGSHADNSIDFQEFMIMPVGAPTFKEALRMGAEVYHALASILKGRGLATSVGDEGGFAPNLGSNEEGFEVIIEAIEKAGYVPGKDVVLAMDAASSEFYDKEKGGYVLADSGEGENTTVDMIAFYVVLVSIYPIISIEDGLDENDWDGFKILTEVLGDKVQLVGDDLFVTNTTKLAEGIEKGIANSILIKVNQIGTLTETFEAIEMAKEAGYTAVVSHRSGETEDSTISDIAVATNAGQIKTGSLSRTDRIAKYNQLLRIEDQLGDVAEYKGLKSFYNLKNK

SEQ ID NO: 54440 - protein, 180 aa, Yersinia pestis CO92
MTLKELVVGFGTQVRSLWMIGLHAFHKRETLMYPEEPVYLPPRYRGRIVLTRDPDGEERCVACNLCAVACPVGCISLQKAEQKDGRWYPEFFRINFSRCIFCGLCEEACPTTAIQLTPDFEMGEFKRQDLVYEKEDLLISGPGKYPEYNFYRMAGMAIDGKQKGEAENEAKPIDVKGLMP

SEQ ID NO: 54441 - protein, 212 aa, Brassica napus
MQNPSTATTHESASSASGFLTRLTGLASLNRSPSSNPDGFALSTSNALFFNGSRTLPPRRATRKALASLSLNAKSSAGSSLRRFISEFNSFIRFHCDKVVPESFASVGVSRDESGVGVSEAGGVLGEEGSPLSGVEADGPKKVLILMSDTGGGHRASAEAIKAAFNHEFGDEYQVFITDLWTDHTPWPFNQLPRSYNFLVKHGTLWKMTYYG

SEQ ID NO: 54442 - protein, 642 aa, Digitalis lanata
MTNESNHTDHNVTRASFNFSNGEKFVFGSATSAYQIEGCAMEFGKGLSVWDTWTLDKPGHIIDGTNGNVAANQYHLFKEDMKIMKRAGLEAYRFSISWPRILPGGKLSTGVNKEGIKYYNDLIDAIIAEGMQPYVTLFHWDLPLALELEYGGFLDKDKRIVEHFRDYAELCFWEFGDRVKHWITINEAWSYTVEGYVNGTCPPGRGASAPSDDMALQTAEILRNRTLSTILDAIGSQAIAELKDIEKLIYTLIPNNIKDLISKFHIEEFVKNIIPEVLKQKCPQLVDFIVDILQSFHVDYKRTGMARACSNGDPGTEPYIVAHNIILAHAAAVRLYKTKFQAYQGGKIGMTNNVTYYLPYDEKYHEDVEASKRGVDFMLYWFVEPIVTGKYPERMVKRVGKRLPCFTVEEEEMVRGSYDFLGVNYYTTYYAINLPIPPIAPPNYFSDMGVLSTPTRGGVPIGIQCGQGGWIYIYPRGLYLILIEMTNKFKDKNDQGPLIYITENGASENANTTFTVCEARYDPIRVLYHNDHLWYLKKAMEDGVNLKGYFIWSFADNFEWNAGYTSRFGIFYVDFVNGQYTRYPKSSALWWTNFLHDVQELKVPDTSNVTNKRSRNTEEENATAKKPKNTSVNSLGFLDNLD

SEQ ID NO: 54443 - protein, 554 aa, Bradyrhizobium sp. BTAi1
MNIMNPAHKEVSRAAVLDEAHIGDIHGALGTIRHHDHGPRRGFWARWRTLIAILGPGLIVMVGDNDAGAFGTYTQAGQNYGTTLLWTLMLLIPVLYVNQEMVVRLGAVTGVGHARLIFERFGKFWGAFSVIDLFLLNALTLVTEFIGISLALRYLGLSQFWGVLASALIVMLAVSTGNFRRFERFAIVLVFGSLLLVPVVLMVHPPVEQIAADFLVPKMPKDGNLSEVMLLIIAVVGTTVAPWQLFFQQSYLIDKRITPRFIQYERWDLCLGIALVILGAVAMISFSAAIFTGRPEFGNYTDALGTAVGLEKYAGRLPAVLFALALLDASIVGAAAVSLSTAYAIGDVFSLKHSLHRRPSDAKGFYGVYFALIIVAAVLVLTPGTPLGLLTNAVQTLAGVLLPSATVFLLLLCNDTAVLGPWANSRMLNLFTGAIIAVLVLLSTILTASVLFPDMGEQWIVGILVGGSILGGLLTIGAKIFELSRRPSAARAWPKRAKRKVDVYDNWRMPPLSELPPAQLSVLSRVWMIVLRGYLLVAGGLVLVRIFQLATAGA

SEQ ID NO: 54444 - protein, 236 aa, Brassica napus
MTESSLDLQESGWEELRREARKIEGDLDVKLSSYAKLGARFNQGGYGVDGGSPGGSWKSMEIEIQSSLEKLLDINDSMSRCAASAAPTTSVTQKLARHRDILHEYTQEFRRIKGNISSMREHAELLSSVRDDISEYKASGSMSPGVQVLRERASIHGSISHIDEVIGQAQATRAVLGSQRSLFSDVQGKVKILGDKFPVIRGLLGSIRRRRSRDTLILSAVIAACTLFIIIYWLSK

SEQ ID NO: 54445 - protein, 1070 aa, Listeria monocytogenes EGD-e
MPKRDDIKTILVIGSGPIVIGQAAEFDYAGTQACLSLKEEGYRVVLVNSNPATIMTDAEMADKVYIEPITLDFVSRIIRKERPDAILPTLGGQTGLNMAMELSAAGILDECNVEVLGTDLTAIKKAEDREAFRDLMNELGEPVPESDIIHNLDEAYAFVERIGYPVIVRPAYTLGGSGGGICHNEQELIETVTSGLKLSPVTQCLLEKSIAGFKEVEYEVMRDANNNAMVVCNMENIDPVGIHTGDSIVVAPSQTLSDREYQLLRDVSLKIIRALEIEGGCNVQLALDPDSYNYYVIEVNPRVSRSSALASKATGYPIAKLAAKIAVGLTLDEVRNPVTGTTFAHFEPTLDYVVAKIPRFAFDKFEQADRRLGTQMKATGEVMAIGRSWEEALLKAVRSLEIGADHLLLEEAENADEATLERKICFPEDDRLFFLAAALRRGQTIEQLHEKTKIDLFFLYKLSKTIELENRIKENPQNQEILAEAKQAGFSDAFLATCWNVDEQAIYDLRKAQNLFPVYKMVDTCAAEFESTTPYFYSTYEEENESTRSAKESVIVLGSGPIRIGQGVEFDYATVHSVWAIQQAGYEAIIINNNPETVSTDFSISDKLYFEPLTLEDVMHVIEIEQPLGVVVQFGGQTAINLADGLAKRGVKILGTSLEDTDRAENRDAFEKALEILQIPQPAGKTATSVEEAITVATDIGYPVLVRPSYVLGGRAMEIVESEEALKHYMTNAVKVNPKHPVLVDRYVSGQEVEVDAISDGVNVLIPGIMEHIERAGVHSGDSIAVYPAQRLSIQVKNTIVDYTTRLATGLNIIGMLNIQYVVDGEEVFVIEVNPRSSRTAPFLSKITEIPMANVATRVILGENLIDLGYTPGLAPEKQEIFVKVPVFSFAKLRSVDTSLGPEMKSTGEVMGKDVTLEKALYKGFVASGTTMHDYGTVLLTVADRDKEEAVELAKRFNRIGFTIMATKGTASTLEEASIPVSQVKKIGENQETLIDYIRNGQVTLVVNTLTTGKRPERDGFQIRRESVENGIPVCTSLDTAEAILRVLESRSFELESMNASEVKQPKSRV

SEQ ID NO: 54446 - protein, 268 aa, Streptomyces collinus
MTGTAGRRVGPGCRPCRTAAAPAPWPPPHEREQHSAMDSLGTSQGLAAYDDRAEPISAVVFDLDGVLVNSFAVMRQAFTTAYAEVVGDGDAPFEEYERHLGRYFPDIMRIMGLPPEMEAPFVRESYRLAHLVPVFDGVPEMLGQLRARGVGLAVATGKSGPRARSLLEQLGLLHLFTVVIGSDEVRRPKPAPDIVLKALGVLGSDPSRTVMVGDAVTDLASARDAGVAAVAALWGETDEETLLAEKPDVVLRTPAELLEVCFGSARTL

SEQ ID NO: 54447 - protein, 795 aa, Actinobacillus pleuropneumoniae serovar 1 str. 4074
MKFNESWLREWVNPAVSTEQLCDQITMLGLEVDDVEPVAGAFSGVVVGEVVECAQHPDADKLRVTKVNVGGDRLLDIVCGAPNCRQGLKVACATEGAVLPGDFKIKKTKLRGQPSEGMLCSYSELGIKEDHSGIIELPADAPIGKDFREYLDLNDVAIEISLTPNRADCLSIAGIAREVGVINRAEVKAPVISEVPATIADKVAVELQAPEACPRYLARVVKNVNVKATSPLWLQEKLRRCGIRSIDPIVDITNLSLLELGQPMHAFDASKIDGAIQVRMAKEGEELVLLDGTTAKLQPNTLVIADSKGALAMAGIFGGEASGVNENTTDVVLESAFFAPLAITGRARQYGLHTDASHRFERGVDPQLARDAMERATALLLEICGGEAGEIVEAVSEQHLPKRNTVTLRRSKLDAVIGHHIEDETVTDILTRLGLNVIFANDSWTAVAPSWRFDIEIEEDLIEEVARIYGYNSIPNNSPLAHLTMKGTPEKLLEVNRIRTALVDSDYQEVVTYSFVDPKKQALLHPNQEALILPNPISNEMSAMRLSLLTGLLDTIAYNQSRQQTRVRIFEGGLRFIPDAAAESGIRQELVFGAAIVGDKRPVHWESKGEAVDFFDLKGDMERVLSLTSARHDLKFVAKQFPALHPGQSAAIMLDGKEIGFIGSVHPSIVQKLGIKGKPVVFEILGDAIANRPVPAAKEISKFPANNRDIAVVVDENVPAGDVLDACRHAGGVKLVAVNLFDVYRGANLAAGKKSLAISLTVQDTEKTLEEEEISTVIQAVLAELAQRFQAYLRD

SEQ ID NO: 54448 - protein, 340 aa, Triticum aestivum
  misc_feature (329)..(329): Xaa can be any naturally occurring amino acid
  unsure (1)..(340): unsure at all Xaa locations
RHEGGLTRPQALKAFKKLSHLKSPAKPNAVLGLSGADAAAVVTKDPLFLRTKVDKTLAPKVVGLTGLGLSSPDIACLVSLTPDCFRSRNIVSKLHYYLPLLGSFHNFLRLLKRSPRLLSWDLNKVVKPNVVFLRECGLGDCDIAKLCIHAPRMLSTNPERVRAMVACVEGIGVPRGSGMFRQALCAVTFQSEEKIAAKMEYLKNTFRWSDAEACVAVRKYPSVLRKSKESLKRRSEFLVSEVGLEPVSIAHQPVVLSLSLEGRLRPRYYVIKFLKENGLLHRDPSFFTAVKITEKVFVEKLISPHKEAAPHLAEDYATACKGEAPTNFXLDGPGTGYENP

SEQ ID NO: 54449 - protein, 116 aa, Fagopyrum esculentum
MAEEAQVIACHTVQEWNEKFQKAKDSGKLIVIDFTASWCGPCRVITPYVSELAKKFPHVAFFKVDVDDLKDVAEEYKVEAMPSFVILKEGQEVERIVGARKDELLHKIAVHAPITA

SEQ ID NO: 54450 - protein, 310 aa, Ralstonia solanacearum GMI1000
MLDIQMQSLLQGMQQAGVPDMADLPPPAARQVYSRIMAAAAEPVRAVSIAERTIAGPGGDLALRIYAPQRPDPRRGVALYLHGGGFVVGTPRDYDSVASALCERSGCVVVQVDYRLAPEHPFPAAVEDAWAAACWVAAHARELGAQPRIAVVGDSAGGNLAAVLARLARDCEGPAIVQQTLIYPMVAARPETTASYLRYGTGYTLTTRLTHYFHDLYLNGRPAEGDPRLVPLSAPDASGLPPALVMVAGYDVLRDEGIQYAHRLAQAGTPVTLVEYSGMVHGFIGMAGALEAARQALAQVADAVGRALAG

SEQ ID NO: 54451 - protein, 434 aa, Rheum australe
MAEKHFKYVILGGGVAAGYAAREFAKQGVQPGELAIISKEAVAPYERPALSKAYLFPEGAARLPGFHTCVGSGGERLLPEWYKEKGIELILSTEIVTADLASKTLTSAAGEVFKYHILIIATGSSVIKLTDFKVQGADAKNILYLREIDDADKLVEAIKEKKGGKVVIVGGGYIGLELSAVMLLNKLDVTMVYPEPWCMPRLFTADIAAFYEGYYANKGVKIIKGTLAVGFESHANGEVKVVKLKDGRELEADIVVVGVGARPLKNLFKGQLEEDKGGIKTDAFFRTSVPDVYTVGDVATFPMKMYGDIRRVEHVDHSRKSAEQAVKAIKASEVGEAIEEYDYLPYFYSRSFDLSWQFYGDNVGDAVIFGDSSPESEKPKFGFYWIKDGKVVGVFLESGTPEENKAIAKVAKLQPPAESLEQLANEGLGFASKI

SEQ ID NO: 54452 - protein, 254 aa, Phaseolus vulgaris var. nanus
  misc_feature (254)..(254): Xaa can be any naturally occurring amino acid
  unsure (1)..(254): unsure at all Xaa locations
MGRKFFVGGNWKCNGTTEEVKKIVTTLNEAKVPGEDVVEVVVSPPFVFIPTVKTLLRPDFHVAAQNCWVRKGGAYTGEVSAEMLVNLGVPWVIIGHSERRQILQETNEFVGDKVAYALSQGLKVIACIGETLEQREAGTTAAVVAEQTKAIAAKVSNWDNVVLAYEPVWAIGTGKVATPAQAQEVHVDLRKWVHDNVSAEVAASVRIIYGGSVNGGNCKELAGQADVDGFLVGGASLKAEFVDIINSATVKKNX

SEQ ID NO: 54453 - protein, 498 aa, Rheum australe
MASRKMLIDGDANQTNENDQADYDFDLFVIGAGSGGVRAARFSANFGAKVGICELPFHPISSEVIGGVGGTCVIRGCVPKKILVYGATLGGEIEDARNYGWELNEKIDFNWKKLLHKKTEEIVRLNGIYKRLLSGAGVKFFEGEGKVVGPNEVHVIQTDGTKLSYTAKHILVATGSRAQRPNIPGKELAITSDEALSLEEFPKRAVILGGGYIAVEFASIWCGMGATVDLFFRKELPLRGFDNEMRAVVARNLEGRGINLHAQTNLTEIVKTDGGLKVYTDHGEEFVADVVMFATGRIPNSSRLNLEAVGVELDKSGAVKVDEYSHTSVPSIWAIGDVTNRMNLTPVALMEGTCFAKTVFEGKPTKPDYSHIPCAVFSIPPLSIVGLSEEQAVDQANGDTLVFTSTFNPMKNTISGRQEKSVMKLVVDAETDKVLGASMCGPDAPEIMQGIAIALKCGATKAQFDSTVGIHPSAAEEFVTMRSVTRRVAPAKKVRTNL

SEQ ID NO: 54454 - protein, 754 aa, Ralstonia solanacearum GMI1000
MLRLPSHLSPGKPYPLGAQWDGLGINFAVFSANATRIDLCLFDPTGRKELARLPLPECTDEVWHGYLPGVESGLVYGYRAYGPWEPYRGHRFNPHKLLLDPYARRLVGALRWSDALFGYRLNSSRADLSFDRRDSAPACPKAVVTDESFNWGNDVRPNTPWSRTVIYEMHVRGASMLRDDLLPPERGTFAALADPVFIEHLRALGVTAVELLPVHAFLQDRFLVERGLRNYWGYSTLAFFAPEPAYLSTPTLHEMKVAIRRLHAAGIEVLLDVVFNHTCEGNELGPTLSFRGLDNASYYRLVPGQERYYINDTGCGNTLNLSHPRVLQMVMDALRYWVNACHIDGFRFDLGVTLGREGLGFDPGSGFFDAVRQDPVLATVKTIAEPWDVGPDGYQLGNHPPGFAEWNDRFRDGVRRFWRGDAGQRPELAARLTGSGDLFGRRYRRPWASINYAASHDGFTLRDVVSYTHRHNEANGEDNRDGHHDNCSANWGVEGPTDDAAILAQRARVARALLATVLLSNGTPMLLGGDEFGRTQQGNNNAYCQDNAISWLDWSMRAQAEGRALFAYTARLIALRKTSPALRWPHFVHGEAEVLPGVPDIAWFDERGQPLTPDAWNDAEARALALRRACIETIDGEARPHVALTLINGAAADLIFTLPGPAMDWLLAIDSAAPEREARPHAEPTVRVQGRSVVLLLATQLAAIAQIASAPEREAAGQTVGRVPDRPVEAGAGAGVQPHPDETVPATGQGEALP

SEQ ID NO: 54455 - protein, 799 aa, Saccharomyces bayanus
MVLPILPLIDDLASWGTKKAYASLVGQVLLDGSSLNKDEVLQFAKEEEVPLVALSLPNAKFSDDDIIAFLNNGVSSLFIASQDAKIVDHLVEELNVPKNRIVVEGNGVFHNQFLVNQKFSQDRIVSIKKLTKDLLIKEVVAEVRTDRPDGLFTTLVVDQYERCLGLVYSSKESIAKAIDLGRGVYYSRSRNEIWVKGETSGNGQKLLQISTDCDSDALKFIVEQENVGFCHLETMSCFGEFKHGLVGLESLLKQRLQDAPKESYTRRLFNDPALLDAKIKEEAEELTEAKGKQEISWEAADLFYFALAKLVTNNVSLKDVENNLNMKHLKITRRKGDAKPKFVAQAKAEEEAPTGPIHLHVVNASDKEGIKKALSRPIQKTSEIMHLVNPIIENVRDRGDSALLEYTEKFDGVKLSTPVLNAPFPEEYFEGLTEEMKDALDLSIENVRKFHAAQLPKETLEVETQPGVLCSRFPRPIEKVGLYIPGGTAILPSTALMLGVPAQVAQCKEIVFASPPRKSDGKVSPEVVYVAEKVGARMIVLAGGAQAVAAMAYGTETIPKVDKVLGPGNQFVTAAKMYVQNDTQALCSIDMPAGPSEVLVIADEDADADFVASDLLSQAEHGIDSQVILVGIKLSEKKIQEIQDAVHDQAMQLPRVDIVRKCIAHSTIILCDGYEEALEMSNKYAPEHLILQIANANDYVKLVDNAGSVFVGAYTPESCGDYSSGTNHTLPTYGYARQYSGANTATFQKFITAQNITPEGLENIGRAVMCVAKKEGLDGHRNAVKIRMSKLGLIPKDFQ

SEQ ID NO: 54456 - protein, 598 aa, Yersinia pestis CO92
MTDLTTSDSLQPAWQTRDHLDDPVIGELSNRFGPEAFVVQATRTGMPVVWVKREQLLEVMSFLRKQPKPYVMLFDLHGVDERLRTHRQGLPDADFSVFYHLLSIERNRDIMLKVALSEKDLHVSTATKIFPNANWYERETWEMFGITFDGHPHLTRIMMPQSWEGHPLRKDYPARATEFDPYVLTKQKEDLEMESLTFKPEDWGMKRGTENEDFMFLNLGPNHPSSHGAFRIVLQLDGEEIIDCVPDVGYHHRGAEKMGERQSWHSYIPYTDRIEYLGGCVNEMPYVLAVEKLAGIVVPDRVNTIRVMLSELFRINSHLLYISTFIQDVGAMTPVFFAFTDRQKVYDVIEAITGFRMHPAWFRIGGVAHDLPRGWERLLRDFLDWMPKRLDSYVKAALQNSILKGRSVGVAAYNAKEALEWGVTGAGLRATGVEFDVRKWRPYSGYENFDFEVPVGNNGDCYDRVMLKVEELRQSLRILEQCYKNMPEGPFKADHPLTTPPPKERTLQHIETLITHFLQVSWGPVMPANESFQMIEATKGINSYYLTSDGSTMSYRTRIRTPSYAHLQQIPSVIRGSLVSDLIVYLGSIDFVMSDVDR

SEQ ID NO: 54457 - protein, 157 aa, Zea mays
MAAAATATPSVAPESGDRKAVAPPVDAVDLELELEEKHVLAVDDSSVDRAVIAKILRSSKYRVTTVDSATRALELLALGLVPDVNMIITDYWMPGMTGYELLKHVKESSALRAIPVVIMSSENVPTRISRCLEEGAEDFLLKPVRPADVSRLCSRIR

SEQ ID NO: 54458 - protein, 153 aa, Triticum aestivum
  misc_feature (73)..(73): Xaa can be any naturally occurring amino acid
  misc_feature (85)..(85): Xaa can be any naturally occurring amino acid
  misc_feature (100)..(100): Xaa can be any naturally occurring amino acid
  misc_feature (117)..(117): Xaa can be any naturally occurring amino acid
  misc_feature (124)..(124): Xaa can be any naturally occurring amino acid
  misc_feature (129)..(129): Xaa can be any naturally occurring amino acid
  unsure (1)..(153): unsure at all Xaa locations
QIKFLLGVPSHGFDRPNVVHDENASENMTRDIENSQDNALSLCTEKVLLARQAYDLIESHIKRLDEDLGQFAXEDLKQEGKIPPXDEPHILPPNAGGWAXMKDGGHFNTPQSSKEFXREKEWEXDRERXMDFDLIPLQVSNNKKAFIYGWSND

SEQ ID NO: 54459 - protein, 579 aa, Debaryomyces hansenii CBS767
MSSQYNNPEAGSSTQPKGSVSNLTRNLLSSSQLQVGKPLIQKDLSTGVLQLQQGDGNRSSSYNASHASSFNKFIPTEGDDRGNNDLRFSQSIDYANSYTNPNNHFTNFSYPNQPSFIYRNSSNPQYIPPNNDSMNYIPSGHNTPTTVSTSYSSTNSYTPMASSGNTYGVQTQPQNISAAASLRPAGLTSTGQPTTNISIESVNTANQSLRSSSINSTRMPQPGSFTNSNYGFEGSKSFQYQPQLQTNTYASIPPQPMPTNTSTASVQNQEFLSQQLQLNAYNNQFPHFFQEPDHYMTYKEFLENLTNDSSEEDDNEHLNIVDYPVNDLILMLSCLLTKIIEANDKLHPNHFDNTIAVRQKLKEEKKKKKLEKLKQKHASVDSHIDPDDLSNDEEDDNDEEDDDDEMKNKYLANVLAFHGTNVPGISLHAYLARVLKYCPVTNEVFLSLLVYFDRIAKKANNLKQFKSNDDEQDQEPESEQLFVMDSYNIHRLIISGITVSSKFFSDIFYKNLRYAKVGGLPLEELNYLELQFLLLLDFKLMISVEDLQNYGDLLLRFWKREQVTNELVIGSQSPNQMDE

SEQ ID NO: 54460 - protein, 1082 aa, Rhodospirillum rubrum ATCC 11170
MPKRTDIKSILIIGAGPIVIGQACEFDYSGAQACKALRAEGYRVILVNSNPATIMTDPETADATYIEPITPEIVEAIIERERPDALLPTMGGQTALNTAMALADRGVLTKYGVEMIAANKEVIAKAEDRLLFRDAMRKIGLDCPRSALVHSIEESRQALEEIGLPVIIRPSFTLGGQGGGMAFNREEYDRIVASGLAASPVRQILVEESVLGWKEYEMEVVRDRADNCIIVCSIENIDPMGVHTGDSITVAPALTLTDKEYQVMRNASIACLREIGVETGGSNVQFAVNPKDGRLVVIEMNPRVSRSSALASKATGFPIAKIAAKLAVGYTLDELSNDITGVTPASFEPTIDYVVTKLPRFTFEKFPDTEALLSSSMKSVGEAMAIGRTFKESLQKGLRSLEIGLDGLDEVEIPGSAGQDGKDAIRAALSKARPDRILIIAQALRQGFTVEEVRAICYYDPWFLEQIKEIVDEERRLRENGLPGDAVSLHRVKKMGFSDARLAKLTGKTVTEVSFRRQVLNVHPVYKRIDTCAAEFASRTPYMYSCYEGDGLTPAECEAEVSDRTKIIILGGGPNRIGQGIEFDYCCVHAAYALSDAGFETIMVNCNPETVSTDYDTSDRLYFEPLTIEDVVELARKEQARGTLLGCIVQYGGQTPLKLARGLEAAGIPVLGTSPDAIDLAEDRDRFQKLIAKLALRQPRNGTALSVEQARAIATRVGYPVVIRPSYVLGGRAMQIVHDEAQLNDYMVNAVKVSGDDPVLIDNYLSGAIEVDVDAIADGETTHIAGIMQHIEEAGIHSGDSACSLPPYSLDEATIAELTKQTEALAKGLNVRGLMNIQFAIKDGDIYILEVNPRASRTVPFVAKATGVAVAKIAARVMAGESLASFGLVTKRLAHVAVKEAVFPFARFPGVDIVLGPEMKSTGEVMGIDTTFARAFAKSQLGAGVTLPEGGTAFISVRDGDKAAIMPIARELTELGFRLVATRGTAALLAENGLSVEVINKVLEGRPHCVDAMISGDIHLVFNTTEGIQSQKDSFDIRHTALMRNIPHYTTVAGATAAVKAMTALRQGHLEVAPLQEYFKVS

SEQ ID NO: 54461 - protein, 326 aa, Arabidopsis thaliana
MDETKIPKKLQSDDEENISLISSLPFDVDFDSTKLFKYQGCWYDDKTLQGVLNFQRGFEPQDTDIIIASFPKSGTTWLKALTVALLERSKQKHSSDDHPLLLDNPHGLVPFLELRLFTETSKPDLTSISSSPRLFSTHVAFQTLREALKNSPCKIVYVWRNVKDVLVSFWYFNSAKLKIEEERSILDSMFESFCRGVINYGPSWEHVLNYWRASLEDSKNVLFLKYEELKTEPRVQLKRLAEFLDCPFTVEEEERGSVEEILDLCSLRNLKNLEINKTGKTLRGADHKIFFRKGEVGDSKNHLTPEMEKIIDMITEEKFEGSDLKF

SEQ ID NO: 54462 - protein, 331 aa, Symbiobacterium thermophilum IAM 14863
MSSQPLAGNIRPLDVFSSIADDLRQVETAIEAALSTQETMLEEVSTHLLRSGGKRIRPALVILASRFPGVELKQVIDVAVAVELIHMATLVHDDVVDNADLRRGRPTVNALWNNQVSVLTGDYLFAKAFTLLADTGNNRVVRLMSEVVREMSQGELAQMASYFDVEQTEEDYYRRIARKTGYLIAEACRLGAVMAGVGEEQVQAVYDYGMGVGLSFQIADDLLDFFGDEETVGKPVCGDLKIGILTLPVIHGLAHAPRRAELRELILSRSIDDTAVARVKEILTESGSFDYARGKAREHIEKAVRALDHVPTLATRPALKTLAEFVINRKF

SEQ ID NO: 54463 - protein, 729 aa, Synechococcus elongatus PCC 7942
MFDLSKFLPVITPLMIDTAKTLCPYCGVGCGLEAVPPAQPGRATVRDREGTPIWQIRGDRQHPSSQGMVCVKGATVAESVSKSRLKYPMFRASLDDPFTEISWDEALDRLCDRIQQTQADYGKDGICFYGSGQFQTEDYYIAQKLVKGCLGTNNFDTNSRLCMSSAVSAYSLCLGSDGPPACYEDLDLADCLLIVGSNTAECHPILFNRYRKRHKQGGTNLIVVDPRCTPTAEVADLHLALKPGSDVALLNGLGWLLYQMGYVKKDFIANQTEGFEDWLAIIEDYPPQRTAELTGLAVAELVRAADLIASAQRWLSLWSMGVNQSIQGTAKATSLINLHLLTRQIGLPGCGPFSLTGQPNAMGGRETGGLAHLLPGYRKVIDPQHRADVETIWGLPMGSISPQPGRTAWQMIEGLEQGAVGFLWVAATNPAVSLPDVKRAQAALKRSPFTVLQDAYHPTETTTYAHLLLPAAQWSEKTGTMTNSERRVTLCQAFRQPPGEARADWQIFAEVGRRLGFAFDYTDAAAVFAEYVQVTAGRLCDLSGLSHELLAQAGPQQWPFPAGAEPTTESKRLYTKHHFAYADGRARFQPFHHLGVAEPPDDRYPLVLTVGRLYGHWHTQTRTGRIDKINKLHPSAFVEIHPRDADRYNISEGQAVVIRSRRGEGCFPAKVTTAISPGVLFVPMHWGALWGDRTEANALTHPAACPISGEPELKACAVQIEAASSTFTI

SEQ ID NO: 54464 - protein, 580 aa, Oryza sativa (japonica cultivar-group)
MAPAPSSSLATAGHGKTKSGRSSSSAVRPALLAIAVSVMVVLLMAVLFGARWTPSGGHGGGADTSWVSAGARVVLNAVSSQQGADPVVKVAQPHDRLLGGLLSPDFNDTSCLSRYRASLYRRRSLHVLSSHLVSALRRYESLHRLCGPGTSAYERAVARLRSPSSSNTTSDAPSECRYLVWTPHAGLGNRMLSITSAFLYALLTGRVLLFHRSGDDMKDLFCEPFPGATWVLPEKDFPIRGMERFGIRTRESLGNALGRGEGGRDPPPPWMYVHLRHDYTRPGASDRLFFCDDGQDALRRVGWVVLLSDNYFVPGLFLIPRYERELSRMFPRRDAVFHHLGRYLFHPSNTVWGMVMRYHGSYLAKAEERVGVQVRTFSWAPISTDELYGQIVSCAQGENILPRVRESSSGSDNATAIPGSGRQQQQRPARRKAVLVVSLHGEYYERIRDMYYEHGAAGGDAVSVFQPTHLGGQRSEERMHNQKALAEMMLLSFSDVALTSAASTFGYVSHGLAGLRPWVLMVPVRKKAPNPPCRLAATVEPCFHTPPHYDCQARTKGDNGKTVRHVRHCEDLKDGVQLVD

SEQ ID NO: 54465 - protein, 411 aa, Pyrococcus abyssi GE5
MKTLNVEDIIEKVANGEIKLHQVEKYVNGDKRLATEIRRKALERKLGISLKHIGHYSIDPNELIGRNIENMIGVVQIPMGVAGPLKINGEYAKGEFYIPLATTEGALVASVNRGCSALTEAGGVVTTILDDKMTRAPLIRCPNARRAREVAEWVKENLNYLQEKAVAKVTRHGKLRDVKPFIVGNNLYLRFEFETGDAMGMNMVTIASEEIMKVIEEEFPDVRYLALSGNLCVDKKPNAVNFILGRGKTVVAEAIVPREIVEKKLKTTPELIAEVNYFKNLVGSAQAGSYGFNAHFGNIVGAIFLATGQDEAQITEGSHGITIAEVTPEGDLYISITMPSLEIGTVGGGTRVPTQREALSIMGVAGGGDPPGVNAKKFAEIVAGAVLAGELSLLAAIAAKHLARAHKMLGR

SEQ ID NO: 54466 - protein, 89 aa, Glycine max
RVFQVYGCVVTAQDMVEPRDPVKVFDKADYYAHPEHYNPTFHEKIAPYASVIVNCMYWEKRFPQLLSYKQMQDLMGRGSPRVGIADITC

SEQ ID NO: 54467 - protein, 539 aa, Arabidopsis thaliana
MVVKTGFPITDSSSSASMAEFPEPGTVNPDSDLSNGRAEKPEIDTSAPFESVREAATRFGGFGFWRPSLNKLPDASQENIQEPDIMGLKAQAFELQRELIVKERETLEVLKELEATKATVLKLQQRNEAYEEDTLREEVDSHIKPAGVVLKDLSQAKMNLCKIASIRESVEQLKNKLNEERAALEKTRERLMEKSLKVFSLEEEEVRVRFAKEGQTGEKDLGMLNEVQRLSRQAQEVKKTGENAELEVVKAMAETESTRDKIRTAKIRLVAARKMKEAAREAEAVAIAEIEAVTGSMNVGKAEAVTISAEEYSVLARSARDAEEEARKRVEDAMSRVEEANVSKKDVLKKVDEAAQEIETSKRVLEEAVERVDAANASKIEAEEALRKWRSENGQRRRLSSSVNNTSKFKSRRETTTRLMDVNGLHLTYDVVDGSSSSSTVPVLKPTMSIGQILSKKLLLAEDSDMNVANERRKMSLGQMLAKNSSSDKTVSKRSEGKENEKRTKTRKRKSFGFAKISVLLNKESKNKKKKKKIALNLR

SEQ ID NO: 54468 - protein, 446 aa, Oryza sativa (japonica cultivar-group)
MAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIAELAVGLATGQIKTGAPCRSERLAKYNQLLRIEEELGAAAVYAGAKFRAPVEPY

SEQ ID NO: 54469 - protein, 177 aa, Triticum aestivum
  misc_feature (18)..(19): Xaa can be any naturally occurring amino acid
  unsure (1)..(177): unsure at all Xaa locations
GPQIIYNVPSRTSQDILXXVIEALSCYSNMAGVKECVGHERVKCYTDKGIAIWSGNDDECHDSRWNYGATGVISVASNLVPGLMHSLMFEGENAALNEKLLPLMKWLFCEPNPIGLNTALAQLGVVRPVFRLPYTPLPLEKRVEFVRIVEAIGRENFVGQQEARVLDDDDFVLISRY

SEQ ID NO: 54470 - protein, 314 aa, Glycine max
  misc_feature (63)..(63): Xaa can be any naturally occurring amino acid
  unsure (1)..(314): unsure at all Xaa locations
MGEACIPTVDLSPFLREDEDGKKRAIEAITQACSEYGFFQIVNHGVSLDLVKEAMQQSKTFFXYSDEEKSKSSPSSDAPLPAGYSRQPLHSPDKNEYFLFFSPGSSFNVIPQIPPKFRDVLEEMFVQMSKMGVLLESIINECLGLPTNFLKEFNHDRSWDFLVALRYFPASNNENNGITEHEDGNIVTFVVQDGVGGLQVLKNGDWVPVVPAEGTIVVNVGDVIQVLSNNKFKSATHRVVRAEGRSRYSYVFFHNLRGDKWVEPLPQFTSDIGEPPKYRGFLYKEYQELRMRNKSHPPSRPEDEIHITHYAIDN

SEQ ID NO: 54471 - protein, 368 aa, Nitrosomonas europaea ATCC 19718
MKTRAAVAWQAGQPLTIEEVDLAGPRTGEVLVEIKATGICHTDYYTLSGADPEGLFPAILGHEGAGIVVEVGADVKSLRPGDHVIPLYTPECRECKFCLSRKTNLCQAIRATQGRGLMPDGTSRFSLDGKAIMHYMGTSTFSNYIVVPEIALAKIREDAPFDKACYIGCGVTTGIGAVLFTAKVEVGANVAVFGLGGIGLNVIQGARMAGADKIIGIDLNPEREALGRQFGMTHFIDPSQVENVVDAVIQLTDGGADYSFECIGNTTVMRQALECTHKGWGRSIIIGVAKAGAEISTRPFQLVTGRKWEGSAFGGARGRSDVPRIVDWYMDGKISIDPLITHILKLEEINEGFKLMEAGESIRSVVVF

SEQ ID NO: 54472 - protein, 502 aa, Pseudomonas aeruginosa UCBPP-PA14
MTMTFQHDDLPLALYSAAQVRDLDARLIAAGTPGFELMQRAAHAAWRALRRRWPEAAALTVLAGHGNNAGDGYLIAALAQRAGWRVRVLAVAAPQRLAGDAAQAHAAALATGVVVEPWSECAVLEGVVVDALLGTGLAGAVREPFAQAIRLANAADLPVLAVDIPSGLSADTGAVLGEAIRADLTVTFIGLKIGLFTGEAPARVGELVFDELGSDAVVLQALQPRARRLARNALPRLAARPRTAHKGLFGHLLVVGGDTGMGGAVLLAAESALRCGAGLVSAATRVEHVPALLGRCPEVMAHGVASANQLLALAERASVLVLGPGLGQRAWGRSLLSAVRSRPLPQVWDADALNLLALEPVGAGPQTWILTPHPGEAARLLGRSTAEVQADRPAAALELARRYQAVVVLKGAGSLIAAPDGRLAVCSQGHPAMAGAGLGDVLSGITGALLAQRVEAFEAACLAVWLHAAAGERLGAQGRGLAATDLIPTVRQLLEECSPCLK

SEQ ID NO: 54473 - protein, 391 aa, Nitrosomonas europaea ATCC 19718
MKKSFAAVQQQTETSIVFDTHPEVSIDLSLVEARLKQGYQKPFLLIDSNIIRNKARRFKTSMPRVRPHYAAKANPDPRVLKTLIEEGVGFEIASIAELDLLMSLGVPAAEIFYSNPMKSRAYIEYAAAKGVEWYVLDSIEELRKIVSIKPDAKLYLRIDTPNIGSDWPLAGKFGTHLVDVSEIIDEAVRLKADLAGVTFHVGSQCRNPQNWRVGIERAQTVFASMREAGLKPRLLNLGGGYPVRHVKPIPSIEVIAEVINEAIADLPEDIHVMAEPGRYLVSDSACFVCRVVGTATRNGKRWMYWDAGIFGGIIEVSEGLRYEILTQRNGSLIPWSVAGPTCDSVDVLMHDEMLPEDIQENDFIFIPNAGAYTTSYASNFNGFPLPDVVVI

SEQ ID NO: 54474 - protein, 462 aa, Zea mays
CAFRRIGLHACATGTMWTASAHIITAVIGSGVLSLGWAIAQLGWVAGPVVMLLFSLVTYYTSSLLADCYRSGDPSTGKRNYTYMDAVNANLSGIKVQICGFLQYANIVGVAIGYTIAASISMLAIRRANCFHQKGHGNPCKISSTPYMIIFGVAEIFFSQIPDFDQISWLSILAAVMSFTYSSIGLGLGVVQVIANRGVQGSLTGITIGVVTPMDKVWRSLQAFGDVAFAYSYSLILIEIQDTIRAPPPSESTVMKRATVVSVAVTTLFYMLCGCMGYAAFGDGAPGNLLTGFGFYEPFWLLDVANAAIVVHLVGAYQVYCQPLFAFVEKWAAQRWPDSAYITGEVEVPLPLPASRRRCCKVNLFRATWRTAFVVATTVVSMLLPFFNDVVGFLGALGFWPLTVYFPVEMYVVQKKVPRWSSRWVCLQMLSLGCLVISIAAAAGSIAGIASDLKVYRPFKSY

SEQ ID NO: 54475 - protein, 532 aa, Zea mays
MQAAIDQSPHLRFRAGMDDKSCYVATGLSLAAILLVLHRLVVRAGGKGNAAARRLPPSPPAVPFLGHLHLLASECPLHSSLARLAARHGPVLSLRLGSRAAMVVSSPECAEACFTEHDVAFANRPRLTSQALASFGGAALAVSSYGPYWRNLRRVAAVRLLSTHRVACMCPVISAEVRAMLRRVGRAAEATGRVQLKASLFELSLSVLMETIAQTKTSRADDADDAVSPEAHEFRRIVDEILPYLGATNLWDYLPLLRRFDVLGVRNKIRDVVGRRDAFLQRLIDAERRRLDGDGDGDEKKSMIAVMLSLQKSEPDVYTDTMIMALCGNLFTAGTETTSSTIEWAMSLLLNHPEALKKAEAEIEAAVGASRLITMDDVPGLGYLQCVINETLRLYPVAPLLLPHESAADCTVGGYDVPRGTLLFVNAYAIHRDPAAWEEPDEFRPERFRDGKAEGRLMLPFGMGRRRCPGETLALRTAGLVLATLIQCFHWDRIDDAEIDMTESGGLTMPRAVPLEATCKPREAMRHVLQQL

SEQ ID NO: 54476 - protein, 279 aa, Prochlorococcus marinus str. MIT 9313
MLFRPLLALVLAFCLTFVSAPSSVSAAITDGAGDSDFVVGNERSNARFGNIVNTGRANDCPTIAAGSSGSISIGSGDTLSDICLQPTEVLVKVAPTKRKKADFAKTKIISPSNNTTIEQVFGDISSSGAFAEKGGIDFQLITVLAPNGEEVPFVFSAKDMQVDSNSSSISVGTEFKGTTRTPSYRTSNFLDPKSRALTTGVDYAQGLVALGGDDKDLQTENVKRYIDGKGQITLSVDSVDAGSNEFAGTFVALQTADTDMGSKEARDLKISGVLYGRKG

SEQ ID NO: 54477 - protein, 282 aa, Oryza sativa (indica cultivar-group)
MDWAAAGYTAAALVCAAAATVIALVHIYRHLLHYAEPIYQRFIVRLIFMVPVYAVMSFLSLILPDNSIYFNSIREIYDAWVIYNFFSLCLAWVGGPGAVVGVLVFLAAKSRFIKNAEKAADLQNFVLCVEMLIAAIGHLFAFPYNEYAGPNGRPSGDFKGSLLHALKFNDFYHDTVHQFAPTYNEYVLYNHNEGDSTQRKYPSASTVPSGRDVELSGISVMPANSAVTSSVSSNQADQEETMSTPIKDRVDNVGLYDLTDLLDVDLSNYPAKVPAISDVRKQ

SEQ ID NO: 54478 - protein, 248 aa, Mesembryanthemum crystallinum
MAGLAFGRFDDSFSWASIKAYIAEFISTLLFVFAGVGSCIAFNKLTADAALSPSGLVAVAVCHAFALFVAVSVGANISGGHVNPAVTFGLAVGGQITILTGVLYWIAQLAGSVAGCFLLKAATGGLTTPIHSVASGVGAIEAVVMEIIITFALVYTVYATAVDPKRGSVGTIAPIAIGFIVGANILAAGPFSGGSMNPARSFGPALASGDFHDHWVYWVGPLIGGGLAGLTYSNVFMHHEHAPLSSEY

SEQ ID NO: 54479 - protein, 471 aa, Symbiobacterium thermophilum IAM 14863
MAKVDRVLEMIAEKDIRLLDLKFVDVLGMLHHLTVPVEVVDAEQLSQGFFFDGSSIRGFRGIAESDMILRPDPATVVCDPFVEGPALSLMADVLEPGLREYGRDPRGVARRAEEYLRQTGIADTSYWGVEIEFFVFDNVRFQTGPDASFYYVDSAEAHWNSGRVPNGGYKVKHQQGYLRALPIDEQTDLRTAMTRQMQALGLVVERHHHEVASAGQNEINFRFSTLTDTADKAMLYKYAVKNVARAHGKTATFMPKPLYRNSGNGMHCNQSLAKDGVNLFYDPNGYANLSQIALWYIGGLLTHADALLAITNPTTNSYKRLVPGYEAPTNLAFSRANRSAAIRIPVSLSPKTTRIEFRTPDPTANPYLALAAQLMAGLDGIRRRIDPTAAGFGPVDIDIYHHAGSAAVQLKHVPSSLRQAVEALKADHEFLLEGDVFSEDLIETFIALKEDEIRNLETHPHPVEFEMYFDN

SEQ ID NO: 54480 - protein, 111 aa, Brassica napus
MVLWELALGTAYFLGLRRSYRLALKTQRRLVSPNHPRIRQFLHRRTHQIFDVALRVHKNIQQRDMEIGRSLGNWILRGLDRMKPSAQVLRPKQIEPTSVGKAAKRLLDSTR

SEQ ID NO: 54481 - protein, 656 aa, Yersinia pestis CO92
MSVEKQFSVSAEKTCNTENKCNTEKKFDVICMGRIAVDLYGQQIGARLEDVASFAKYLGGSSGNVAYGSARQGLRSSMLARVGDEHMGRFLREELHQVGCDTSHLTTDKKRLTALVLLSIKDRDTFPLIFYRDNCADMAITAQDFSEQYIASARSLAITGTHLSHPNTREAVLTALRYARRNGVRTVLDIDYRPVLWGLTSLGDGETRFIESHQVTAELLAVFNLFDVIVGTEEEFHIAGGSTNTLDALRGVREVSDAALVCKRGALGCSVYTEAIPQTLDEGLTVSGVRVKVLNVLGAGDAFMSGLLRGYLNDEGWPQACRYANACGALVVSRHGCAPAMPSKIELDNYLARADAVVRPDLDVHLNHLHRVTTRRRQWPELCVMAFDHRSQLEEMALQCGADLCHISTLKTLILQASREAVHTAGLQGKAGLLCDGTFGQDALNAITGAGWWIGRPIELPGSRPLAMEHGNIGSQLIGWPQEHIVKCLVFFHPEDAYSLRLEQEQKIIEVYRACCQSGHELLLEVILPAGMPRSDELYLRAISRFYNLGVYPDWWKLPPLASEGWAALNKLIERRDPHCRGVVILGLDASLEALRTGFNAAAGYPIVKGFAVGRTLFGDASLAWLKRDIDDTQLIARIRDNYLQLITLWRERGQK

SEQ ID NO: 54482 - protein, 503 aa, Prochlorococcus marinus str. MIT 9313
MGKDHFFLELEPPEERLRRAPHVVIIGGGFAGVRACKALANTEVRVTLIDKRNFNLFQPLLYQVATGLVSKGDVATPLRQLIGRQFNVQVLLGEVTQLNPQDKQIVFNNKSLSYDYLVLATGSGSTYFGHEEWRSFAPPMKILEHAEEIRRRLLMAMEQAEQTPDPNARQFLQRVVIVGAGPTGCEMAGAVSELMRNAMRREFKQLNPDQTKIYLVDPGVRVLRAMPEMLSKSARTTLESLGVEIVFKGRVQSMQPGEVMISTPNGDQCIQAATVIWTAGVRPSHLGRNLADSIGCELDKGGRVVVEPDFSVAGHPEIRVVGDLCSYRHTTNQNPLPGMAGPATQAGGFVGKDIAALVSGSSRPTFNWFDFGSMAVLDRVAAVADLRGFKFSGGIGWMCWALAHLAFMPNPENRITLLFKWLVAVVSQQRSSMLLTGMPSQHIDIDAPDAHFPMQPGLGPSIAAPDAALQAAMKYYSTQIAGIAPQPMASKEGSGEDSKAAIK

SEQ ID NO: 54483 - protein, 206 aa, Mesembryanthemum crystallinum
LTSDGALDPAGLVAVALAHAFALFVGVSMAANVSGGHLNPAVTFGLAIGGHITVLTGLIYWVAQVLGSIVACLLLKFVTNGMSIPAHGVASGMNAFEGIVMEIVITFALVYTVYATAADPKKGTIGTIAPIAIGFIVGANILAAGPFSGGSMNPARSFGPAIVSGDLSQSWIYWVGPLIGGGLAGLVYGDVFIGSYAPLPTPENYP

SEQ ID NO: 54484 - protein, 467 aa, Fulvimarina pelagi HTCC2506
MSNATAALNAPILPTEQTRPFRAPAPVPHSEPLGFFGFLQTASRNPIEIWGTRAFKEPYIEGRWLGVPNIVVNDPQAVRHLLVENAKNYVMQPLRQRILRPLLRDGLLTAEGQLWRRTRKAIAPVFTPRHIAGFTESMAARSENARERLSGMTGKTIDISHETTLLTFDILQATLFSDDIASEPDEFARSTSDFLGSMGRVDPLDLLGAPQFLPRIRRLRGRKSMAYFRQLIGDTIEKRRAQLERDPEGVPADLLTLLLKADGLSRDEIEDNIITFIGAGHETTARSLAWTLYLLSQAPDEREKVETEIDAVVPSLEHPSQYLDALPRTRAAFEESMRLYPPAPSLNRTALQPDQVGDLKIPAGATVLVMPWLIHRHEMLWDRPDHFIPERFMPDRREAIDRYQYLPFGVGPRVCIGASFALQEAVIALAILMRSLRFDYTGAKQPSVVQRITVQPENGLPMSVRRR

SEQ ID NO: 54485 - protein, 180 aa, Oryza officinalis
FGGVYRGVVDGDTKVAIKRSNPSSEQGVLEFQTEIEMLSKLRHKHLVSLIGCCEDEGEMILVYDYMAHGTLREHLYKGGKPALSWKQRLEITIGAARGLHYLHTGAKYTIIHRDVKTTNILVDEKWVAKVSDFGLSKTGPTAMNQTHVSTMVKGSFGYLDPEYFRRQQLTEKSDIYSYGI

SEQ ID NO: 54486 - protein, 633 aa, Neisseria meningitidis Z2491
MTTPKKTAKTSGNEARELADLSEDIGIRFKYPNSERVYLQGSRDDIRVPLREIRQDDTYTAQGAEANPPIPVYDTSGVYGDPAAHIDLKQGLPHIRTVWLDERGDTEILPKLSSEYGIERAHDPKTAHLRFNQITRPRRAKAGRNVTQLHYARQGIITPEMEFVAIRERLKLDELSQKPEYAKLLKQHAGQSFGANIPTHPDQITPEFVRREIAAGRAIIPANINHPELEPMIIGRNFRVKINGNLGNSAVTSSLTEEVEKMVWSLRWGADTIMDLSTGAHIHETREWIIRNAPVPIGTVPIYQALEKTGGIAEDLTWDLFRDTLIEQAEQGVDYFTIHAGVLLRYVPMTANRLTGIVSRGGSIMAKWCLAHHRENFLYTHFDEICEIMKAYDVSFSLGDGLRPGCIADANDESQFAELHTLGELTDKAWKHDVQVMIEGPGHVPLQRVKENMTEELQHCFEAPFYTLGPLVTDIAPGYDHITSGIGAANIGWYGTAMLCYVTPKEHLGLPDKEDVRTGIITYKLAAHAADLAKGWPGAQLRDNALSKARFEFRWRDQFRLSLDPERAESFHDETLPAEGAKIAHFCSMCGPKFCSMKITQEVRDYADKQKAQRQGMEEKAVEFVKKGAKIYS

SEQ ID NO: 54487 - protein, 135 aa, Desulfotalea psychrophila LSv54
MNSKNQYGVIPYIKTKKSLKIFLITSRTNGYWILPKGHLVKKKSCIESAAQEAFEEAGIIGCIEGKKSYLIKYQHHGTKYKIQFFPMEVTEILKKWPEQHQRIRKLVSLNRAHELIELGSIQKCLRQWQDDLSRK

SEQ ID NO: 54488 - protein, 396 aa, Arabidopsis thaliana
MQFQLSKPANNKQRRNMETQGKVITCKAAVAWGAGEPLVMEDVKVDPPQRLEVRIRILFTSICHTDLSAWKGENEAQRAYPRILGHEAAGIVESVGEGVEEMMAGDHVLPIFTGECGDCRVCKRDGANLCERFRVDPMKKVMVTDGKTRFFTSKDNKPIYHFLNTSTFSEYTVIDSACVLKVDPLFPLEKISLLSCGVSTGVGAAWNVADIQPASTVAIFGLGAVGLAVAEGARARGASKIIGIDINPDKFQLGREAGISEFINPKESDKAVHERVMEITEGGVEYSFECAGSIEALREAFLSTNSGVGVTVMLGVHASPQLLPIHPMELFQGRSITASVFGGFKPKTQLPFFITQCLQGLLNLDLFISHQLPFHDINEAMQLLHQGKALRCLLHL

SEQ ID NO: 54489 - protein, 236 aa, Oryza sativa (japonica cultivar-group)
MGMGTFTTDESDKHEESYLSLGLTVSQSKKNNTEYPKVLLLLAAYLDRSVQKNEDLLDSNKIKDSSTIFHGHRAPDLSIKLYAERIFKYSECSPSCFVLALIYMERYLQQPHVYMTSLSVHRLLITSVVVAAKFTDDAFFNNAFYARVGGISTVEMNRLELDLLFNLDFRLKVDLETFGSYCLQLEKETMVLVIDRPIQQVHGVNSTKDLSRNSSIDESCKSELMRYSSQALQGCS

SEQ ID NO: 54490 - protein, 515 aa, Candida albicans
MLEEISFESWYLYLIICGVLYFCTNYLYIQYLNKKLGAKSPGSCKSDGCFGFRSGFEMLKAKKIGRQVDLLHERFNDLSNPEVNDTFTSYNFGFPMIITKDPENIKALLATQFNDFSLGRRYDFFKPLLGKGIFTLDGEGWKHSRSMLRPQFAREQIAHVKALEPHFQLLKKHITKNKGQFFDIQELFFRFTVDSATEFLFGESVSSLKDESIGYNQDEFDFAGRKDFPEAFNKSQIYLSTRSLLQNLYWLVNPKDFQNCNAIVHKFSDYYVNKALNATPEELEKNSGYVFLYELVKQTRDPQVLRDQALNILLAGRDTTAGLLSFAVFELARNPQVWKKLREEIIERYADGVTEISFETLKQCEYLKAVINETLRLYPSVPRNGRFANKNTTLPRGGGPDGMSTILIKQGQAVMYSIYSTQRDPKYYGKDADVFRPERWFEPETRKLGWAFLPFNGGPRICLGQQFALTEASYVLVRLAQCCENLQLTEGIEYPPAKLTHLTMCMFDGVPIKVD

SEQ ID NO: 54491 - protein, 506 aa, Ehrlichia ruminantium str. Welgevonden
MRNIYVTTPIYYVNDVPHIGHVYTTLISDIIARFKRLDGYNVKFITGTDEHGQKIEKAAAKANKSLVEFTDHASAIFQHLAGVMNFSHDDFIRTTEIRHKKAVTGLWRRLYNYGKIYLGNYAGWYAVRDETFYQEKELIDGKAPTGAEVEWVEEPSYFFRLSHFQERLLDFYDKHPNFIIPKHRYNEVISFVKSGLKDISISRQNISWGISVPEDDNHIIYVWIDALTNYLTTLGFPEINSSEYKNYWVDENSTVVHVVGKDILRFHAVYWPAILMAAELPLPKQILAHGWWTNEGQKISKSLGNVINPFELIEEFGVDQVRYFLIKEMPVGNDGDYKRSSIINCINCDLANNIGNLVQRTVSLLHKECRGTIPNVASSLFQDEDALPNYQEILENVRICINQYNLNGMIHIVEELSSIANEYIAFRAPWKLSKTDPIVMQAVLYKLLEYIRCVGLLLQPIMPYLSSKILDQIALSEYKRSFNNFAVPIDTGIILPKPEPIFTKII

SEQ ID NO: 54492 - protein, 753 aa, Fulvimarina pelagi HTCC2506
MTIHITPNTKASHQRGAVRPAWRVREGRPYPLGATWDGLGVNFAIFSAHATKVELCIFSPDGKTEIERIELPEYTDEIYHGYLPEARPGLIYGYRVHGPYEPDVGHRFNPNKLLIDPYAKQLRGEVKWDHALFGYTIGHKDEDLSYDERDSAPFMPRCVVVDPAFTWGEERKPNVPWDRTIFYETHVKGFTQRHPSVTDFDRGKFAGLMNRDVVNYIRSLGVTSVEFLPIHALVDDSYLVDQGLRNYWGYNTIGFFAPDPRYLASPIVNEFKELVATYHNAGLEVILDVVYNHTAEGNEKGPTLSFKGIDNAAYYRLLPNQPRYYINDTGTGNTVNTSHPRVMQMVTDSLRYWAGEMRVDGFRFDLATILAREPSGFSQESSFLHACMQDPLLSQVKLIAEPWDCGPGGYQVGRFPPGWAEWNDTYRDIVRAYWRGDEGFIPKLAGKLSASADLFDSRGRKPWASVNFITAHDGFTLKDLVTYNEKHNEANGENNQDGHDHNLSYNYGVEGETDDEEIKDIRLRQMRNFFATLLFSRGTPMILAGDEFARSQGGNNNAYAQDNKIGWIDWNAPEESRQLARFVQQLIRLRQSLPILRRGTFLHGTYDDELGVKDVAWIRPDGEEFEDDDWEDPAAKCFGVLLDGRAQSTGIRRLGTDATMLLVMNSHDDVVNFKLPEAAGGLRWQRVFDTNTPDEFEFEPLDFGHDYMVTGRSFLMFLVEPDRNEEGQEEAIRSFAYIREALAKAAGDPLPLR

SEQ ID NO: 54493 - protein, 514 aa, Vibrio fischeri ES114
MYNLANNLERNATFRPNNIALIFQEQKITYQELNQKVNAIADHLHQLNIKPNEKIALSCPNTPEFVIAYYAIQKIGAVVVPLNVMLKGEEVAYHLKDSDAVALISYQGSDAMPIGQFGYEGYTKADFCEHFILIETAPVSKKPAEAHSFNQWLETGRKTFETVYRSAEDSCVILYTSGTTGAAKGAELSQSNMLCNAQACQALTNQKGTDVSIAILPLFHTFGQSLIMNTSILAGSALVLISRFVPKTVVQQIHEHKVTHLAGVPTMFIGLLAYAEKHPGAYLKEIAQTLKVAISGGASMPVEVLKQFEEKLQVPVIEGYGLSESSPVAAFNHLEFERKPGSIGQPLPGVTMKVVDKNGHEVPTGQEGELVIRGHNVMKGYYKKPQETAKTIINGWLHTGDIVRFDDEGYIYVVDRLKELIISGGYNIYPREVEEVYMSHPSVHLVAVIGVEHPRFGEEVKAFVILKEGHSISEKELIKWSRQHLADYKCPKHLDIVEALPMTATGKILKRMLK

SEQ ID NO: 54494 - protein, 379 aa, Cucumis melo
MSTAGQVIKCKAAVAREAGKPLVIEKVEVAPPQANEVRLKILFTSLCHTDVYFWEAKGQTPLFPRIFGHKAGGIVESVGEGVKDLQPGDHVLPIFTGECGDCSHCQSEESNMCDLLRINTDRGVMINDGKTRFSKNGQPIHHFVGTSTFSEYTVVHVGCLAKINPAAPLDKVCVLSCGISTGLGATLNVAKPKKGQSVAIFGLGVVGLAAAEGARIAGASRIIGVDLNPARFEEAKKFGCNEFVNPKDHNKPVQEVIAEMTNGGVDRSVECTGSIQAMIAAFECVHDGWGVAVLVGVPNKDDAFKTHPMNFLNERTLKGTFFGNYKPRTDIPGVVEKYLSKELELEKFITHTVSFSEINKAFDYMLKGESIRCIIRMDN

SEQ ID NO: 54495 - protein, 263 aa, Synechococcus elongatus PCC 7942
MGEVRRHLKLVNGLARSEQSAVRRIIIAGNWKMYKTQAEALEFLQAFLPQLSETPESRKVVLCAPFTTLSSLSKTLHGSRVRVGAQNIHWAKEGAFTGEISGAMLTEIGVRYVVVGHSERRQYFGETDETVNQRLLAAQSFGLLPILCVGESKQQRDAGETEAVISRQLERGLVGADQTNLVIAYEPIWAIGTGDTCAAEEANRVIGLIRSQLKDTDVPIQYGGSVKPENIDEIMAQPEIDGALVGGASLEAESFARIVNYQS

SEQ ID NO: 54496 - protein, 308 aa, Escherichia coli
MLELQEASRLPERLGDDFVRAANIILHCEGKVVVSGIGKSGHIGKKIAATLASTGTPAFFVHPAEALHGDLGMIESRDVMLFISYSGGAKELDLIIPRLEDKSIALLAMTGKPTSPLGLAAKAVLDISVEREACPMHLAPTSSTVNTLMMGDALAMAVMQARGFNEEDFARSHPAGALGARLLNKVHHLMRRDDAIPQVALTASVMDAMLELSRTGLGLVAVCDAQQQVQGVFTDGDLRRWLVGGGALTTPVNEAMTVGGTTLQSQSRAIDAKEILMKRKITAAPVVDENGKLTGAINLQDFYQAGII

SEQ ID NO: 54497 - protein, 177 aa, Echinochloa crus-galli var. formosensis
YYEAGARLAKWRAVLNIGPNEPSQLAIDQNAQGLARYAIICQENGLVPIVEPEILVDGPHDIERCAYVTEKVLAACYKALNEHHVLLEGSLLKPNMVTPGSDAKKVANEVIAEYTVRALQRTVPAAVPAIVFLSGGQSEEEATLNLNAMNKLNTKKPWSLSFSFGRALQASTLKAWS

SEQ ID NO: 54498 - protein, 266 aa, Cucumis melo
MEGATKNVLLSSGGDEISKNLALHLARRGCRLVLIGNECVLQSMSKMIAESLKGVLPIEVVGLDMEEEREAAFDEAVNRACSVLGTLDAFVHAYSYEGPIQDALQLSEEEFKKIVKINLMASWFLMKAVCRRMRDQKSGGSVIFLTTLIGAERGLYPGGAAYGSCSAGLQQLARTSALDVGKYKIRVNAIARGLHLDNGYPVSVGKERAKKLVKDAAKLERWLDVKDDLASTVIYLISDGSRYMTGTTIFVDGAQSLVRPRMRSYM

SEQ ID NO: 54499 - protein, 425 aa, Nitrosomonas europaea ATCC 19718
MRIAIIGSGCSGLTAIKNLLDAGLKEIICFEKSDQIGGNWVYTAAPSHSSVSEATHIISSKALSQFSDFPMPDDYPDYPSHQQILAYFQAYTRHFHLDHYIRFNTAVLRAEKIEKERWCLHLDDGTQAEFDYLLVANGHHSVPRHPDWKECFTGKYLHAHEYKTNQGLEGKRILVVGAGNSGCDCAVEASRVAARVDISLRSPQYIIPKFIMGRPTDTFAATFHWLPQSVQDGLQRISLRLQIGRYHDYALPEPDFSPTRAHPTINSALFDKIRHGKVHPRPGIQKVSGQTVYFADNATAQYDVLIAATGYKISFPFFDRDFLDWEEAAHIPLFLRIFHPDHPSLFFVGLIQPQGCIWPLAEIQARLIGQLLTNKIQLPLNWRKLALSEGRNRAQQFIARPRHSIEVHYYPYLKQLQRMIQGQIK

SEQ ID NO: 54500 - protein, 159 aa, Glycine max
MSSIRFLWILMVSLTASCALSQPQKLSAYDVLMEYGFPVGLLPKGAIGYSLNRDSGEFAVYFQGACSFDIESYTLKYKSTITGVISKGRLYNLKGVTVKILLLWLNIVEVSRQGNDIYFSVGIASADFGVENFLESPQCGCGFDCKTLPLNGDVSVSSI

SEQ ID NO: 54501 - protein, 452 aa, Pseudomonas fluorescens Pf-5
MSDSSKQCVPDAPAIQRLPFLQLILVGLQHVLLMYGGAIAVPLIIGQAAGLSREEIAFLINADLLVAGIATIVQSMGIGPMGIRMPVMMGASFAAVGSMVAMAGMPGIGMQGIFGATIAAGFFGMLIAPFMSKVVRFFPPLVTGTVITSIGLSLFPVAVNWAGGGSSAAQFGSPIYLTIAALVLGTILLIHRFMRGFWVNISVLIGMGLGYILCGLIGMVDLSGMAQAPWLQVVTPLHFGMPQFHLAPILSMCLVVVIIFVESTGMFLALGKITGQEVTPRMLRRGLLCDAGASFFAGFLNTFTHSSFAQNIGLVQMTGVRCRSVTMVAGGLLIVLSLLPKAAFLVASIPPAVLGGAAIAMFGMVAATGIKILQEADIADRRNQLLVAVSIGMGLIPVVRPEFFAHLPLWMSPITHSGIAMATLSALVLNLLFNILGGSERAASNAQHAHQH

SEQ ID NO: 54502 - protein, 210 aa, Mycobacterium tuberculosis CDC1551
MFGVSGTGDTSGYGRLVRQVVLPGSSPRPYGGYFDDIVDRLAEALRHERVEFEDAVEKVVVYRDELTLHVRRDLLPRVAQRLRDEPELRFELCLGVSGVHYPHETGRELHAVYPLQSITHNRRLRLEVSAPDSDPHIPSLFAIYPTNDWHERETYDFFGIIFDGHPALTRIEMPDDWQGHPQRKDYPLGGIPVEYKGAQIPPPDERRGYN

SEQ ID NO: 54503 - protein, 398 aa, Mycobacterium tuberculosis CDC1551
MGPQHPSTHGVLRLILEIEGETVVEARCGIGYLHTGIEKNLEYRYWTQGVTFVTRMDYLSPFFNETAYCLGVEKLLGITDEIPERVNVIRVLMMELNRISSHLVALATGGMELGAMTPMFVGFRAREIVLTLFEKITGLRMNSAYIRPGGVAQDLPPNAATEIAEALKQLRQPLREMGELLNENAIWKARTQGVGYLDLTGCMALGITGPILRSTGLPHDLRKSEPYCGYQHYEFDVITDDSCDAYGRYMIRVKEMWESMKIVEQCLDKLRPGPTMISDRKLAWPADLQVGPDGLGNSPKHIAKIMGSSMEALIHHFKLVTEGIRVPAGQVYVAVESPRGELGVHMVSDGGTRPYRVHYRDPSFTNLQSVAAMCEGGMVADLIAAVASIDPVMGGVDR

SEQ ID NO: 54504 - protein, 884 aa, Oryza sativa (japonica cultivar-group)
MKRVSSHVSIASEAEINLDLSRLLIDKPRLTLERKRSFDEQSWSELSHRQNDGFDSIMHSPAFPSGFDSPFSLGTLGDPHPLVNEAWEALRKSVVYFRGQPVGTIAAVDHASEEVLNYDQVFVRDFFPSALAFLMNNETDIVKNFLLKTLHLQSSEKMVDRFKLGAGAMPASFKVDRNRNRNTETLVADFGESAIGRVAPVDSGFWWIILLRAYTKYTADTSLAESPECQNCMRLILNLCLSEGFDTFPTLLCTDGCSMIDRRMGIYGYPIEIQALFYMALRCALQMLKPDGEGKDFIEKIGQRLHALTYHMRNYFWLDFPHLNNIYRYKTEEYSHTAVNKFNVIPDSIPDWVFDFMPCRGGYFLGNVSPAMMDFRWFALGNCIAIISSLATPEQSVAIMDLIEERWEELVGEMPLKICYPAIENHEWRIITGCDPKNTRWSYHNGGSWPVLLWLLTAACIKTGRPQMAKRAIELAESRLLKDGWPEYYDGKLGRFIGKQARKFQTWSIAGYLVARMMLEDPSTLMMISMEEDRPVKPTMRRQDHRGGLPLLVRPSRPRLPPPRVATGGVGAKLPLLTVRRLRIRSSSLPALDVRRRCPRRLRAPRDALPEGRVPTIRDRLLLLQCRRRRRGPTTAAAVVVALPTYQGTNTKPPRLRGGSTGLLVRRCGDDDDDELVVAALLTEEYRRRDTLEGAELVVLRSGEWSATPIAPIVHDDGKGEELSYWETDMAVPVGDRLLCYVDLYRGVILCGDDLFDEIPPRLQYVSLPVEAPAGAFDEEHFDRQGDNYRRCLLNTRTVVCAIDGGGAALKFVDISSRCCCGSLGKHTTCDRSSRAFVIRTWTLRIDGDGDDDMAWTMDAMIDAAELGPSTPTPPSHGAFHYTP

SEQ ID NO: 54505 - protein, 782 aa, Streptomyces coelicolor A3(2)
MGRTTRRGAAAGTPCALLPDVVPRAVGGRQVSSAAEREAVPGERAAADGRPAVVVNGARRAAPPPAVPARPGTPVPLGARFRTGPDQVAGTNFALWAGGAEAVELCLFDGPGPGARESRVRLTELTHEIWHGFVPGVRPGQRYGYRVHGRWDPWTGARWNPAKLLLDPYARAVDGDFGLPPEVYGHVRDWPEQRVADTVRDDRDSAPHVPKGVVVHDDDDWSDDRRPKTPWADSVIYELHVRGFTKLHPEIPPELRGTYAGLAHPAAIAHLTRLGVTAVELLPVHQFAHESHLLERGLRNYWGYNSVGYFAPHAGYTASGTTGEQVGEFKRMVRALHAAGIEVILDVVYNHTAEAGELGPTLSLKGIDNRGYYRLQPDARRYADYTGCGNTLHVVQPHVLRLITDSLRYWVTEMGVDGFRFDLAAALARSMHDVDMLSPFLAVIAQDPVLRRVKLIAEPWDVGSGGYQVGAFPPLWTEWNDRYRNAVRDFWRHALPDVREMGYRLSGSSDLYAWGGRRPYASVNFVTAHDGFTLRDLVSYERKHNEANGEGNRDGTDDNRSWNCGTEGETDDAQVRALRRRQLRNLLTTLLLSTGVPMLVAGDEMGRTQRGSNNAYCQDNETGWVDWSLRDDPEWAPLFALASRLIGLRHRHPVLRRRAFFSGRAHSADGLRDLAWFTAGGTEMTERDWYAPAATLGMYLSGRDIPGRDEHGDPVVDDSFLAVLHAGGEPAGFVLPGAPWAERYEVVVDTGQEEQGEAPGTAHPAGAEITVPARTVLLLRAG

SEQ ID NO: 54506 - protein, 509 aa, Arabidopsis thaliana
FRGASSLFLNLISLSLSLSLSLSLSLSLSLSLSLSRIAINEIRKMSRLLQTPFLPSVSLPTKTRSSVTGFRVKPRIIPIQAKIREIFMPALSSTMTEGKIVSWVKSEGDKLNKGESVVVVESDKADMDVETFYDGYLAAIMVEEGGVAPVGSAIALLAETEDEIADAKAKASGGGGGGDSKAPPASPPTAAVEAPVSVEKKVAAAPVSIKAVAASAVHPASEGGKRIVASPYAKKLAKELKVELAGLVGSGPMGRIVAKDVEAVAAGGGVQAAVAVKEVVAAPGVELGSVVPFTTMQGAVSRNMVESLGVPTFRVGYTISTDALDALYKKIKSKGVTMTALLAKATALALAKHPVVNSSCRDGNSFVYNSSINVAVAVAIDGGLITPVLQNADKVDIYSLSRKWKELVDKARAKQLQPQEYNTGTFTLSNLGMFGVDRFDAILPPGTGAIMAVGASQPSVVATKDGRIGMKNQMQVNVTADHRVIYGADLAQFLQTLASIIEDPKDLTF

SEQ ID NO: 54507 - protein, 289 aa, Listeria monocytogenes
MKVLVNNHLVEREDATVDIEDRGYQFGDGVYEVVRLYNGKFFTYNEHIDRLYASAAKIDLVIPYSKEELRELLEKLVAENNINTGNVYLQVTRGVQNPRNHVIPDDFPLEGVLTAAAREVPRNERQFVEGGTAITEEDVRWLRCDIKSLNLLGNILAKNKAHQQNALEAILHRGEQVTECSASNVSIIKDGVLWTHAADNLILNGITRQVIIDVAKKNGIPVKEADFTLTDLREADEVFISSTTIEITPITHIDGVQVADGKRGPITAQLHQYFVEEITRACGELEFAK

SEQ ID NO: 54508 - protein, 638 aa, Oryza sativa (japonica cultivar-group)
MGYHQPVHGGAAAGAGGSGGGGGGDHLHQHHHPRLHSPRISGGGSMTRRANSFKRGEIELQIGSPRSPRGDGVGSPLAESSSASEASAGGGGAVHHHHHQSQQQQLRFRLFKRPGSGAGEVVLGLGIRERRRIGNLLFLAFCGVCLLLGVAKIWAGGWFALPGDDKDADLQDLSISFSSDGGYQFDSHFGHVGGKESDRMLMTVGSEDSVPEAPDVWSQPSSGKFRQCIISNSHKKEDSHTNGYILINANGGLNQMRFGICDMVAVAKILKATLVLPSLDHTSFWADDSEFKDLFNWRHFIESLKEDIDIVEMLPPAYKHIEPVAKAPISWSKVNYYRDEILPLLKKHKVIYFTHTDSRLANNGLPSYIQKLRCRVNYRSLKYSQTIEDLGATLVSRMHQDGSPYLALHLRFEKDMLAFTGCSHSLTSEEEEELRKMRYEVSHWKEKEINGTERRSMGGCPLTPRETSFLLKGLGFTRSTRIYLVAGEAFGNGSMQALMDDFPNIYSHSTLATKEELEPFRNHQNMLAGLDYIVALQSDVFLYTYDGNMAKAVQGHRRFENFRKTINPDRMSFVNLIDEYDEGRMSWDDFSSEVKRIHRDGERIGAPYLREPGEFPKLEESFFANPLPGCICEKLNDE

SEQ ID NO: 54509 - protein, 458 aa, Oryza sativa
MASSNSTSSARRRAARAPPPPNLGDLSGVSAPLPSNGLHAPSISTHPTNAATPNPSPPGASIVVVVRPAMQPASPVSGDAGPVAEAVPPRGAPQVLVRRRSVPFSPDSPLAPGSRGGGERRSTFREDVSHAAAETYLVTRLAFILLRYLGVGYRWISQLAALIIYAILLMPGFIRVGYYYFFSRQVLRSVIYGDQPRNRLDLYIPRDPKKPSPVVAFVTGGAWIIGNFPQGTISDMVSDASDGISFVCETVGAYGGDPNQIYLMGQSAGAHIAACALLEQAAKESRGEQISWSVTQIKAYFGLSGGYNIENLVDHFHERGLYRSIFLSIMEGKKSLPHFSPETVAKKLCPETIALLPQIVLLHGTDDYSIPFSASETFAGVLKQAGAKAKLLLYEGKTHTDVFLQDPLRGGRDKLVEDVISVIHADDADAREKDALAPIPGRLVSEWQIKLAHRISPF

SEQ ID NO: 54510 - protein, 455 aa, Arabidopsis thaliana
MSSSYASSCTKLISLTKQLSSYANQGNHEQALNLFLQMHSSFALPLDAHVFSLALKSCAAAFRPVLGGSVHAHSVKSNFLSNPFVGCALLDMYGKCLSVSHARKLFDEIPQRNAVVWNAMISHYTHCGKVKEAVELYEAMDVMPNESSFNAIIKGLVGTEDGSYRAIEFYRKMIEFRFKPNLITLLALVSACSAIGAFRLIKEIHSYAFRNLIEPHPQLKSGLVEAYGRCGSIVYVQLVFDSMEDRDVVAWSSLISAYALHGDAESALKTFQEMELAKVTPDDIAFLNVLKACSHAGLADEALVYFKRMQGDYGLRASKDHYSCLVDVLSRVGRFEEAYKVIQAMPEKPTAKTWGALLGACRNYGEIELAEIAARELLMVEPENPANYVLLGKIYMSVGRQEEAERLRLKMKESGVKVSPGGSRGKLKARVLEEVSPKAPARLFLAFVLQICRIP

SEQ ID NO: 54511 - protein, 388 aa, Vibrio fischeri ES114
MSERKPATIAVRTGIETDSQHNAVVPPIYLSTNYSFPEFGDVPKYDYARSGNPTRTQLETTLSDLEGGAGAVVTNCGTSALNLMVSALLGPDDLIVAPHDCYGGTYRLFNTRANKGDFQTLFVDQSNTEALDAAIAKKPKLILLETPSNPLVRVVDIAEICQKAAQVGALVAVDNTFLSPVLQQPLSLGADFVIHSTTKYINGHSDVVGGVLIAKTKAHADDLAWWGNCIGATGTAFDSYLTLRGIRTLGARMRVHEENAIEVLKCLQEQPLVGTIYHPSLPEHPGHEIAKRQQVGFGAMLSFELNGSLEQLKVFVKELKYFSLAESLGGVESLIAHPGTMTHRAMSDEAQEEAGLAPTLLRLSVGLEDSRDLIADLQQAFAIAAEVK

SEQ ID NO: 54512 - protein, 410 aa, Symbiobacterium thermophilum IAM 14863
MAGSTGTLSPTKRFVLGLQHVAAMFGATVLVPIQTGLNPSVALLTAGLGTLLFHLVTKGRVPVFLGSSFAFIAAIQLVGQTEGLEYAAGGIVAAGLVYLVLSGLIYLFGVDRIRSFFPPIVAGPMIMVIGLTLAPVAVDMASSHWLVALITLLTVVLVSVYARGFLKLLPIICGLLVGFAASAAFGLVDWAAVAQASWVAVPPVTAPKFSLSAILAIAPLALVTMVEHIGDITTNGAVIGKDLIRDPGLHRTLMGDGLATALAGLLGGPANTTYSENTGVLAVTRVYDPGILRIAAVVAIALSFVGKLGALLQAIPTPVMGGISIVLFGMITSIGIRQVVDARVDLTNGRNLVIAAVVLVLGIGGAALPLPGGLQLGGMALAALVGVVLNKLLPEQVVRETEPALTGGDD

SEQ ID NO: 54513 - protein, 511 aa, Synechococcus elongatus PCC 7942
MAALSLADRVVVTAEQMQAIESRLFAAGMPVAALMEKVAGLLSQRLQMAYPDRTQRWGIWVGPGHNGGDALVVARELHLQGYPVQIWHPFERRKPLTEAHLQFAQHLGISIACDYPEHCDRWLDGGFGFGLNRPLNEATQTAIAQLNDSGKPILSIDLPSGLDTDSGEPLGAAIRAERTYCLGLWKQGLLQLVAAPWHGELERVDFGIAEADIVAVLGAVPDRQILTDEAAIAALPLPIAADAHKYRRGQLLLIAGSQRYRGAALLAALAARSSGVGMMTLAVPASLSAIAIAQVPEALVVACPETETGEIAELPIDCDRYNAIAIGPGVGTGPTIRTILHRVLQQSTPFLIDADALTVLAQHPEDWALRPAEARTVITPHAGEFQRLFGSAPTPASLSSAASERSLILVRKGPSPTVVTPVGASWALVDSTPALARGGSGDVLTGLLGGLLAQTDAVSAAIAATWWHSRTAQAIAQKQTALGVTPTELAAQLTPWLGQRLQSEIAQYLAS

SEQ ID NO: 54514 - protein, 415 aa, Vibrio fischeri ES114
MSEEFRKQALDYHAYPTPGKIEVALTKPADTVEDLALAYSPGVAEPVREIAKNPDDVYKYTSKGNMVAVISNGTAILGLGNLGPLASKPVMEGKSLLFKRFAGLDSIDIEVKHRTIDEFVDTVANIADTFGGINLEDIKAPDCFEIERRLIEICDVPVFHDDQHGTAIVTAAGMLNAIELQGKKLEDAIIVCLGAGAAAVACMELLIKCGAMREKIYMLDRKGVIHTRRDDINEYKQRFANNTDKRTLQDVIEGADLFLGVSGPNLLDAEDLKLMADKPVVFACSNPDPEIKPELAHEVRSDLIMGTGRSDYPNQVNNVLCFPFIFRGALDVRASEINDEMKLAAVEAIRQLAKEEVPVEVLKAAGVESLTFGSDYIIPKPMDPRLLPRVAKAVAQAAVDSGVARIEMPKGYMEA

SEQ ID NO: 54515 - protein, 156 aa, Capsicum annuum
MAARAHDVAALALRGRSACLNFADSTWRLPIPASSNSKDIQKAAAEAVESFRPSESEGVSGESADSSSPQTPESVFFMNEEVPESRFFMDEEALFFMPGLLANMAEGLTLPPPQCGEFGDHVEVDSYMPLWNYSVLSFVIYITLGAVFLLSTFLNY

SEQ ID NO: 54516 - protein, 614 aa, Symbiobacterium thermophilum IAM 14863
MCGIAGWADWKRDLSREGPVLETMIAPLADRGPDAGGIWCSGHCAFGHRRLAVVDLVGGAQPMVRSRGDRTYVLVYNGQLYNTQELKEELTARGHAFSTQSDTEVLLVAYMEWGPECTRRLNGIYAFAVWDEAGQQLFLARDRFGVKPLFYKTMGSAILFGSELKALLAHPLVQPEVDAEGLAEVLYLGPSRTPGHGVFRGVREVLPGHWLLFDRAGVRTQPYWQLESRPHTDGPAETAERVRELLREAVRRQLVADVPVATLLSGGLDSSAITAFAAEAFRAQGRGPLHTWSIDYAENDRHFRAHAFQPDPDSAYAGTMAESLGTVHHEVVIDTPQLVDALEKAALIRDLPGMADVDAALFLFCREIKKGATVVLSGECADEVFGGYPWFHRPGPETGRTFPWIRSLEARTALLQPGVTGPIRAEDYVAQRYSNTVARVPRLPGEEPEEARIRELFYLNLAWFMATLLDRNDRMSMAVGLEARVPFCDHLLVEYVWNIPWRLKTYGGREKGILREALRGVLPEAVRTRRKSPFPKTHHPEYFRAVRDRVLALLDDPACRLHKIVRADRVRALARQDHEATDLPWFGQLMSGPQYFAWLIQLEAWLRHYKVVLV

SEQ ID NO: 54517 - protein, 208 aa, Oryza sativa
  misc_feature (160)..(160): Xaa can be any naturally occurring amino acid
  misc_feature (190)..(190): Xaa can be any naturally occurring amino acid
  misc_feature (197)..(197): Xaa can be any naturally occurring amino acid
  unsure (1)..(208): unsure at all Xaa locations
MGKKRKHSETTQAVAQPKKEEAAPERPARTLLGWKDKNQVEDDSPIFRNKEKLLVTCSRRINYRYRHLMLNLVTLLPHCKKDNKVESKETKGATLNELVELKNCSSCLFFECRKHKDLYLWMAKCPNGPSVKFLVSAVHTMEELKLTGNHLQGSRPILTXSANFEKDAHWKLLKEMLLQIFETPKDHRKXKPFHDHXVFVFSISDDHI

SEQ ID NO: 54518 - protein, 459 aa, Rhizopus stolonifer
MSTLDRQSIFTIKELESISQRIHDGDEEAMKFIIIDKKVYDVTEFIEDHPGGAQVLLTHVGKDASDVFHAMHPESAYEVLNNYFVGDVQETVVTEKSSSAQFAVEMRQLRDQLKKEGYFHSSKLFYAYKVLSTLAICIAGLSPLYAYGRTSTLAVVASAITVGIFWQQCGWLAHDFGHHQCFEDRTWNDVLVVFLGNFCQGFSLSWWKNKHNTHHASTNVHGQDPDIDTAPVLLWDEYASAAYYASLDQEPTMVSRFLAEQVLPHQTRYFFFILAFARLSWALQSLSYSFKKESINKSRQLNLFERVCIVGHWALSAFCIYSWCSNVYHMVLFFLVSQATTGYTLALVFALNHNGMPVITEEKAESMEFFEIQVITGRDVTLSPLGDWFMGGLNYQIEHHVFPNMPRHNLPTVKPMVKSLCQKYDINYHDTGFLKGTLEVLQTLDITSKLSLQLSKKSF

SEQ ID NO: 54519 - protein, 180 aa, Arabidopsis thaliana
MYPIERLIYLLSSNQCLFLGRFNTSSALEISASKEIHDYLKTICPDLHIVRGEFDEDARYPENKTLTIGQFKLGLCHGHQVIPWGDLDSLAMLQRQLGVDILVTGHTHQFTAYKHEGGVVINPGSATGAYSSINQDVNPSFVLMDIDGFRAVVYVYELIDGEVKVDKIEFKKPPTTSSGP

SEQ ID NO: 54520 - protein, 405 aa, Zea mays
MELCTCVARSSAPPSSSCRAVPFPRVLSHRIWSRSGYCTVCFTPSSPVARSRFSTLMTTAHNTGTPDLVDFNWDDLGFQLIPTDFMYLMSCSSDGVFMNGKLVPYGSIELNPAAAVLNYGQGLLEGLRAHRKEDGSILLFRPHENARRMEIGADRLCMPAPSVEQFLEAVKLTVLANKHWVPPFGKGSLYIRPQLIGSGAILGVAPAPQYTFIVFVCPVGHYFKGGLAPISLLTEEEYHRAAPGGTGEIKTIGNYASVVSAQRRAKEKGHSDVLYLDPVHNKFVEEVSSCNIFMVKGNIISTPLLTGTILPGITRRSVIEISQNLGFQVEERLITIDELLGADEVFCTGTAVVLSPVGSITYRGRRVEYGKNQEAGVVSQQLYAALTAIQKGLTEDSMGWTLQLT

SEQ ID NO: 54521 - protein, 316 aa, Pisum sativum
MWPFSSKKGVSGFSGSSTAEQVTHGIDATGLTAIVTGASSGIGAETTRVLALRGAHVIMGVRNMVAAKDVKDTILKDIPSAKVDAIELDLSSLDSVKKFASEFNSSGRPLNILINNAGIMACPFKLSKDNIELQFATNHIGHFLLTNLLLDTMKKTTRESKKEGRIVNVASEAHRFAYPEGIRFDKINDQSSYNNWRAYGQSKLANVLHANQLTKHLKEDGVNITANSLHPGTIVTNLFRHNSAVNGLINVIGKLVLKNVQQGAATTCYVALHPQVKGVSGEYFSDSNVYKTTPHGKDVDLAKKLWDFSINLVKQK

SEQ ID NO: 54522 - protein, 468 aa, Gibberella zeae PH-1
MATLRLASRGVKSLCMRPATFAARPFSTTCLRRNAAPVETVGTRLVPVDEDFSSAQDSYGLSKPHTPGTRKSRENSVSDRKVRHYTVNFGPQHPAAHGVLRLILELNGEEIVRADPHVGLLHRGTEKLIEYKTYLQALPYFDRLDYVSMMTNEQCFSLAVEKLLNVEIPERAKWIRTLFGEITRILNHLMSVLSHAMDVGALTPFLWGFEEREKLMEFYERVSGARLHAAYVRPGGVHQDIPVGLLDDIYQWATQFGDRIDETEEMLTDNRIWIERLRGVGVVPAAEALNLSFTGVMLRGSGVPFDVRKNQPYDAYDQVEFDVPVGTNGDCYDRYLCRMEEFRQSLRIIHQCLNKMPAGPVRVEDYKVSPPPRAAMKENMEALIHHFLLYTKGYAVPPGETYSAIEAPKGEMGVYVVSDGSERPYRCHIRAPGFAHLGGFDHVSKGHLLADAVAVIGTMDLVFGEVDR

SEQ ID NO: 54523 - protein, 366 aa, Saccharomyces cerevisiae
MFSRLPTSLARNVARRAPTSFVRPSAAAAALRFSSTKTMTVREALNSAMAEELDRDDDVFLIGEEVAQYNGAYKVSKGLLDRFGERRVVDTPITEYGFTGLAVGAALKGLKPIVEFMSFNFSMQAIDHVVNSAAKTHYMSGGTQKCQMVFRGPNGAAVGLGAQHSQDFSPWYGSIPGLKVLVPYSAEDARGLLKAAIRDPNPVVFLENELLYGESFEISEEALSPEFTLPYKAKIEREGTDISIVTYTRNVQFSLEAAEILQKKYGVSAEVINLRSIRPLDTEAIIKTVKKTNHLITVESTFPSFGVGAEIVAQVMESEAFDYLDAPIQRVTGADVPTPYAKELEDFAFPDTPTIVKAVKEVLSIE

SEQ ID NO: 54524 - protein, 456 aa, Magnetospirillum magnetotacticum MS-1
GHCAGEAGYGRPRGNGASSSRKGTMNTTQQAKVRLLVDDQAQDLPVVAATEGNDGIVVSSLLKSTGLVTVDPGFMNTASCESSITYIDGEAGILRYRGYPIEQLAERSSFLEVAYLLIHGELPDAATLDAFVERVNRHTLVHEDFRTFMGTFPRNAHPMAVLSSAINALSTFYPESLDPFDDETVELATVLLLAKSRTITSYLHRRRVGEPLLYPDYSRGYVDDFLRMTFATPYQQYEADPVVVDALDKLLILHADHEQNCSTSTVRVVGSSHANLYASVAAGVNALSGPLHGGANESVLTMLDKIAGAEYDVDTFMKKVKNKEDGVRLMGFGHRVYKNYDPRAAIVKKSADAVLSTLGKKDQLLDIAMGLEEIALNDDYFIERKLYPNVDFYTGLIYKAMGFSPAMFTPLFALGRMPGWIAQWREMMKDPQTKIGRPRQVYVGETERDYVAVSDR

SEQ ID NO: 54525 - protein, 461 aa, Listeria monocytogenes
MSLFSLKRKNHFVPLEIQRQQWFKHFIVAFMSVFICYLTVYLLRNNFKAAQTLLIEQNHFSTTELGMIGLAFSVMYGIGKTILGYVVDGRNAKKIMSFLLGISAIISIIIGILLVAKQATVGILFILWGANGFVQSPGGPASYSTITRWTPKLKRGRWLGFWNASHNIGGALAGIVAFWGATTFFNGGAGGMFIVPGIIAIIIAIICFSVGHDEPEELGWNSAAEIFEEREEQGESETKDLSRFQILCRFVINNPWVWTLCVINIFIYIVRIGIDNWAPVYCIQALGWSTKDAIMTISFFEIGALLGSLSWGWLSDIMKGRRMLCSIIAVVIEFFMLISYSQVTSVYSMYTVLFILGFLVFGPQLLIGVSVIEFVPRNALAVTNGLTGTFAYLFGDSFAKVFLGYIADPTKAGMQIFGYNLHGWGATFTIMFTALIIAGLMMIPVALKQEKIIRQAKVLHL

SEQ ID NO: 54526 - protein, 187 aa, Triticum aestivum
MAGAGVTTTGSPCGACKFLRRRCAAECVFAPYFCAEDGASQFAAIHKVFGASNAAKLLQQVAPGDRSEAAATVTYEAQARLRDPVYGCVAHIFALQQQVVALQAQVAHARTQAQLGAATAMHPLLQQQLQQQAWQVAAAADQHDHQSMTSTQSSSGCYSGAHQRSDGSSLHGAEMYCGYGEQEEGSY

SEQ ID NO: 54527 - protein, 340 aa, Fulvimarina pelagi HTCC2506
MSGFADRAVSADQASIASTDTPFVRYRTKRDNPRRLLMIRNFTAEDVTDQSGRTFFVTGANSGIGLETARVLAAKGARVLLGCRTEAKALSAMADIRLEHPNADLGFVPLDLADLGSVRGAAAKVKAEERIDVLVNNAGVMVPPLGRTKDGFELQFGVNHLGTFALTGLLLDQLFARPYARIVITSSIAHRSGEIDFDDIDAQADYNRLKRYRMSKLANLLHMYELDRRLRDAKADAIALACHPGVAATNLMRFLPGPAKLLMMPGRLLLNSAAEGAWPTLAAATSPKLDGGAYVGPSKRGETAGPAAIAKSAERARNSEIAERLWAVSEEKTGVEYRFA

SEQ ID NO: 54528 - protein, 586 aa, Rhodospirillum rubrum ATCC 11170
MCGIAGMVTKLGRSVPEGLADRFAQKLAHRGPDGKGVFEAPGVLLVQARLAIIDLLTGDQPLHGPDGLVLVANGEVYNYRELRAELGEGVFLTRSDCEPPLHLYARRGLAGFDVLRGMYAIALWDPPRRRLVLCRDPFGIKPLYYVETNDGVAFASEPQALIGAGLLPAREDAAAVDELLQLQFTCGARTIFQGIRRVLPGETLVFEDAQLVERHRRPALPAVRERVSPADPLALLDHVLEDSLDLHQRADVPYGLFLSGGIDSSSVLAMMARLNERPVLAFTAGFPGTEVADERADARAATRAVGARHVEVAVSEGDFLEHLPAIAAAVDDPVADYAIVPTWLLAREAAKSVKVVLCGEGGDELLGGYGRYRSAMRPWPLARPLRRKGLLDGLGLLRGGGGRNWRAGIARAEVEARAQGGSRLIRAQRVDCADWLPHDLLNKLDRCLMAHGLEGRVPFVDVDVARFCLPLADGLKVRDGMGKWILRSWLERTLPEARPFAPKRGFSVPVGEWMSRHGDRLGPLVAASPAVAARCHGEAVRALFTHPRKETALAAWILLYYALWHRRHIVGLAPEGDVFHCLSTAA

SEQ ID NO: 54529 - protein, 446 aa, Mycobacterium leprae TN
MGSTDQATAPAGPAVSISAKLFEDACAVIPGGVNSPVRAFSAVGGTPLFITEARGCWLTDADGRRYVDLVCSWGPMILGHAHPAVVDAVATVAASGLSFGAPTPAETQLAAEIIGRMAPVERIRLVNSGTEATMSAVRLARGFTGRTKIIKFSGCYHGHVDALLADAGSGVATLSLPSSPGVTGAAAADTIVLPYNDIEAVRQTFARLGDQIAAVITEASPGNMGVVPPAPGYNAALRAITAEHGALLIIDEVMTGFRVSRSGWYGLDPVAADLFIFGKVMSGGMPAAAFGGRAEVMERLAPLGPVYQAGTLSGNPVAMAAGLATLRAAADAVYATLDRNADRLVAMLSEALTDAGVPHQIPRAGNMFSVFFSEAPVTDFASACNSQVWRYPAFFHALLDAGVYPPCSTFEAWFVSAALDDAAFGRIVDALPGAAAAAVAARHRES

SEQ ID NO: 54530 - protein, 215 aa, Capsicum annuum
MNIFRSYYSDPLTESSSSFSDSSIYSPNRAIFSDEEVILASNNPKKPAGRKKFRETRHPVYRGVRKRNSGKWVCEVREPNKKSRIWLGTFPTAEMAARAHDVAAIALRGRSACLNFADSAWRLPVPASSDTKDIQKAAAEAAEAFRPLKLEGISKESSSSTPESMFFMDEEALFCMPGLLTNMAEGLMLPPPQCAEIGDHVETADADTPLWSYSI

SEQ ID NO: 54531 - protein, 508 aa, Zea mays
MGEEKQRRDGHGGKNKYAVACSIIGSIISILMGYDTGVMTGAMLFIKEDLKTNDTQVQVLAGILNVCALVGSLTAGRVSDWVGPRRTISLAACIFLAGSVLMGLSPNFGTLLAGRCVAGVGVGYALMIAPVYAAEISSAHIRGSVTSLPEICISFGILIGYVANYLLAKLPLVYGWRAMLGLGALPSAVLAVAVLAMPESPRWLVMQGRVEQAHAVLRRVSDTAGEADVRLAEIKTAAGLADDDDGSPRGVGKGVWKEMFLHPTPPVRRILVAAFGVHFFQHLTGIEAVVLYSPRIFKAAGIATRSEILAATIGVGVTKTVFIMTAILLVDRIGRRPLYLSSLAGIIASLACLGLGLTVVERSVPRHSPTWAMALSIATVFTFIASFSIGVGPITWAYSTEVYPLRLRAQGASVGVAINRVMNAGVSMTFVSLYNAVTIGGAFFLFAGLAVLAAMFFYFLCPETQGRPLEEIEEVFGRGWRARLLSWDEAVVELPMSNTTDGNTKARP

SEQ ID NO: 54532 - protein, 357 aa, Desulfotalea psychrophila LSv54
MKKIAVLAGDGIGPEVMEQALKVLVAVQKKFGFELSFQHADVGGAAIDSHGVALPESTLTLCAESDAILFGSVGGPKWEHLPPAEQPERAALLPLRKHFDLFCNYRPARVFKSLTAACPLRADIIGDGFDILCVRELTSGIYFGTPKGREGAGEDEYAYDTMGYKRSEVRRIAHMAFAAARQRSGKVTSVDKANVLTTMVLWREVVLEVAKEYPDVKLNHIYVDNATMQLVRDPHQFDVMLCGNMFGDIISDEAAMLTGSMGLLASASLNTENFGLFEPAGGSAPDIAGQGIANPIAEILSAAMMLRYSLGYGEAADAIEAAVEKTLDRGICTADIAVDRSQAVNTAEMGDAIVAAL

SEQ ID NO: 54533 - protein, 197 aa, Glycine max
MVGVVIEDEVVVAPTNFSMVEEGIYRSSFPRSSNFSFLESLNLRSIIYLCPEPYPQENLEFLQSQNIRLFHFGIEGKTDLSVSAVRDNILEAVKVLIDVRNHPVLIHCNQGKHRTGCVVGCLRKLQSWCLSSVFEEYKRFAGAKYRTTDLRFIETVDLLSLRQCLNSIIYQYLGYASKKLRLRYRDENSIKPQLTSV

SEQ ID NO: 54534 - protein, 320 aa, Oryza sativa
  misc_feature (173)..(173): Xaa can be any naturally occurring amino acid
  unsure (1)..(320): unsure at all Xaa locations
MAASCALTLPSAISVSVSVSSNSPRRFRRSRRVVAMASVGQKVYAPGVAVSEGNGGLPKIDLKSPHGSEAEIYLFGACVTSWKVPSGKDLLFVRPDAVFNGQKPISGGIPHCFPQFGPGTMQQHGFARNMNWSITDSEANEGDPAVTLELKDDSYSRSMWDFSFQALYKVALXHSTSLSTTLKITNTDDKPFSFNSALHSYFSASISGVSVKGLKGCKTLNKDPDPKNPLEGKEEREEVTFPGFVDCIYLGAPSELTLDNGLGDKIVISNANWSDAVLWNPHLQMEACYKDFVCVENAKIETLQLGPNQSWVAEQKIELI

SEQ ID NO: 54535 - protein, 343 aa, Nicotiana tabacum
MAEEVSNKQVILKNYVTGYPKESDMEIKNVTIKLKVPEGSNDVVVKNLYLSCDPYMRSRMRKIEGSYVESFAPGSPITGYGVAKVLESGDPKFQKGDLVWGMTGWEEYSIITPTQTLFKIHDKDVPLSYYTGILGMPGMTAYAGFHEVCSPKKGETVFVSAASGAVGQLVGQFAKMLGCYVVGSAGSKEKVDLLKSKFGFDEAFNYKEEQDLSAALKRYFPDGIDIYFENVGGKMLDAVLVNMKLYGRIAVCGMISQYNLEQTEGVHNLFCLITKRIRMEGFLVFDYYHLYPKYLEMVIPQIKAGKVVYVEDVAHGLESAPTALVGLFSGRNIGKQVVMVSRE

SEQ ID NO: 54536 - protein, 621 aa, Dendrobium cv. 'Sonia'
MEGCDCIEPQWPADELLVKYQYISDFFIALAYFSIPLELIYFVKKSSFFPYRWVLIQFGAFIVLCGATHLINLWTFTMHSRTLAIVMTVAKVSTAVVSCATALMLVHIIPDLLSVKTRELFLRNKAEELDREMGLIRTQEETGRHVRMLTHEIRSTLDRHTILKTTLVELGRTLDLAECALWMPSRTGLNLQLSHTLSNQIPVGSVVSTNLPIVNQVFNSSRAVRIPHTCPLARFQHQTGRYVPPEVVAVRVPLLHLSNFQINDWPELSAKSFAVMVLMLPSDSARKWHVYELELVEVVADQVAVALSHAAILEESMRARDLLLDQNVALDLARQEAEMAIRARNDFLAVMNHEMRTPMHAIIALSSLLLETELTPEQRLMVETILKSSNLLATLINDVLDLSKLEDGSFELEATVFNLHTVFREVVNLIKPIAAVKKLSVFVSLSPDLPSLAIGDEKRLIQTMLNVVGNAVKFTKEGSISITATIAKSDSLRDSRDPEFHPIPSDGYFYLRVQVKDTGCGISPLELPRLFTKFAHTQNGSYKGYTGSGLGLAICKRFVNLMKGRIWLESEGIGKGCTTIFIVKLGISEDPTLRYQQKLLPPIPKDEKNSIPSKIRHQRSL

SEQ ID NO: 54537 - protein, 190 aa, Triticum aestivum
MRPPRGGGGFRGRGGDRGGRFGGGGRGGGGRGRFGGGGGGFRDEGPPAEVVEVSTFLHACEGDAVTKLTNEKVPYFNAPIYLQNKTQIGKVDEIFGPINESYFSVKMFEGVIATSYNEGDKFFIDPMKLLPLSRFLPQPKGSTPRGGGRGGRGGGRGGFGGRGGFRGRGAPRGRGPPRGGGRGFRGRGRF

SEQ ID NO: 54538 - protein, 229 aa, Zea mays
  misc_feature (39)..(39): Xaa can be any naturally occurring amino acid
  misc_feature (64)..(64): Xaa can be any naturally occurring amino acid
  misc_feature (69)..(69): Xaa can be any naturally occurring amino acid
  misc_feature (88)..(88): Xaa can be any naturally occurring amino acid
  misc_feature (176)..(176): Xaa can be any naturally occurring amino acid
  misc_feature (200)..(200): Xaa can be any naturally occurring amino acid
  unsure (1)..(229): unsure at all Xaa locations
MAPPEPEMFDVVIFGASGFTGKYAIREAPMFLNASSCHXSSPFRSLAASRSLAAVVTASQPRGXRRPRXEDVPILIADTSDPASFRRXATCARVVLSCAGLFRLHGHAVAAACAAVGADCLDISEEPEFMERVEAELHEPTARSGSLIVSACGFGFVPAEFGFLFHSRQWEVGTPXPPATVEAYVSLLPYKRIVVDISTXESATLEVVNAGQLQVLRRSRLRRPWPNVS

SEQ ID NO: 54539 - protein, 370 aa, Zea mays
MIRFRASRNRRSSFGDQVTWFFEFCKVEDPEHLFGEGYYTSLLSEGTNPQDYDDLVDLYPEEQPQRVEVNTYAPSARPNHKRSKNFSDVEDELLVSAWLNISLDPIIGYNQTRSSYWTRIYDYFHANKTFSSTRSQNSIMHRWTSIQEGVNRFTGCLAQVERRRQSGATMQDKLTQACALYKSEDKQHKAFPYMHCWNKLRTQRKWEMKLEELAVGKSSNKKQKMNSNETSPPHLPSATETSEPTTPNETVTTRPPGKKKAKAAAFQAEKKGYTETLNKLFEKKKETDEFKEMKKDERFRLALAVEQERAANEKLNMQLRSKELELRQQEVEQHKKREEERIMTLDLSVMPADQKQYYMRLRSKILSENA

SEQ ID NO: 54540 - protein, 404 aa, Vibrio fischeri ES114
MTTNSQVERKDFNDVMVPCYNPMEVIPVKGEGARVWDQTGKDYIDFAGGIAVSCLGHCHPIMVNALQEQSQKLWHLSNVMTNEPAIRLAKKLTEVSFAEKVFFANSGAEANEAALKLARRWAVDVHSEEKSEIIAFKQGFHGRTFFTVTVGGQAAYSDGFGPKPGDITHLEYNNLAELEAHMSDKTCAVMMEPLQGEGGIVSPTSEFVKGVKALCEKYNALLIFDEVQTGNGRTGDFYAYQGLGVTPDILSTAKSLGGGFPIGAMLTTTELAQHLKVGTHGSTYGGNPLACAIAEAVVEEVSKPEVLNGVKEREQWFRSGLEALNAKYHMFSEIRGKGLLLGAALNEEWQGRARDILVAAGEQGLMVLVAGVNVVRFTPSLVITKEEVELGFERLDKALASLTK

SEQ ID NO: 54541 - protein, 145 aa, Triticum aestivum
  misc_feature (124)..(124): Xaa can be any naturally occurring amino acid
  unsure (1)..(145): unsure at all Xaa locations
MASSADPWVREYGEAARLADDVAAMVADRAALPQSGPEVMRRTSAIRRKITILGTRLDSLEGMLARLPPKSITDKELNKHRDTLFNLKSRAKQMAESFNMSTFANREDLLGQSKKAADDMNRVXGLDNQGELLALQRAIHEKKPE

SEQ ID NO: 54542 - protein, 392 aa, Symbiobacterium thermophilum IAM 14863
MALMTVRDIDVKGKRVFVRVDFNVPLEDGRITDDTRIRAAVPTIRYLVEEGAVAVLASHLGRPKGQRNEKYSLAPCARRLSELLGREVVFAPDCIGEEVERLVAEQPPGSVVLLENVRFYAEEEKNDPEFAAKLARLGEIFVNDAFGTAHRAHASTRGVADHMPVRVAGFLMQKEVDIMGKALSDPDRPFVAIIGGAKVSDKIMVIENLLTKVDRLIIGGGMANTFLRARGFATGKSLVEEDRVDTARELLAKGGDKILLPTDLVVASEFKADAEQKVVPVDAIPEGWMALDIGPETARAFADVIRGAHTVVWNGPMGVFEMEPFARGTFAVAQAMADCEGVTIVGGGDSVAAVEAAGLADRMTHVSTGGGASLEFLEGKELPGVACLAVKP

SEQ ID NO: 54543 - protein, 256 aa, Symbiobacterium thermophilum IAM 14863
MRTPIVAANWKMHKTQPEARQFLADFLPREAGMSGVEIVICPPFTALAAVAGGLTGTRVGLGAQNMSDKPSGAFTGEVSGAMLVDAGCRYVILGHSERRRLFGESDEVVGAKVRAALQHGLIPILCIGETLEEQQAGEADAVNRRQLLAGLEGLTPEQVANLVIAYEPVWAIGTGRNCDPGDAQARIAAVRAVVAEAFGPEAAARVRIQYGGSVKPENMAAYMAQPDIDGALVGGASLDPTSFAAICAAAAEARAR

SEQ ID NO: 54544 - protein, 197 aa, Medicago truncatula
MSGSRFIKCVTVGDGAVGKTCLLISYTSNTFPTDYVPTVFDNFSANVVVDGSTINLGLWDTAGQEDYNRLRPLSYRGADVFLLAFSLISKASYENIAKKWIPELRHYAPGVPIILVGTKLDLRDDSQFFQDHPGAAPITTAQGEELRKLIGAPVYIECSSKTQKNVKAVFDSAIKVVLQPPKQKKTKRKGQKACSIL

SEQ ID NO: 54545 - protein, 547 aa, Rhodospirillum rubrum ATCC 11170
MPDPTTLSAWAALAAHAPTLSDQPLRVLFDADPDRFARFHLRFEDLVLDYSKNRITGETMALLADLARQSGVEARRDAMFAGEPINTTEGRAVLHVALRDPTPTPVLVDGADVKPAIAAVLAHMEAFSEAVRSGAWTGATGKAITDVVNIGIGGSDLGPVMVVEALKAYAKPGLRVHFVSNVDGTHIAETLKGLSPETTLFLVASKTFTTQETLTNAHTARDWLVGALGEPAVARHFAALSTNAKAVSAFGIDTANMFEFWDWVGGRYSLWSAIGLPIAISVGFANFRALLDGAHAMDTHFREAPIERNLPVILGLLGVWYGDFLGARAQAVLPYDQYLHRLAAYLQQADMESNGKRTTLDGKTVAYATGAVLFGEPGTNGQHSFYQLIHQGTSLIPCDFIAPAISHNPLGRHHAILLSNFLAQTEALMRGKTEAEARAELAAQGLAGEALEALLPHKVFPGNRPTNAILVKRLDPRTLGMLIALYEHKIHVQATVWNINAYDQWGVELGKQLAKAILPELEDATISPAHDSSTNGLIALYREFSAG

SEQ ID NO: 54546 - protein, 197 aa, Medicago truncatula
MSASRFIKCVTVGDGAVGKTCLLISYTSNTFPTDYVPTVFDNFSANVVVNGSTVNLGLWDTAGQEDYNRLRPLSYRGADVFILAFSLISKASYENVSKKWIPELKHYAPGVPIILVGTKLDLRDDKQFFVDHPGAVPITTAQGEELRKLINAPAYIECSSKSQQNVKAVFDAAIRVVLQPPKQKKKKSKAPKACSIL

SEQ ID NO: 54547 - protein, 229 aa, Zea mays
MCSVARLAFVLALAIAASSITVAESRDFNIFAQGSLPDATKGSSGLAATSGKLCQLCEQYSSEALLYLTQNETQTEILSILHHECASLAPLKQQCITLVDYYVPLFFLEVSMVTPEKFCESMHLCKKGMKISLPTREGTCGLCHHVVVEILIMLKDPNMQLEVIDLLTKTCSKAQNYEQQCKRLVLKYIPLILVKGQKFLETTDVCSVIHACKAGTQASMEAMPLSAML

SEQ ID NO: 54548 - protein, 279 aa, Arabidopsis thaliana
MLNGKEEPKQKKGWSESLLEFRSGFGEKMKVVSKKRWKSLGPLHLKSKSVARFCFFSKLKSNNHGPGRAPVYLNVYDLTPINGYIYWAGLGIFHSGVEVHGVEYAFGAHDYATSGVFEVEPRQCPGFKFKKSIFIGTTNLNPTQVREFMEDMACSYYGNMYHLIVKNCNHFCQDVCYKLTGKKIPKWVNRLAQIGSVCSCILPESLKITAVCHDPDGQIPEEENEKRSLRSSFSCLSSISMRQKQLSTSSLFLQSPLRGCLPPWQLKRSKSNSSSLKER

SEQ ID NO: 54549 - protein, 517 aa, Symbiobacterium thermophilum IAM 14863
MSAYRRPVALIVLDGWGLNPDPRANAVAMARHPNFDRLMARYPHTTLTASGEAVGLLPGQMGDSNVGHLNLGAGRIVYQTLVRIWRSIQDGSFYTLPVWRPVLDRAKQPGKALHLMGLVSDGGVHSHIDHLLALIDLAKRENVERVYVHAFLDGRDVPPQSALPYLERVEAKLKETGIGAIATISGRYYAMDRDKRWDRTEKAFLAITQGIGHTAGSVAEAVERAYARGETDEFVQPTVIEGVDGRVREGDGVIFFNFRPDRARQLVRALHETAFDGFKRPEGYRPVELVTMTQYDQTFTDIPVAFGPQFVDVPMGQVVAEAGLRQLRIAETEKYAHVTYFFNGGEERVFPGEERVLVPSPKVATYDLKPEMSAYEVAREAVKWIEEDRTDFIVLNFANPDMVGHTGVLEAAIRAVEAVDECLGQVVDALLAKGGAAVIIADHGNCDQMVDYETGAPHTNHTLNPVPCILVDDQRLDAKLKPGVLANVAPTLLEIIGLPKPPQMDADSLLVSNAEGA

SEQ ID NO: 54550 - protein, 250 aa, Arabidopsis thaliana
MTPAAGYRGYQRIGENVTKGIPDIHEAIDCYREIKQGKYGDIGKVMEGPNQWPENPQEFKELMEEYIKLCTDLSRKILRGISLALAGSPYEFEGKMAGDPFWVMRLIGYPGAEFTNGQPENDIGCGAHTDYGLLTLVNQDDDKTALQVRNLGGEWISAIPIPGSFVCNIGDMLKILSNGVYESTLHRVINNSPQYRVCVAFFYETNFDAVVEPLDICKQKYPGGRGGCQVFKRAVYGEHLVSKVQTNFAM

SEQ ID NO: 54551 - protein, 430 aa, Symbiobacterium thermophilum IAM 14863
MTTIVNVHAREVLDSRGNPTVEVEVILASGTTGRAIVPSGASTGQFEAVELRDGDKQRYLGKGVLTAVRNVNEVIAEAVVGMDATEQVEVDQAMLALDGTPNKSKLGANAILGVSLATARAAAAELGIPLYRHVGGLTARTLPVPMMNIINGGKHADNNVDMQEFMIFPAGAPSFAESLRMGTEVFHALKSVLKSKGYNTAVGDEGGFAPDLKSNEEAILVILEAIEKAGYKPGQDVFLCMDVASSELFQDGKYVLAGEGNKVLSTEQLIDLWDSWTRQYPIVSIEDGVAEDEWEAWVELTRRIGDRVQLVGDDFFVTNTERLARGIGMNAANAILVKVNQIGTLTETLEAVALAHRNGYSSVMSHRSGETEDTTIADLAVALNCGQIKTGAPSRTDRVAKYNQLLRIEEELGDAAIFAGTSVIRGRKQG

SEQ ID NO: 54552 - protein, 177 aa, Brassica napus
  misc_feature (160)..(160): Xaa can be any naturally occurring amino acid
  unsure (1)..(177): unsure at all Xaa locations
STIFIVQESISNGSLRDYLTDWRKKEVLKWPQRMSIAIGVARGIQFLHTGVAPGIFGNNLDIENVLLDETLIVKLSGYTIPLPSKVGAESTSYEDGEKEDVYQFGVILLQIITGKVMAAASSELGSLKLQLENGLREEPSVLRSLTDPSVRGTYAYESLXRSTVEFAINCLCERSKE

SEQ ID NO: 54553 - protein, 992 aa, Oryza sativa (japonica cultivar-group)
MSGQSNSPDMIFQVYTPRKRKFLNSVHYSESNRAVSHGSGLVTSAKDSHQGEESFLNGPAGLSSILSNSQGFAPQDILSGTTELSGIRCTTSSCKPNETILHTISTNNGTSNCQDTTQSFSLLMECTNHTTPSKPMHPHITFQLMHTKIESSNSCAKYADSTDQSQTAVAHKLLFSCEKGDQSIVAMVHPSQSSLEKIQQKQGISSYEAKHDVQGSTKADDSSSILSPHSLDDEIMSVVGLLSPSAYESLCDGTIQLSSTVKVSVIAFFKSGEKNHDITWPKIIEIKGRVKLDVFEKFVQELRRCQTRSLMVISLCWKFGTSKAGLLGMKEVAENFEASQKVGFADVCDGSNLYVCPRSDAVITILAKCGFFKGMSAADTNQDSLIGCIVWRRNPLSKIVDHSRSETIGKGSPCVPHVGARHPTSLPFSDGHQATSCSNNPGMDSRTNTGNIQNDIDQMQEIQSNSVKTHPVATGLLSQCGHAKSTGERDPTEKVVPHSLFKLASKLTPQPPFKAPSLIGCQLSQVSPFELASHEVPEIQQHVQSIIDSHSGSFGVWHPTSHSQGLSLKSLHVQQRTTHYDLAAQKNHMAEAFSGSITQEYASNAVESSKQQETNPFLLQPDTYGAHRANDIDDLPKVDFANLHRVELKFDVHPINRETTITSDVLICPRLSDKKSNSPFQQSSQPSFQVEGIKNHEKVEVKENVTDMISREITNQVSHRKAEIENFKSKDDIDAEDMPECHFQGLDNEKLHQSGSSKHTSPSLKNSTGSKAPSQVFPPITQKSYTPLEVEDISSGHDPNMPSGCLNIPRDQVSFPRHPPPAQGDQRLAARHPPVLADQGYVPRLPPPVLEDQGLAPRCPPPALAGQGFVPRHPPPVLPNQGFFPRRCPPFAGQDLYPWRPPFHANQGPFPRHAPPHPCPPFTPGHVRPPSNFAPPGPWRPVLHPGQEHHHHHYGHPGRSNGPSGSGNKPGYHNPSYGNGPGGCRPQHQAQG

SEQ ID NO: 54554 - protein, 740 aa, Oryza sativa
  misc_feature (281)..(281): Xaa can be any naturally occurring amino acid
  unsure (1)..(740): unsure at all Xaa locations
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFRLQKPAASQERAGREAALQLAFGVDQLLRRTDGKPAPAARVVGSGREGERMATTASVRPPLLRQAAGSEKASLLCKPKXQRASVRRRSFTARASSNPVSIPKQWYNLVADLPVKPPPPLHPQTHQPLNPSDLSPLFPDELIRQEVTEERFIDIPEEVAEVYKLWRPTPLIRARRLEKLLGTPAKIYYKYEGTSPAGSHKPNTAVPQAWYNAAAGVRSVVTETGAGQWGSALSFASSLFGLTCEVWQVRASYDQKPYRRLMMETWGATVHPSPSAATESGRRILERDPASPGSLGIAISEAVEVAARDADTKYCLGSVLNHVLLHQTVIGEECLEQLAAAGDVPDVVIGCTGGGSNFGGLVFPFMREKLAGRMSPAFKAVEPAACPTLTKGVYAYDFGDTAGLTPLMKMHTLGHGFVPDPIHAGGLRYHGMAPLISHVYELGFMEAIAIQQTECFDAALKFARTEGIIPAPEPTHAIAAAIREAMECKRTGEKKVILMAMCGHGHFDLASYEKYLRGDMVDLSHSDEKLQEALAAVPKI

SEQ ID NO: 54555 - protein, 397 aa, Arabidopsis thaliana
MLTERGRRISGFNGSFEFSNRKFRGYGFVDRSQGFHERSPSRSCSVSKILRITPPTSSPPSSASTCAGYIEHRVSKFDTLAGIAIKYGVEVADITKLNGLVTDLQMFALESLRIPLPGRHPPSPCLSNGSLNHGEDWSEQASSSASNGNHQDVFDSFQSLRLNHSEKKISPAMNSLQGYYGLKPKNRRASEGFGMAVYKNEASQLQDNDQYLTPFPATSTPLSHHRKSRSLVDAVIAEVNQSPNPSKAGGGEVNSTDKPMRRRQKSEADFSSRAPELLLKEENRSSSGAFSAIAGKNLALRSKASSRANLSAETRHLNSIPINLMDAPVGDSFSSVRKSVSASSLQEPNCNSNGSSLWPTSKWTLKPELLTQVAMASSIFDGLPKPLTGRRNKKAVD

SEQ ID NO: 54556 - protein, 247 aa, Mycobacterium leprae TN
MQQGNTATLILLRHGESDWNARNLFTGWVDVGLTDKGRAEAVRSGELLAEHNLLPDVLYTSLLRRAITTAHLALDTADWLWIPVRRSWRLNERHYGALQGLDKAVTKARYGEERFMAWRRSYDTPPPPIEKGSEFSQDADPRYTDIGGGPLTECLADVVTRFLPYFTDVIVPDLRTGRTVLIVAHGNSLRALVKHLDEMSDDEVVGLNVPTGIPLRYDLDADLRPVVPGGTYLDPEAAAAVISQARP

SEQ ID NO: 54557 - protein, 546 aa, Thiomicrospira crunogena XCL-2
MNIISKSFRQLTRIIKINRVLTHYQIDKLVLSDTKYAWLIVANLLLPWNWRFQSKGNRGERIRLALEELGPIFIKLGQALSTRKDLLPEDISVELRKLQDDCPPFDEQHSISIIEKGLKRPIEEAYASFDPTPMASASIAQVHAATLYDGSEVVVKVVRPDIKPVIEQDVSIMKSLAQLLEAAVKESKRLHPTEVVEEFEKTILDELDMMREASNASQLRRNFEHSDLLYVPDIYWSHTNDNVMTMERIYGIRISEIDKLKAANIDLTDLSAKGVTIFFTQVFKHNFFHADMHPGNIFVLPDGRYAAIDFGIMGTLNPEDQRYLAENFLAFFNRDYLRVSELHIESGWVPADTRVNELESAIRSVCEPIWDRPLKEISFGLFLMRLFQTARRFGMEVQPQLVLLQKTLLNIEGLGRQLDDELDLWDTAKPFLEDWMQERVGLKSLVKNTKANLPFWIEQAPSLPGLLHSSLQKLSHANFDQQSEQIARLEQQLAKQQKADRNRAIAVLLFVVAAIPELTHVPYLMQQIWLQGLIALLGLYFLFKKP

SEQ ID NO: 54558 - protein, 707 aa, Oryza sativa (japonica cultivar-group)
MDVSVPPTNYPKSLSSIIKCHRRRAAINNCHSVVSHPPLSHSNHHHRSLRVRSSAAVAPPLPPPLVVPMTTPKPSPTIRRLDVASPVPADIDIANAVSPLPIADIAAELGLRPEHFDLYGKYKAKVLLSVLDELKGQQDGYYVVVGGITPTPLGEGKSTTTVGLCQALGAFLDKKVVTCLRQPSQGPTFGIKGGAAGGGYSQVIPMDEFNLHLTGDIHAITAANNLLAAAIDTRIFHEASQSDKALFNRLCPPNKEGKRRFADVMLRRLIKLGISKTDPNELTPDEVRRFARLDIDPESITWRRVMDVNDRFLRKITIGQGPDEKGMVRETGFDIAVASEIMAVLALTTSLADMRERLGRMVIGNSKAGEPITADDLGVGGALTVLMKDAIHPTLMQTLEGTPVLVHAGPFANIAHGNSSIVADKIALKLVGKGGYVVTEAGFGSDIGTEKFMDIKCRYSGLMPQCAIIVATIRALKMHGGGPDVVAGKPLDHAYVSENVALVEAGCVNLAKHIANTKSYGVNVVVAINKFASDTEAEMDVVRNASLAAGAFDAVVCTHHAHGGKGAVDLGLAVQRACESQADPLKFLYPLESGIKEKIESIAKFYGASGVEYSEQAEKQIEMYTKQGFSNLPICMAKTQYSFSHVPSMKGAPSGFVLPIRDVRASIGAGFIYPLVGTMSTMPGLPTRPCFYEIDVDTATGKVMGLS

SEQ ID NO: 54559 - protein, 360 aa, Rhodospirillum rubrum ATCC 11170
MLRLTPGGVRRHHQGSGKALANVVNHEKQREGREDALDVLLTLVGGDLKRVNEIIVERMHSPIALIPQLAGHIIAAGGKRLRPLLTLASARLCGYEGERHAQLAACVEFIHTATLLHDDVVDESLLRRGRDSANALWGNKASVLVGDFLFSRSFELMVEDGVLKVLGILSHASRVIAEGEVAQLITANDMATTEAQYLEVIRGKTAQLFAAACRIGAVVAERPEAEEEALDTYGMTLGIAFQLVDDYLDYSARQQDLGKTVGDDFMDGKITLPVILAYQRGTDDERAFWRRCMEAQDMAEPEKDLAKAIELMTRYGTLAETVERARHYGERARSALDIFADGPAKAALAGIVDFCIERAR

SEQ ID NO: 54560 - protein, 244 aa, Schizosaccharomyces pombe 972h-
MPDRLKRRIEEIDHQDEIIDREASTASPVSGAGKIDQNGEIKDLLERNLTWSQQTSRKYPSFFTATKDIQTPQVLWIGCSDSRVPETTILNLLPGEVFVHRNIANVVPRSDINALAVMEYSVTVLKVKHIIVCGHYGCGGVAAALGPNLNNLLDHWLRHIRDVIEDNREELDAIEDPQLRRLKLAELNTRAQAISVTRVGFVREAMEKRGLQVHGWIYDLSNGQIKKLDITDAIKKAKYGTYDS

SEQ ID NO: 54561 - protein, 510 aa, Oryza sativa (japonica cultivar-group)
MEASTILWLLYVSLASCLLYKVFVSTKNGHPKIAARRPPGPTPVLLLGNVFDLRGELHLALARLAEEHGPVMSLKLGTATAVVASSAAAARDALQRYDHVLAARAVCDAARALGTHERSIVWLPGSSALWKRLRAVCTNHLFSARGLDATRAVREAKVRELVEHLRGHAAGAGEEEAAAVDVGRVVFSAVINLVSNVLFSEDVADLSSDRAQELEMLVRDTVEEATKPNLSDLFPVLAALDLQGRRRRTAVHIRKFHDFFDEIISRRQNAGGEGERKEDFLDVLLQLHSADQLSLDTIKTFLGDLFTAGTDTNSITVEWAMAELLRHPAAMSRARAELRDALGAKPHPDESDIGRLPYLSAVVMETMRLHPPSPLLMPHEAVADGAAVGGYAVPRGTKVIVNVWSIMRDPASWPRPEEFEPERFVAAGGSFRGGEMLEFMPFGAGRRACPGTPMATRVVTLVLASLLHAFEWRLPGGMRPCDVDVRGRFGTSLNMVTPLKAVPVPVPARP

SEQ ID NO: 54562 - protein, 547 aa, Acinetobacter baumannii
MYLYTDFDQQLINQRVAQFRDQTERYLAGKLSEDEYRPLRLQNGLYVQRYAPMLRIAVPYGLMNSKQLRKIAEVSTQYDRGYAHVSTRQNIQLNWPALEDVPEILAELATVQMHAIQTSGNCIRNTTTDQYAGVVAGEIADPRPTCELIRQWSTFHPEFAFLPRKFKIAVSALEEKDRAATAFHDIGVYIVRNEAGEMGYKIMVGGGLGRTPIIGSVIREFLPREDLIAYLEAVLRVYNLHGRRDNKYKARIKILVKALTPEVFAQKVEAEFEHTRETLKIQPEILKKLDEEFTPFDYQDLEDEDFTALFAEHPKFKQWFNINTHAHKVKGYRIVTISLKRAGIAPGDMTTEEMNFIADLADKYTFGELRTTHEQNIALADVPQKDLFDVWQALEQHNMARAHIGFITDIISCPGGDFCSLANAKSIPIAEAITRRFEDLDKVYDLGHLDLNISGCMNACGHHHVGNIGILGVDKKGAEFYQITLGGNSDHDASIGDILGPSFAAEAVPDVIEEVLNTYLDLRTEGERFVDTYRRVGIHAICLSRWL

SEQ ID NO: 54563 - protein, 270 aa, Arabidopsis thaliana
MELSSASAILSHSSSAAQLLRPKLGFIDLLPRRAMIVSSPSSSLPRFLRMESQSQLRQSISCSASSSSSMALGRIGEVKRVTKETNVSVKINLDGTGVADSSSGIPFLDHMLDQLASHGLFDVHVRATGDVHIDDHHTNEDIALAIGTALLKALGERKGINRFGDFTAPLDEALIHVSLDLSGRPYLGYNLEIPTQRVGTCDTQLVEHFFQSLVNTSGMTLHIRQLAGENSHHIIEATFKAFARALRQATETDPRRGGTIPSSKGVLSRS

SEQ ID NO: 54564 - protein, 894 aa, Rhodospirillum rubrum ATCC 11170
MSKWVYSFGNGKAEGRADMKNLLGGKGANLAEMSNLGIAVPAGFTITTEVCTAFYDNDHAYPAGLTDQVVTALARVEEIMGARFGDANNPLLVSVRSGARASMPGMMDTVLNLGLNDQTVQGLIKQSGDARFAYDSYRRFIQMFSDVVLGVEHYHFEEILENHKEDKGLSLDTELGADDWKLLVERFKAKVQQELGKPFPENPEEQLWAAVGAVFGSWMNQRAITYRRLNDIPQEWGTAVTVQSMVFGNMGDDCATGVCFSRDPSTGENTFYGEYLVNAQGEDVVAGIRTPQQISIAGKEKNASALPAMEEVMPGLYKELVATRDVLEAHYRDMQDMEFTIQGGKLWMLQTRTGKRTAGAALRIAVEMAREGIITSDEAILRIDPEALDQLLHPTLDPKAAKIVLTKGLPASPGAASGKVVFSAEVAEDWVQRGEKVILVRIETSPEDIGGMHVSQGILTTRGGMTSHAAVVARGMGTPCVAGAGEIRVDYKAGLFTVGGKTVREGDIITLDGAAGTVMLGAVPTIQPELTGDFGVLMDWADAKRTMKVRANAETPVDAEAAKRFGCEGIGLCRTEHMFFDPRRIINIRRMILASDEAGRRAALAELLPYQRGDFVELFRIMAGLPVTIRLLDPPLHEFLPHTDGEIAEVAAIAGVDESLVRHRASVLSESNPMLGHRGCRLGVTYPEIYEMQARAIFEAALEIAQEVGEAPVPEIMIPLVATKRELDLMKAVVDAAAKAVFAEKGGEVTYSVGTMIELPRAALQAGSIAQTAQFFSFGTNDLTQTTLGLSRDDSASFLETYRVKGIYERDPFASLDVEGVGELVKIAAERGRATRPGLKLGICGEHGGDPQSIAFCQSVGLDYVSCSPYRVPIARLAAAQAALRSVVKQPAMV

SEQ ID NO: 54565 - protein, 316 aa, Lupinus albus
MLTKEDTVKDKEEEEEEEEKPRFNFNLYMVEKSRSVNQALNDAVSLREPHKIHEAMRYSLLAGGKRVRPVLCIAACEVVGGNESTAMAAACSIEMIHTMSLIHDDLPCMDNDDLRRGKPTNHKVFGENIAVLAGDALLAFAFEHIAVSTSGVSPERIIGAIGELAKSIGTEGLVAGQVVDINSEGLCDIGLEKLEFIHLHKTAALLEGSVVVGAILGGGCNEEVEKLRMFARYIGLMFQVVDDVLDVTKSSKELGKTAGKDLVADKVTYPKLLGIEKSNEFAQKLNRDAQEQLSGFDPVKVAPLIALANYIAYSPN

SEQ ID NO: 54566 - protein, 337 aa, Arabidopsis thaliana
MSYSGAGLGKPGSGKRRIRDLLTQSDNRVCADCGAPDPKWASANIGVFICLKCCGVHRSLGSHISKVLSVTLDEWSDEEVDSMIEIGGNASANSIYEAFIPEGSSKPGPDASHDQRMRFIRSKYEHQEFLKPSLRITSVRGSSTKTPAFLSSSLSKKIVDSFRTNSSSQQPQLEGMVEFIGLLKVTIKKGTNMAIRDMMSSDPYVVLTLGQQKVQSTVVKSNLNPVWNEELMLSVPHNYGSVKLQVFDYDTFSADDIMGEAEIDIQPLITSAMAFGDPEMFGDMQIGKWLKSHDNALIEDSIINIADGKVKQEVQIKLQNVESGELELEMEWLPLEQ

SEQ ID NO: 54567 - protein, 506 aa, Symbiobacterium thermophilum IAM 14863
MSGIAGILGKPDKARIVRMLEQQAHRGPDGRGIWTATAGFGLGHVRLATVDVAGGGQPLSNEDGSLWLAMTGAIYNHGALRRELEGRHAFRTQSDAEVVVHLFEEYGPACVERLDGMFAIAIWGEEVGLFLARDPLGIQPLYWGEDEEGNVLFASEIKALVGETRFVREFPPGHRWRAGEPLEPYERLPAHTGELADPDQIVLALDRLLHAAVRKQLAADVPVGCLLSGGLDSSLVTAIARQHAEGELHTFAVGLEGSADLEQARMVAGELGTIHHERVLTEKEVTAVLPRVVDALESCDPALVRSAVATYYVAELAAGHVKVVLSGEGADELFAGYDYLAEFERDAGALGAELYEITAAMHNCNLQRVDRMTQVHGVEARMPFADQAVVDFAFRIHPRLKRRDGESKWILRRVAEQYLPPAIVWREKQKFAIGSGIAPLLEHYAAKAVPDAAFRRARSPKGVPFASKEEFLYWSLFRERYGREDVLALMGRSRSLNQGQRWVGAL

SEQ ID NO: 54568 - protein, 263 aa, Brassica napus
MASISTSKLLLLLICYVSLIFSVSSSSSSSSSDLPSSPKVSLGLYYESLCPYCSSFIVNHLTKLFEDNLISIVDLHLSPWGNTKLRSDNVTAVCQHGAFECLLDTVEACAIDAWPKLRDHFPFIHCVESLVTEHKYDKWETCYQKLNLNSKPVSDCLSSGHGDKLELKYAAETSALQPPHQYVPWVVVDGQPLYEDYENFISYICKAYKGAKKPDACAKYSSSHFIRSAKVNRFPLVCRKGVNRMWDLLERVKTSLLSYTGLL

SEQ ID NO: 54569 - protein, 419 aa, Triticum aestivum
  misc_feature (7)..(7): Xaa can be any naturally occurring amino acid
  unsure (1)..(419): unsure at all Xaa locations
MAFAARXRSLASRFSHHLTRRLHPSVPHLLSRSNDDDPPSQPQPHPLPSLRSPLPPASGAAQTLHHPFPFSLHHSGLPRRSFSSSAPAPAPDPPGEVDAAASVLVDAVASSVPAPFPGEVAAAAADSFFPFAALQHLIDTIHTFTGLNWWASIALTAVLIRTAVIPFTVSHQKSGEKIHAMKPEVDAIKHAVDLTDPKSVLVGNYKMTALYRNHGVTPYTPLKGVLIRPSIFMSFFFAINNMVEKVPSMKGGGVFWFTDLTTPDPLYICPVLAALTFLATVELNLQEGMEGNSMADKMKTFSRGMALMTVPFTMNFAKGIFCYWVTSNLFSLVYGIVMRRPAVRKLFNLPAWEAPSAPALNSALNMFGGSKAVPSARSPLALTAAQQSSLEKPDAAALGYRVKNLEKKGKSRGKSRKRR

SEQ ID NO: 54570 - protein, 421 aa, Triticum aestivum
  misc_feature (56)..(56): Xaa can be any naturally occurring amino acid
  unsure (1)..(421): unsure at all Xaa locations
IVDSRGNPTVEVDLVAGDGSLHRSAVPSGASTGIYEALELRDGDKSVYGGKGVLTXVRNINEVIAPKLVGVDVRNQKDVDAIMLDIDGTENKSQLGANAILGVSLSVCRAGASAKGVPLYKHIQELSGTKELVMPVPAFNVINGGSHAGNNLAMQEFMLLPVGATSFAEALRMGSEVYHVLKGIIKAKYGQDACNVGDEGGFAPNVQDNREGLVLLMDAIEKAGYTGKIKIGMDVAASEFLMKDGSYDLNFKNQPNNGAHVLSAQSLCDLYKEFVKDFPIVSIEDPFDQDDWSSWASLQSSVDIQIVGDDLLVTNPKRIVEAIDKKACNALLLKVNQIGTVTESIQAALDSKAAGWGVMVSHRSGETEDNFIADLAVGLASGQIKTGAPCRSERLAKYNQLVRIEEELGNVRYAGEAFRSP

SEQ ID NO: 54571 - protein, 258 aa, Brassica oleracea
MDPFSLHAPGFVNLLASHSSSPIDVDSAEAAVNSPGLVKPAERRKWSTKEDLVLISVWLNTSKDPIVSNEHKLGAFWKRIEAYFNSSPQLSGSLPREWGQCKQRWGRVNAEVCRFVGSHETALKEQASGQSENDVMKTVHDIYFNDYNLKFTLEHCWRELRFDQKWRSHSQPKENRKEAGAEAVPKEEEEVRPPGVKASKAAKRKKPNEAAYDHIHSILAEKNTISRQKILDRLLAKNIDTLSDNEVALKNKLISEML

SEQ ID NO: 54572 - protein, 216 aa, Oryza sativa (japonica cultivar-group)
MGQQQQQENLTLLPMSSSSAAAAADAAAASSPAASAGRLFTAGLVASWYASNIGVLLLNKFLLSTYGFRYPVFLTACHMSACALLSYAAAAASAAAPRAARPRRSRGQLARVALLGAVFCASVVAGNVSLRYLPVSFNQAVGATTPFFTAVLAYAVAARREACATYAALIPVVAGVVIATGGEPSFHLFGFIMCIGATAARALKTVLQGILLSSEE

SEQ ID NO: 54573 - protein, 396 aa, Debaryomyces hansenii CBS767
MPGELQDINDYIKESKRGRDEHNIQGVVPILDISAALDKERRPQLLKDLKRALFDIGFFYVKNPPSKKIPSIFHDLKEESWNFFNLPKEKKSEISMENSKHFLGYNDVGDELTAKHIDWREQVEFGTELPEPVINSDDELWKNIEGPNLWPDKQLVPNFRSTIEDYMSELETLSKLLIDLIKESLNLPEAVFDKYFKEKQQCKMKIIRYPDLLKLKNDLEGIRSHLLQSLIDLKQGVGEHRDNDFLTIIYQATNHTSLQVQTFEGEWVNVPPIKDTFVVNAGQTLEYITNGVCVATVHRVLTPIPGEGDRLSIAFFQTVDVSSYKSKIEIPEEIQKEADIRDSRRTKEDISFQFPQANAKPLGYSIFLNRIKSHPKVGAKWYPDTLKYVQKQLEKA

SEQ ID NO: 54574 - protein, 104 aa, Arabidopsis thaliana
MEIESVTCECCGLMEDCTQHYISKVKANFAGKWLCGLCSEAVSDEFSRSSKTVEEAVNAHMSFCGKFNANPAELVADGMRQMLRRRSGELSPKMSKKFGRSNTT

SEQ ID NO: 54575 - protein, 378 aa, Cryptococcus neoformans var. neoformans JEC21
MTLIRTSRLALSRGSRATFVSRSLQTSSSVHPLYPDLPVYSYSIGLSYAAKYSPPFINPKQDIKPYGFAKQSNDVGKWVQQMLELTAGRGDLKASEEDLAEARRRWGAGEDFFGITNARGDLHIAVSDGVGGWSDRVDASLFPQLLCYHYAKAAQELANSSTGSVDPRSIMKKAYEDALKDKNVSAGGATMVSARLDEDGQGIFANLGDSGYFILRGDEILEFSQAQTHFFNCPTQLSKVPPEMKHQGIVHDTPDMADTKSFELQAGDVIALFTDGFSDNVPPSHIPGLSKLLNRILEDPTNKDLSPAERDSERARLFADMLVGYGRTAMTKTGEEKGPNGWKTPFEEEATKKVPKWGWKGGKIDDITVVTAVVSELD

SEQ ID NO: 54576 - protein, 303 aa, Oryza sativa (japonica cultivar-group)
MEEEGFYTNLMNEGNDSLDWDSLSSMPVEDDMSNQLDENGMSSEPVTQQFPTAERTTVARPNQKRSKNFSEQEDKILVSAWLHVSLDPVLGTNQTRAAYWTRIYEHFYKTSKSTPDRSQNSLMHRWETIQENVNKFCGYLSQIEGRRQGGVSIHDKIAQAIAVFKELEGKPFQFLHCWSLLRSQSKWHDKMKQITSQKPCATNRQKPSIDGSAKATPTNDETTNHVGEDNEPTETEEPKRPMGKKRAKEHLRRGETCTDAFDHLWEKKKEADAEKKKERDERHQKSYELDKQRLELDKKKGRE

SEQ ID NO: 54577 - protein, 497 aa, Mesorhizobium loti
MKGDDGLTVTQSLTRRLKNPELFDDLAGVPGRKAEQSTRRFSVFNPSTGELLAELPDMDVRDVSKAIDKAEAAQEHWAALTARERSDILWEWHQLILDHSEDLAAILTAEMGKPLAEAKSEIAHAAAYLQWYAEEANRIYGETISPPSNDRRMLVIKQPIGVVGAITPWNFPASMVARKISPALAAGCAIVLKPAEQTPLVAGAMFTLARMAGFPDGVLNLIYASEGDAVGRELCSNPKVRKISFTGSTEVGRLLMRECSDQIKRTSFELGGNAPFIVFDDADVDAAVDGALQAKFRNAGQTCVSANRLYVQSSVYNEFCDKFTKRVSALRVGDGFEPEVAIGPLIDKCALAKIEDHIRDAVRQGGKIRCGGNRIGESGTFFEPTVITDVERTMRVAQEETFGPLAPIIRFNDPDQVVREANDTIYGLAAYFYASNLKRVWRVAETLEYGMVGINTGRMSSEAAPFGGMKQSGIGREGSRHGLEDYLEMKYLCMGGL

SEQ ID NO: 54578 - protein, 527 aa, Debaryomyces hansenii CBS767
MGLEDNALIRKYVNVGEKRAGSASMGIFVGAFAAFGGVLFGYDTGTISGIMAMNYVKGEFPANKESFTSKESSLIVSILSAGTFFGALLAPFMSDTLGRRWSLIISTFIVFNLGVILQTVSTGIPLLCAGRAIAGFGVGLISAVIPLYQSEATPKWIRGAVVSCYQWAITIGLLLAACVNQGTHNRNDSGSYRIPIAVQLLWSLILGTGMIFLPDTPRFWIHKGNESEAKKSLKILRKLPLDHPDLIEEYEDIKAAYDFECSFGKSSWMDLFTTRNRQLKRLFTGVALQAFQQLTGVNFIFYFGTSFFKSAGIENEFLISLATSIVNVGMTVPGIFLIELVGRRSMLLWGAVGMSVSQFIVAIVGIATDSADANKVLIAFTCFFIAFFASTWGPIAWVVVGEIFPLRTRAKSVALSAASNWLWNWAIAYATPYLVEDGKGNANLGTNVFFIWGGCNFLCILFTYVFIYETKGYSLEQIDELYEKVPHAWKSRGFIPSAHAFREDAPESISSMGKDMEKVTEIETTSV

SEQ ID NO: 54579 - protein, 457 aa, Mortierella alpina
MAAAPSVRTFTRAEILNAEALNEGKKDAEAPFLMIIDNKVYDVREFVPDHPGGSVILTHVGKDGTDVFDTFHPEAAWETLANFYVGDIDESDRAIKNDDFAAEVRKLRTLFQSLGYYDSSKAYYAFKVSFNLCIWGLSTFIVAKWGQTSTLANELSAALLGLFWQQRGWLAHDFLHHQVFQDRFWGDLFGAFLGGDCQGFSSSWWKDKHNTHHAAPNVHGEDPDIDTHPLLTWSEHALEMFSDVPDEELTRMWSRFMVLNQTWFYFPILSFARLSWCLQSILFVLPNGQAHKPSGARVPISLVEQLSLAMHWTWYLATMFLFIKDPVNMMVYFLVSQAVCGNLLAIVFSLNHNGMPVISKEEAVDMDFFTKQIITGRDVHPGLFANWFTGGLNYQIEHHLFPSMPRHNFSKIQPAVETLCKKYGVRYHTTGMIEGTAEVFSRLNEVSKAASKMGKAQ

SEQ ID NO: 54580 - protein, 393 aa, Oryza sativa (japonica cultivar-group)
MFPTAGGRRLLVLIRRASAAAAAGANPNHHHHHATLFTHRYSSSPLARTPEAESAAAASYLVASVGLSPAAAARISRKARFRSNADAEAVVSLLRGHGFSDANIAQVLPKIPGLLILNPDKILRPKLEYFASLGVVPSALSRAPLLARSLEKHLVPCVEFIRGVVGTDANLCAAISRNPWALWCDINSSMRPAVESLRRHGLAEANISRLVVINLSALTMSPDRIDGIFGDLEALELPISHSRFVYGFWALSRLKRGAWEERMSVFMRFGVSRSELLKAFREQPGILVFTAKTIQRKLSFYQEKLKVAPADVIAHPLLLTFSLEKNIIPKCAVLNVLLREGKIKRYGREMDLLRPLQRSNISFFERFVRKYEEDVPDVVKAYEGKIKFTGFMD

SEQ ID NO: 54581 - protein, 526 aa, Triticum aestivum
MSAIKPPPPDRPPQAARLPSPSSSSSAAAAAKQGGTGSRGLLMGRYELGRVLGKGTFAKVYHARHVQTGESVAIKVLDREKAVRSGLVSHIKREIAVLRRVRHPNIVHLFEVMATKTKIYFVMELLVRGGELFSRVSKGRLKEDIARRYFQHLISAVGFCHTRGVFHRDLKPENLLVDEAGNLKVSDFGLSAVAEPFQPEGLLHTFCGTPAYVAPEVLARRGYEGAKADIWSCGVILFVLMAGYLPFHDQNLMAMYRKVYKGEFRCPRWFSKDLTSLIMRFLDTNPSTRITLPEVMESRWFKKGFRPVKFYIEDDQLYNVIDAENDMLDLGLPDPLPQPLPPPPPSPSPQQVDGDDSGSESDASVVSCPATSSFEERHRLRGPLPRPASLNAFDIISFSRGFNLSGLFEEKGDEVRFISGEPMPDIITKLEEIANVKSFAVRKKDWRVSLEGTREGVKGPLTICAEIFELTPSLVVVEVKKKAGDKEEYDDFCNKELKPGMQHLVHQMVPVPNTPTISELAERPSR

SEQ ID NO: 54582 - protein, 457 aa, Umbelopsis isabellina
MAAAPSVRTFTRAEILNAEALNEGKKDAEAPFLMIIDNKVYDVREFVPDHPGGSVILTHVGKDGTDVFDTFHPEAAWETLANFYVGDIDESDRAIKNDDFAAEVRKLRTLFQSLGYYDSSKAYYAFKVSFNLCIWGLSTFIVAKWGQTSTLANVLSAALLGLFWQQCGWLAHDFLHHQVFQDRFWGDLFGAFLGGVCQGFSSSWWKDKHNTHHAAPNVHGEDPDIDTHPLLTWSEHALEMFSDVPDEELTRMWSRFMVLNQTWFYFPILSFARLSWCLQSILFVLPNGQAHKPSGARVPISLVEQLSLAVHWTWYLATMFLFIKDPVNMMVYFLVSQAVCGNLLAIVFSLNHNGMPVISKEEAVDMDFFTKQIITGRDVHPGLFANWFTGGLNYQIEHHLFPSMPRHNFSKIQPAVETLCKKYGVRYHTTGMIEGTAEVFSRLNEVSKAASKMGKAQ

SEQ ID NO: 54583 - protein, 399 aa, Oryza sativa (japonica cultivar-group)
MFAAICRRRLAALFPQIRGGGGGAYHVQSNPQAALLFHSYSSTAVTGGSDPEPCPDTVSYLVSCGLPPAVARHTAANTRGLRIRSTEKADAVRTLLRSYGFSDADVARIARSAPLLLTVDPDRIIRPKLEFFATMGFQPSKLSTAPLLLARSLEKHLVPTIQFLRSIIGSDDGIRRGFSRIPRALLVSLDNCMRPAVEALHRHGLTGREDVSKVLVLQMGVLMLSPVRIGEIFEDLKAMGMSITDGRFANSFRAMCSMRRATWLRKVALYRSFGLSESEVFEAFKKQPTALLGADETIKKNASFFRDALKLEMREVMVHPVVMAYSFEKTILPRCAVLSVLMREGKINPDIQLLHALLGSAKTFSGRYVDRFAADVPDVVEAYEGKIKFKGFKGQGQGV

SEQ ID NO: 54584 - protein, 498 aa, Debaryomyces hansenii CBS767
MSSIPDNLGPTKRSTTSTSTSTSPNSTENELSTLHSNHLNDAGNKSNDHYKSKLSPLRYKLRALCLPIIRKETEILANMQKKVRHPILDFYFAWTANLASHTFYVLMLPLPIWFGASTLSRDLLAVLGLGIFITGNLKDFLCLPRPRSPPLHRITMSSYTTQEYGFPSSHSANATAVTLVLLAKLFEFQDTLEPLTKVSIFCFLIIYYFSLIFGRLYCGMHGFFDVFTGSVIGFLLFLFRFFFGKQWDQWLLATHNESAMGLIFTPLSIIAGYVLLIHFHVEPVDDCPCFDDSVAFIGVLIGIDISHWLLNITNYLTYKNPFEEPIIVRYDFDEFGLVKSIIRVVMGVTFVVIWKTISKPVIFTVLPPIYKFIGVYLPRKNYQPTAFSKKTTRQIRSQSLSNMEGSQSIGDINTFIKGVTDHNQIDEVGPENDIDYYEMLDYEKKLGHENSSKTVQPISGVFKSRYDVEIVGRLIIYAGVSTTAVWGFAFGTELFGLN

SEQ ID NO: 54585 - protein, 449 aa, Triticum aestivum
  misc_feature (197)..(197): Xaa can be any naturally occurring amino acid
  unsure (1)..(449): unsure at all Xaa locations
MIRAASPRPPSAVQLRSSAASSSSSASPFRARGSGSRVAATGGRRRRNAISCCASDDREGARGAAPPAPAPTAPSDGSIQLYSQIEKVITEAAKQSNQGWSSTGDWTEIEGAWVLRPKSSEPSFVVHFIGGIFVGAAPQVTYRYFLERLADKGALVIATPYASGFDHFFIADQVQFKFDRCLRNLVEPVNDLPTFGXLGTSLGSVIHLLIGSRYAVQRSGNILMSFNNKEASLAIPLFSPVIVPMAQSFGPILSQLTSSPTIRFGAEAAIKQIENLGPPVVKQLLPLIQQLPPLYMDLVKGREDFIPKPEETRRLIKSYYGISRNLLVKFEDDQIDETSIIAQVLSSESAISSLLDMSIRSLPGDHGLPLQQVLPDVPPGMADAVSRGGELLANLTTGTPWEAVAKEVGTTFGTDSDVLRAQAPEDVNALVDVIVSWIASNSGPKLLRS

SEQ ID NO: 54586 - protein, 459 aa, Silicibacter pomeroyi DSS-3
MATEILMPALSPTMEEGTLAKWLVKEGDTVSSGDILAEIETDKATMEFEAVDEGIVGKILIAEGTEGVKVNTPIAVLLEDGESADDIASASSGAAAPSSAPVAAPAEKAPQGAAEAPAAPPVDLSPDWPADAPMKSQTVREALRDAMAEEMRADEAVYLMGEEVAEYQGAYKISQGMLDEFGSKRVIDTPITEHGFAGIAVGSAFGGLKPIVEFMTFNFAMQAIDQIINSAAKTLYMSGGQMGCPIVFRGPNGAAARVGAQHSQDYAAWYMQIPGLKVAMPYSAADYKGLMKTAIRDPNPVIFLENEILYGRSFDVPQIDDLAIPFGKARIWREGTDVTIVSFGIGMQYALEAAERLATDGISAEVIDLRTLRPMDLPTVINSVMKTNRLVTVEEGWPQGSVGSYIASEVMQQAFDYLDAPIITCTGKDVPMPYAANLEKLALVTTDEVVAAVKQVTYR

SEQ ID NO: 54587 - protein, 431 aa, Synechococcus sp. RS9916
MKRVLAIILGGGAGTRLYPLTKMRAKPAVPLAGKYRLIDIPISNCINSSITKMYVLTQFNSASLNRHLSQTYDLSAGFGQGFVEVLAAQQTPESPSWFEGTADAVRKYQWLFQEWDVDEYLILSGDQLYRMDYSLFVEHHRKSGADLTVAALPVDPQQAEAFGLMRTDEHGTIQEFREKPKGDSLKEMAVDTSRFGLSPESAQSKPYLASMGIYVFSRKALFDLLNDHPTYKDFGKEVIPEALSKGMSLKSYVFDDYWEDIGTIGAFYEANLALTQQPKPPFSFYDEDFPIYTRPRYLPPSKVGDSQIIDSIIGEGSIIKSCSVNHCVLGIRSRIENSVVVQDSLVMGSDFYESTQEREELRRNGGIPLGVGEGSTVKRAILDKNTRIGRNVTIINKDNVEEADRPELGFYIRNGIVVVCKNATIPDGMVI

SEQ ID NO: 54588 - protein, 437 aa, Silicibacter pomeroyi DSS-3
MPTEILMPALSPTMEEGTLAKWLVKEGDSVSSGDLLAEIETDKATMEFEAVDEGIVGKILVPEGTEGVKVNTPIAVLLDEGESAGDIASASSGATAPSSAPAAASAEKAPQGAAEAPAAAPAAPKAADGARVFASPLARRIAADKGLDLSQIAGSGPHGRIVKADVIGATAPAAAPASAAPAPAAAAAPAAAPSGPGADMVARMYEGREYEEVKLDGMRKTIAARLSEAKQTIPHFYLRRDIKLDALMKFRAQLNKQLEGRGVKLSVNDFIIKAVANALQQVPDCNAVWAGDRVLKLKPSDVAVAVAIEGGLFTPVLKDADMKSLSALSTEMKDLATRARDRKLAPHEYQGGSFAISNLGMFGIDNFDAIVNPPHAGILAVGSGVKKPVVGADGELTVATVMSVTMSVDHRVIDGALGAQLLQAIVDNLENPMVMLA

SEQ ID NO: 54589 - protein, 455 aa, Prochlorococcus marinus str. MIT 9515
MSHEIFMPALSSTMTEGKIVEWLKNPGDKVERGESVLVVESDKADMDVESFQDGYLAAVLMPAGSTAPVGETIGLIVENEDEIASIQEQNKGKQIEVSSDAQLKLPNKKSEIIEEKQKELPQINEQQVEIKREKVINTSNEIQFNASTSNNSSRVIASPRAKKLASTMGVELTKVHGSGPHGRIQAEDVLKANGQPVSIPWIGEGSSPASIGSSHVQAESKSETLGNSFGKPGETVKFNTLQKAVNNNMESSLNVPCFRVGYSINTDKLDNFYKKVKQNGVTMTALLVKAVAKTLKKHPQVNSSFSENGISYPENINIAVAVAMEDGGLITPVLKEPCNTDLFELSREWKDLVKRSRAKQLEPDEYSTGTFTLSNLGMFGVDRFDAILPPGTGAILAIASSKPTVVANNDGSISVKKIMQVNLTADHRVIYGADGASFLKDLSSLIENEPETLVS

SEQ ID NO: 54590 - protein, 92 aa, Glycine max
MERKGRRRRRKRKGFLDKIKEKLPGHKKTEEATATTPPPPPPVASLEHGEGAHHEGEAKEKKGILEKIKEKLPGYHSKTEEEKEKEKESGAH

SEQ ID NO: 54591 - protein, 205 aa, Schizosaccharomyces pombe 972h-
MSSCFGSKKKPIYRKIVILGDGAAGKTSLLNVFTKGYFPQVYEPTIFENYIHDIFVDGNSIELSLWDTAGQEEYDQLRSLSYSDTHVIMICFAVDSRDSLENVITKWLPEVSSNCPGVKLVLVALKCDLRGADEEQVDHSKIIDYEEGLAAAKKINAVRYLECSAKLNRGVNEAFTEAARVALAAQPRGTKDGADESHGTGCIIA

SEQ ID NO: 54592 - protein, 253 aa, Glycine max
MTDYKQEQDMEIEALEAILMDEFKEIHSGESGLSTSNRCFQIKVVAQDDDADGPITNPAQLALIFSHTETYPDEPPLLNLKSLQGMSTEDLRILKENLQQEASENLGMAMIYTLVTSAKEWLADRFCQDDVGSTEAEEAAKEDVVIPHGEPVTVETFLAWRERFEAELALERAKLMPESVLSAPKEKKLSGRQWFESGRVKGVAAVAEESDVEDEEDIDFDEDDFEDDEEEDMLEHYLAEKSDLSTHSSMRAS

SEQ ID NO: 54593 - protein, 304 aa, Triticum aestivum
FRAAARAGVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSGKFDQVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVIDK

SEQ ID NO: 54594 - protein, 508 aa, marine gamma proteobacterium HTCC2143
MYTKVHDWIATHAGTRPNAIAITDLFSEREYTYAQMNERVAQCAGFLRDGLNIQQGQHVAILSQNSSDFMEILFACARIGAVLVPLNYRLVADELDFITGDAEAKALFCDADFLEVGKEVAMGCDLPLIDMQGDGSKSRYEYGLAEAVPIYHMVDQDLSALWVIMYTSGTTGRPKGARITHYVMQSNNLNNMSNSNITQSSISLTFMPVFHIGGLNCYTVPTLFVGGRILMMRSFDAATTLAALNNKTVQVTHFLGVPATFQFMCQHPDFEHFDPSGIELATVGAAPMPVPLLKIWIEKGLQLQQGYGMTETGPSVFSLPREYALEKIGSCGKTLMFTKVRIVADDGSDVSANEIGELWVQGGNIIESYWNRPEANVKDFVDGWFRTGDAARIDEDGFYYIVDRTKDMYISGGENVYPAEVENTIYQLEDITEAAVIGLPDEKWGEIGCVVAVLKSGSTLTEEDILNHCDGKMAKFKLPRSVRFIDALPRNTTGKVLKTVLRQQAQQG

SEQ ID NO: 54595 - protein, 145 aa, Desulfotalea psychrophila LSv54
MIEFIKEIVLGLWSLIVGMRITAREFFTPKITVQYPHETEVMPARFRGHIELIGDEEGNTRCVACGMCVRACPSGCIKVSGEKLEGSKKKIATVYELDFTKCSLCGSCIESCNFGAIQFSRVYNHVSTKKEDFYYNLIKDLEEKK

SEQ ID NO: 54596 - protein, 418 aa, Brassica oleracea
MVRVLGSSTAIQHHTKSIPLLIRRFSLPSTRKDPDLESALSRNKRWIVNSRLKNIILRCPNQVAPVKFLQKKFKTLDLQGKALNWLKKYPCCFDVYLEEDEYYCRLTKPMMALVEEEELVKEAQEPVLADRLAKLLMMSVGQRLNVVKLNELKRSFGFGDDYVVRIVPKYADVFRLVNYSGRKSSMEIELLSWKPELAVSAVEAAAGNECGSEPGFSCSLPTTWTNPWERFMEFNASPYISPYRELGEVVEGSKESEKRSVGLVHELLSLTLWKKLSMVKLSHFKKEFALPEKLNGMLLKHPGIFYVSNKYQVHTVLLREGYDGSELVQKDPLVIVKDKFGEFMQQGLYEYNRRRYLANLEKKREKGIESVKSVVRKRDGIEHGDEVDEQENHGGRPGGMFDPEERKRFYQILFSDTQ

SEQ ID NO: 54597 - protein, 361 aa, Arabis stelleri
CKAAVAWEAGKPLVMEEVEVAPPQKHEVRIKILFTSLCHTDVYFWEAKGQTPLFPRIFGHEAGGIVESVGEGVTDLAPGDHVLPIFTGECGDCPHCHSEESNMCDLLRINTERGGMIHDGESRFSIDGKPIYHFAGTSTFSEYTVIHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTDGGVDRSVECTGSVQAMIQAFECVHDGWGVAVLVGVPSKDDAFKTHPMNFLNERTLKGTFFGNYKPKTDIPGVVEQYMNKELEIEKFITHAVPFSEINKAFDYMLKGEG

SEQ ID NO: 54598 - protein, 388 aa, Buchnera aphidicola str. Sg (Schizaphis graminum)
MNLRKMTELNITGKKILIRTDLNVPIKNGVIQSDARILAALPTIEIAIEKKAKIIILSHLGRPKEGCYTKKYSLFPIFEYLKKKLKKTKIYFSDNHLKKVEINSGEILILENVRFNVGELKNDENLSKEYANLCDIFVMDAFGSAHRMQSSTYGIGKFVKIACAGPLLISEINNLKKALKNPKRPMVAIVGGAKVSTKFNVLNKLAAISDTIIVGGGIANTFLAIDNKIGKSLHEPKFILKAKKLRDKYNNIVIPIDSRVGKNFSHKEKCTIKLSSNIEKNEEIMDLGDKTIKKIIKILKKSKTILWNGPVGVFEFPNFRKGTEMIAKAIAENNGFSIAGGGDTLSVIDMFQIKDKISYISTGGGAFLEFIEGKKLPAMKMLEENFHK

SEQ ID NO: 54599 - protein, 622 aa, Candida albicans SC5314
MRSAIKPIIIRNLGWRTHAQTHFHTLVGFRFCYIRWAYFEFQLLLFDFLLPSKGPQNLNIINTDYKKKSFLSTSFSLLLSYRRITFSNKKNTMSSKTVPRFPIIRKFFKYTLSGVALTVVGGTSFIAYKVYQESQPVDQIKQSPYFPNGQPKKSIVILGSGWGAVSLLKNIDTSLYNVSVVSPRNYFLFTPLLPSVPTGTVDMRSIIEPIRSMIRRCRGEVNYYEAEAIGIDPVNNKLTIQQSTTVHSGHSGDDTSSNDPKIHQEHKMEHITTELNYDYLVVGIGAQPSTFGIPGVAEHSTFVKEVRDSIKIKKKIIDLIEAANLLPVGDPDRKRLLHIVVCGGGPTGVEAAGEIQDYIDQDLKKWMPQIAKDMKVSLVESQPVVLHTFSSELVEYTNHIFQDTNINLVTNSRIVKVDDTHVDVMRKSDKSIDKVPYGMLIWATGNSVRGFTKIIMDKFSEQQTSPRGLLVDDQLKLKGSDNIYALGDCTFTKYAPTAQVAFQQGIYLAHYFEKLQKVEKLRYKIKQDPSISEVYVHRLQRLENSLPKFVYNYRGSLAYIGSEKAVADLAVGSWSNLSSGGNLTFLFWRSAYIMMCLSIKNQVLVCFDWIKVYLFGRDCSRE

SEQ ID NO: 54600 - protein, 361 aa, Turritis glabra
CKAAVAWKAGKPLVMEEVEVAPPQKHEVRIKILFTSLCHTDVYFWEAKGQTPLGPRIFGHEAGGIVESVGEGVTDLQPGDHVLPIFTGECGDCRHCHSEESNMCDLLRINTERGGMIHDGESRFSINGKPIYHFPGTSTFSEYTVVHSGQVAKINPDAPLDKVCIVSCGLSTGLGATLNVAKPKKGQSVAIFGLGAVGLAAAEGARIAGASRIIGVDLNSKRFDQAKEFGVTEFVNPRDHDKPVQQVLAEMTDGGVDRSVECTGSVQAMIQAFECVHDGWGVAVLVGVPSKDDAFKSHPMNFLNERTLKGTFFGNYKPKTDIPGVVEKYMNKELELEKFITHTVPFSEINKAFDYMLKGES

SEQ ID NO: 54601 - protein, 1021 aa, Cryptococcus neoformans var. neoformans JEC21
MRISRPLGQLNLYARTSPRISFPLPSARVISAPLRQSLPPPRLRVNTPLASRSFSISSTHLAKMSADVEMTSQSAKIIDGTAIAKQIRTSISQAITDLHASNPTFHQPHLVIFQLGSSAASSTYIRMKLKAAEESGMTVEHIKIPSDEESGALKGTGVKRVLEAVKKANQDEKVSGILVQLPLEGAGKAEEKAVVDSVDVTKDVDGFHPENIGLLSSRISEPFFTPCTPAGAIKLIESTGFNLAGSNVVVLGRSDIVGTPVCALLRKKDATVTQCHSRTKNVERIISQADVIVAAIGQAEFVRGEWLKPGAIVIDVGTNYIPDASKKSGQRLVGDVHFESASKVASYITPVPGGVGPMTVAMLMNNTFEAAKRQWSSRRAKQLIPLPLEIKEKVPSDIEIAVAQTPKPVAEIAEEIGVHPDEVESYGRYKAKIELSVLDRLKERKDGKYIVVAGITPTPLGEGKSTTTIGLAQALGAHLHKTAIACVRQPSQGPTFGIKGGAAGGGYSQVIPMTEFNLHLTGDIHAITAANNLLAAAIDARMFHEATQTDKGLFNRLCPPKKGVRTFSKPMIARLHKLGINKTNPSDLTEEEAARFARLDIDPATLTWNRVLDTNDRYLRQITVGQAPTEKGLERKTAFDIAVASECMAVLALSKDLADMRARLGRMVVASSKAGEPITAEDIGCAGAMAVLMKDAIKPTIMQTLEGTPVFVHAGPFANIAHGNSSIIADRIALKLAGVEEGDDESRNGYVITEAGFGADIGMEKFCNIKTRVSGLKPSAVVLVATIRALKMHGGGPAVTPGKPLDQVYVEENLELLEKGCANLGKHIENAKKFGLKVVVAINKFSNDTAAEMALVQEYALKVGADYAVPADHWARGGAGAVDLANAVIEACATPSTFDFLYDLNQPLTKKIEIIAKEMYGADGISLSAEAQAEIDRYEKQGYGGLPICMAKTALSLSDDPSKKGVPTGFTLPIRNVRLSAGASFVYPLVGDMSTMPGLTTRPGFYDIDLNPDTGEIEGLF

SEQ ID NO: 54602 - protein, 361 aa, Arabis flagellosa
CKAAVAWEAGKPLVMEEVEVAPPQKHEVRIKILFTSLCHTDVYFWEAKGQTPWFPRIFGHEAGGIVESIGEGVTDLAPGDHVLPIFTGECGDCPHCHSEESNMCDLLRINTERGGMIHDGESRFSINGKPIHHFVGTSTFSEYTVVHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGES

SEQ ID NO: 54603 - protein, 619 aa, Mesorhizobium loti
MHEQRSLKMNALTPAVSTGPLPASRKIHKSGVLHPHIKVPMREISVHPTAGEPPVIVYDPSGPYTDPIVETSIENGLARLRNEWITARGDVEAYDGRHVRPEDNGFATGERLTPEFLTRNRPLRAKQGKAVTQLAYARAGIITPEMEFVAIRENLGREMLRGKLERDGEAFGAAIPDFVTPEFVRDEVARGRAIIPANINHPESEPMIIGRNFLVKINANIGNSAVTSSMAEEVEKMVWAIRWGADTVMDLSTGRNIHNIREWIVRNAPVPIGTVPLYQALEKVNGIAEDLTWEVYRDTLIEQAEQGVDYFTIHAGMRLHYIPLTVDRVTGIVSRGGSIMAKWCLQHHRESFLYEHFAEICDICRAYDVSFSLGDGLRPGSIADANDAAQFAELETLGELTQIAWAKDCQVMIEGPGHVPMHKIKENMDKQLAVCGEAPFYTLGPLTTDIAPGYDHITSGIGAAMIGWFGTAMLCYVTPKEHLGLPDRNDVKIGVITYKIAAHAADLAKGHPAAKVRDDALSRARFEFRWEDQFNLSLDPETARSFHDQTLPKEAHKVAHFCSMCGPKFCSMRISHDIRAEAQKEGMAAMAAKYRAGGDLYVPADKTGVALMTGAPEPS

SEQ ID NO: 54604 - protein, 361 aa, Arabidopsis kawasakiana
CKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVWIVSCGLSSGLGATLNVAKPKKGQSVAIFGLGAVGLAAAEGARIAGASRIIGVDLNPQRFDQAKEFGVTEFVNPRDHDKPVQQVIAEMTNGGVDRSVECTGSVQPMIQAFECVHDGWGVAVLVGVPSKDDAFKTHPMNFLNERTLKGTFFGNYKPKTDIPGVVEKYMNKELELEKFITHTLPFSEINKAFDYMLKGES

SEQ ID NO: 54605 - protein, 359 aa, Arabis hirsuta
  misc_feature (134)..(134): Xaa can be any naturally occurring amino acid
  misc_feature (255)..(255): Xaa can be any naturally occurring amino acid
  misc_feature (314)..(314): Xaa can be any naturally occurring amino acid
  unsure (1)..(359): unsure at all Xaa locations
IRCKAAVAWEAGKPLVMEEVEVAPPQKHEVRIKILFTSLCHTDVYFWEAKEQTPLFPRIFGHEAGGIVESVGEGVTDLAPGDHVLPIFTGECGDCPHCHSEESNMCDLLRINTERGGMIHDGESRFSIDGEPIXHFVGTSTFSEYTVIHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTXGGVDRSVECTGSVQAMIQAFECVHDGWGVAVLVGVPSKDDAFKTHPMNSLNERTLKGTXFGNYNPKTDIPGVVEQYMNKELEIEKFITHAVPFSEINKAFDYML

SEQ ID NO: 54606 - protein, 385 aa, Triticum aestivum
MIRLRSCILTQLLCSPPASPISSLRRLLSTTEPVPPVPANPGFAVEDYLVASCGLTRPQALKASLKISGLKSPSKPDSVLALLAGLGLSSADVAALVATDPRLLCAKVDTLTSNVAGLAGMGMSRSQIAQLVMLGCIIFRCKPVVSRLHYYLPLFGSPENLLRVLKQNSYLLSTNIDKVVEPNVAFLRECGLGACDIAKLCTSLPRLLSTKPEKVRAMAACTESLGVCRGSGMFRKAMQAVAFRSKEKIAAEVAYLKNTFRWSDAEVGIAVCRSPMVLSRSEDTLLRVSEFLISEVGLEPAYIAPRSVMLCLSLEGRLRPRYYVMKFLKENGLLNLGWSYFSIVKATEKVFVEKFICPHKEAAPYLAEDYDAACRGEVPTNFRFA

SEQ ID NO: 54607 - protein, 218 aa, Thiomicrospira crunogena XCL-2
MCHQCDCDTSIEQLLQNNRDWVDEINAIRPDFFETLSHQQKPEYLWIGCSDSRVPANELVKMDPGTIFVHRNIANLVNSSDMNVLSVIQYAVEILKVKHIIINGHYGCGGVIASMEEHNPSLIDHWVRPIRKYYQRKQTELDALPYEERVNRLCEINVVEQVRNICHVPAVKNAWKKGQHLAIHGFIYNIKDGRLKNLNVSIDDIESAEKAVLRATDS

SEQ ID NO: 54608 - protein, 406 aa, Neisseria meningitidis Z2491
MTLFCEQVPYPRLAEAFGTPLYVYSQSALTEAFEHYQTAFAELSPLVCYAVKANGNLSIIKHFASLGSGFDIVSGGELARVLAAGGDAAKTIFSGVGKSEAEIEFALNAGVKCFNMESIPEIDRIQKVAARLGKTASVSLRVNPDVDAKTHPYISTGLKANKFGIAYADALEAYRHAAQQPNLKIIGIDCHIGSQLTDLSPLVEACERILILVDALAAEGIVLEHLDLGGGVGIVYQDEDVPDLGAYAQAVQKLIGTRRLKLILEPGRSLVGNAGALLTRVEFVKYGEEKNFVMVDAAMNDLMRPALYDAYHHIEAVEPKNIAPLTANIVGPICETGDFLGKDRTIACEEGDLLLIRSAGAYGASMASNYNARNRAAEVLVDGNEYRLIRRRETLEQQMANELACL

SEQ ID NO: 54609 - protein, 685 aa, Zea mays
MEAVDKIAEPKDPFVLTAQKVQSSEPPIPIKASCEGNDSQQQEETDLPDDGEESFRSMDSSDEGVRSSFSGASHPPEPIDMDIMKTVYVAIDEKSEPPVSLVRGVSVKGPFIDDLSIRVTGAKANLVVGAGGAEGMAEERKVSASAVASVTTARSSQATSLPQDSEEKECVWDASLPPSGNVSPHSSIDSMGVVTAMSTLNSCTSTYKSETIAGEAMLNVERNCESVKGVRGDLLESAKTSMSRASDSSVVSDDSSWSHITGGASKPHKGNDPRWKAIHAVRTRDSVLGMSHFRLLKRLGCGDIGSVYLSELSGTRCYFAMKVMDKASLASRKKLNRAQTEREILQLLDHPFLPTLYTHFETDRFSCLVMEFCPGGDLHTLRQRQPGKHFSEYAARFYAAEVLLALEYLHMLGVVYRDLKPENVLVRDDGHIMLSDFDLSLRCAVSPTLIRTSAFDSDPRRAGGSFCVQPACIEPTSACIQPACFLPKFFGQKSKKKTRKARSELGHNAGTLPELVAEPTSARSMSFVGTHEYLAPEIIKGEGHGSAVDWWTFGIFLHELLYGKTPFKGSGNRATLFNVVGQQLKFPESPSTSYSSRDLIRGLLVKEPQSRLGVKRGATEIKQHAFFEGVNWALIRCSTPPEVPRPVEAELPVKYGVAEAIGSNSKRVVGADVKSAGKYLDFEFF

SEQ ID NO: 54610 - protein, 201 aa, Schizosaccharomyces pombe 972h-
MKLFYFSLLFTLFFGLISANRGPKVTDTVYFDLQQGDEFLGRVTIGLFGKTVPKTAENFRALATGEKGFGYEGSIFHRVIPNFMIQGGDITKGDGTGGKSIYGSRFPDENFKLSHQRPGLLSMANAGPDSNGSQFFITTVKTPWLDGHHVVFGEVLSGYDIVKKISKAETDNRDKPLEDVKIIKSGQLSQENVEDDGTDEL

SEQ ID NO: 54611 - protein, 512 aa, Gluconobacter oxydans 621H
MTASLRCEVAALLDSLGVSPDLYTGGSLAVKSPLTGEVIAEVSEVSAEQAKETIASSLDAFKAWRRVPAPRRGELVRLLGEELRASKEALGRLVTLEVGKVPSEGLGEVQEMIDICDFAVGLSRQLYGLTIQSERPDHRLTEQWHPAGPVGIISAFNFPVAVWSWNAALALVCGDSVIWKPSEKTPLTALATQALFLKAAARFGSDAPVALSTLLVGGREIGELMVKDRRVPVISATGSTRMGRDVGERVARRFGRSILELGGNNASIVTPSADLDLTLRAVAFGAMGTAGQRCTTLRRLFVHSSVYDTLVPKLVNVYKTISVGNPVEGDALVGPLIDVASFKMMQDSLKAAADAGGTVHGGTRVDVNGEASFYVRPAMVEMPSQTGPVLEETFAPILYVMKYDTLDEAIALQNDVVQGLSSSIFATDIREVEQFLSAQGSDCGIANVNMGPSGAEIGGAFGGEKETGGGRESGSDAWKAYMRRQTNAINYGRTLPLAQGVKFDVYGGSADA

SEQ ID NO: 54612 - protein, 799 aa, Streptococcus suis 89/1591
MLVSYKWLKELVDFDATSHDLSEKMSTTGIEVEGVEQKSAGLSKLVVGQVVSAEPIPDTHLNTCQVNVGDEITQIVCGAPNVKPGIKVIVALPGARIAGNYKIKKGKIRGVESLGMLCSLSEIGVSDSVVPKVYADGIYHLPEDAVVGEPVFSYLDLDDEIIELSITPNRADALSMRGVAHEVAAIYDSKVNFKPVVLEESDKKASDVIEVAIESDKVAAYTARVIENVTIAPSPQWLQNLLMNAGIRPLNNVVDITNYILLYFGQPMHAFDFDKFDGKKIVARQAKEGENLVTLDGEERDLITDDIVISVGDKAVALGGVMGGANTEIDNNSKTVVLEAALFDGKSIRKTSGRLNLRSESSSRFEKGINVATLTEAMDTAAAMIAELAGGQVLSGIVSAGSVDTSDVPVTATIDYVNRSLGTNLDYAQIADIFRRLGMETTGDASQFTVAVPRRRWDIRIPADLVEEIARIYGYNNLPTTLPKEDGTAGELTLTQNIRRQVRSLAEGAGLTEIISYALTTPEKAVEFAARPTTVTELMWPMTVDRSALRQNMVSGMLDTVAYNVARKNKNLALYEIGKIFEQSGNPKEDLPQEINKFALVLTGLVAEKDFQTPAVPVDFFHAKGILEAIFGHYKLAVDFVATSEIAALHPGRTAEIHLNGAVIGFVGQVHPQTAKDYGIPETYVAEINLDAIEEALQPAQPFTEISKFPAVSRDIALLLSSDVKHQDVLDAIAGAGVKRLTKVTLFDVYAGSNIEAGKKSMAYNLTFQNPADSLTDEEVAKYMEKISKALVELGAEIR

SEQ ID NO: 54613 - protein, 579 aa, Gibberella zeae PH-1
MAIAMGWQKPDNVAGSSAPAIMVGLFVASGGLLFGYDTGAINGILAMTEFKEQFGKHTNCVDENGAVDICTKDSSIIVAILSAGTALGALLAAPTGDSLGRRKTLLLAVAIFCVGAIFQVAANNIDLLLVGRFFAGVGVGLISVLVPLYQSEMAPKWIRGTLVCAYQLSITFGLLAASIVNILASKLNNSSAYRIPLGLQIVPAIILTGGLLLLPETPRFLVKKGLHEAAGLSLSRLRRLDITHPALVDELQEMIANHQYELTLGPDSYKQLFIGSPHLGRRMFTGCGLQMLQQLTGINFIMYYSTSFFDGAGVESPYTKSLIINIINVVSTIPGLLVIEKWGRRRLLMIGALGMAGCQLLMASFDTATGQSYEKASQTILIAFCAINIFFFAASWGPVVWVVTSEIYPLKVRAKAMSVSTASNWLLNFAIAYCAPYLVGTGPGNASFGPKIFFIWGAFCILAVFFVWCMVYETSKISLEQIDEMYERVNHAWNSKSFEPSWSFQQMLNDGWSPSAQPPADHELQTTTSASSADTTLGDGDASSITVSQSNNNSSSPNNNNDQNKGPPAMSMANVDFSY

SEQ ID NO: 54614 - protein, 372 aa, Desulfotalea psychrophila LSv54
MSEHIILNPDETFTLNLGPQHPATHGVLRVKLTMDGEYIYSAETVIGYIHRMHEKMGENRTYNQYLPNLSRLDYLSAMAYCHGYVLAVEKAGSIEVPERAEYIRAITVELNRLSSHLVWFGAFIMDLGGFSPLMYAFDDREQILDLLESITGSRLTYCYYRFGGLYNDIDDEFLVGTRKFIIRMRKSLKTYRDLVTNNIILMKRLKDIGHISPEICRKYGATGPVARGSGINFDVRKNEPYSVYNEFDFDIPVYHEGDSYARYMVRMDEMEQSLRIIEQAMDKLPGGPIIPEKKPKIIKLPEGDYYSTVEAARGSFGIRLVSDGGKNAYRLKLRSPTFSNMHLFDEVCQGMLIADALALMGSLDLVIPEIDR

SEQ ID NO: 54615 - protein, 714 aa, Agrobacterium tumefaciens str. C58
MRMTVIPIVILCGVLSVVYAVWTTKSVLDADQGNERMREIAGYIREGAQAYLTRQYLTIAIVGLIVAVLAWYLLSAIAAIGFVIGAVLSGVAGFVGMHVSVRANLRTAQAASHSLGAGLDIAFKSGAITGMLVAGLALLGVSIYYFVLTSVLGHPPGSRAVIDALVSLGFGASLISIFARLGGGIFTKGADVGGDLVGKVEAGIPEDDPRNPATIADNVGDNVGDCAGMAADLFETYAVSVVATMVLAAIFFAGTPILESAMVYPLAICGACILTSIAGTFFVKLGTNNSIMGALYKGLIATGVFSVAGLAVATYATVGWGTIGTVAGMEITGTNLFFCGLVGLVVTALIVVITEYYTGTNKRPVNSIAQASVTGHGTNVIQGLAVSLESTALPAIVIVGGIIGTYQLGGLFGTGIAVTAMLGLAGMIVALDAFGPVTDNAGGIAEMAGLDPDVRKATDALDAVGNTTKAVTKGYAIGSAGLGALVLFAAYANDLSYFAANGDTYPYFKDIGEISFSLANPYVVAGLLFGGLIPYLFGGIAMTAVGKAASAIVEEVRRQFREKPGIMAGTEKPDYGRAVDLLTKAAIREMVIPSLLPVLAPLVVYFGVLLISGSKASAFAALGASLLGVIINGLFVAISMTSGGGAWDNAKKSFEDGFIDKDGVRHVKGSEAHKASVTGDTVGDPYKDTAGPAVNPAIKITNIVALLLLAVLAH

SEQ ID NO: 54616 - protein, 544 aa, Nitrosomonas europaea ATCC 19718
MSTLTRSPAWLALSAHQTEIANRPLRTLFDEDPQRFDKFSLQFKDLLLDYSKQPVDATTIRLLLALAEQQKLVDWLGRMANGEKINFTESRAALHIALRANSPVFMDGVDVTQEVRRVLRQIEQFVQKIHNQSHRGYSGLPITDVVNIGIGGSDLGPVMVTEALKPYHLPQLRTHFVSNLDGAHLSDTLQHINPATTLFVIASKTFTTQETLANAHSARKWFLAGGGSKQDIAAHFVAVSTNREAVSQFGIDPDNMFEFWDWVGGRYSLWSAIGLPIALAVGMEHFHSLLAGAQAMDDHFLTAPFEQNLPVILGLIGIWQINFFHITSQAILPYDQSMHRFPAYLQQLEMESNGKRVTRNGEAVDYSTGIIIWGEPGTNGQHAFYQLLHQGTQKFTADFLAPCRCHHPLSEHHPMLLANFFAQTEALMRGKTEQEVRSELANQNLSADLVEHLLPHRVFPGNHATTSILFKKLDPATLGMLIALYEHKVFVQSVIWEINPFDQWGVELGKQLAGKILAELALDKPVTGHDASTNGLINFYRAQQ

SEQ ID NO: 54617 - protein, 770 aa, Aspergillus oryzae
MSQSRSRGQQSADVEECPHDPTLQGDGAPKKPVTAEEALEIAIGESQDVEYTIDSDNSPYLEVRANVPNTDDPTLPINTFRMWFLGIVFTLVGTGVNQFFSMRYPSVTITSLVAQLISYPVGCFFAKAMPIMTIRVRGREIPINPDHHFNVKEHAVITIMSNLSFNQSWASAIIQAQKVYLDMPTPVGYQILLALSMQMFGLGLAGLSYRYIIEPPHMIWPSTLANAALFQTLHSGANPIADGWRISRYRFFLYVFIGSFCWYWLPGYIFTGLSTFAFICWAAPNNKVVNNLFGMTTGLGYMPTTFDWSQIAYNTSPLTIPFWAQANVFAGWFCIYAVIAPILYYTNTWYTAHLPLTGSDAYDNTGNLYNSTRILNDEGAIDDAKYREYSPIFLPITFALCYGVGFAVLSCLLTHVVLYHSKDILDTFRGQNKKDVHARLLSRYPDVAWWWYAILTVIVVAVAIMVQYVWNTGLPFWGLFITLALATLYVIPVGTVYAVANLNANVLTVLGEIVSGYLLKGKPLVLLIFKFYAYTGLSQAMYYGADMKLGLYMKIPRRTLFVAQLIACILGTLTQNGVLLWMLGHVKDVCASDQPNNFTCPQGRVNYNSAVFWGAIGPARLYNIGQRYSGLLHMFWIGALLPIITFFLRRRYPNSRVLNAIHWPIFFAGTGNLPPATGINYSTAFVVSLIFNKIIKGRRPNWWAKYNYVLSAALDSGVAVSAILIFFSLVLPGVSLNWWGNNVNSGTVDSKGTPWLELKPNETFGESTWS

SEQ ID NO: 54618 - protein, 363 aa, Crucihimalaya himalaica
  misc_feature (17)..(17): Xaa can be any naturally occurring amino acid
  misc_feature (253)..(253): Xaa can be any naturally occurring amino acid
  misc_feature (350)..(350): Xaa can be any naturally occurring amino acid
  unsure (1)..(363): unsure at all Xaa locations
IRCKAAVAWEAGKPLVXEEVEVAPPQKHEVRIKILFTSLCHTDVYFWEAKGQTPLFPRIFGHEAGGIVESVGEGVTDLQPGDHVLPIFTGECGDCRHCHSEESNMCDLLRINTERGGMIHDGESRFSIKGKPIHHFLGTSTFSEYTVVHSGQVAKINPDAPLDKVCIVSCGLSTGLGAVLNVAKPKKGQSVAVFGLGAVGLAAAEGARIAGASRIIGVDLNSKRFDEAKKFGVTEFVNPRDHDKPVQQVIAEXTDGGVDRSVECTGSVQAMIQAFECVHDGWGVAVLVGVPSKDDAFKSHPMNFLNERTLKGTFFGNYKPKTDIPGVVEKYMNKELELEKFITHTVPFSXINKAFDYMLKGES

SEQ ID NO: 54619 - protein, 388 aa, Mycobacterium leprae TN
MAQREWVEKDFYKELGVSSDASPEEIKRAYRKLARYLHPDANPDNSAGERFKVVSEAHNVLSDPVKRKEYDETRRLFAGGWLGGRRFDSSFGDFGMGGDGAEFNLNDLFDAASRTGGTNIGDLFGGLFGRGASVRPSRPRRGNDLETEADLDFVEAAKGVAMPLRLTSPAPCTNCHGSGARPGISPKVCSTCNGSGVINRNQGAFGFSEPCTECRGSGSIIEHPCEECKGTGVTTRTRTINVRIPSGVEDGQRIRLAGQGEAGLRGAPSGDLYVTVHVRPDKIFGRNGDDLTVTIPVSFTELALGSTLSVPTLDGTVGVRVPKGTSDGRILRVRGRGVPKRSGGHGDLLVTVKVAVPLNLEGAAQKALEAYAAAERSSGFNPRAGWGR

SEQ ID NO: 54620 - protein, 363 aa, Olimarabidopsis pumila
IRCKAAVAWEAGKPLVMEEVEVAPPQNHEVRIKILFTSLCHTDVYFWEAKGQTPLFPRIFGHEAGGIVESVGEGVTDLQPGDHVLPIFTGECGDCRHCHSGESNMCDLLRINTERGGMIHDGESRFSINGKPIHHFLGTSTFSEYTVVQSGQVAKINPDAPLDKVCIVSCGLSTGLGATLNVAKPKKGQSIAIFGLGAVGLAAAEGARIAGASRIIGVDLNSKRFDQAKEFGVTEFVNPRDHDKPVQQVIAEMTDGGVDRSVECTGSVQAMIQAFECVHDGWGVAVLVGVPSKDDAFKTHPMNLLNERTLKGTFFGNYKPKTDIPGVVEKYMNKELELEKFITHTVPFSEINKAFDYMLKGES

SEQ ID NO: 54621 - protein, 362 aa, Olimarabidopsis cabulica
RCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCRHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSKRFDQAKEFGVTEFVNPKDHDKPVQQVIAEMTDGGVDRSVECTGSVQAMIQAFECVHDGWGVAVLVGVPSKDDAFKTHPMNLLNERTLKGTFFGNYKPKTDIPGVVEKYMNKELELEKFITHTVPFSEINKAFDYMLKGES

SEQ ID NO: 54622 - protein, 428 aa, Oryza sativa (indica cultivar-group)
MSKAAAAASLPPPPPEVAHLVDQLQRHHLAPDASLLSSSAHSDLLQAREEVASERARYLEALAVYAEAIAMVEEYQHAISTGVANAGKKLNCSPQVYESLEHHLAVAEAAQRLRLPLLSQDGDVHEEEIEKLSALSRSSFDSTMTSAAPSSSSISTSYNNYSSTASAATVAAAPGTGGSEPVEPGVGGVPDRFLGITSDYLYQVQQEQPAMTVDMVDYQRTLAREIEARLEAKCDALADLFAMDERDSSSISQISSARLPERVKLIIEEIEKEEALLLDDLASMDRKFAEHYNVLEQILAVLIQFVKDKKLEHQHQYDDLKKTWLIKRCRTMNAKLSYLEHHLLRDTYTKETVPALHRIRKYLVEATKEASNSYTEAVSRLREYQGVDPHFDVIARQYHEIVKKLEGMQWTIHQVEMDLKPHHDHAGV

SEQ ID NO: 54623 - protein, 363 aa, Crucihimalaya wallichii
IRCKAAVAWEAGKPLVMEEVEVAPPQKHEVRIKILFTSLCHTDVYFWEAKAQTPLFPRIFGHEAGGIVESVGEGVTDLQPGDHVLPIFTGECGDCRHCHSEESNMCDLLRINTERGGMIHDGESRFSIKGKPIHHFLGTSTFSGYTVVHSGQVAKINPDAPLDKVCIVSCGLSTGLGAVLNVAKPKKGQSVAVFGLGAVGLAAAEGARIAGASRIIGVDLNSQRFDEAKEFGVTEFVNPRDHDKPVQQVIAEMTDGGVDRSVECTGSVQAMIQAFECVHDGWGVAVLVGVPSKDDAFKSHPMNFLNERTLKGTFFGNYKPKTDIPGVVEKYMNKELELEKFITHTVPFSEINKAFDYMLKGES

SEQ ID NO: 54624 - protein, 304 aa, Arabidopsis thaliana
MAIISEVEEESSSSRPMIFPFRATLSSANPLGFLEKVFDFLGEQSDFLKKPSAEDEIVVAVRAAKEKLKKAEKKKAEKESVKPVEKKAEKEIVKLVEKKVEKESVKPTMAASSAEPIEVEKPKDEEEKKESGPIVPNKGNGTDLENYSWIQNLQEVTVNIPVPTGTKARTVVCEIKKNRLKVGLKGQDPIVDGELYRSVKPDDCYWNIEDQKVISILLTKSDQMEWWKCCVKGEPEIDTQKVEPETSKLGDLDPETRSTVEKMMFDQRQKQMGLPTSEELQKQEILKKFMSEHPEMDFSNAKFN

SEQ ID NO: 54625 - protein, 232 aa, Oryza sativa (indica cultivar-group)
MASSSDPWVREYSEASRLADDVTSMIADRGSLPQSGPEIMRHTSAIRRKITILGTRLDSLEALLSRIPPKSITDKELHKRQDMLSNLKSRAKQMATSFNMSNFANREDLLGQSKKAADDMSRVAGLDNQGIVSLQRQVMKEQDEGLEKLEETVLSTKHIALAVNEELTLHTRLIDDLDDHVDVTNSRLQRVQKRLAILNKRVKGGCSCMALLISVVAIVFLAVIAWLLIKHL

SEQ ID NO: 54626 - protein, 363 aa, Arabidopsis suecica
IRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSGYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPKDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGES

SEQ ID NO: 54627 - protein, 347 aa, Streptomyces coelicolor A3(2)
MSRSLNLAVIPGDGIGQEVVAEGLKVLSAVLPQDVKLETKEFDFGARRYHATGETLTDADLDALKAHDAILLGAIGDPSVPSGVLERGFLLKLRFAFDHHVNLRPSKLLPGVATPLAGQPEIDFVVVREGTEGPYTGNGGTIRKGTEHEVATEVSVNTAYGVERVVRDAFARAQARPRKKLTLVHKNNVLTFAGHLWTNIFNKVAAEYPEVTTDYLHVDAATIFLVTDPARFDVIVTDNLFGDIITDLAAAVSGGIGVAASGNINPSGDFPSMFEPVHGSAPDIAGQGKADPTATVLSVALLLRHLGYEDEAARIEDAVSADLGERGDLPARSTSEIGDTLAARVAG

SEQ ID NO: 54628 - protein, 362 aa, Streptomyces coelicolor A3(2)
MTTPTIELKPSAHPLSDSERAAILANPGFGRHFTDHMVTIKWTEGRGWHDGQLVPYAPLSLDPATMVLHYAQEIFEGLKAYRRPDGSVATFRPEKNGARFQASSRRLGMPELPVDTFIEACDALVAQDEKWVPAHGGEESLYLRPFMIATEVGLGVRPANEYLFIVIASPAGAYFPGGVKPVSIWVSEDRVRAVPGGMGDAKTGGNYAASLLAQAEAAAKGCDQVCYLDAIERKWVEELGGMNLYFVYGNKIVTPSLTGSILEGVTRDSLLTVARDLGYEAEEGRVSVDQWQRDSENGTLTEVFACGTAAVITPVGTVKRAGAQWQQSGGETGEVTQRLRDALLDIQRGTVADPHGWMHTLA

SEQ ID NO: 54629 - protein, 188 aa, Yarrowia lipolytica CLIB122
MSASSEPDTNPRGIPRAPFVDNVAEFVSKSGVKESLDKFQEMLQKYKYMEMTTLQRQAGLKEKIPDIQKSLEMVEFLQLKGSAGEDVVTNYELNDTLYTEAKIEASGIQSVYLWLGANVMLEYDVAEAKQLLSERLEGAKRGYDTAEEDVLFLRENITTVEVNIARVHNWDVNRRKKEREEAERAENK

SEQ ID NO: 54630 - protein, 480 aa, Neisseria meningitidis Z2491
MKQLAMYINGRFENDFNGEWRNVLNPSTEEAIAREPKGGKADVDRAVAAARAAQPAWERLPAVERGAYLRKIAQGIRERADELTDTIVAEGGKTKDLARVEVMFTADYLDYQAEWARRYEGEIIQSDRPRENILLFKRPLGVIAGILPWNFPFFLIARKMGPALVTGNTIVVKPSSVTPINCHIFAEIVDAVGLPAGVFNVVNGPGAEIGNALSAHPQVDMVSLTGSVEAGRQVMEAASANITKVSLELGGKAPAIVLKDADLDLAVKSILASRVGNTGQICNCAERVYVHSSLKDAFIEKMTAAMKGVRYGNPAEAEAGALEMGPLIEERAVKAVAEKVERAVKQGAKLVCGGKRAEGRGYFFEPTLLTDTDNSMDIMKEETFGPVLPVSAFDTLDQVIALANDCEFGLTSSVYTTNLNEAFYVTRRLQFGETYINRENFEAMQGFHAGWKKSGIGGADGKHGLEEYLQTQVVYLETDI

SEQ ID NO: 54631 - protein, 248 aa, Mycobacterium sp. MCS
MSTAPLTGRRALVTGGSRGIGAEIVRRLAADGAAVAFTYSASGTNAEKLVAEVAADGGTAVAIQADAADPAQTAAAVDRAVAELGGLDIVVNNAAVAHIAPFDEFPAEQFDRLVAINIGGMYWTTRTAIKHLGEGGRIINIGSINADRIPGPGLSVYGMTKGAVASFTRGLARDLGASGITVNNVQPGPIDTDANPDNGDFAESLKQVTTQGRYGHTTDVASFVSFLAGPESGYITGANLNVDGGFTV

SEQ ID NO: 54632 - protein, 291 aa, Clostridium perfringens ATCC 13124
MFKGSCVALITPFTEDGVNYEELRKLLEWHIKNHTDAILVCGTTGEGSTMTLEEKKEVIKFSVEVVNKRVPVIAGTGTNNTKASIELSKYAEEVGADMVLIITPYYNKTSQKGLYAHFNAINDAINIPIMLYNVPSRTGMNITPLMLDKLADLNNVVAIKEASGDLSQVAKMAELCGDRIAIYSGNDDQIVPILSLGGAGVVSVLANILPEETHNICEKYFLGEVIESRNLQLKYLSLANSLFIETNPIPVKTAMNLMNFNCGPLRLPLCEMEDSNLVILEENLKANGLIK

SEQ ID NO: 54633 - protein, 368 aa, Gibberella zeae PH-1
MSPSAVAAKKTYNIASIPADGIGPEVISAGIEALTALASTLQTFNLDFTHYDWSSDTYKKTGKYIPDGGLDQLKKHDAILFGAVGAPDVPDHISLWGLRLAICQPFQQYANVRPTRIMRGTQSPLRNCKTGDLDWVIIRENSEGEYAGQGGRSHRGHPWEVATEVSIFTRHAVNRLIRFAFEIAQKRPRKHLTVVTKSNAQRNGMVLWDEVAAEVAKDFPDVTVEKMLVDAMTTKMVLKPESIDTIVASNLHADILSDLAAALAGSIGIAPTSNLDPTRENPSMFEPIHGSAFDITGKGIANPVATFWTAAEMLSWLGEEDASAKLMECVENVTASGVLTQDLGGNATTKQVTDAVVAEIEKLGNGSD

SEQ ID NO: 54634 - protein, 481 aa, Oryza sativa (japonica cultivar-group)
MESTSKVDDEQWLVYWILYSLITLMEMALHKVLYWIPLWYEAKVLFVAWLVLPQFRGASFIYDKFVREQLKKNRVKLHEHHGHGHGHADEHQSHVVRASSRRLPPAAGRLLPPPRLASSRRRLPLSSPTPAAELVASLAGRHARRPRRPPSSSPLSPAAALVASLAGRRAHLPSRRPRRPPSSSSLLPATALVASLASWCSVEPNTKQGNCCNGWRGETGGECLRVRQEMGRTWKSARGRPSPAKLHHRTQIQRYAIQSLNPLALLGGGVMEGAPREEEGTGEREGKAVVGEEKPGSSSRRRRERCRGAAAGANLHHWHVRWPAVRFPNDDEVEEEQEEGDPPAHSDSSHSEHVSWVCAAIVDVVVVGADREKGLWACGIAATASAPTEHGKGGWLARSGSTGAAAAAKKKEAAETYADAGRRPHRRMPTLPLPVVVAGSRSPNADAGAPRRWCPPRPPPQLRPRRHRPLPLALSAIPPAV

SEQ ID NO: 54635 - protein, 515 aa, Bacillus halodurans C-125
MLQPYKHEPFTDFTVEANRKAFEEALGLVEKELGKEYPLIINGERVTTEDKIQSWNPARKDQLVGSVSKANQDLAEKAIQSADEAFQTWRNVNPEERANILVKAAAIIRRRKHEFSAWLVHEAGKPWKEADADTAEAIDFLEYYARQMIELNRGKEILSRPGEQNRYFYTPMGVTVTISPWNFALAIMVGTAVAPIVTGNTVVLKPASTTPVVAAKFVEVLEDAGLPKGVINYVPGSGAEVGDYLVDHPKTSLITFTGSKDVGVRLYERAAVVRPGQNHLKRVIVEMGGKDTVVVDRDADLDLAAESILVSAFGFSGQKCSAGSRAVIHKDVYDEVLEKTVALAKNLTVGDPTNRDNYMGPVIDEKAFEKIMSYIEIGKKEGRLMTGGEGDSSTGFFIQPTIIADLDPEAVIMQEEIFGPVVAFSKANDFDHALEIANNTEYGLTGAVITRNRAHIEQAKREFHVGNLYFNRNCTGAIVGYHPFGGFKMSGTDSKAGGPDYLALHMQAKTVSEMY

SEQ ID NO: 54636 - protein, 464 aa, Citrus junos
MAFFRSVTALSRLRSRVGQQSNLSNSVRWLQMQSSSDLDLHSQLKEMIPEQQERLKKVKSELGKAQLGNITVDMVIGGMRGMTGLLWETSLLDPDEGIRFRGLSIPECQKLLPAAKPDGEPLPEGLLWLLLTGKVPSKEQVDGLSKELRDRATVPDYVYKAIDALPVTAHPMTQFASGVMALQVQSEFQEAYEKGIHKSKYWEPTYEDSLNLIARVPVVAAYVYQRIYKDGKIIPKDDSLDYGGNFSHMLGFDDPKMLELMRLYVTIHSDHEGGNVSAHTGHLVASALSDPYLSFAAALNGLAGPLHGLANQEVLLWIKSVVDECGENVTTEQLKDYVWKTLNSGKVVPGFGHGVLRKTDPRYTCQREFALKHLPDDPLFQLVSKLFEVVPPILTKLGKVKNPWPNVDAHSGVLLNHFGLAEARYYTVLFGVSRSLGICSQLIWDRALGLPLERPKSVTLDWIE

SEQ ID NO: 54637 - protein, 290 aa, Rickettsia slovaca
AYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGI

SEQ ID NO: 54638 - protein, 199 aa, Desulfotalea psychrophila LSv54
MVVIEKNRKSAISRKTTETDIQLELNLDGAGQHLIDTGVPFLNHMLTLFSVHGFLDLSLRAEGDIDIDDHHTTEDIGIVLGQAIAQALGNKGGISRYASVYLPMDEALVRIVIDLSNRPYLHYNAPVIEQKLGTFDSCLVKEFFRAVSQQAGMTLHIDMIHGENGHHIVEAIFKGFGRALSLAIEPLGTDGALSSKGCL

SEQ ID NO: 54639 - protein, 467 aa, Flavobacteria bacterium BBFL7
MRSLLNCLKITTDMRHILIIGAGKSTGVLVDYLLKKSEEENLKLLIADKNIDQAKLLSQNHKNADAVELDIFNEDQRRAYVQKASIVISMLPARFHIEVARDCITYGKSMVTASYVSPEMQALDEDAIKKNLIFMNEIGVDPGIDHMSAMQVLDRIRAKGGKILLFESFTGGLVAPENDDNLWNYKFTWNPRNVVTAGQGGAAKFIQEGQYKYIPYHKLFRRTEFLDVDGYGRFEAYANRNSLKYRSVYGLDDILTLYRGTMRRVGFSKAWNMFVQLGMTDDTYVIEDSENMSYRDFVNSFLPYSPTDSAELKMRHILKIDQDDIMWDKLVELDLFNATKKVELKEATPAKILQKILEDSWTLQSGEKDMIVMYHKFGYELDGHKKQIDSTMVCLGDGEMQTAMAKTVGLPVAIAALKILNGEINTPGVQIPITAPIYEPILKELEDYGIRFRESEMEYLGYNPLSL

SEQ ID NO: 54640 - protein, 678 aa, Magnaporthe grisea 70-15
MNGATQALSGASEAPSTEDAQQQQSSSGSNGTPAGEGNGAAAAAAAAAAGLKKRKKDALKPIITTENPAPTSQPALAAGVAACHSSIAETGSPFVILLPARAQSSNAFPPTEPKPSQAYASSQPSREPAHSALGQGLDWTGQDTPPSQRNPHRPPPRCFEIHAPRRSKTAHLSAHSPTSSSSHDDPENTADEEDSEDYCKGGYHPVQIGEKFKDGKYTIVRKLGWGHFSTVWLSRDNSSGKHVALKVVRSAAHYTETAIDEIKLLNKIVQAKPDHPGRKHVVSLLDSFDHKGPNGTHVCMVFEVLGENLLGLIKKWNHRGIPMALVKQITKQVLLGLDYLHRECGIIHTDLKPENVLIEIGDVEQIVKRVVKSEPSDKENNRNGRRRRRTLITGSQPLPSPLNATFNHANLFPSPSSQHSSLGQMLHDGAKSKSSTSPRRDGDDKQKQREKSADLLSREVSGISLDKTGEKRKADDNHGFDVISVKIADLGNACWVSHHFTNDIQTRQYRSPEVILGSKWGASTDVWSMAAMVFELITGDYLFDPQSGTKYGKDDDHIAQIIELLGPFPKSLCLSGKWSQEIFNRKGELRNIHRLRHWALPDVLKEKYHFKEEEAKRIAEFLLPMLELVPEKRANAGGMAAHLWLDDTPGMKGVKIPGLDAGSRGEGIDGWANEVRKR

SEQ ID NO: 54641 - protein, 331 aa, Helianthus annuus
MGKKSWFSAMKKAVSISKIKKEKRSNKSKSNPKNSLQVNQVSLDACSSHTEAALANPIPQYHSIMDTEFIVPENEQIKHVDVDTITYTTIVAEDVVSQSAATSEEISATKIQAAYRGYTARRAFRSLRAMRRLKLWLQGQAVKRQTTSALMRIQTMGRVQSQVRARSMRMAEVNETLQRQQIKKRQKVLEKQAFDLSPKSKAQVEASLRSKKEAAERREKALAYAFSRQQMWRNSQSPKSAVVDPKHFDWAWSWSNRWDAIRPRETGAMVRPQSPPSKPALSSGQRSTSPKSVIPKASPRRVNTGCRVGLANKRHLVTSTPFTGAARIAVR

SEQ ID NO: 54642 - protein, 331 aa, marine gamma proteobacterium HTCC2143
MSLTTKEVQLKSRPDGIPAASDFEIVARKIPSPDDSQVLIQNIFMSVDPYMRGRMRDDFQLGAVMEGATVGKVIESRHPDFQVGDYVTHWKGWREHYLSDGKDLDKVDPDLAPLSAYLGVLGFPGLTAYGGLLTTGALQDGESVFVSAASGAVGSLVGQIAKIKGCTVVGSAGSDEKVTHLIEEFGFDHAFNYKTADIDAELTKALPRGIDVYFENVGGPQLEAALNHMRMYGRIPLCGMISMYNNGPTIAPGPKNLSAMIYKRVTMKGLVTPDYIDQQAQFREDVGQWIKDGKVKYKETIHQGIESAPQSFIELFSGGNEGKMLVQLAEQ

SEQ ID NO: 54643 - protein, 430 aa, Aspergillus oryzae
MTPLVFLRRACSPTCSRLQPVTRDRLLASFSNSTPWPRSSPISSSSPPPRRSFHSTRSLDSESPRISYRVAASSSGKGRRFHPAKNTSDFDPQRHHAIGVATDVKSPAIRRQRRPDSGEDAYFVSRVGQHDNGAVAFAVADGVGGWAESRVDPADFSHALCGYMAQSALDWDAPAEQLRAKALLQAGYDQVVADESIRAGGCTASVGVGLDDGRVELANLGDSGSVLLRLAAVHHYSVPQTHGFNTPYQLSIIPPRMRTQASIFGGAFLEDFPRDAAVTNLQMQHGDVLLLATDGVFDNLNNQDILKLITSRMVLTGAWTATPDVGIKPSIDLDQLTGPEGLASLIPSSSTQASQHHRSTNKSHLYSLPSLLAATIAGEAKLASVDMRRDGPFAKEAQRYYPGDWYRGGKVDDIAVLAVVAVEEGYVPSP

SEQ ID NO: 54644 - protein, 350 aa, Brassica oleracea
  misc_feature (227)..(227): Xaa can be any naturally occurring amino acid
  unsure (1)..(350): unsure at all Xaa locations
PLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPEAPLDKVCIVSCGLSTGLGATLNVAKPKKGQSVAIFGLGAVGLAAAEGAKIAGAGRIIGVDLNPKRFEEAKEFGVTEFVNPXEHDKPVQQVIAEMTNGGVDRSVECTGSIQAMIQAFECVHDGWGVAVLVGVPSKDDAFKTHPMNLLNERTLKGTFFGNYKPKTDIPGVVEKYMNKELELEKFITHTVPFSEINKAFDYMLKGES

SEQ ID NO: 54645 - protein, 267 aa, Nostoc sp. PCC 7120
MENFVTPPAFGEKIRERWTLAGRKALITGATKGIGLAIAQEFLALGAEVVIVARNAEAIEQQMKAWHSAGKVHGVAADVSTSEGRQMMLDYVSKTFGELDILVNNVGTNIRKKATDYTEEEFAAIFQINLTSIFELSRLFYPLLKTSKNSSIVNIGSVAGLISVRTGAPYGMTKAALVQLTRSLAVEWADDGIRVNAIAPWFIQTPLTEPLLNNPETLSAVLSRTPMKRVGQPEEVASLTAFLCMPTASYITGQCIAVDGGFLAFGF

SEQ ID NO: 54646 - protein, 395 aa, Arabidopsis thaliana
MSSPERKRKRVTSTKNPSVKKKKKISPVPTPIPSLPDDLLVSIFARVSRLYYPILSLVSKSFRSLLRSPELYETRSLLGRTESCLYLCLQEGNPDPNPLWFTLCMKPDRTLKNGKKKKKKKMSSGNLLIPIPVPNPPLEHWSGHASVGSDIYFFGGYMEENVRSSRVVILDCRSHTLREAPSLQMERSDPAASVIDGKIYVAGGVDGDDADSLYPIEVFDIKTQIWDHRPIPYWEKDWGALSRSAYVDGKFYLTIGMKVMAYDLEESRWDFAGYQMGQSWFWSCNCVIENVLYCYGDAFRWFDTKLRLWKVMKVKGLPKLSRNVDVKIADYGGKMAIFWDNPSPSASDTNKIIRCAVIALERPNSEEIWGTVEWHEAVLTVPVSYEFEHALAVTV

SEQ ID NO: 54647 - protein, 674 aa, Hordeum vulgare subsp. vulgare
MFPLGARQPPPSAMDNQQQQQPPRGEHAAQPRCWEEFLHRKTIRVLLVETDDSTRQVVAALLRHCMYQVIPVENGHQAWAYLQDMQSNIDLVLTEVFMHGGLSGIDLLGRIMNHEVCKDIPVIMMSSHDSMGTVLSCLSNGAADFLAKPIRKNELKNLWAHVWRRSHSSSGSGSGSAIQTQKCTKSKSGDDSNNNSNDRNDDASMGLNARDGSDNGSGTQSSWTKRAVEIDSPQDMSPDQSADPPEGTCAHVNHPKSEICSNRWLPGTNNKKCQKPKETTNGDGFKGKELEIGAPGNLNTDDQSSPNESSVKPTDGRCEYLPQNNSSDTVMENLEEPIVRAADLIGSMAKNMDAQQAAARAIDAPNCSLQASEGKDTDGENAMPYLELSLKRSRSTGEGAGPIQEEQRNVVRRSDLSAFTRYNMCAVSNQGGAGFVGSCSPNGDSSEAAKTVAAQMKQGSNGSSNNNDMGSTTKSVVTKPCGNNKVSPINGNTHTSAFHRVQPWTPATAAGKDKADEVSKKNVAAAAAAAKEMGCEAQSKHPCAAADDVNGGSAGGTAQSSVVNPSGPVEGHTANYGSNSFSNNNTNNGSTAATTAAAAAVHAETGGGVDKRSNMMNMKRERRVAAVNKFREKRKERNFGKKVRYQSRKRLAEQRPRVRWQFVRQPPAPATVER

SEQ ID NO: 54648 - protein, 400 aa, Hordeum vulgare subsp. vulgare
MDCCFPCPGARRKRKPPAPAEKPQIPPAPDKAKPGCSSSSAAARQDSLLEAKKEFVLSNGSEHRHIAAQTFTFRELAAATNGFRADCLLGEGGFGRVYKGYLESINQVVAIKQLDRNGLQGNREFLVEVLMLSLLHHPHLVNLIGYCADGDQRLLVYEYMPLGSLEDHLHDPSPDKPRLDWNTRMKIAAGAAKGLEHLHDKTNPPVIYRDLKCSNILLGEGYHPKLSDFGLAKLGPVGDKTHVSTRVMGTYGYCAPEYAMTGQLTLKSDVYSYGVVLLEIITGRRAIDNTRATGEQNLVAWARPLFKDRRKFPQMADPALEGRYPARGLYQALAVAAMCVQEQPTLRPLIGDVVTALSYLASQPYDPEVHGVHRPSRLTASGTPPRSRNHGADRQRGGSE

SEQ ID NO: 54649 - protein, 359 aa, Synechococcus sp. RS9916
MRQHRVVLLPGDGIGPEITAVARRLLEAVSERHGFTLSFEDQPIGGSAIDATGEPLPASTLAACRAADAVLLAAIGSPRFDSLPREKRPESGLLALRAGMELFANLRPVKIVPALIDASTLRPEVIEGVDLMVVRELTGGIYFGQPKGRVEADGEERGFNTMTYSSSEVDRIARVAFDLAKERRGQLCSVDKANVLDVSQLWRDRVDAMAPDYAGVEVSHMYVDNAAMQLVRAPRQFDVLLTGNLFGDILSDEAAMLTGSIGMLPSASLGSDGPGLFEPVHGSAPDIAGQDKANPMAMVLSAAMMLRIGLKEAQAASALEAAVDQVLADGFRTGDLMAEGCTALGCKAMGEALLKALDR

SEQ ID NO: 54650 - protein, 152 aa, Coccidioides immitis RS
MSLEQTFIAIKPDGVQRGLVGPIISRFENRGYKLVAMKLVSPSKEHLEKHYADLSDKPFFKGLVTYMLSGPICAMVWEGRDAVKTGRTILGATNPLASAPGTIRGDYAIDVGRNVCHGSDSVENAKKEIALWFSEGELIKYKHSQHEWIYEA

SEQ ID NO: 54651 - protein, 414 aa, Schizosaccharomyces pombe 972h-
MISSAVILVGGPSRGTRFRPLSFDVPKPLFKIGGREMIYHHLAALSKIESVKDVFLVGFYDESVFKDFINEVASHFPSFNRIKYLREYNCLGTGGGLYHFRDQILKGHTSNVFVMHADVCCSFPLQELLNVHHEKKALVTLMATKVSKEDASNFGCLVEEPSTGRVLHYVDKPSSYLSNIISCGIYIFDASIFDEIKKAYERRLEEVEKQLRSLDEGMEDYLSLETDVLAPLCSDSSKAIYAYNTPEFWRQIKTAGSAVPANSLYLQKAYHDGTLPKPDTEAEIIQPVFIHPNAIVSKGAKIGPNVSIGARVRIEDGARIRNSIIQEDCEISANAVVLHSILSRHCKIGKWSRVEGSPTLPSQHSTTIMRNSVKVQAITVMGADCIVHDEVRVQNCLVLPHKEIKVGLVGEIVM

SEQ ID NO: 54652 - protein, 125 aa, Streptococcus suis 89/1591
MKTIHTDKAPAAIGPYVQGKVVGNFLFASGQVPLSPETGEVVGETIQEQTEQVLKNIAAILSEAGTDFDHVVKTTCFLKDMNDFVAFNEVYKTAFSADFPARSAVEVARLPRDVKVEIEVIAVID

SEQ ID NO: 54653 - protein, 386 aa, Kluyveromyces lactis NRRL Y-1140
MFRKAIAIGGISLRRTFASSMIRKANQPGMMKAMVYYGANDLRFEDRAIPKIIDQRDAIIKMTNTSICGTDVGIWKGKSPEIEEIAVKNEGSFNGRVLGHEGTGIVTEVGDAVRNIKKGDKVIISCITRCGTCENCARGMYAHCMNDGGWALGYSIDGTQAEYVRTPFADTSLYALPEGLSDENAVLLSDALPTAHEIGVQMGNVKPGDSVAILGAGPVGMGCVLTSQLYSPSLLIVVDMDDNRLEMAKEMGATHTINSGKEDAVAKILEITNGRGVDCAMEAVGAQPTWDICQQIIKEGGHLANVGVHGKPVDFAIDKLWIKNLTITSGLVNTNTTSMLMKNCCSGKLQSDKLVSHHCNFKDMANNYNIFKHAAKEKALKLLISF

SEQ ID NO: 54654 - protein, 326 aa, Pediococcus pentosaceus ATCC 25745
MAQKTYIQAITEAQDLALANDENVVIFGEDVGKNGGVFRATDGLQAKYGEDRVFNTPLAESGIGGMAIGMTTQNYRPIMEIQFFGFVYEVMDSLAGQMARGRFRFHGTRTFPIVVRSPYGGGTKTPEMHADSLEGLVAQTPGLRVVMPATPADAKGLLLSAVESNDPVIFLENLRLYRSIRGDVPEGYYTTPLDKANVIREGKDVSIITYGGMVHTSLAAAEELAKDGIDAEVVDLRTVSPLDLDTIGESVEKTGRVVVAQEAQRQAGIGAMVMSEISERFIMSLKAPIGRVAAPDSVYPFALAENEWLPKADDIIEKVKEVVNFD

SEQ ID NO: 54655 - protein, 1052 aa, Monascus pilosus
MASAAVTPKLGWVQHQVTNGLHAVVGQVCRHPIHTLLVTALIAATTYLHVLEGTFRAANLGPGSKTDAAPFDVQSFLWGSRSLRLGETSSWRWQVGDLSEATGDGQVNHHWALVTLSFPGASVDDRSPAFLWNALPDSVGAEPITPTSNFFTSISNEFSLAFRVPYTQLSDFLEAVEFVASDKEDRSWAIRFPHGEGKPISLGRWLGNSWLSFLHRAKHAETVDMAIIGLGYLALNMTLVSLFRAMRQLGSRFWLAASVLLSGAFAFVFGLGVTTACGVPVDMLLLSEGIPFLVLTVGFEKPIRFTRAVLYASNQLRRGLQQRDVADKHDSRQRHMIPNAMLFAINREGWSIVQSYLLEIGALALGAVFRPRERFGQFCFLAAWMVLFDAILLFTFYATILCVKLEVTRMQNPGTLDLADDQHGPRIFGYKVNPTSLARWKLIMVGGFVLFNVLQLSSFFYRIMGGFMTNAALTPTTVSPFKVAANGLNDIYLAARAGGVETWVTVLPPIRYVMEASGLEMSAGRRPVFDGVLAGLESPLGRLCLMGALVFSLYLNNHLIPAARWHFSPGAPKESAAPAPPSSPASVPSAVPVPAPSSRSFEEIEALFKANQAESLTDDELAELCLRGKIAGYSLEKTLESIASAGSSSTATTRLEAFTRAVRIRRAAVSRTPSTRDLSGGIQESLLPYRNYNYELVHGACCENVIGYLPLPLGLAGPMVIDGQAYFIPMATTEGVLVASASRGCKAINTGGGAVTMLKGDGMTRGPCLGFPSAKRAAEAQRWVESPVGHQVLTDAFNATSRFARLQTLTVAQAGTYLYIRFRTTTGDAMGMNMISKGVEKALQAMTAHGFPDMNTITLSGNFCADKKSAAINWIGGRGKSVIAEATIPADTVRKVLKTDIDALVELNTAKNLVGSAMAGSMGGFNAHASNLVQAVFLATGQDPAQNVESSSCITTMKKIDGNLHIAVSMPSMEVGTIGGGTILEAQGAMLDLLGVRGAHPTDPGANARRLARIVAAAVLAGELSTCSALAAGHLVNAHMRHNRSAASSEKK

SEQ ID NO: 54656 - protein, 372 aa, Pediococcus pentosaceus ATCC 25745
MAVKDDNKQVLDFNLQMEKQTDSFPMLQVLNNDGEIVDEDALKEAGLSDDQLVELMKQMVFSRVLHERSTKLAKQGRLGFYAPTIGEEASQIASNYAFEKGDWLFPGYRDIPQLVMKGWPIYKAFLWSRGHYEGNEFDDVNGWMPQIIIGAQYVEAAGAALGLKMRKQPNVAYAYTGDGGTSQGDFYEGMNFAGAYNAPAVFFSQNNEYAISTPRKLQTKAPHLAAKGWAAGLPSLVVDGMDPIAMYLASKKARQWAVDGNGPVFIETITNRLGAHSMSGDDPLRYRTQEEIDEWTKKEPLIRFRKYLEGLGFWSEEIENDWTEVVNEQIDDGVKQADGIDKQKISDFIEQTLEVPGQAAQEQINKFRGEGK

SEQ ID NO: 54657 - protein, 190 aa, Medicago truncatula
MGSSDVEYRCFVGGLAWATDSQALEQAFSKFGEITDSKVINDRETGRSRGFGFVTFAEEKSMRDAIEEMNGQDIDGRNITVNEAQSRGSGGGGRGGGGGGYGGGGGYGGGGGGYGGGGGRRDGGYSRSGGGGGYGGGGDRGYGGGGGGGYGGGRDRGYGGGGGDRGYGGGGGGDRYSRGGGADSGGNWRD

SEQ ID NO: 54658 - protein, 770 aa, Flavobacteria bacterium BBFL7
MSKDSKRREALVYHAKPTPGKIKVVPTKKYSSQRDLSLAYSPGVAEPCLEIAKDKANVYKYTTKGNLVAVITNGTAVLGLGDIGPEASKPVMEGKGLLFKIFADIDCFDIEIDTKNVDEFIQTVKNIAPTFGGINLEDIKAPEAFEIEKRLKEELDIPVMHDDQHGTAIISSAALLNALEIADKKIEDVKIVISGAGSAAISCTNLYAKLGARKENILMFDVDGLITTSRTDLGPEQMEFARDMDPITLVDAFKGADVFLGLSVGNIVSPAMLLDMNENPIVFAMANPNPEIEYDTAIATREDLIMATGRSDHPNQVNNVLGFPFIFRGALDVRASKINEEMKLAACHAIAQLAKEPVPEQVNIAYGETKLNFGREYIIPKPFDPRLISTIPPAVARAAMESGVAMEPIQDWEKYEDQLLSRMGSDNKLIRLILNRARTNPKRIVFAEADNLDVIKAAQIVHEDGIATPILLGRRDVIEELMTEIDWDDKILIIDPKSDEEKPRKDRYANELWQMRARKGVTEFDAGKLMRQRNYFAAMMVKLGDADAVITGVAQSFPISVKPMMEIIGKSPGVQKVATTNLMITDRGPIFVSDTSININPDATELAKIAQMTARTARMFGIDPAVAMISYANFGSSDHPHARKVTEAVNYLHRYYPDITVDGEIQADFALNPELLKKKFPFSKLAGKKVNTLVFPNLESANSTYKLIKELYNTDSIGPIMMGMQKPVHILQLNASVDEIVNMAAVAVIDAQQKEKHEQKREQATRNSAN

SEQ ID NO: 54659 - protein, 251 aa, Brassica oleracea
MGDDIKFTWVIKKFSSLVSNKSYSDKVVIGGCKWSLMAYPGGNSKASTLCLSIWVNDGPNVCSGWSEHAKLSCTIVNKNPEKVSQLEETYRAEHTKWGFTSIIPLSELEDENGGFIVNGEVKIVVEIEIFVLVKQPLKKTKLNDKGELVDVNGFQVLPSQVSSSSFTDLVEADNALAYVKNAGFKVDWLEKKLTKVKENKGKVHIGEIRMRELEEELKNLKQKSLEVEALLEKEKADVLAAKTHLTLDEFV

SEQ ID NO: 54660 - protein, 173 aa, Synechococcus sp. CC9605
MSIFVGNLPFRAEQEDVIELFAQFGEVTNCALPLERDTGRKRGFAFIEMADESTEEAAIEGLQGAELMGRPLRINKAEPRGSAPRRGGGGYGGGGGGGYGGGGGGYRGGGGGGYGGGGAGDRPSGARGWEDRSYGARDSAGEGNAYDEGRSRRRRGSSSGGGDEYSGYGGAEG

SEQ ID NO: 54661 - protein, 437 aa, Arabidopsis thaliana
MHRASSKHTNAKKEAISTSKIRDNNVRVTRSRAKALGVSNSPSKPAFKHETKRVARPSNKRMASDNITVCNQKRRAVLKDVTNTLAESIISTEGNVKACKRGGKETKQIEEDGLVDVDGEKSKLAEDLSKIRMVESLDASASKQKEDRSDVTDCVQIVDIDSGVQDPQFCSLYAASIYDSINVAELEQRPSTSYMVQVQRDIDPTMRGILIDWLVEVSEEYKLVSDTLYLTVNLIDRFMSHNYIEKQKLQLLGITCMLIASKYEEISAPRLEEFCFITDNTYTRLEVLSMEIKVLNSLHFRLSVPTTKTFLRRFIRAAQASDKVPLIEMEYLANYFAELTLTEYTFLRFLPSLIAASAVFLARWTLDQSNHPWNQTLQHYTRYETSALKNTVLAMEELQLNTSGSTLIAIHTKYNQQKFKRVATLTSPERVNTLFSR

SEQ ID NO: 54662 - protein, 378 aa, Synechococcus sp. CC9605
MADFYDLLGVSRDVDPDSLKRAYRRMARQYHPDINKDPGAEDRFKEIGRAYEVLSDPQTRARYDQFGEAGLGGAAGAPDMGDMGGFADLFETFFQGFGGPGGAGAGRPRRQGPQQGDDLRYDLTIDFEQAVFGQEQEIKIPHLETCDTCGGSGAKAGSAPTTCGTCGGAGQVRRATRTPFGSFTQVAECPNCGGTGQVISDPCGSCGGQGVKQVRKKLRINIPAGVDTGTRLRVTGEGNAGPRGGPSGDLYVFLTVRNHPRLQRDGLNIFSEVKVSYLQAILGDTIEVETVDGSKELDIPAGTQPGTVLTLPNLGIPKLGNPVARGDQRVTVTVDLPKRISDLERELLEQLAGHHSARGKQHHHHNSGLFARLFGQKG

SEQ ID NO: 54663 - protein, 255 aa, Triticum aestivum
MASTNGGFVSPLAATVPVEAVLFDIDGTLCDSDPLHHIAFQELLLAIGYNNGVPIDDEFFINNIAGRSDAEAAQNLFPDWPLEKGLKFLEDKDVKYRSPFFCYSLAMERLEPVKGLHKVVQWVKDHGYKRAAVTNAPRINAELMIKLLGLSDFFQAVIVGGECEKPKPAPFPYLKALKELEVSAAHTFIFEDSASGTRAGVAAGMPVVAVSTRNPVKSLQEAGAALIVSDYEDQKLWNALEEIDREEAKLKTGGA

SEQ ID NO: 54664 - protein, 131 aa, Yersinia intermedia
MRKTGDIDRVMSARQLPNKALALILAGGRGSRLKDLTSVRAKPAVHFGGKYRIIDFALSNCLNSGIRRIGVITQYQSHTLVQHIQHGWSFLSEEMNEFVDLLPAHSAQGQNHWYTGTADAVFQDLDIIRRR

SEQ ID NO: 54665 - protein, 478 aa, Arabidopsis thaliana
MHDWLVEYLYNSRTVVVPMPFTTYTYIADPINVEYVLKTNFSNYPKGETYHSYMEVLLGDGIFNSDGELWRKQRKTASFEFASKNLRDFSTVVFKEYSLKLFTILSQASFKEQQVDMQELLMRMTLDSICKVGFGVEIGTLAPELPENHFAKAFDTANIIVTLRFIDPLWKMKKFLNIGSEALLGKSIKVVNDFTYSVIRRRKAELLEAQISPTNNNNNNNNKVKHDILSRFIEISDDPDSKETEKSLRDIVLNFVIAGRDTTATTLTWAIYMIMMNENVAEKLYSELQELEKESAEATNTSLHQYDTEDFNSFNEKVTEFAGLLNYDSLGKLHYLHAVITETLRLYPAVPQDPKGVLEDDMLPNGTKVKAGGMVTYVPYSMGRMEYNWGSDAALFKPERWLKDGVFQNASPFKFTAFQAGPRICLGKDSAYLQMKMAMAILCRFYKFHLVPNHPVKYRMMTILSMAHGLKVTVSRRS

SEQ ID NO: 54666 - protein, 437 aa, Frankia sp. EAN1pec
MDEFSYRDGTLWCEQTELREVAEKFGTPTYVYSAATLVDHYVRFAKAFESINPLICFSAKALSNVHLLRLLAGQGAGIDTVSGGELHRALVAGVDPERIVLAGVGKSVDELRAAVRHDIRCINVESEAEVELLARVAREEDRRPRLAIRVNPDIAPDMRTPARTTTAIRGAKFGVDIERAAALFRAASTDEFLRAEGFHVHIGSPIFDPRVYATALDRILALTAGLEADGHSVTTLNVGGGFPAEYTEGSAPGWDDFAEAICPRLQGFVDRGGQVVFEPGRTIAANAGILLATVRYRKRAGDRELVVIDAGMTHIVRAAMYDSYHFMWPVTPVNGTVPRSRDQQSIDDLVDYDVVGPICESSDYLAKGRALPAMVSGDLIAIFSAGAYGMTMTSNYNSQLRPAEVLVRGGRADLIRRRETYDDLVALELLDGLTPPL

SEQ ID NO: 54667 - protein, 449 aa, Schizosaccharomyces pombe 972h-
MPKAPKTKLHHAPLYKDIAESSESGVLRQKPSKQKKSKESNTGNGFLDAKTSKKILQLAREQKEELDEEENGKPSQISAFISNGHQKDTLENPAIESSYEESEHARNVSDSESITSQEEEEYEELEIDDADRDLFDRFLPTVSGEEGDLTEEKTTSLSDLIMQKINEAEARARGEYIPSAEEEENALPPLPPKVIEVYSKVGVLLSKYRSGKIPKAFKIIPTLSNWEDILYLTRPDMWTPHACYEATRIFISNLKPVQAQHFLTVIILERVRDDIRENKKLNYHLYMALKKALYKPSSWFKGFLFPLVQENCTLREAAIIGSILQKVSVPVLHSAAALLRLTEFDLSGATSVFIRILLDKKYALPYKVLDSLVFYFMRWKSLERPLAVLEHQSMLVFAQRYKFDITPEQKDALLEVVRLKGHYSIGPEIRRELLNSASRGEEIPVEMEY

SEQ ID NO: 54668 - protein, 311 aa, Flavobacteria bacterium BBFL7
MKTIDILCIGEILIDFIGHEKNASISDTKNYHRFLGGSPTNVAVNAARLGLNSAIIASCGKDGLGDFIVDKLKDNDVDTSYIHRASGLPTSIILVSKSIDTPDFTAYREADCVIPEELVTDALLDLSKIYHTTCFALSKNPARNTILKGAQRASQLGLQLSIDLNYSEKIWPDRKKAKEVISEYLSYNPLLKISIDDCYRYFDSHKSDDEIFDYFHSLGVTTICLTKGKEGVTVSDLNFGLLHQEALKISDIKDVTGAGDAFWAGFLYAQIQSKSLRESISMAQKLATIKLQNVGRLPDMVGLKNIFNDLV

SEQ ID NO: 54669 - protein, 164 aa, Medicago truncatula
MASADVEYRCFVGGLAWATDSEALEKAFSQYGEIIDSKIINDRETGRSRGFGFVTFADEKSMRDAIEGMNGQDMDGRNITVNEAQSRGSGGGGGRGGGGYGGGGGGYGGGGRREGGYNRSSGGGGGYGGGGGGGYGGGRDRGYGDDGGSRYSRGGGGDGGSWRS

SEQ ID NO: 54670 - protein, 418 aa, Fagus sylvatica
MAIETKHPEAVPADETCSAKCSKQGEGLKQYYLQHIHEHQLQVRQKTHNLNRLEAQRNEFNSRVRMLREELQLLQEPGSYVGEVVKVMGKNKVLVKVHSEGKYVVDIDKNIDITKITPSTRVALRNDSYVLHLILPSKVDPLVNLMKVEKVPDSTYDMIGGLDQQIKEIKEVIELPIKHPELFLESLGIAQPKGVLLYGPPGTGKTLLARAVAHHTDCTFIRVSGSELVQKYIGEGSRMVRELFVMAREHAPSIIFMDEIDSIGSARMESGSGNGDSEVQDHMLELLNQLDGFESIKQIKVLMRTNRIDILDQALLRPGRIDRKIEFPNPNRESRFDILKIHSRRMNLMRGIDLKKIAEKMNGASGAELKAVCTEAGMFALTAERRVRLVTQEDFEMAVAKVMKKETEKNMSLRKLWK

SEQ ID NO: 54671 - protein, 326 aa, Wolbachia endosymbiont of Nasonia giraulti
TITFIDGDEGVLKYRGHNIADLAENNNFTAVIYLLLYGELPSSEQHKKFLLKIQESSKVSEQVTNVIKAFPKTAHPMSILVACFANLSASYHEMHGKNVNGEDLDFGISAIAKVPAIVAMIYRHINNQEFINANNKLSYSENFLNMIFGSAVNNTLFVKALDKIFTLHADHEQNASTAAVRLVGSAGSNLFASLSAGVATLWGPAHGGANEAVINMLKEIEQSGDVDRFIEKAKDDKDPFKLMGFGHRVYKNYDPRALILKDACHEILSKLEQNNELLEIAKKLEEIALKDEYFITRKLYPNVDFYSGIIMNAIGIPSSMFTPIFA

SEQ ID NO: 54672 - protein, 449 aa, Flavobacteria bacterium BBFL7
MREIAQVPALTFLAKSRQIYKDPLPFHRENFEKYGNTFKISPKPGLMIHFTCDEKITQHILQKNQKNYHKSSLQTEDLGKYIGHGLLTENGEKWRANRKLIQPAFYKKSINNFMATMDVVVKEELDRIQLDEITDVYAIFNDLAFKVVARSLFDFADIENLEQKISRLQEITEQAQNMLIKELRIPWMKWYFDREWLSGTNSVPYALKMVDEARDILYAIISNRRRSKNEPGDLLDMLLHSTYEDGSYMDDDQLVDEILVLFIAGHETTANALSFAVQLLAHHPETIEKAREDVSKANLDETLMNQLMAMPYLKQCVEETLRLYPPAYVTDREALEADECDDIFIEKGSIWLVSFYEMHRRKDLWENPESFDPSRFEPSKAKSYREFYFPFGAGPRMCVGNNFAMMEMMLVIRRMVERFEITTVQDHIDYHPLITLKPKNANLVFKPRV

SEQ ID NO: 54673 - protein, 426 aa, Bacillus halodurans C-125
MATEITMPQLGESVTEGTISRWLVKPGDKVNKYDPLAEVLTDKVNAEIPSSFSGTIQELLVEEDETVAVGHVICTMNVEGEAVEAETNDTSVSSAETTESPTETQEQSTSAKKRYSPAVLRLAEEHDIDLTHVTGSGKGGRITRKDLQAIIEGGDIPKAAPMTEQKTAPVHETMPLTEKVQEPVQVPTVSGDVEIPVSGVRKAIAQNMVKSKHEAPHAWTMVEVDVTNLVQLRNQLKEGFKKKEGFNLTFLPFFIKAVVEALKAYPQLNSMWAGDKIIQKKDINISLAVATDDALFVPVIKHADEKTIKGLAREVNELAHKVRTGKVTSSDMQGGTFTVNNTGSFGSVLSTPIINHPQAAILSVESIVKRPVVIESEAGDMIAIRSMVNLCLSLDHRVLDGLICGRFLAKVKNILENMTIENTSIY

SEQ ID NO: 54674 - protein, 327 aa, Bacillus halodurans C-125
MAVMSYIEAVTLALKEEMERDENVFVLGEDVGARGGVFRATNGLYEQFGEARVLDTPLAESAIAGVGIGAAMYGMRPVAEIQFADFIMPAVNQIVSEAAKIRYRSNNDWQCPITIRAPYGGGIHGALYHSQSVEAMFANTPGLKIVMPSTPYDVKGLLKAAIRSDDPVLFFEHKRAYRLIKGEVPENDYTLPIGKADVKREGDDVTVITYGLAVHFALQAAERLEKDGISTHILDLRTVYPLDKDAIIEAASKTGKILLVTEDNKEGSIMSEVAAIIAEHCLFDLDAPIQRLAGPDVPAMPYAPTMEKHFMINPDKVEKAIRELAEF

SEQ ID NO: 54675 - protein, 171 aa, Glycine max
  misc_feature (117)..(117): Xaa can be any naturally occurring amino acid
  misc_feature (152)..(152): Xaa can be any naturally occurring amino acid
  unsure (1)..(171): unsure at all Xaa locations
MLGNGVVGILAESVNKWERRAPLTPSHCARLLHGGTGVSRIIVQPSTKRIHHDALYEEVGAEISQDLSQCGLILGIKQPKLEMILPDRAYAFFSHTHKAQKENMPLLDKILAERASXYDYELIVGDNGKRLLAFGKFAGRAGMIDLLRGLGXRVLSLGYSQPSCHLEHLHV

SEQ ID NO: 54676 - protein, 474 aa, Bacillus halodurans C-125
MAEEYDLVILGGGTGGYVAAIRATQLDLKVALVEKGKLGGTCLHKGCIPSKALLRSAEVFSTVQKADQFGVKIDGAALDFTSVQNRKEQIVTQLHRGVEMLMKKGKIDVYKGHGRILGPSIFSPTPGTISVEMNNGEDNMMLIPRNVIIATGSSPRVLPGMEIDGEAVLTSDEALKMEQLPKSMLIVGGGVIGIEWASMLNDFGVDVTVIEYGPRILPTEDADIAKEAERLLKKRGVTFKTNAKVLAETLEKGDNSVVIEAEVGGVSERFTAEKMLVSVGRTPNVNDIGLENTDIEVIDGAIAVNEWYQTKESHIYAIGDVIGGMQLAHVASHEGILAVEHMTDHKPEPLNYLTVARCVYSHPEMASIGLSEAEAKEKGYEVKVGTFPFQAIGKALVYGESDGFVKILSDKKTDDLLGVHMIGPHVTDMISEAALAKVLDAAHWEVAHTIHPHPTLSEVVGEAALAVDGKAIHF

SEQ ID NO: 54677 - protein, 429 aa, Xylella fastidiosa Temecula1
MSDLDKVTLNAGETSLVLPVLKPTLGNGCVDIAKLTKETGLFTYDSGFTATASCKSAITYIDGEKGVLLYRGYPIEQLAEHSSFLEVAYLLMNGELPRKDEFAKFDDEITHHTMMHESLKNFLGGFHYDAHPMAMLAASVASLSAFYHDTLDLNDLEQRRLAAIRLIAKVPTLAAAAHRYSIGWPIRYPRNNLGYVERFLHMMFEVPSEPLQLNPVVIKALDLLFILHADHEQNASTSTVRLVGSTGANPYASVAAGITALWGPAHGGANEAVLKMLEEIGDAKNVDLVIAKAKTKDKNSPFRLMGFGHRVYKHFDPRAKIIREMAHTVLGELGVNDPLLEVALKLEEAALKDDYFVQRKLYPNVDFYSGIIYKAINIPLEMFTVMFAIARTAGWVSHWLEQQVDPEMKISRPRQIYTGHRERDYKDAR

SEQ ID NO: 54678 - protein, 440 aa, Rhodobacter sphaeroides 2.4.1
MTFSRADFPADFLFGVATSAYQIEGHGAGGAGRTHWDDFAAAPGNVAHAEDGRRACDHYHRWEEDLDFVRDAGFDSYRFSASWARVMPEGRGTVNAEGLDFYDRLVDGMLARGLKPALTLYHWELPSALQDLGGWRNRDIAGWFADYAEVLLGRIGDRVWSTAPVNEPWCVAWLSHFLGHHAPGLRDIRAAARAMHHVLLAHGAAVESARGLGVGNLGAVCNFEHAIPADGSEASAAATRRHDALINRWFVSALFNRQYPEEALDGIAPHLPSGWEKDLDRIAQPLDWFGINYYTRKLVAAAPGPWPGLSEVEGPLPRTRMGWEIHPEGLSDILLRIHEGYTRGLPLIVTENGMAAADRVQAGEVQDPDRIAYLEGHLAAVQRAIAQGVPVRGYHVWSLLDNFEWAFGYDQRFGLVHVDFQNLQRTPKASYHALARALAR

SEQ ID NO: 54679 - protein, 748 aa, Cryptococcus neoformans var. neoformans JEC21
MAVSQSHPNIVDGWFREINTQWPGQAMTLKVKQVLHQEKSLFQDVLVFESETYGNVLVLDGVIQATERDEFSYQEMITHLPMASHPNPENVLVIGGGDGGVIREVLKHKSVKKVTLCDIDEAVIRVSKQWLPLMSDCYKDPRVEVHIGDGFKFLPEHKNEYDVIITDSSDPVGPAEALFQPPYFQLLKEALKEGGSVSTQAECLWIHLPLIKTLKETCSKLFPVVKYGFTTIPTYPAGQIGIMVCTKDSTRDLTVPLRAVPDTRYYNSEVHRAAFTIPEFGRAMLEDGVNVLPKFSGARPTTTKKKVLLLGSGLVAGPAANYIARHNHELTIACRTLASAEELASGLPNATPMSVDVSSADALRQAIKGHDVVVSLIPYTHHAQVMEAALEEKVHVVTTSYVNPQMRALEQKFKDAGLICFNEIGVDPGVDHLWAVKVFDEVKKAGGKIKSFYSFCGGLVEPAAADNALGYKFSWSPVGVLMALNNDGKYLKDGKVVEVAGKDLMSTAKPYYFTPAYNLVAYPNRDSTVFREFYGLEGVQNLCRGTMRYAGFCEVITAWKEIGLMSDAQVDYLAQGAAPITWIKVISQLLGVEAKEAAIIEKLKTLKSFETESRVLISKFRDLGLFSEEQVAQRGSVMRALSALLEEKCAFKEGEVDLVLLQHTFEIINADGSEQTITSSLEAYGDRNGGPSAMAKLVGVPCGMAVQFILEGVLNKPGVFAPYDEETCKLFRERLEKEEGITMVEKLV

SEQ ID NO: 54680 - protein, 317 aa, Rhodobacter sphaeroides 2.4.1
MADAPLCLVADIGGTNTRVALAEGSRLRPETTRRFRNADYPALAPVLRDFLSVAGSPEIDGTCVAAAGPVRDGVALLTNLAWTVDGAELQRATGAPRVAVLNDLQAQGHALGHLDPANLRVLIPGPTPRRGGPMLVVGVGTGFNAAPVHDVAGLRLVAASECGHAGMPVRTARDLRLAEFVQTAHGFAGVEDVLSGRGLERLYAFTAAEAGLEDRKSAAEIMAAIAEPGPARAAAELFARLLGAEAGNLALIHLPFGGLYLCGGVARAFAAHLGPMGFAENFRDKGRFSAFMDDFPVCIVEDDYAALTGCAAYLATL

SEQ ID NO: 54681 - protein, 324 aa, Wolbachia endosymbiont of Protocalliphora sialia
TITFIDGDEGVLKYRGHNIADLAENNSFTAVIYLLLYSELPSSEQHKKFLLKIQESSKVSEQVTNVIKAFPKTAHPMSILIACFANLSASYHETHCNNVNGEDFGISAIAQVPAIVAMIYRHINNQEFINANNELSYSENFLKMIFGDAVDNALFAKALDKIFTLHADHEQNASTAAVRLVGSAGSNLFASLSAGVATLWGPAHGGANEAVINMLKEIEQSGDIDRFIEKAKDDKDPFKLMGFGHRVYKNYDPRALILKDACHKILSKLEQNNELLEIAKKLEEIALKDEYFITRKLYPNVDFYSGIIMNAIGIPSSMFTPIFA

SEQ ID NO: 54682 - protein, 311 aa, Brassica oleracea
MAVRTHHPSRFLFVNNNGQEDNNCSLQPQDTHFTLIKAGVVDSRKRSRDVSSVGFLQFSSVTTPMNPPPPKPPQVIDMRELLQNHNRKTLNVVSTGLRLTHEQSQNQEQLLSPSSMLPGDLAGESKRQRDELDSFIQTQGEELQSKLALYGERRYVELLYAAEELAGRRVREKEAELEKATRRHAELEARAAQLTEEARTWQLRAATREAEVSSLQAHIQKVIASQATAEKQSAIGGETEEAEDAESVFVDPERIELIGPCCSICRRNSTTVMALPCRHLVLCKGCDGGGDVRVCPICLAVKNFGVEVLFS

SEQ ID NO: 54683 - protein, 72 aa, Glycine max
  misc_feature (34)..(34): Xaa can be any naturally occurring amino acid
  unsure (1)..(72): unsure at all Xaa locations
MASSMISSPAGTTVNPAGAGMDAAWAGLNFMAAXHSKKTNSDIPSIASSGSRVHRMQVWPTTGMRKFETLYY

SEQ ID NO: 54684 - protein, 708 aa, Aspergillus oryzae
MAVGPVTINGSGKSALPLVQQMSKDHDIVLKTFRMLISDLCQQFGGGHPGGAIGMAAIGVALWRYVMRYAPHTPDFFNRDRFILSNGHTCLFQYSFLHLTGYKAMTFDQLKSYHSDRVDALCPGHPEIEHEGIEVTTGPLGQGVANAVGLAMATKNLAAKFNQPGYDVVNNHTWCMIGDACLQEGVGLEAISYAGHLKLNNLTIIYDNNQITCDGSVDLTNTEDINGKMRASGWDVIDVEDGCYDVEGLVRALEQARASTEKPTFINVRTVIGLGSNVAGQAAAHGAAFGAPNVAQMKKENGFNPDEHFVIGETVRKFFEDLPARGESLVQEWKDLVKQYTAQYPELGAEFQRRMSGELPSNWKDLIPASFPEKPTASRASSGLVFNPIAKEIENFMVGTADLSPSVNMIWPGKVDFQHPDLRTTCGINGNYGGRYIHYGVREHAMCAISNGLAAYAPNTFIPITSSFFMFYLYAAPAVRMGALQHLQIIHAATHDSIGMGEDGPTHQPIELAALYRAMPNLLYIRPGDSEETAGAWIAAIEAKKTPTIISTSRHTLPQLKQTSRDSVARGAYVLEEAENAAVTLIGVGAELSFALEVANKLKEKGVVARVVSFPCQRLFEQQSLEYKRSVLQRHRGIPAVVIEPYAPNGWERYADAGVCIKRFGHSLPGKVAYKYFGYDIDTLTEKVHGYLGQVEKDELLKHEFVEL

SEQ ID NO: 54685 - protein, 388 aa, Aspergillus oryzae
MAPSLLDPSLNPPTAATPAKSSTETIVTPFPNPSLQVTADHKLKAIDAPVYAPKHGEVLLQIKATGICGSDLHFWKTGCIGELIFKGDCIIGHEAAGVVLKCGEGVTHLRPGDRVAVEPGVPCGDCFLCLDGRYNLCEDVQFAGVYPYAGTIQRYKTHPAKWVHKLPDNLTYAEGALLEPLSVVMRGMSVAGLQLGRGAVVCGAGPIGLIALAAARASGAHPIVITDLDASRLAFAKEFVPSCITYQVNRDLDAQGNAKAIRALFGSEEYFAPETVLECTGVESSVCTAAFTARRGGTVVVIGVGKAVMNNLPFMHISLAEIDLRFINRYRDTWAPAIQCMSGGILDLKRLVTHTFPLEQAESALQLCSNPKNPSIKVLVVDEVEATL

SEQ ID NO: 54686 - protein, 385 aa, Aspergillus oryzae
MASLRLPRLIRPSGRRLYSGAASPSSRLNLPIDYKTTPLLHHTSSTLSESLELPGSTTSKSMNLYQAINSALRTALAKSEKVMLFGEDVAFGGVFRCSMDLQTEFGSERVFNTPLTEQGIVGFAIGAAAQGMKPVAEIQFADYVFPAFDQIVNEAAKFRYREGATGVHAGGMVVRMPCGAVGHGALYHSQSPEALFAHVPGVQVVVPRSPSQAKGLLLASIFEHNNPVIFMEPKCLYRAAVEHVPNEYYTIPLSKAEILKPGNDVTLISYGQPLYLCSAAIAAAEKALGVSVELIDLRTIYPWDRQTVLDSVKKTGRAIVVHESMINYGVGAEVAATIQDQAFLRLEAPVKRVAGWSTHTGLQYEKFILPDVARIYDAIKQSIEY

SEQ ID NO: 54687 - protein, 341 aa, Synechococcus sp. CC9605
MTLRVAINGFGRIGRNVLRGWISRGADTGLEIVGMNSTSDPATSAHLLTYDSILGRLDPSVDIKTTDSSMFVNGKEIKFFADRNPLNCPWKEWGVDLVIESTGVFNTDEKASMHIQAGAKKVILTAPGKGDRVGTFVVGVNDDQYRHEDWDILSNASCTTNCLAPIVKVLDQNFGLDWGLMTTIHSYTGDQRILDNSHRDLRRARAAALNMVPTTTGAAKAVALVYPEVKGKLTGFAMRVPTPNVSAVDLTFGPSRAASVDDIKAAIKSASENGMKGIIKYGDLPLVSTDYAGTNESTIFDADLTYAMGDKAVKILAWYDNEWGYSQRVVDLAEVVAKNWK

SEQ ID NO: 54688 - protein, 380 aa, Oryza sativa
SNRLGCTEMDEKVKMESKLSSAAAFVEGGVQDACDDACSICLEAFCDNDPSTVTSCKHEYHLQCILEWCQRSSQCPMCWQPISMKDPMSQELLEAVEQERNIRANRLNTAAVFHHPVLGDFEVPVGADDAELEERIIQHLAAAAAMRRSHRHGRRDGHRSRSGSHSRPQIVVFSRNEAIPGGSLHASSGQDEDHEQSSDLGSAHPFAALAAVDQGHMSGGSQLYVGHSDQGASNPSLHDERAMSRTSENQSAPVNQDTAGPSDLQSFSDTLRSRLQSASMKYKDSITKSTRGWKERWFSRSNTISGLGTEVRREVNAGIAAVSRMMERLETKDDTGPSAVPAASACSPSDANNQRTVSPNHAAVVNETSSTTCASGSGSQ

SEQ ID NO: 54689 - protein, 563 aa, Chlamydomonas reinhardtii
MMLTQTPGTATASSRRSQIRSAAHVSAKVAPRPTPFSVASPATAASPATAAARRTLHRTAAAATGAPTASGAGVAKTLDNVYDVIVVGGGLSGLVTGQALAAQHKIQNFLVTEARERVGGNITSMSGDGYVWEEGPNSFQPNDSMLQIAVDSGCEKDLVFGDPTAPRFVWWEGKLRPVPSGLDAFTFDLMSIPGKIRAGLGAIGLINGAMPSFEESVEQFIRRNLGDEVFFRLIEPFCSGVYAGDPSKLSMKAAFNRIWILEKNGGSLVGGAIKLFQERQSNPAPPRDPRLPPKPKGQTVGSFRKGLKMLPDAIERNIPDKIRVNWKLVSLGREADGRYGLVYDTPEGRVKVFARAVALTAPSYVVADLVKEQAPAAAEALGSFDYPPMGAVTLSYPLSAVREERKASDGSVPGFGQLHPRTQGITTLGTIYSSSLFPGRAPEGHMLLLNYIGGTTNRGIVNQTTEQLVEQVDKDLRNMVIKPDAPKPRVVGVRVWPRAIPQFNLGHLEQLDKARKALDAAGLQGVHLGGNYVSGVALGKVVEHGYESAANLAKSVSKAAVKA

SEQ ID NO: 54690 - protein, 459 aa, Ralstonia metallidurans CH34
MSHAPHSATSTLDVQSLIDSQRFSAYQWLILVLCFLIVAVDGFDTAAMGYVAPALVQDWGIEKSSLGPVMSAALFGLAFGAIFAGPMADRVGRKKVLVLSVFFFGACSLATAFAPTIRWLTVLRFLTGLGLGAAMPNAVTLMSEYAPARRRAVLVNTMFCGFPLGSAAGGFFAAAIIPQFGWHSVLVFGGVVPLVLAVVLVTTLPESVRYMVVRQYPADQIRQVLARVTGARVDGAGVFTISEAAPASSSAIGTVLAPRYRLGSTMLWLTYFMGLVIFYLLTSWMPTLMKDAGFSLQRASFLTALFPLGGGIGTIAAGWFMDRFNPNKVIAMTYALTGVLIYAVGQVASGDQVVLGVLIFLAGTAMNGAQSSMPSLAAAFYPTQGRATGVAWMLGIGRFGGITGALLGAELLRLHLGFDVIFTLLAIPAFAATAALVAKHVGARGAAPVDTGGAMVSGH

SEQ ID NO: 54691 - protein, 252 aa, Oryza sativa (japonica cultivar-group)
MGAEAVRVLVVDDSPVDRRVVELLLRAHCGGGGGAAAGEAAPFHVTAVDSGKKAMELLGRRRGDRDHLTPSSPAAAAAANDQAIDIVLTDYCMPEMTGYDLLKAIKALGSPNPIPVVVMSSENEPQRISRCLTAGAEDFILKPLKMNDVQRLRKCSGATRPKSAVAGDDDRCCNTAKKAAAAAAATPEQQQQQQRSSHLAGLAMVMNASSFEVSHYFQLIFKLILLAYAVLCLSQLLHRWSNGSSLLSLWCA

SEQ ID NO: 54692 - protein, 556 aa, Silicibacter pomeroyi DSS-3
MCRSESVKGQGMSELLTAAQMRAIEQAAIASGEVTGLELMERAGRGVVEAIFEEWPELGEAGGPTPQTPWSTSGEMKKAVVLCGPGNNGGDGFVVARLLHERGWAVEVFLYGDPEKLPPDARVNYERWCQAGEVQAFAKFEPENWNWQTGEVGAVDLIVDAVFGTGLVRPVGSEMWLHEKIGVLTTEVVNARRVAIDLPSGLCADSGKPLIDTQDETGRGKLKFELSVSFHREKVGHRISDGPAFCGRTVVKSIGLDDLPSSRAVARELASEIVRLAQPRLSDKAAESHKYTHGHALILSGGSGKTGAARLAARGALRIGAGLVTLGVSPGAQQEVACQITALMLTRIEGADGFAAVLEDTRLNALCLGPGMGVERARDLVPVALNAKRATVLDADALTAYAGDPAELFALLHEACVLTPHGGEFARLFPDIAKRLRKEPKSGPAYSKVDATREAAKRAGCVVLFKGPDTVIAAPDGRCSVNSAHYLRSAPWLATAGSGDVLAGFVTGLLARGFAPMQAAETAAWLHVECALEFGPGLIAEDLPEQLPAVFRKLGV

SEQ ID NO: 54693 - protein, 427 aa, Arabidopsis thaliana
MAFAPILRRASAVKNLFSLTRLAVGSALSTRSLQTGASGDDSQSMGGYHVSPGGFMRGAVYREPNKPLTIEEFHIPRPKSNEILIKTKACGVCHSDLHVMKGEIPFASPCVIGHEITGEVVEHGPLTDHKIINRFPIGSRVVGAFIMPCGTCSYCAKGHDDLCEDFFAYNRAKGTLYDGETRLFLRHDDSPVYMYSMGGMAEYCVTPAHGLAPLPESLPYSESAILGCAVFTAYGAMAHAAEIRPGDSIAVIGIGGVGSSCLQIARAFGASDIIAVDVQDDKLQKAKTLGATHIVNAAKEDAVERIREITGGMGVDVAVEALGKPQTFMQCTLSVKDGGKAVMIGLSQAGSVGEIDINRLVRRKVWVIGSYGGRARQDLPKVVKLAESGIFNLTNAVSSKYKFEDAGKAFQDLNEGKIVSRGVVEIL

SEQ ID NO: 54694 - protein, 468 aa, Silicibacter pomeroyi DSS-3
MSKDAVLQLIKDEGAEYVDIRFTDPRGKLQHVTIVSDLVDEDFLEEGFMFDGSSIAGWKSIEASDMKLMPDTESAYVDPFYAEKTICIHCSVVEPDTGEAYDRDPRGTAVKAEAYLKASGIGDVAYMGPEAEFFLFDDVRFSNTINKVSYEVDATDASWNSDAEFETGNMGHRPGLKGGYFPVNPIDEAQDLRAEMLSTMKRMGMKVDKHHHEVASCQHELGLIFGTLTKQADEIQKYKYVIHNVAHAYGKSATFMPKPIYGDNGSGMHVNMSIWKDGKPLFAGDKYADLSQEALYFIGGILKHAKTLNAFTNPGTNSYKRLIPGFEAPVLRAYSARNRSGCVRIPWTESPKAKRVEARFPDPSANPYLCFAALLMAGLDGIKNKIDPGEAMDKNLYDLPAEELADIPTVCGSLREALECLASDHDFLLQGDVFTKDQIEGYIELKMEEVHKYEHTPHPVEFGMYYSC

SEQ ID NO: 54695 - protein, 411 aa, Glycine max
MNALAATNRNFKLASRLLGLDSKLEKSLLIPFREIKVECTIPKDDGTLQSYVGFRVQHDNARGPMKGGIRYHPEVDPDEVNALAQLMTWKTAVANIPYGGAKGGIGCDPAELSISELERLTRVFTQKIHDLIGIHTDVPAPDMGTGPQTMAWILDEYSKFHGYSPAVVTGKPIDLGGSLGRDAATGRGVLFATEALLNEYGKSVSGQRFVIQGFGNVGSWAAQLISNKGGKVVAVSDITGAIKNSNGLDIPSLLEHSKVHRGVKGFNGSDPIDPNSILVEDCDVLVPAALGGVINRENANEIKAKFIVEAANHPTDPEADEILKKKGVVILPDIFANSGGVTVSYFEWVQNIQGFMWDEEKVNNELKTYMTKGFKDVKEMCKTHECDLRMGAFTLAVNRVARATVLRGWEA

SEQ ID NO: 54696 - protein, 1547 aa, Aspergillus fumigatus
MADGSRLPESATSTTMETNTNEHAKVLSPDAETVPSSSVTATSSELSLDGRWGERDQGEPVSRRGAMEDFEEMRRELTQLSLRRTRSVGKDAHRLRSRASGRASQVHDEEKAIDEEDSTIDGDGDGYQGGFDLGEFLMGGHLERRTTTGEPAKKVGVLFKHLTVKGVETGASFVRTLPDAVVGTFGPDLYRIVCSFIPQLRFGKQPPVRELLHDFTGLVREGEMMLVLGRPGAGCSTFLKTIANDRGAFAGVEGEVRYGGLSAEEQLKHFRGEVNYNPEDDQHFPSLTVWQTLKFSLINKTKKHDKNSIPIIIDALLKMFGITHTKNTLVGNEYVRGVSGGERKRVSIAETLATKSSVVCWDNSTRGLDASTALDYAKSLRIMTDVSKRTTFVTLYQAGESIYELMDKVLVIDSGRMLYQGPANKAREYFVNLGFHCPEKSTTADFLTSICDPNARQFQPGREASTPKTPEELEAVFRNSETYKTICDEVASYEKKLQDTDQEDTRRFQKTVAQSKSRTVSKKSSYTVSFARQVLACVQREFWLLWGDKTSLYTKYFIIISNALIVSSLFYGESLDTSGAFSRGGALFFSILFLGWLQLTELMPAVTGRGIVARHKEYAFYRPSAVSIARVVMDFPAIFCMVVPFTIIMYFMTGLDVTASKFFIYFLFVYTTTFSITSLYRMFAALSPTIDDAVRFSGIALNILVIFVGYVIPKQGLIDGSIWFGWLFYVNPIAYSYEAVLTNEFSDRIMDCAPSQLVPQGPGVDPRYQGCALPGSELGRRGVSGSRYLEESFQFTRSHLWRNFGVVIAFTVLYLIVTVLAAEFLSFVGGGGGALVFKRSKRAKKLATQTTQGNDEEKVQDVGDKAALSRGEAMSASNGESFKRISSSDRIFTWSNVEYTVPYGNGTRKLLNGVNGYAKPGVMIALMGASGAGKTTLLNTLAQRQKMGVVTGDFLVDGRPLGADFQRGTGFCEQMDLHDNTSTIREALEFSALLRQDRNVSKQEKLDYVDQIIDLLELNDIQDAIIGSLNVEQKKRVTIGVELAAKPSLLLFLDEPTSGLDSQAAFSIVRFLKKLSLAGQAILCTIHQPSSMLIQQFDMILALNPGGNTFYFGPVGHDGGDVIKYFADRGVVCPPSKNVAEFILETAAKATTTKDGKKIDWNEEWRNSEQNQRVLDEIQQIREERSKIPVTETGSHYEFAASTMTQTLLLTKRIFRQYWRDPSYYYGKLFVSVIIGIFNGFTFWMLGNSIANMQDRMFSIFLIIMIPPVVLNSIVPKFYINRALWEAREYPSRIYGWFAFCTANIVCEIPMAIVSSLIYWLLWYYPVGFPTDSSTAGYVFLMSMLFFLFMSSWGQWICAFAPSFTVISNVLPFFFVMCNLFNGIVRPYRDYPVFWKYWMYYVNPVTWWLRGVISSIFPTVQIDCSPSETTHFNPPPGQTCANYAGNFITNIAKNGYLLNPDASADCQYCPYSNGAEYMATLNVHDGDKWRCFGIFLAFVIINWLLVYFFIYTVRVRGWSFGMGYLFGGMGLVIDKVKGVFKRKSEKA

SEQ ID NO: 54697 - protein, 249 aa, Prochlorococcus marinus str. MIT 9515
MSNKESLTGKVALITGASRGIGKEIALELSNLGAEVIINYSSSDEKAEEVLNLIKGLGGKVHKLKFDVSKEESVSQAFEEIIKINGSIDILINNAGITRDGLLMRMKSEQWDDVLNTNLKGVFLCTKYASKFMLKKRSGKIINISSIVGIIGNPGQANYSAAKAGVIGFTKTCAKEFASRGINVNAIAPGFIETEMTEKLNNEEIVKAIPLGKLGSCSQIADLVSFLVSSNAGSYITGQTISIDGGMSI

SEQ ID NO: 54698 - protein, 453 aa, Mycobacterium sp. MCS
MKTLHDKQDDHARLAAELADDGVQFAMAAWVDVTGRPKSKVVPIGHLPDMLAGSERYTPRGIGRLGEMNPAEDECVGLPDPDTMRILSWDPRIALFHADLVLGDAGEPFENCPRSALKGVIAKARDMGFAMNLGVETEFYLFRTSALPELTPRFASSVIEPTPAYDARAVIDSLEFFSEVSAHMEAAGYGLYSFDQEGGEGQYELDFSYTDVLSMCDRLTYMRLMLPALAQKVDATVSFMPRPETRSWGSGAHMNMSLVSTTTGDNVFVDPDGSWSKTAMSFAAGVLRHAPALSALTCPTVNSYKRLTPKLADGSVSWAPVWARYGTNNRSCMLRLPGNRPAIENRSVDMMANMYLASAFTLAAGLEGIELGLDPGEPVTDDASDWEASAGGAGERLPRTLLEAIDAFATDPLVATTFPAGFVRDYLAMKVDEWNGYHSVVTQWEVDRYLLDV

SEQ ID NO: 54699 - protein, 440 aa, Streptococcus pyogenes M1 GAS
MADNWKKSTRGKALLVIEAIFDQGAYTNIALNQQLSNKALSAKDRALLTEIVYGTVSRKISLEWYLAHYVKDRDKLDKWVYYLLMLSLYQLTYLDKLPAHAIVNDAVGIAKNRGNKKGAEKFVNAILRQFTSHPLPDMETIKRRNKYYSVKYSLPVWLVKKLEDQFGSDRSVAIMESLFVRSKASIRVTDPLKLEEVAEALDAERSLLSATGLTKASGHFAASDYFTNGDITIQDESSQLVAPTLNIDGDDIILDACSAPGGKTSHIASYLKTGKVIALDLYDHKLELVKENANRLGVADNIETRKLDAREVHRHFEKDSFDKILVDAPCSGIGLIRRKPDIKYNKESQGFNALQAIQLEILSSVCQTLRKGGIITYSTCTIFDEENRQVIEAFLQSHPNFEQVKLNHTQADIVKDGYLIITPEQYQTDGFFIGQVRRVL

SEQ ID NO: 54700 - protein, 478 aa, Xylella fastidiosa Temecula1
MSEHYDVVVIGAGPAGYHAAIRAAQLGLKVACVDAALGKDGKPALGGTCLRVGCIPSKALLDSSRQYWNMGHLFNEHGISFKDAKMDIATMIARKDKIVKQFTGGIAMLFKANKITPYYGFAQLQPGNVVKVKQHEGKNIELKGANVILASGSDSVELPFATFDGETIVDNIGALDFTKVPKRLAVIGAGVIGLELGSVWKRLGAEVTILEAMPNFLAAVDADVAKTAAKEFKQQGLDIKLGAKVSRTEISSKNNKKEVIVTYTDASGKQTLTVDKLLVAVGRKAATKGLLADGTGVQLNERGQIVVDEHCHTGVDGVWAIGDCVRGPMLAHKGFEEGIAVAELIAGLPGHVNFETIPWVIYTEPEIAWVGKTEQELKADNIPYKAGSFPFAAVGRAVAMAEPSGFAKVLAHAETDRVLGLHLIGVNVSELVHEGVLAMEFSGSADDLARICHAHPTLSEAIHDAAMAVSKRSIHKAN

SEQ ID NO: 54701 - protein, 393 aa, Arabidopsis thaliana
MEVCGDLKSDNLKNRPLTPLRILRGLMILLVFLSTAFMFLLYFAPIAALGLRLLSVQQSRKVVSLIFGLWLALWPYLFETVNGTTVVFSGDIIPVEKRVLLIANHRTEVDWMYLWNIALRKGCLGYIKYVLKSSLMKLPIFGWGFHVLEFIPVERKREVDEPVLLQMLSSFKDPQEPLWLALFPEGTDFTEEKCKRSQKFAAEVGLPALSNVLLPKTRGFGVCLEVLHNSLDAVYDLTIAYKPRCPSFMDNVFGTDPSEVHIHVRRVLLKEIPANEAESSAWLMDSFKLKDKLLSDFNAQGKFPNQRPEEELSVLKCIATFAGKQQQVTKPSCQKVFLLLNQSSDEKESKKAVAQHPFTDTLDHLFQVEHSISCFLYMHIYNLSTCHLISLYE

SEQ ID NO: 54702 - protein, 184 aa, Crocosphaera watsonii WH 8501
MTQLESKKPASLPPGDKGLPLIGESLSFLFDPDFGKKKLKKYGHVYKTNIFGNNAVIMIGAEANQFLFRNENQYVVSTWPKSTRILLGKLSLSTNDGTFHTSRRKLLAQAFKPRALNSYIPKMTEITQQYIDKWLQTKELTWYPELRDYTFDVACSLLISIDNASQTKLASYFETWVKGLFRVC

SEQ ID NO: 54703 - protein, 544 aa, Rhodobacter sphaeroides 2.4.1
MTVKTVSTTPFSDQKPGTSGLRKKTPVFMRPHYLENFVQSIFDAIGGARGKTFVLGGDGRYFNDRAAQVILRMAAANGAARVIVGQGAILSTPAASHLIRLRKTDGGIILSASHNPGGPEEDFGVKFNTPNGGPAPESVTEAIFEATKTLSEYRIFEAQDVDLSVVGRTVLGDMQIEVVDPVADYAALMESLFDFPAIRAMFSDGFTMRFDAMCAVTGPYATEILENRLGAAKGTVVNGTPLPDFGGMHPDPNPTWAKALMDEMFSAEAPDFGAASDGDGDRNMVVGRGIYVSPSDSLAVLAANAHLAPGYKAGLKGVARSMPTSAAADRVAEALGVEEFETPTGWKFFGNLLDAGRATICGEESFGTGSDHVREKDGLWAVLLWLNILAVRKESVREILEAHWQQFGRNYYSRHDFEAIETARADAMMEELRGKLVGLTGAAFNGHLKVAEADDFAYTDPVDGSVSRKQGVRILFQDGSRIVMRLSGTGTEGATLRLYLERYAPGPEGLDLDPQEALGPIIAAAHEIAGIERHTGRREPDVIT

SEQ ID NO: 54704 - protein, 251 aa, Brassica oleracea
MTTVEVSNVSLGATDRDLKEFVSFSGGILYPETLSEAERSKLAYVTFKDLQGAETAVLLSEPKDSSKSPRAGDSVFRKAEDVVSSMLAKGFILGKDAIAKAKSVDEKHQLTSTASARVASLDKKFGFTDKINTGTVVVDDKTISAIAASEQTAIMKNRYVLTGATWVTGAFRKVAKAAEEEKVGMAEEEDKRKVVDEFARVHLSESPKAPSSKEEEVHEPKLSDSPEPKESEHHEPQQQQQSSQPVGPAQP

SEQ ID NO: 54705 - protein, 300 aa, Brassica oleracea
MTTVKVSNVSLGATDRDLKEFFSFSGDILYLETQSETERSKLAYVTFKDLQGAETAVLLSGATIVDSSVIVTMAPDYQLSPEALASLEISKSPRAGDSVLRKAEDVVSSMLAKGFILGKDAIAKAKSVDEKHQLTSTASAKVASLDKKLGFTDKINTGTVVVGDKVREVDHKYQVSEKTKSAIAAAEQTVSNAGSAIMKNRYVLTGATWVTGAFNKVAKAAEEVGQKAKEKVGMAEEEDKRKVVDEFARVHLSESPKAPSSKEDDVHEPKRSESPEPKESEHQEPQQQQQSSQPVGPAQP

SEQ ID NO: 54706 - protein, 704 aa, Rhodobacter sphaeroides 2.4.1
MTAAAQPSGLPGLATAPGRPWPLGASFDGEGVNFALFSAHAEKVELCLFAPDGRREALRLPLTERDGDIWHLKVNGLLPGQLYGYRVHGPYQPEQGHRFNPNKLLIDPYARKLEGRLRWSDAVMGYRVGSARADLSFDGRDSAFAVPKSVVVGHNFNWGPDAPPERALTETLIYEAHVKGLTALHPGVEDGLRGTFLGLASDPILEHLTRLGVTAVELLPVQAFLDDRFLVNRGLSNYWGYQTVGFFAPDPRYLAKGALWEFAAMVRRFHAAGIEVILDVVYNHTGESDELGPTLSFRGIDNRSYYRLTEGGRRYANMTGTGNTLDLSHPMVLRMVMDSLRYWVEVMHVDGFRFDLASTLGREEDAFDEQGAFFDAIRQDPVLTRVKLIAEPWDLGPGGYRLGGFPHPFLEWNDKFRDDVRRFWRGEGGMTGDLARRLLGSAERFDHHSRAATSSVNFVTAHDGFTLLDLVSHARKHNEANGEDNRDGHDDNHSDNMGLEGPTTDAGILAARALRRRNLLATLFLSQGTPMLLGGDEIGNGQGGNNNAYAQDNPIGWIDWDRPDETMLAFVARISELRRSLPVLRQKGFLHGRIREADGLRDVVWRLPDGREPGPQDWHSPAMSCLCVEIRMDADRPDAGESPVFAVFNAGEAVPLALPPVPESWSLVLDTTRPEAGPEPAAPGLEAPARSVLVFVPAPPGETG

SEQ ID NO: 54707 - protein, 172 aa, Crocosphaera watsonii WH 8501
MDLKALIRDIPDFPKQGIVFRDITTLLSDAEGLRYTIDTLKEKCLSANLSPDYIVGMESRGFLFGAPLAYQLNAGFVPVRKPGKLPAAVHKVEYELEYGTDSLEIHQDALEDHHNVLIVDDLMATGGTAKATAELLEKIGCNVLGFAFIIELKALEGRKKLPDVPIITLIEY

SEQ ID NO: 54708 - protein, 423 aa, Rhodobacter sphaeroides 2.4.1
MKAQPPLRLTAQAMAFVLAGGRGSRLKELTDRRAKPAVYFGGKARIIDFALSNAMNSGIRKMAIATQYKAHSLIRHIQRGWNFFREERNEYLDILPASQRVDENRWYLGTADAVTQNIDIVDSYDIKYVIILAGDHVYKMDYEIMLRQHCETGADVTIGCLTVPRAEATAFGVMHVDANLRITDFLEKPADPPGIPGDEANALASMGIYVFDWAFLRDLLIRDAEDPNSSHDFGHDLIPAIVKNGKAMAHRFSDSCVMTGLETEPYWRDVGTIDAFWQANIDLTDFTPKLDLYDREWPIWTYSQIVPPAKFIHDSENRRGTAISSLVSGDCIVSGSEIRSSLLFTGCRTHSYSSMSHVVALPHVTVNRKADLTNCVLDRGVVVPEGLVIGQDAEEDARWFRRSEGGIVLVTQDMLDARARALN

SEQ ID NO: 54709 - protein, 233 aa, Pisum sativum
MASHLCKSASRAARSLLSASFHSQGRAVAAAAAVASIRKVPVFAPNYRRTGSGNGPSSWIAGALALPAAAYMLQDQEVHAAELERTFIAIKPDGVQRGLISEIISRFERKGFKLVGIKVLIPTKQFAQQHYHDLKERPFFNGLCDFLSSGPVIAMVWEGEGVITYGRKLIGATDPQKSAPGTIRGDLAVVVGRNIIHGSDGPETAKDEIKLWFKPEELVSFTSNSEKWIYGDN

SEQ ID NO: 54710 - protein, 296 aa, Arabidopsis thaliana
  misc_feature (31)..(31): Xaa can be any naturally occurring amino acid
  unsure (1)..(296): unsure at all Xaa locations
MENPAKRVLMTSNGDEVSRNIAFHLAKHGCXLVMMGNEGSLRSIVDKIRDSIEGAFPADVIALDMESDSEVAFHAAVQKAWELSGHFDAFLNSYTYQGLICFLFFTTLPLMLLCVDHSFIQQSFFLAGKVQDILQVSQDEFHRITKINLTAPWFLLKAVATRMKDHGSGGSIVFMATIASGERALYPGADAYASTSAAIHQLVRASAMSLGKHKIRVNMISRGLHLDDEYTASVGRDRAQKLVKDAAPLGQWLNPDTDLYSTVIYLISDGSRFMTGTTVLVDGAQSLTRPRLKSYM

SEQ ID NO: 54711 - protein, 404 aa, Rhodococcus sp. RHA1
MAPDTAQIETLQEPLTDEEIFSAHLGGKLAVQAVVPLASRRDLSIAYTPGVAQVSRAIAADPQLAQQYTWTNRLVVVVSDGSAVLGLGNIGARASLPVMEGKSALFKQFADLNSIPLVLDTTDPDEIVETLVRLRHSFGAVNLEDIAAPRCFEIEERVIAALDCPVMHDDQHGTAIVVLAALISAARLQNRDIQSLRTVISGAGAAGVACAKMLLARGISNVTVTDSVGIVHSLRDDLNAYKAGLAACTNPEGRTGGLAEALVGADVFIGVSSGAVAEELIATMAPESIVFALSNPEPEIHPDVAINHAAIVATGRSDFPNQINNVLAFPGVFQGALDVGATTITEGMKLAAANAIASVVLPDIGVDHIVPSPLDPTVAPAVAAAVAEAAIAEGVAAAPLTPSR

SEQ ID NO: 54712 - protein, 348 aa, Arabidopsis thaliana
MEKPKFKTVQEVVAAGEGLPERYLHAPTGDGEVQPLNAAVPEMDIPAIDLNLLLSSSEDGREELRKLHSALSTWGVVQVMNHGITKAFLDKIYKLTKEFFALPTEEKQKCAREIDSIQGYGNDMILWDDQVLDWIDRLYITTYPEDQRQLNFWPEVPLGFRETLHEYTMKQRIVIEQFFKAMARSLELEENSFLDMYGESATLDTRFNMYPPCPSPDKVIGVKPHADGSAITLLLPDKDVGGLQFQKDGKWYKAPIVPDTILINVGDQMEIMSNGIYKSPVHRVVTNREKERISVATFCIPGADKEIQPVNELVSEARPRLYKTVKKYVELYFKYYQQGRRPIEAALI

SEQ ID NO: 54713 - protein, 490 aa, Oryza sativa (japonica cultivar-group)
MQVHHDMNAPLSHYFIYTGHNSYLTGNQLSSDCSDIPIIKALQIGVRVIELDMWPNSSKDDVDILHGRTLTAPVSLIKCLKSIKEYAFVASPYPVIITLEDHLTSDLQAKVAKMVLEVFGDTLYYPESKHLQEFPSPEALRGRVILSTKPPKEYLESKGGTMKDRDIEPQFSKGQNEEAVWGTEVPDIQDEMQTADKQHENDILYTQRDVEEDDEKKMCQHHPLEYKHLITIKAGKPKGAVVDALKGDPDKVRRLSLSEQELAKVAAHHGRNIVSFTHKNLLRIYPKGTRFNSSNYNPFLGWVHGAQMVAFNMQGYGRSLWLMHGFYKANGGCGYVKKPDFMMQTCPDGNVFDPKADLPVKKTLKVKVYMGEGWQSDFKQTYFDTYSPPDFYAKVGIAGVPSDSVMQKTKAVEDSWVPVWEEEFVFPLTVPEIALLRVEVHEYDVSEDDFGGQTALPVSELRPGIRTVPLFDHKGLKFKSVKLLMRFEFV

SEQ ID NO: 54714 - protein, 358 aa, Rhodopirellula baltica SH 1
MTPTAASELLLSIESTCDETAAAVIRRDGTVLGQCIATQETLHEQFGGVVPEIAARAHLERILPVIDTALTQAKVRGEDLTAIAVADRPGLAGSLLVGVVAAKTLALAWNKPLISLNHLHAHLYACQLIEGAPANIYPAIGLIVSGGHTSLYVCRTAIDLEYLGGTIDDAAGEAFDKVAAMLSLPFPGGIEVAKLASQGNDKAYSFPRSMIHDPGDDFSFSGLKTAVRYAIVGPGRQDFASLDISDQVKRDVCASFEAAVVDVLVSKCRRAIKRHRNRNNDPQNSINRLIVGGGVAANQRLRRDLQAAADKDGFELWIAPPHLCTDNAVMGAIAWKKFEAEQFASLDLDITPGLQRGF

SEQ ID NO: 54715 - protein, 465 aa, Brucella melitensis 16M
MSGNFGGPMDDRCIIIGAGHAGSQAAVSLRQEGYAGEIILINDETDIPYHKPPLSKSYLKAPEKGSLVLRPESAYRDNNIEMLFGAHVDAVSIAERTVTLGDGRVLPWSELVFATGARARIPDVPGVALEGVVTLRRMEDARRIAAMMPDVRNVVIIGGGFIGLEMAHSAIALGKKTVLIEAAPRVLGRSVAAPVSAHVEARSRAADITLLTGLGVASIEGENGRAIGVTAGDGTFFPADLVVIGTGAVPNVELAAKAGLSIDNGIRVDEHMRTSAPHVYAIGDCASYAHFHAGRHVRLESVQNATDQAKHFARTIVGRETPYREVAWFWSDQGDMKLQTAGLSFDADRHVLSGEPEENAFSVFSFQGRQAGGGRFHQSPGRSYDCASSACGGDQPKRGRYYGWYAAPQGIAGGCGAIKVLWKRPDLGGGEESVRFLIAEGMGGGETPGDILETEGPRGFIRSQS

SEQ ID NO: 54716 - protein, 437 aa, Streptomyces avermitilis MA-4680
MPERTSRPMPDLSLAELLDLDRRHVWHPYGPMPGRQEPLVVEAASGVRLRMADGTGELIDGMSSWWSAIHGYNHPVLNEAAREQLSRMSHVMFGGLTHEPAVRLAKRLVDISPEGLEHVFLADSGSVSVEVAVKMCLQYWRSLGRPGKQRLLTWRGGYHGDTWQPMSVCDPQGGMHELWQGVLQRQVFADAPPVAYEESYADQLRELIERHADELAAVIVEPVVQGAGGMRFHSPAYLRVLREACDAHDVLLVFDEIATGFGRTGALFAADHVGVTPDVMCLGKALTGGYLTLAATLCTARVADGISRGEVPVLAHGPTFMGNPLAAAVANASIDLLLGQDWQTEVKRIETGLREGLAAAADLPGVRDVRVLGAIGVVQLDRPLDEAAMAAATRAAVREGVWLRPFRDLVYTMPPYVTGDADVARIAGAVCAAAREG

SEQ ID NO: 54717 - protein, 282 aa, Medicago truncatula
MFAETGLLFPYLQNYSHEFQQLEEYCMTHKSNASMSDLVQSSAMSEFDLFVEGDLFKAPETIIEEPEMDLDQMQAAMSMMSGGEDMSSQGLKSSDIDDVLQSEQLLSEVYYDCKKDLLEKATIESPLSEILEIKIPALNIDENSIQENKPIPDVLLSKSVSSGNLSSMDWMHGPAMKPAFLDFPGIDFNAVYGMRRAFSEGDIKTLGNGNMSVGQSTLERPFLLSNCTSEQRQEKLSRYRNKKTRRNFGRKIKYACRKALADSQPRIRGRFAKTEELDVKKQ

SEQ ID NO: 54718 - protein, 705 aa, Pseudomonas syringae pv. syringae B728a
MTESAATILIIDDDVHVRDLLEVLLQNQGYRTLTAESGELALAMVKRQAPDLILLDIMMPGMDGYEVASQLKAEKGTANIPIIMLSALDDQSSRLSGLEAGAEEYLNKPVDSAELWLRVRNLLRLKAFGDYLKSHSLILEDQLQQRTIDLERFRTVMDASEDAIFLINRNTMSLIEFNRRACQLLGYTAEELSHKTPAELGETSMEQLEVVYDQIIAGKGPSEPLETQIRDKSGRDVEVEIHRQAYRTGEDWVIVGIVRDITRRKESDQRLLTMAHYDTLTGLPNRDLFFTSLQMGMTQAAISRWKLAALTVNIDGFKNINETWGHVLGDEVLLEVSRRLSNCLNASDTLGRVDGDQFALILMLRPGQADTRQTLERIRNALRAPFRIEGQSLVMTASIGIALYPEDGEDSRELIRHAYTAMNSARKIGPDNYRFYTPQMNADVSARLDLEAALREAVRNQAFEIVYQPKLDLNNDRICGLEALLRWPRPGHPGVSPAVFVPVLESLGLIGEVGNWVVDSVCAQIARWQRSGLGSFQVAVNISGQQISSSSLVADIRQALEKHNVAPQWLEVELTESSLMENTAHTIATLGALRANRVSISIDDFGTGYSSLAYLRRFPIDKLKIDIAFIREVTSNPQDAAIARAIIELAHSLDLQVIAEGVETPEQLAFLRENHCDQIQGYLISKPLPLEELETFLCSPASRVG

SEQ ID NO: 54719 - protein, 295 aa, Medicago truncatula
MAIISDYQEETQTSSSSQPKPSKPIPFSSTFDPSNPTAFLENVFDFIAKESTDFFDNDSAEKVVLSAVRAVKVKKAKAVAAEKAKIAAEEKAKVDKAASVAAAEKKAKEVDEKEDDKKDGESGLAAPNQGNGMDLEKYSWTQTLQELNVNVPVPNGTKSRFVTCEIKKNHLKVGIKGQPPIIDGELYKSIKPDDCYWSIEDQNTLSILLTKHDQMDWWKCLVKGDPEINTQKVEPESSKLGDLDPETRQTVEKMMFDQRQKSMGLPTSEELQKQEIMKKFMSQHPEMDFSNAKLS

SEQ ID NO: 54720 - protein, 290 aa, Medicago truncatula
MAIISDYQDETQTPSSSSQPKPSKTIPFSSTFDPSKPTAFLEKVFDFIAKESTDFFDKDSAEKMVLSAVRAAKVKKAKAVAAEKAKIASQEKAKAAAGIKVNDEKSGVGTEKKDGESGLAAPNQGNGMDLEKYSWTQTLQELNVNVPVPNGTKSGFVICEIKKNHLKVGLKGQPPIIDGELYKFIKADECYWSIEDQSTVSILLTKHDQMDWWKCLVKGDPLINTQKVEPESSKLGELDSETRMTVEKMMFDQRQKSMGLPTSEELEKQEMMKKFMSQHPNMDFSGAKLS

SEQ ID NO: 54721 - protein, 495 aa, Coccidioides immitis RS
MLVSAGARRSGAAAGAVRSTLHRSLHSQRQFSSFIAARNSQSQWRRVARNNSAFRGRSQPSGYPSLISSPRFISSSSSSAATVTSATPETPVDNGVQTIEALSDGSNPALDLSQVPVKLGYLKELGLDYGFGPSSLIETLLESIHIYAGLPWWGSTIAAAVFIRVALFKFNLNASDMSAKLRRMQPITKPLQERMLKAVREGNNLEGLKLKQEMAMIREQHGVKMWKTFVPMLQIPLGFGFFRVLRGMSSLPVPGLLSEQFLWLNDITLSDPFFILPLVTGGSMYFAIKRGGETGMDFANSPLGKFMLYGLPVISTTAMSFWPAVLQLYFASTSLLALIQAYLVTSPGFRKLAGVEPLPSKTKPVGPNEPGASGSSGRIRVIPTTARVVPEAQQNPEQQVYSPQKVSVIDRTLDNVKQGFRDVQKQVQEKMDEMAGDKTEKNPDGTPKAPPRLSKQELENAAAYEKRRREQLEMERELRNQSLREEYMRKKQNIQ

SEQ ID NO: 54722 - protein, 1218 aa, Brucella melitensis 16M
MAVFQNFAPPIREQSALRQAITAAYRRPEAECVSALAEQATLPEETRQQIRSTARKLIEALRAKHKGTGIEGLVHEYSLSSQEGVALMCLAEALLRIPDMATRDALIRDKISNGDWKSHIGGGRSLFVNAATWGLVVTGKLTNTVNDRGLSAALTRLIARCGEPVIRRGVDMAMRMMGEQFVTGETIDEALKRAKELEERGFRYSYDMLGEAATTAADAERYYKDYETAIHAIGRASAGRGIYDGPGISIKLSALHPRYTRAQSERVMGELLPKVKALAAIAKSYNIGLNIDAEEADRLELSLDLLQSLCEDPDLAGWDGIGFVVQAYGKRCPLVLDFIIDLARRTKRRVMVRLVKGAYWDAEIKRAQVDGLEDFPVYTRKVHTDVSYIACARKLLAATDVIFPQFATHNAQTLATIYHLAGPDFKTGKFEFQCLHGMGEPLYDEVVGPEKLGRPARIYAPVGTHETLLAYLVRRLLENGANSSFVNRIGDKNVSVDELIADPVEVVRSMAVVGARHDQIALPENLYGARRNSAGFDLSNEVTLAELSKTLKETAGRAWTAEPQVAGAKVKGVSRPVLNPGDRNDVVGTVTEIAEADVAKAMKAAQTATTSWSAVAPAERAACLERAADIMQRDMPALLGLVMREAGKSMPNAIAEVREAIDFLRYYAEQTRRTLGVGHKALGPVVCISPWNFPLAIFTGQIAAALVAGNPVLAKPAEETPLIAAEGVRILHEGGIPADALQLLPGDGRIGAALVAAPETCGVMFTGSTEVARLIQAQLASRLLPNGKPVPLIAETGGQNAMIVDSSALAEQVVFDVIASAFDSAGQRCSALRVLCLQEDVADRILTMLKGALRELSIGRTDQLKVDIGPVITDEAKNTIEKHIQAMRDLGRKVEQLPLGPETQNGTFVAPTIIEIESLRDLKREVFGPVLHVVRYKRDDMESLIDDINSTGYGLTFGLHTRLDETIANVADRIRVGNIYINRNIIGAVVGVQPFGGRGLSGTGPKAGGPLYLGRLVETAPIPPRHASVHTDAALKDFARWLGNRGMNDLAQAARDTGSASALGLELELPGPVGERNLYALHPRGRVLLVPQTEIGLYRQLTAVLATGNTAVIDEACGLRAVLKDLPETVAARAIWTGDWQADAPFAGALIEGDSARIKEVNSRIAALPGPLVLTQAASPEDLAANQDAYCLNWLLEEVSTSINTTAAGGNASLMAIG

SEQ ID NO: 54723 - protein, 525 aa, Gibberella zeae PH-1
MLSRLAQASRLGLMTARLSQPVASPSLRAIPATAPHFASPWLRSYSKRSSGQPPKESKKKPSQAQNDAEAAKTPEKPAENDVNKASEQSPEAPKEGEQIPFHKLPDLTQGIPSTLFEEMGGDKKKEQQALQELEEAESKGNERDRSEYVSTSERNRKWWTRFMLTAVAAGGTLSLLYMGRNWEDTIEAERHSDSPNGPSPSLWWKRAKARMTESVTYYQEPAFEKLLPDPDPTFERPYTLCLSLDDLLIHSEWTREHGWRIAKRPGVDYFIRYLSQYYELVLFTTTPYATGEPVMRKLDPFRLILWPLYREATKFEDGEIVKDLSYLNRDLSKVIIIDTKAKHVRNQPDNAIILDPWKGDKDDKNLVNLIPFLEYIHTMQYSDVRKVIKSFDGKDIPTEFARREAIARKEFQAKQLTHKHKHGSGVGALGNMLGLKPSNMNMMVSPDGEQNPAEAFAQGKMLQDVARERGQRNYMELEKQIRENGEKWLKEEAAMMEAAQKEAMNSMMGSFGGWFGGNNPPEKKA

SEQ ID NO: 54724 - protein, 170 aa, Prochlorococcus marinus subsp. marinus str. CCMP1375
MPRGYIPEDDISILNLFGFMSVERTFLAIKPDGVQRGLVGEILGRFERKGFKLVGLKQLIPSKELAEKHYGVHKERPFFTGLVGFITSGPVVAMVWEGDGVILSARKLIGATKPLEAEPGTIRGDLGINIGRNVIHGSDGPETASFEIDLWFNSSELNNWNPSDQKWRVE

SEQ ID NO: 54725 - protein, 289 aa, Medicago truncatula
MAIISDYQDDNQTKTSSSSSSQPKPSKPIPFSSTFDPSNPTTFLEKVFDFIAKESTNFFDKDSAEKVVLSAVRAARVKKAKSVAAEKAKIAAKEKAKAAAEKKLNDEKSEAVTEKIDEKAAPNQGNGMDLEKYSWTQTLQELNVNVPVPNGTKSGFVICEIKKNHLKVGLKGQPPIIDRELYKSIKPDECYWSIEDQNTVSILLTKHDQMDWWKCLVKGDPEINTQKVEPASSKLGDLDSETRMTVEKMMFDQRQKSMGLPTSEELQKEEMMKKFMSQHPNMDFSGAKF

SEQ ID NO: 54726 - protein, 338 aa, Arabidopsis thaliana
METKSEEKLSVIELLKRALKLLFGNINLALFLFLCSLPLFCFLIFFELSLQTTVSLASTYISKLVNSEEDLSENDLLPWLIQTTLLYFFPYTILDLLTTTTIVAASSIAYTSEEEPLGLLYLVGRSFKLCQNKVGGCLITSLYVLLLSTSVFLGLFSGSTIYLYFASLTLEQQIFFNQAVVQDQRFLEQAVVLLDVVVVLIHGTVFIVLAAKFSKWSAGWNISMVVSVLEEEEDSKGIYGSSALSLSAWYLRGQEKRDFWMMLVFLVGALVTRMPCLYYKCSESLSGNGVLYTGLYVSLICVGNVVKWVSCVVWYHDCNTRVLRKKGDVEIGSKAFAT

SEQ ID NO: 54727 - protein, 140 aa, Rhodobacter sphaeroides 2.4.1
MAIERTLSIIKPDATRRNLTGKINAKFEEAGLRIVAQKRIHLSLAQAQKFYGVHKDRPFFGELTEFMASEPVVVQVLEGEGAIAKNREVMGATNPANADAGTIRKEFALSVGENSVHGSDAPETAAEEIAFFFSGLELVG

SEQ ID NO: 54728 - protein, 182 aa, Triticum aestivum
YTYIVQSLVPTVMASLATSVAPFQGLKSTAGLPVSRRSNGASLGSVRNGGRIRCMQVWPIEGIKRFETLSYLPPFSTEALLKQVDYLIRSKWVPCLEFSKVGFIFREHNASPGYYNGRYWTLWKLPMFGCTDASQVINEVEEVKKEYPDAYVRIIGFDNMRQVQCVSFIAFKPPGCEESGKA

SEQ ID NO: 54729 - protein, 255 aa, Brassica oleracea
MDPSNLRSQSSSYVGLLHSQQGNVFHENFPYESFHSSVNFGESQTFPAFSSQQSQDAPVETPVKTPAARVVRHKWNLAYNEVLISAWLNTSKDAIVANEQRSGAFWKRVAAYYASSPHGKEDGVREHGCCEKRWHRINEDVNKFCAAYSAAEQQMRSGETDTDVLKKAHDIFFSDEEHKFTLEHAWCVLRYEQKWLSLTTPTAGGVSKRKNVEINSPTSTNEGFVDVESRPEGVKAAKAKRNTGKGKSVAEIATV

SEQ ID NO: 54730 - protein, 334 aa, Triticum aestivum
RINRKRRLKKNKSARAGARLPPPPPHYPRPPLRRQPTLPAPHSVSPRALRFPRSAKTISPPPLSVSWKMGAPPWMLLCCCCCRESDRNGVDDLKLKPDAADGEEGAAGDRYDLPPFQDFTFQQLRLATSGFTAENIISESGDKAPNVVYKGKLDAQRRIAVKRFSRSAWPDPRQFMEEAKSVGQLRNKRIVNLLGCCCEADERLLVAEYMPNDTLAKHLFHWESQAMVWPMRLRVVLYLAEALDYCISKERALYHDLNAYRVLFDDDCNPRLSCFGLMKNSRDGKSYSTNLAFTPPEYMRTGESLLRNVSYTALAHCCWMFLVGSIFLLAMLLI

SEQ ID NO: 54731 - protein, 125 aa, Aspergillus oryzae
MSSAKVYVGNLSWNTNDESLRQTFSEFGNVLDAIVMKDRETGRSRGFGFVTFSAQTEADAAIGGLNEQELDGRRIRVNLANARPAGGSRNYGGGNGYGGGYGGGYSQGGYQGGGYQGGNYGQGDY

SEQ ID NO: 54732 - protein, 893 aa, Burkholderia vietnamiensis G4
MRRPAGSRVCRRARESVASYSPWRSFVSGYCRRSPSDAPDAPNAIHDCTGRHVTPRHALCCRDGRPRSEPRHRARRAARRSQRDRRRAPAGLKRVRDEPHARALARGHRRPAARARRTPARADAARDGVARARARGRTRSAGRAAAGSGRPRPRDAVGHLHAARGGVVHGDAGRPGRRRDRRRRARRARALRAAARARPRAAARRLGRSRHRQARRRRAGAAHARAVSRRARRGGAQRPPAVRRGQNHAGALRGLPPRDRGAARRLRRPGRRRRAHGGGRAQRPRGRARLSGCDARRGRHRPDRAGAALEPRQRAHAGARGCARAAQLRDPGQVARDPDLGAVAPAHARRPGASAAARRRHRRLHACVSAKPRAAPPALTVHGTAAPSFSTPFAAAVPWPPGAGRRATPRGGAPGRSAKMPHFPSCPARSSMQPASSARSAAHGADDASSARDLVYGPNDRPAPTIAFVAALQHLLAIIVPIVTPGLLICQALGVASRDTTLIVSMSLVISGIATFVQCKRFGPLGAGLLIVQGTSFNFVGPLIAGGSVMVKQGTPVETVMAAIFGVVIAGSFVEMAVSRILPFVKRLITPLVTGIVVLLIGLTLIKVGLVSMGGGYGAMANGTFASAQNLTLSCVVLGTIIVLNRVPIVWVRSTALVIALAIGYAVAAALGRLDFTGMHQAALFQVPTPLHFGIGFSWSLFVPMLIIYLVTSLEAIGDVTATSKISNEPVEGPVWMRRIKGGVLVNGANSLLAGVFNTFPSSVFAQNNGVIQITGVASRYVGIWIAAMLVVLGLFPVVAGALQAVPEPVLGGAAMVMFGAVAASGINILSGVHLDRRALLIIAVSLALGLGVSQVPDILNSLPHALKNVLASGVATGGICALVMNWFLPERQ

SEQ ID NO: 54733 - protein, 286 aa, Polaromonas sp. JS666
MDKYFVLGNPIQHSKSPQIHARFAELTGQTLEYDRLLTPLDGFAATLAQLVQSGARGCNVTVPFKFEAFQAAGTQSDRAQLAQAANTLKLDGNTIYADNTDGIGLVNDIQNNAGVSLAGRDVLLIGAGGAGAGALAPLLAAGPRRLVLANRTRAKADALVLRHTLHPSLQEALQKTELSAQDLQGIDGSFDVVINASASSLSGGGVPVDSRVLKPGALAYDMMYGPAADGFMTWAREHGATPRDGLGMLVEQAAEAFALWRGVRPPSQQVLQEMRTAMQTQQTQAR

SEQ ID NO: 54734 - protein, 686 aa, Cryptococcus neoformans var. neoformans JEC21
MFRLRPAPGSVPHRLSTLRPIRPLPPSTFRSLSNDAGGKVVRPTNSALSQNFFAGHHRPSSKPHSQLNLVRTRSTFRISSEEFAGKHPYLSVSIRLVLSSIFGLVVLTGAILVHDAFTYSERHVDRVPCNPLSLKPRVGGKKNLPIIEVNLDDEEDDTKRAMRGKPRLVIVGGGWGAVSLIQSLPAHAYNVTLISPQTYFAFTPLLPSACVGTIEPRSLVEPLRKLIARVRGHYLMGAAVDLDMTERLLEVEVPKEDGEGTMRCYVPYDKLVIAVGSTTNNHGVKGLEHCYQLKTVPDAQAIRRKVMNNLELASLPTTTPDERKKLLSFVVCGGGPTGVEFAAELADMMAEDVLKYYPKILSSEVEVTVVQSRDHILNTYSEKISQYAEKRFARNDVKVIINARVQEVKEGRVILSIKNPKDKDAKPEIKELEAGFVLWSTGIAMQPFTKRLVELLPNQYHSKAVEVDGFLRVQGAPQGSVYALGDSATVQTNLMNDLYNLWDKFDINKDGNIDYEEWQEMVKYIKKKHPLAHRSLTKMRAVFEEFDRDHDEKLTLNEVAELFAKLSKKVTSYPATAQVASQQGKYLGAKFSKLAKQRDTLSSNGIFDLDDESYYHPFEYRHLGSLAYIGNSAVFDYEGWSLAGGLLAMYAWRSIYWSEQTSMRTRLLLMLDWVKRGIFGRDLSKF

SEQ ID NO: 54735 - protein, 441 aa, Arabidopsis thaliana
MYGGDEVSAIVVDLGSHTCKAGYAGEDAPKAVFPSVIGAVDGVEAMDVDVDSTKTNSNSEDSKTESEKEKGKRKLYVGSQAMSYRRDHMEVLSPIKDGIVSDWDLVDNIWEHAFKSCLMIDPTEHPMLLAEPPLNTQQQREKAAELMFEKYKVPALFMAKNPVLTSFATGRATSLVVDCGGGSTTISPVHDGYVLQKAVVSSPLGGEFLTDCLLKSLESKGIKIRPRYSFKRKEVRAGEFQVEDVDIPDTTESYKLFCQRMIVGDIKDSICRVPDTPYDDKSYSNIPTTSYELPDGQTLEIGADRFKVPDVMFNPSIVQTIPGMEKYADMIPSVRGLPHMVMESINKCDVDIRRELYSSILLAGGTSSMQQLKERLEKDLIEESPHSARVKVLASGNTTERRFSVWIGGSILASLGSFQQMWFSKSEYEEHGASYIQRKCP

SEQ ID NO: 54736 - protein, 596 aa, Gibberella moniliformis
MRGLNNIAVALALSAIWSFGLDLGRHGTSGSSLLLALFRTLCKAYPFVVISHFVWSAIIWPTFFSPLRQLPNVPSDGWLSKETLRLVSEPRGVPQSDWINSLSNRPVDLARYRSFLGFERLLIISPKALAEVLTTKSYDFRKPGLIVSELKQATGMGVLLAEGSEHKSQRKALQTAFNYRHIKNLYPVFWDVAGEFATVLEKQIPTGTPRTSDTTAVIDIVDWASRATLDIIGRAGMGQGFDAIQNDDSRLHQAYRMIFEPSRGAIFLALLRLIFPERLVNWLPLRRNKRMRHGIQVIRSKCQELIRERKEKIKRQKAGVDNSGNDILTVALLNGVFTDEQLIDQLMTFLAAGHETTATALTWAIYILCKQPEVQNRLREEIRMHFPNPKGWPRSERPSSNTLQQAIDFKLPYLNVVCLEVMRYFAPIPLTMREATCDTTILHTFVPAGTRIILAPRVTNRDSALWGPDANNFNPDRWLSPKNGNREATEQSKFKIGNQKRDSTAAPEVTQEEVRGRTEARSNYADLTFLHGPRSCIGQSFARVEFAILLATLIANFEFQIEDESLLDERNISISRGATSRIVGGLKVRVRPIAVV

SEQ ID NO: 54737 - protein, 140 aa, Glycine max
  misc_feature (19)..(19): Xaa can be any naturally occurring amino acid
  unsure (1)..(140): unsure at all Xaa locations
LDAIKPIADAHFKRFFKYXEIALRDYKAQLEEDPIVPRPLSSLYDSLMEQNLWRLIEPYARVEIAHIAELIKLPVDHVEQKLSQMILDKKFVGTLDQGAGCLVIFDDPKTDAIYPATLETIFNIGKVVDSLYVRSAKIVA

SEQ ID NO: 54738 - protein, 265 aa, Brassica oleracea
MKISIFRYKKNLKDEGSMRLLKFRRKDATQVVANLQRQQVNSRLIASDYLESNIDLMDFLVDGFENTDMALHYGTMFRECIRHQIVAKYVLDSQHVKKFFYYIQLPNFDIAADAAATFKELLTRHKSTVAEFLTKNEDWFFADYNSKLLESSNYITRRQAIKLLGDILLDRSNSVVMTKYVSSMDHLRILMNLLRESSKTIQIDAFHVFKLFVANQRKPSDIINILVANKNKLLRLLADVKPDKEDESFEADKAQVVREIVSLKP

SEQ ID NO: 54739 - protein, 559 aa, Rhodococcus sp. RHA1
MTAQHSDITATSAWQKLHAHRDETSALTIRELFAADTERGRELTLTAGELYIDYSKQRVSRHTLALLVELARAAGVEERRDAMFRGERINTSEDRAVLHTALRLPAHASLRVDGHDVVADVHRVLARMGVFSDRLRSGEWRGATGRPIMTVVNIGIGGSDLGPHMVYRALRHYADSGISVRFISNVDPSDLVATLADLDPSTTLFIVASKTFSTLETLTNAANARRWVTSALGEQAVARHFVAVSTNAERVAAFGIDTENMFGFWDWVGGRYSVGSAVGLAVMVAIGKDSFEEFLDGFHTIDRHFADTPLEDNAPAILALLGVWYSNFFGAETRAILPYSNDLGRFPAYLQQLAMESNGKSVRADGSPIGTTTGAVFWGEPGSNGQHAFYQLLHQGTRLVPADFIGFAEPTHDLPAADGAGSMHNILMSNLFAQSRVLAFGKTPEELTREDTAPDLIAHKTMPGNQPSTTILAPRLTPSVLGQLIALYEHQVFVEGIIYGIGSFDQWGVELGKTQALELEPALSSGNGSLPSDLDSSTASMIRWYHGVRAHGTATVGRP

SEQ ID NO: 54740 - protein, 170 aa, Yarrowia lipolytica CLIB122
MVASILATVAPYHLWTYSLLFGATAYQSFYNGIMAYRALPHEHFSNLQAKLFPGYFAFQALASGILLLTPPFVAGPAFYWPLGICLVGGLLNTLILGPANRRVMAQRKAQLDKEGLSHHKDPKASAELKAINKEFAKVHGASVLVNLIAFGAMTFYGATLTGGLLKTIPK

SEQ ID NO: 54741 - protein, 406 aa, Arabidopsis thaliana
MSAILQGAGAATALSPFNSIDSNKLVAPSRSSLSVRSKRYIVAGSDSKSFGSSLVARRSEPLIPNAVTTKADTAASSTSSKPGHELLLFEALQEGLEEEMDRDPHVCAMGEDVGHYGGSYKVTKGLADKFGDLRVLDTPICENAFTGMGIGAAMTGLRPVIEGMNMGFLLLAFNQISNNCGMLHYTSGGQFTIPVVIRGPGGVGRQLGAEHSQRLESYFQSIPGIQMVACSTPYNAKGLMKAAIRSENPVILFEHVLLYNLKESIPDEEYICNLEEAEMVRPGEHITILTYSRMRYHVMQAAKTLVNKGYDPEVIDIRSLKPFDLYTIGNSVKKTHRVLIVEECMRTGGIGASLTAAINENFHDYLDAPVMCLSSQDVPTPYAGTLEEWTVVQPAQIVTAVEQLCQ

SEQ ID NO: 54742 - protein, 234 aa, Zea mays
  misc_feature (121)..(121): Xaa can be any naturally occurring amino acid
  unsure (1)..(234): unsure at all Xaa locations
IGRQLGEDSRQAGRGSVGGMIAAVNRVPAGWGEDEMSVLPRHTKVVVTGNNRTKSVLVGLHGVVKKAVGLGGWHWLVLTNGIEVKLQRNALSVIEPPTGNEDDDKFDCENMQWNSSDMASXDALSPKPQRSRSRQHRGFHRKSISRSMSCDSHSKTSVSSSSRAHTKVDLSKLELTALLRYWRHFNLDACPNPSREQLVDAVQRHFTAQQLDELQVIVGFVQAAKRLKTTMKVA

SEQ ID NO: 54743 - protein, 96 aa, Arabidopsis thaliana
MDIKHHTSTSKPKNKNKLLKMLPKAMSFGHRVPPFSPGRDLHHNNHHNYTAANKMFFSGPMVPLVPNAARVRRNKSDAVWDEPTSPKVSCIGQIKL

SEQ ID NO: 54744 - protein, 261 aa, Triticum aestivum
  misc_feature (22)..(22): Xaa can be any naturally occurring amino acid
  misc_feature (38)..(38): Xaa can be any naturally occurring amino acid
  misc_feature (46)..(46): Xaa can be any naturally occurring amino acid
  unsure (1)..(261): unsure at all Xaa locations
LLKRSHLQSPSNLPVSMNMGLXVLSSPPSSWSVSSSPXNTAGRASXARRPPGPTKFRETRHPVYRGVRRRGNAERWVCEVRVPGKRGARLWLGTYATAEVAARANDAAMLALGGRSAACLNFADSAWLLAVPPALSDLGDVRRAAVEAVADFQRREAANGSLTATVTEEASCGAPEESSSESDSAGSSETSEPSADAEFEVPVAVDTDMFSRLDLFPEMDLCSYYASLAEALLVDPPSTVAIIDSYWDNGDDGADVALWSY

SEQ ID NO: 54745 - protein, 431 aa, delta proteobacterium MLMS-1
MGIERSRELFARACKYIPGGVNSPVRACKAVGCEPLFVERASGSKVYDADGNEYVDFVCSWGPMILGHNHPAVVAAIRETLENGTSFGAPTSKEIELAELVVDALPSVDKVRFVSSGTEATMSAARLARGYTGRSKVIKFDGCFHGHADSFLIKAGSGVITLGIPGSPGVPEDIVKNTLSIPYNDAEILEKTLRDPELDIACVIIEPVAGNMGVVPPAPGFLETLRQLTSELGIVLIFDEVITGFRLSLGGAQQYYGVIPDLTCLGKIIGGGLPVGAYGGKREIMDQIAPDGPVYQAGTLSGNPLAMAAGAATLRELGRAGFYDELEEKSARFAARLADLAQRHLPGKTTLNRVGSMMTTFFNPGPVNDHATATLSDTEMYAAHYRNMRQQGIWLAPAQYEAAFISAAQSEQDLELALEKTEWSFKKLRKR

SEQ ID NO: 54746 - protein, 442 aa, Mesorhizobium loti MAFF303099
MSNRLKVTPNDLSAFWMPFTANRQFKQAPRMFVSAKDMHYTTSDGRKVLDGTAGLWCVNAGHCRPKITEAIQHQAAELDYAPAFQMGHPIVFELANRLVDIAPKGMDHVFFTNSGSESVETALKMAIAYHRMKGEGARTRLIGRERGYHGVNFGGISVGGIVSNRKMFGTLLGGVDHMPHTHLPEKNAFSKGVPEYGAELANELERIVALHDASTIAAVIVEPVAGSTGVILPPKGYLQKLREICTKHGILLIFDEVITGFGRLGAPFAADYFGVVPDIMTTAKGVSNGVIPMGAVFVKKEIHDAFMTGPEHMIEFFHGYTYSGNPIACAAALGTLDTYKEEGLLTRGEELAPYWEDALHSLKGEPHVIDIRNIGLIGAIELAPIAGSPTKRAFSAFVKAFERGALIRTTGDIIALSPPLIITKGQINELIDHVREVLRSID

SEQ ID NO: 54747 - protein, 333 aa, Pseudomonas syringae pv. syringae B728a
MTLRIAINGFGRIGRNVLRALYTQGYRQDLQVVAINDLGDSEMNAHLLRFDTVHGPFSGTVECDKDSLTVNGDRISVSAIRNPAELPWKAQDIDVVFECTGLFTSRDKAAAHLTAGARKVIISAPASGADATIVYGVNHDTLRQSHQIISSASCTTNCLAPVAQILHRELGIENGLMTTIHAYTNDQNLIDVYHTDPYRARSATQSMIPSKTGAAEAVGLVLPELAGKLTGMAVRVPVINVSLVDLTVTLKRETTADEVNALMKEASQHSKVLGYNSLPLVSHDFNHNPLSSIFDANHTKVSGKLLKVLSWYDNEWAFSNRMLDNCLALHNAQ

SEQ ID NO: 54748 - protein, 656 aa, Ustilago maydis 521
MQKRDARGMPTEDDPLLPSSVQHDSEGASTNPTSPSQEAGPSTPRTAMNASSSMVEATSASSSGSFVSSLIADNPIFSGGLGLMVFGGAVAMTRRGVKVAASTAQRRLLISLEIPSKDRAHPWFLHWMGAQAQAQSMRQRGLLGKQKKEGLVDFLGLRDRSAETLSASSSKDRAHDPLLIASSGSSVSPVRILSHELSVETNYTPHASASTPNAEAAERGKARFSLVPGPGTHWFRYRGVWMRLTRERDGKMVDLSTGAPWETVTLTTLFAYAHLFPQLLEEARQLALSSTEGKTVIYTSWGPEWRPFGQPRRTRELGSVVLGKGKKEAIVDDVKRFLSRDRWYAERGIPYRRGYLLHGAPGSGKSSFITALAGHLDFNICLLNLSERGLTDDKLNHLLSNAPDRSILLLEDVDAAFLGRQQAAEDGYQASVTFSGLLNALDGVASGESRIIFMTTNHIEKLDPALIRPGRVDMIAELGDAEREQVEELMVRFYRTTMREIRIKQAEISPNALEASKPLLAAAAGSTDHASVLESYKSLEAVSGLRAAVQEADDEVRQLAADFGGIVEEEAMARRAASGLGPDGRQADSAYGGPEQASYANAPILTQRVHRPAPSASGGVSMAELQGLFIRFPDDPRTAVEAFVSENASRRHANSA

SEQ ID NO: 54749 - protein, 156 aa, Prochlorococcus marinus str. MIT 9515
MAKEKQENESEIINQTDKSTVITVENEKKASISQTEKIHSSSNLIKEFESEQLKKQLPEIYVGDTVKVGVKITEGNKERVQPYEGVVIAKRHGGLNQTITVRRIFQGIGVERVFMLHSPQVASLKVERRGKVRRAKLFYLRDRVGKATRVKQRFDR

SEQ ID NO: 54750 - protein, 634 aa, Brucella melitensis 16M
MSKRLDLITIGRSSVDLYGAQIGGLLEDMASFNKYVGGSPTNIATGTARLGLRSALITRVGDEHMGRFLLRELEREGVDTRGIVTDPERLTALVILGIRDQQHFPLIFYRENCADMALCEDDIDPDFIAEARCVLATGTHLSHPRTEAAVLKALRLARENGSRTALDIDYRPNLWGLSGHGDGENRFIESAAVTAKLQSTLHLFDLIVGTEEEFHIAGGSTDTLEALKAVRRVTKAALVCKRGPMGAVVFEGDIPDDLDKGQSGQGFPIEVFNVLGAGDGFMSGLLRGWLKGEDWPTSLKFANACGAFAVSRHGCTPAYPSWEELQFFLQRGIRNKALRKDAELEQVHWSTNRNGTWPHMRVFAFDHRIQLEEMAAEAGASTDKIGEFKQLCLDAALKVAGGAQGYGILCDGRLGRDALYRAAGTGLWIGRPAEWPGSRPLKLEPELGPDCGGLMEWPVEHVVKLLCFYHPDDPAEMRAGQEETVQRLFTAARRNRLEFLLEIIPSKAGPVDDMTTARVIERFYEIGVYPDWWKLEPLKTKAAWANACDAITRNDPHTRGIVVLGLDAPAEELEQSLGIAAGFDLVKGFAVGRTIFAEAARKWLSGTIDDAQAIAEMAARYQSLCDVWDKAHAY

SEQ ID NO: 54751 - protein, 654 aa, Prochlorococcus marinus subsp. marinus str. CCMP1375
MCGIAGLICKDRQILALDEIGSKMNTSLLNRGPDDSGIWIDNDIGILLSHTRLSVNDLSKAGHQPMLSSSNRFVLTFNGEIYNHWDLRQELEITQGSQNWKSHSDTETLIQAIECWGVYKTLTKLIGMFAFGIFDRKENKFYLARDRFGEKPIYWGITGVGTRKVLIFGSDLKALKSYPEFNNTINRESMGLFINYNYVPDPHSIYENIWKLEAGKILEIDVTDDDYSKIYPMSWWQLEDTIKNVDGREIENESEAINLLKQELIKSVKSQSKADVKITSFLSGGIDSSLVSALLQETSNSQINTFTIGFENKRFDEATYARRISNYLGSNHSELIFTNEDALNIVPKINEYYSEPFADPAAIPTLLLCNAAKSQGYTVALSGDGADELFGGYNRYTMAPKIWKYFGIIPNFMKPMLINSVNKLSTQSIDLIGSILKIRQFRERLYKITDKISYSNSLEDLYYRLIREWSDVSSITEYKYNQPFTPISNERLNQSIHELKLDPVTFMMVIDCLSYLPGNNQVKLDRASMAVGLETRSPFLDKNVGELIWRLPINLKIKNNCGKYILKEILADYIPKKLFERPKAGFATPINEWIKGPLREWAEEMLNSNKVRDEGFLNPEITTKLLNEHIQGVKDNSKKLWSALIWESWIDKNI

SEQ ID NO: 54752 - protein, 486 aa, Brassica napus
  misc_feature (335)..(335): Xaa can be any naturally occurring amino acid
  unsure (1)..(486): unsure at all Xaa locations
MAMASLYRRSLPSPPAIDFSSSEGKKIFNEALQKGTMEVFFRLISYFQTQSEPAYCGLASLSVVLNALSIDPGRKWKGPWRWFDESMLDCCEPLEVVKEKGISFGKVVCLAHCSGAKVEAFRTNQTTIDDFRKFVMKCSTSENCHMISTYHRGVFKQTGSGHFSPIGGYNAERDMALILDVARFKYPPHWVPLKLLWEAMDSIDDSTGKRRGFMLISRPHREPGLLYTLSCKDESWISIAKYLKEDVPRLVSSQHVDSVEKILSVVFKSLPSNFNTFIRWVAELRIAEDTKQNLSAEEKSRLNLKQVVLKEVHETELFKHISKFLSTVGYEDSLXYAAAKACCQGAEILSGCSSKEFCCRETCVKCIITSPGEAEGTVVTGVVVRYGSEQNVDLLVPSTQTDCECGPEANYPAGNDVFTVLLLALPPQTWSGIKDQALMHEMKQLISMASLPTMLQEEVLHLRRQLQLLKRCQENKEEEDFAAPAF

SEQ ID NO: 54753 - protein, 528 aa, Crocosphaera watsonii WH 8501
MDKQQLWQRYQDWLYYHEGLGVYVDVSRMRFDHGLVTQLTPKFEKAFADMETLESGAIANPDEGRMVGHYWLRAPELAPNDDVRKEITEPLANIGEFVQKVHAGTIKPPTADKFTHVLSVGIGGSALGPQFVAEALSDVDPPMVIHFIDNNDPAGIDRVIEQIGDHLKNTLVLITSKSGGTPETRNGMLEVKNAYESKGLAFEPNAVAVTMPGSKMDKVAVDDKWLARFPMQDWVGGRTSELSAVGLLPAALQGINIDEMLVGAKEMDEATRVKDLKTNPAALLALAWYHSGNGKGEKDMVVLPYKDSLLLFSRYLQQLVMESLGKEKDLDGNTVYQGIAVYGNKGSTDQHAYVQQLREGVPNFFATFIEVLEDGRDTLFEIEPGVTSGDFLSGFLQGTRQALFENNRDSITITIPQVNPRIVGALIALYERTVSFYASLVNINAYHQPGVEAGKKMAASILDLQTKVQTVIKETSEVLDMATLAEKAGSPDEVESVYKIVRHLAANGRGVSLEGELTDLKTLKVSAS

SEQ ID NO: 54754 - protein, 1501 aa, Candida albicans
MSDSKMSSQDESKLEKAISQDSSSENHSINEYHGFDAHTSENIQNLARTFTHDSFKDDSSAGLLKYLTHMSEVPGVNPYEHEEINNDQLNPDSENFNAKFWVKNLRKLFESDPEYYKPSKLGIGYRNLRAYGVANDSDYQPTVTNALWKLATEGFRHFQKDDDSRYFDILKSMDAIMRPGELTVVLGRPGAGCSTLLKTIAVNTYGFHIGKESQITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSAVILDTTPLIAIYQCSQDAYDLFDKVVVLYEGYQIFFGKATKAKEYFKKMGWKCPQRQTTADFLTSLTNPAEREPLPGYEDKVPRTAQEFETYWKNSPEYAELTKEIDEYFVECERSNTRETYRESHVAKQSNNTRPASPYTVSFFMQVRYGVARNFLRMKGDPSIPIFSVFGQLVMGLILSSVFYNLSQTTGSFYYRGAAMFFAVLFNAFSSLLEIMSLFEARPIVEKHKKYALYRPSADALASIISELPVKLAMSMSFNFVFYFMVNFRRNPGRFFFYWLMCIWCTFVMSHLFRSIGAVSTSISGAMTPATVLLLAMVIYTGFVIPTPSMLGWSRWINYINPVGYVFESLMVNEFHGREFQCAQYVPSGPGYENISRSNQVCTAVGSVPGNEMVSGTNYLAGAYQYYNSHKWRNLGITIGFAVFFLAIYIALTEFNKGAMQKGEIVLFLKGSLKKHKRKTAASNKGDIEAGPVAGKLDYQDEAEAVNNEKFTEKGSTGSVDFPENREIFFWRDLTYQVKIKKEDRVILDHVDGWVKPGQITALMGASGAGKTTLLNCLSERVTTGIITDGERLVNGHALDSSFQRSIGYVQQQDVHLPTSTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDRLLFLQKGGRTAYFGELGENCQTMINYFEKYGADPCPKEANPAEWMLQVVGAAPGSHAKQDYFEVWRNSSEYQAVREEINRMEAELSKLPRDNDPEALLKYAAPLWKQYLLVSWRTIVQDWRSPGYIYSKIFLVVSAALFNGFSFFKAKNNMQGLQNQMFSVFMFFIPFNTLVQQMLPYFVKQRDVYEVREAPSRTFSWFAFIAGQITSEIPYQVAVGTIAFFCWYYPLGLYNNATPTDSVNPRGVLMWMLVTAFYVYTATMGQLCMSFSELADNAANLATLLFTMCLNFCGVLAGPDVLPGFWIFMYRCNPFTYLVQAMLSTGLANTFVKCAEREYVSVKPPNGESCSTYLDPYIKFAGGYFETRNDGSCAFCQMSSTNTFLKSVNSLYSERWRNFGIFIAFIAINIILTVIFYWLARVPKGNREKKNKK

SEQ ID NO: 54755 - protein, 404 aa, Glycine max
MTLPLSDRKSRRSPKTYHQNLISDAAIQCGSSFSGAVFNLSTTIVGAGIMALPAAVKQLGLIPGLVMIILCAMLTESSISMLVRFTRASKSSTYSGVVRDAFGGLGRNLLLLCIIVNNVGMLVVYMVIIGDVFSGSWSEGVHYSGVVEEWFGQRWWSTRPVLLFLTAILVLVPLASFRRVDSLRYTSALSVGLAIVFVVITAGIAIVKFIDGSIVMPRLMPKFTGLESFWKLFTTIPILVSAYICHHNVHPIENELQDPSQMKAIVRTSLLLCSSVYIATSLFGFFLFGDNTLDDILANFDGDLGVPYGSFLTDIVRVSYGIHLILVFPIVFYSLRLNIDGLMFPHAIPLAFDTQRFYLVTTVLMAFIFVGANFVPSIWDAFQFIGATAAISAGYIFPAAIALR

SEQ ID NO: 54756 - protein, 69 aa, Glycine max
  misc_feature (44)..(44): Xaa can be any naturally occurring amino acid
  unsure (1)..(69): unsure at all Xaa locations
CRNATSAVPAGASMVAPFTGLKYIAVLPTRNTILDFAYIASNGXRAQCMHVWPPIGKKKVETLSYLPDL

SEQ ID NO: 54757 - protein, 1501 aa, Candida albicans
MSDSKMSSQDESKLEKAISQDSSSENHSINEYHGFDAHTSENIQNLARTFTHDSFKDDSSAGLLKYLTHMSEVPGVNPYEHEEINNDQLNPDSENFNAKFWVKNLRKLFESDPEYYKPSKLGIGYRNLRAYGVANDSDYQPTVTNALWKLATEGFRHFQKDDDSRYFDILKSMDAIMRPGELTVVLGRPGAGCSTLLKTIAVNTYGFHIGKESEITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSAVILDTTPLIAIYQCSQDAYDLFDKVVVLYEGYQIFFGKATKAKEYFEKMGWKCPQRQTTADFLTSLTNPAEREPLPGFEDKVPRTAQEFETYWKNSPEYAELTKEIDEYFVECERSNTRETYRESHVAKQSNNTRPASPYTVSFFMQVRYGVARNFLRMKGDPSIPIFSVFGQLVMGLILSSVFYNLSQTTGSFYYRGAAMFFAVLFNAFSSLLEIMSLFEARPIVEKHKKYALYRPSADALASIISELPVKLAMSMSFNFVFYFMVNFRRNPGRFFFYWLMCIWCTFVMSHLFRSIGAVSTSISGAMTPATVLLLAMVIYTGFVIPTPSMLGWSRWINYINPVGYVFESLMVNEFHGREFQCAQYVPSGPGYENISRSNQVCTAVGSVPGNEMVSGTNYLAGAYQYYNSHKWRNLGITIGFAVFFLAIYIALTEFNKGAMQKGEIVLFLKGSLKKHKRKTAASNKGDIEAGPVAGKLDYQDEAEAVNNEKFSEKGSTGSVDFPENREIFFWRDLTYQVKIKKEDRVILDHVDGWVKPGQITALMGASGAGKTTLLNCLSERVTTGVITDGERLVNGHALDSSFQRSIGYVQQQDVHLPTSTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDRLLFLQKGGRTAYFGELGENCQTMINYFEKYGADPCPKEANPAEWMLQVVGAAPGSHAKQDYFEVWRNSSEYQAVREEINRMEAELSKLPRDNDPEALLKYAAPLWKQYLLVSWRTIVQDWRSPGYIYSKIFLVVSAALFNGFSFFKAKNNMQGLQNQMFSVFMFFIPFNTLVQQMLPYFVKQRDVYEVREAPSRTFSWFAFIAGQITSEIPYQVAVGTIAFFCWYYPLGLYNNATPTDSVNPRGVLMWMLVTAFYVYTATMGQLCMSFSELADNAANLATLLFTMCLNFCGVLAGPDVLPGFWIFMYRCNPFTYLVQAMLSTGLANTFVKCAEREYVSVKPPNGASCSTYLDPYIKFAGGYFETRNDGSCAFCQMSSTNTFLKSVNSLYSERWRNFGIFIAFIAINIILTVIFYWLARVPKGNREKKNKK

SEQ ID NO: 54758 - protein, 285 aa, Saccharomyces cerevisiae
NVTTGEMMAVKQVEVPKYSSQNEAILSTVEALRSEVSTLKDLDHLNIVQYLGFENKNNIYSLFLEYVAGGSVGSLIRMYGRFDEPLIKHLTTQVLKGLAYLHSKGILHRDMKADNLLLDQDGICKISDFGISRKSKDIYSNSDMTMRGTVFWMAPEMVDTKQGYSAKVDIWSLGCIVLEMFAGKRPWSNLEVVAAMFKIGKSKSAPPIPEDTLPLISQIGRNFLDACFEINPEKRPTANELLSHPFSEVNETFNFKSTRLAKFIKSNDKLNSSKLRITSQENKTE

SEQ ID NO: 54759 - protein, 611 aa, Oryza sativa (indica cultivar-group)
MQQLQARRRRGAPGGRRRITHGAPLLAAVAVLLCASVRFAGASPPPGPVRCASGTANCTVTNAYGAFPDRSTCRAAAAAYPASERELLRVVAGAAASRTKMKVATRYGHSVPKLACPGDGGGGGGGLVISTDALNRVVAVDAGRMEITVESGVTLAELIDAAAGGGLALPHSPYWLGLTVGGLLSTGAHGSSVWGKGGAVHEYVVGMRIVTPAPASEGHAKVRVLAAGDPELDAAKVSLGVLGVISQVTLKLQPMFKRSVAFRRRDDDDLAERVAAFAGEHEFADILWLPSQGKAVYRIDDRVPNTTSGDGAVYDLVVFQSSPTVAIQANRIGEDALEATANSAGKCLAGSATIARLAAGNYGVTRRGVLPPPPGAAVVGYQNRIQSSGSCLSGADDGLLTACTWDPRVRHNSFFFQSGISVPLSGAAAFIRDVQRLRDLNPDALCGLEVYYGVLLRYVRASTAHLGKPEDSVELDLTYYRSRDPAAPRLHEDAVEEIEQMALRKYGGVPHWGKNRNAAFDGAIAKYPKSGEFLKVKGSYDPEGLFSSEWSDKVLGVAGAGGVSVVRDGCALEGLCVCSEDAHCSPEKGYLCRPGRVYKEARVCRRVAGDH

SEQ ID NO: 54760 - protein, 1501 aa, Candida albicans
MSDSKMSSQDESKLEKAISQDSSSENHSINEYHGFDAHTSENIQNLARTFTHDSFKDDSSAGLLKYLTHMSEVPGVNPYEHEEINNDQLNPDSENFNAKFWVKNLRKLFESDPEYYKPSKLGIGYRNLRAYGVANDSDYQPTVTNALWKLATEGFRHFQKDDDSRYFDILKSMDAIMRPGELTVVLGRPGAGCSTLLKTIAVNTYGFHIGKESQITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSAVILDTTPLIAIYQCSQDAYDLFDKVVVLYEGYQIFFGKATKAKEYFEKMGWKCPQRQTTADFLTSLTNPAEREPLPGYEDKVPRTAQEFETYWKNSPEYAELTKEIDEYFVECERSNTRETYRESHVAKQSNNTRPASPYTVSFFMQVRYGVARNFLRMKGDPSIPIFSVFGQLVMGLILSSVFYNLSQTTGSFYYRGAAMFFAVLFNAFSSLLEIMSLFEARPIVEKHKKYALYRPSADALASIISELPVKLAMSMSFNFVFYFMVNFRRNPGRFFFYWLMCIWCTFVMSHLFRSIGAVSTSISGAMTPATVLLLAMVIYTGFVIPTPSMLGWSRWINYINPVGYVFESLMVNEFHGREFQCAQYVPSGPGYENISRSNQVCTAVGSVPGNEMVSGTNYLAGAYQYYNSHKWRNLGITIGFAVFFLAIYIALTEFNKGAMQKGEIVLFLKGSLKKHKRKTAASNKGDIEAGPVAGKLDYQDEAEAVNNEKFSEKGSTGSVDFPENREIFFWRDLTYQVKIKKEDRVILDHVDGWVKPGQITALMGASGAGKTTLLNCLSERVTTGVITDGERLVNGHALDSSFQRSIGYVQQQDVHLPTSTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDRLLFLQKGGRTAYFGELGENCQTMINYFEKYGADPCPKEANPAEWMLQVVGAAPGSHAKQDYFEVWRNSSEYQAVREEINRMEAELSKLPRDNDPEALLKYAAPLWKQYLLVSWRTIVQDWRSPGYIYSKIFLVVSAALFNGFSFFKAKNNMQGLQNQMFSVFMFFIPFNTLVQQMLPYFVKQRDVYEVREAPSRTFSWFAFIAGQITSEIPYQVAVGTIAFFCWYYPLGLYNNATPTDSVNPRGVLMWMLVTAFYVYTATMGQLCMSFSELADNAANLATLLFTMCLNFCGVLAGPDVLPGFWIFMYRCNPFTYLVQAMLSTGLANTFVKCAEREYVSVKPPNGESCSTYLDPYIKFAGGYFETRNDGSCAFCQMSSTNTFLKSVNSLYSERWRNFGIFIAFIAINIILTVIFYWLARVPKGNREKKNKK

SEQ ID NO: 54761 - protein, 585 aa, Oryza sativa (indica cultivar-group)
MQGSVVTARRAVHGILVAVVVVQRLLAAGASPPADPVHCASGTARCTVTNAYAAFPDRSTCRAAAAAYPASEEELLRVVAAAAASGTKMKAATRYGHSVPKLSCPGAGDGRGLAISTSALNRVVAVDAAGMAITVESGVTLAELIDAAAGAGLALPHSPYWLGVTVGGLLSTGAHGSSVWGNGSAVHEYVNGMRIVTPAPAREGYAKVRVLAAGDPELDAAKVSLGVLGRSVAFQHCGDGDLAERVVAFAGEHEFADILWYPGHGKAVYRIDDRVPSNTPGDGVYDFVGFRATPTLAIQAKRLVEDGLEATGNAAGKCLAASTTNSILAARNYGLTRNGQLLGAFPGTAVVGYQNRIQSSGSCLAGADDGLLTACPWDPRVEHGTFFFQSGISVPLSRAAAFIRDVQRLRDLNPDALCGVELYDGVLMRYVRASAAHLGKPEDSVDFDLTYYRSRDPATPLLHEDVVEEVEQMALRKYGGVPHWGKNQNAAFEGAAAKYGGARAAAFMRVKRAYDPEGLFSSEWSDKVLGVAGAGGVSVVRDGCALEGLCVCSEDAHCSPEKGYLCRPGRVYKEARVCRRVADDL

SEQ ID NO: 54762 - protein, 325 aa, Rhizobium leguminosarum bv. viciae 3841
MTSVLAPDQLGPTVCVGEILVEIVATTVGDGFLEAQPLVGPFASGAPAIFISQCGRLGGKAAMVGAVGDDDFGRVNTDRLKRDGVDVSTISIDPDYPTGSAFVRYRKDGSRDFVYNIATSAAARFGWSQTVGDLINRSGHLHVMGSALSVPSARAVIDKAVGIVKARGGTLSVDPNIRKELKLDKDTERRFSKLVAAADLLLPSGEELERAAGVEGKAEAIRRLFEVGVKEIVLKRGAEGATYFGRDGDRIDAPAFVVQEVDPTGAGDCFGGAYLTCRRLGMSPQQALTYGSAAGARNVTVLGPMEGAGTQQELDAFIASTERRP

SEQ ID NO: 54763 - protein, 252 aa, Buchnera aphidicola str. Sg (Schizaphis graminum)
MIVFLLKRILLLYLIFFVPKSFSENLPFFKIKSYSEKKEFFQNDNEKVGYSLGVSLGNYVNESFERQKKMGINLDKYNILLGVQDAISGNLKLSNEEISTILQKLEKNLKNAAKIEFEKSEKENLIQGKLYMKKFSEMKGVSKTSSGLLYIIDKLGEGEEIKTKNAEITVHYKGSLINGTEFDSSYKRGKPITLMLKDVILGWQEGLKYIKKGGKIKLIIPPNLGYGSNRINEIPANSILIFDIELLDIKNI

SEQ ID NO: 54764 - protein, 279 aa, Mesorhizobium loti MAFF303099
MDLKDKTILITGSTDGVGRVVAQRLGADGARVLVHGRDAARGKAAVAEIEAAGGRAEFFAADLASLAEIRHLAEAVRARTNRLDILINNAGIGTAAAKRQVSADGYELRFAVNYLAGFLLTSELLPLLKASAPARIVNVASAGQQAIDFGDVMLTHGYSGVRAYCQSKLAQILFTVDLAEQLKGTGVTVNALHPASYMNTTMVRQAGVTPWSSVETGAEAIVNLAASPALEGRSGLYFDGLREARADAQAYDATARQQLRSLSRDLVGAASSKSRERHS

SEQ ID NO: 54765 - protein, 254 aa, Ipomoea batatas
MRVRFFFYFAYFLITLVFFPSVTLQSYSGGHRQEATGFCGEEGEREDNLIRMATTTLGGISDSASAENSVEIESLARFAVEEHNKKENAMIELVRVVKAEEQVVAGKLHHLTLEVIDAGKRKLYEAKVWLKPWMNFKELQGFNHIEDIPTLTSSDLGAKRDWPNTGLKSVPVNDPVVQEAAQHAVKTIQQRSNSLLPYELQEIVHANAEVIDDSAKVHMLIKTKRGEKEEKFSVEVPKNNEGAFFLNHMAPANS

SEQ ID NO: 54766 - protein, 321 aa, Pseudomonas syringae pv. syringae B728a
MKLALVGDIGGTNARFAIWENSTLHSVRVFPTIDYAGPEKAIEVYLQDLELQRGDIGHVCLAVAGPVDGDFFQFTNSHWQLSREAFCADLQVDELLLINDFTAMALGMTRLKDDEYLTVCHGVGKPDRPRVVVGPGTGLGVGTLIKLEGSRWMALPGEGGHADLPIGTAREALLWTRLMAEHEHVSAEVVLSGAGLLLLYQVSCALDDIEPVLKSPAAITTAALSGDPVAAAVLEQFCVFLGRVVGNHVLALGSLGGVYIVGGVVPRFTEFFINSGFKRAMAEKGVMSDYFKGLPVWLVTAEYPGLMGSGVALQQAFGAQI

SEQ ID NO: 54767 - protein, 227 aa, Streptomyces avermitilis MA-4680
MHLDHAHTHDGPSAVSADAHRPDGTRRALRIGLGGPVGSGKTATVAALCRALRDAFSLAVVTNDIYTREDAEFLLREAVLPPERITAVETGACPHTAIRDDISANLEAVEDLEDEVGPLDLVLVESGGDNLTATFSKGLVDAQIFVIDVAGGDDIPRKGGPGVTTADLLVVNKTDLAPYVGSDLGRMAADAKAQRAELPVVFQSLRTEPGVAPVADWVRARLAAWAA

SEQ ID NO: 54768 - protein, 244 aa, Haematococcus pluvialis
MATERELALYSAKLSEQAERYPDMVSEMKKIAAGAQDQELSVEERNLLSVAYKNLVGARRASWRILQSVEQSELAKGNEKRVKLIQKYRTVVEKELDEVCGEILSLLDTYLVPSASSVEASVFYLKMKADYHRYLAEFKVDEDRRSAAEKTLEAYKAAQNKATSELPSTNPIRLGLALNFSVFYYEVLNQPDQACSLAKQAFDEAISDLDTLGEDSYKDSALIMQLLRDNLTLWTSEMQDSKPE

SEQ ID NO: 54769 - protein, 624 aa, Oryza sativa (japonica cultivar-group)
MVQDEVTEEVPLDPLFNRTGNVWHVFIEGELHNMLYGYRFDGMFAPHCGQYFDVSNVVVDPYAKAVISRGEYGVPGPGGDCWPQMAGMIPLPYSTELGVNCVELMPCHEFNELEYFSCSSKMNFWGYSTINFFSPMIRYSSGGIRNCGRDAINEFKTFVREAHKRGIEVIMDVVFNHTAEGNEKGPILSFRGIDNSTYYMLAPKGEFYNYSGCGNTFNCNHPVVREFIVDCLRYWVTEMHVDGFRFDLASIMTRGCSLWDPVNVYGSPVEGDMTTTGTPLATPPLIDMISNDPILGDVKLIAEAWDAGGLYQVGQFPHWKIWSEWNGKGMGYEKYRDIVRQFIKGTDGFAGGFAECLCGSPHLYQAGGRKPWHSINFVCAHDGFTLADLVTYNKKYNSSNGEDNRDGENHNLSWNCGEEGEFAGLSVKRLRKRQMRNFFVSLMVSQGVPMFYMGDEYGHTKGGNNNTYCHDHYVNYFRWDKKEESSDLQRFCSLMTKFRKQCESLGLADFPTAQRLHWHGHQPGKPDWSETSRFVAFSTKDETKGEIYVAFNASHLPAVVGLPERPGYRWEPLVDTGKPAPYDFLTDDLPDRAHAVHLFSHFLNSNLYPMLSYSSIILELQPDD

SEQ ID NO: 54770 - protein, 268 aa, Prochlorococcus marinus str. MIT 9515
MSTSFKNVTPTGPGGTATLLIVLSFTGFLLLTQSLFVVPSGQVAVVTTLGKVSGGSRRAGLNFKVPFVQSVFPFDIKTQVQPEKFETLTKDLQVIRATATVKYSVKPNEAGRIFATIASRNSDVYQKIVQPSLLKALKSVFSQYELETIATEFNVISERVADTVAEELNSFDYVDVKSLDLTGLEIAEEYRAAIEQKQIAGQLLLRAKTEVEIAEQEALRYETLNKGLNDQVLFKLFLDKWDGSTQVVPGLPGTNGGTPPVIVGGNNR

SEQ ID NO: 54771 - protein, 413 aa, Prochlorococcus marinus str. MIT 9515
MPGGVSSPVRAFKSVGGQPIVFDRVKGPFAWDVDGNRYIDYIGSWGPAICGHAHPEVITALQEAIEKGTSFGAPCVQENKLAEMVIDAVPSVEMVRFVNSGTEACMAVLRLMRAFTGRDKVIKFDGCYHGHADMFLVKAGSGVATLGLPDSPGVPRTTTANTLTAPYNDLEAVKKLFSENPDAISGVILEPIVGNAGFITPEPGFLEGLRELTTENGSLLVFDEVMTGFRISYGGAQEKFGVTPDLTTLGKVIGGGLPVGAYGGRKEIMSMVAPSGPVYQAGTLSGNPLAMTAGIKTLELLKQEGTYEKMGLATSRLIEGIMQSAENNGIAINGGSVSAMFGFFLCEGPVRNFEEAKTNNSELFGKLHREMIKRGVYLAPSPFEAGFTSLAHSEEEIDRTIEAFDQSFSVIKN

SEQ ID NO: 54772 - protein, 309 aa, Bacillus halodurans C-125
MQEIFAVLPETIRQLLKKLPPSIQKDVEEIRIRVHRPLEVIVNHLPHYPEHQGCEYVVTTKDAQFLLNQLSAYSIYAFEEELKRGFITMAGGHRVGLAGKVTLEKGYVKTVRDISSFNIRVAKQKIGTAEPLISHVYQKGWLNTLLIGPPQSGKTTLLRDLARLVSVGWSRKGIPPLKVGIVDERSEIAAAVKGVPQHELGMRVDVLDGCPKAEGMMMMIRSMSPDVLIVDEIGRKEDCVAIQEALHAGVKVMTTAHGYELEEVSKRPAIRELLEIEAFDRCIELERRAKPGVVRRIRNAKAKDVGYVS

SEQ ID NO: 54773 - protein, 209 aa, Manihot esculenta
LSSKSRQGNREFVTEIGMISGLRHPNLVKLYGCCVEGNQLLLVYEYMENNSLAHALFDSETSSLMLDWATRQKICVGIARGLAFLHEESPLRIIHRDIKATNVLLDRDLNAKISDFGLAKLFEEDNTHVSTRIAGTIGYMAPEYALWGYLTEKADVYSFGVVALEIVSGRCNTSYRPKNDAVCLLDWAFILHQRGNLMEIVDPRLGFEF

SEQ ID NO: 54774 - protein, 408 aa, Erwinia carotovora subsp. atroseptica SCRI1043
MSSVDILVPDLPESVADATVATWHKKPGDSVQRDEVLVEIETDKVVLEVPASEAGILDAVLEEEGATVMSRQLLGRIRRGDSSGKETGEKSQSKESTPAQRHTAGLEEEHSDALSPAIRRLIAEHNLDASAIKGSGVGGRITREDVDKHLAAQKKDSAKAAKPEAPAASPAPALGARSEKRVPMTRLRKRVAERLLEAKNSTAMLTTFNEINMQPIMDLRKQYGEAFEKRHGVRLGFMSFYIKAVVEALKRYPEVNASIDGEDVVYHNYFDVSIAVSTPRGLVTPVLRDVDALGMADIEKRIKELAVKGRDGKLTVEELLGGNFTITNGGVFGSLMSTPIINPPQSAILGMHAIKDRPMAVDGQVVILPMMYLALSYDHRLVDGRESVGFLVTVKEMLEDPARLLLDV

SEQ ID NO: 54775 - protein, 416 aa, Pseudomonas fluorescens
MDAFNYRGGELFAEGVALSAIAERFGTPTYVYSRAHIEAQYRTFADALEGMPHLVCFAVKANSNLGVLNVLARLGAGFDIVSGGELERVLAAGGSADKIVFSGVGKTREDMRRALEVGVHCFNIESTDELGSRLQIVAAELGVRAPISLRVNPDVDAGTHPYISTGLKENKFGIAIADAEDVYVRAAQLPNLEVLGVDCHIGSQLTTLEPFIDALDRLLALVDRLGDCGIYLRHIDLGGGVGVRYRDEEPPLVADYIKAVRERLDGRDLALMFEPGRYIVANAGVLLTQVEYLKHTEHKDFAIVDAAMNDLIRPALYQAWMDVTAVRPRDTAARSYDIVGPICETGDFLAKGRELALEEGDLLAVHSAGAYGFVMSSNYNTRGRCAEVLVDGDQAFEVRRRETVAELFAGESLLPE

SEQ ID NO: 54776 - protein, 711 aa, Streptococcus pyogenes M1 GAS
MMSKLVFFWQNREKEFRDFGGFSEKSVYFCDTIDNRKRLILVVINREVLLMTFDAIDQLAVNTVRTLSMDAIQAANSGHPGLPMGAAPMAYVLWNHFMNINPKTSRNWSNRDRFILSAGHGSAMLYSLLHLAGYDLSVEDLKNFRQWGSKTPGHPEVNHTDGVEATTGPLGQGIANAVGMAMAEAHLAAKFNKPGFDIVDHYTFALNGDGDLMEGVSQEAASMAGHLKLGKLVLLYDSNDISLDGPTSMAFTEDVKGRFEAYGWQHILVKDGNDLEEIAAAIEAAKAETEKPTIIEVKTIIGFGAEKQGTSAVHGAPLGAEGIAFAKKAYQWTHQDFEVPAEVTERFAQGLQARGEKAEQAWNDLFAAYEAEYPELAAEYQKAFTNEAAQVELEAHELGSSMASRVSSQQAIQQISEQVASFWGGSADLSASNNTMVKAETDFQPGHYEGRNIWFGVREFAMAAAMNGIALHGGTRVYGGTFFVFSNYLLPAVRMAALQNLPTVYVMTHDSIAVGEDGPTHEPIEQLASVRSMPNLNVIRPADGNETNAAWKRAIAETDRPTMLVLTRQNLPVLEGTKELAEDGLSKGAYILSEAKGDLDGILIATGSEVKLAMDTQEALEAEGIHVRVVSMPSQNIFDEQSAEYKESILPAAVTKRLAIEAGSSFGWAKYVGLSGKTLTIDTWGASAPGNRIFEEYGFTVANATELYKSL

SEQ ID NO: 54777 - protein, 421 aa, Sulfitobacter sp. EE-36
MDHFLYRDGALLAEDVAISEIAAAVGTPFYVYSTATLLRHFKAFDDALDGMDHLVCYAMKANSNQAVLKTLAQAGAGMDVVSAGEYLRAKAAGVPGDKIVFSGVGKTVSEIRLALEGGIRQFNVESEPEMEVLDAVARSMDKVAPITIRVNPDVDAKTHAKIATGKSENKFGIPIARAREVYRMAAAMPGLEVVGIDVHIGSQLTDLTPFELAYQKVAELTEQLRADGHTIRRLDLGGGLGIPYERSNAAPPLPTDYGAMVQKTLGHLGCEIEIEPGRLIAGNAGLMVSEVIYVKSGEGRDFLIIDGAMNDLIRPAMYEAHHDIIPVVEAEAGAEQQPYDIVGPVCESGDTFAKQRMMPKLAAGDLVAFRSAGAYGAVMASEYNSRALIPEVLVHGDQFAVIRRRPTFDEMINRDTIPEWL

SEQ ID NO: 54778 - protein, 68 aa, Triticum aestivum
  misc_feature (43)..(43): Xaa can be any naturally occurring amino acid
  unsure (1)..(68): unsure at all Xaa locations
KLLLYEGKTHTDIFIQDPLRGGRDPLVEDVFSIIYADDATRRXTASAPTPRRLVFEWQLQLAGGISPF

SEQ ID NO: 54779 - protein, 311 aa, Arabidopsis thaliana
MDPYPYSHGSGFVNLLTSQQEVHTLETNPCDDVPIFSTQCTDSPSLEEHVPKVKRERMKWSAKEDMVLVSSWLNTSKDAVIGNEQKANTFWSRIAAYYDASPQLNGLRKRMQGNIKQRWAKINDGVCKFVGSYEAASREKSSGQNDNDVISLAHEIFNNDYGYKFPLEHAWRVLRHDQKWCSQASVMSKRRKCDKAAQPSTSQPPSHGVEEAMSRPIGVKAAKAKAKKTVTKTTTVEDKGNAMLEIQSIWEIKQKDWELRQKDREQEKEDFEKKDRLSKTTLLESLIAKKEPLTDNEVTLKNKLIDFLLEH

SEQ ID NO: 54780 - protein, 321 aa, Bacillus halodurans C-125
MDRQTIAQKFQERILGLLFYPYHSRILQTFTQKWRDRIDRDRSNALEPSTIPFVQREEKILPTSYGGTRVLIYRPDKTLNSSIPVYVNMHGGGFVMGNAEMDDVWCRVIADRANCVVVNIDYRLAPQHKFPTAVYECYEVVKWLVDHPEQFSITPQKVAIGGHSAGGNLATAVCLLNLERGNELPIIYQIIDYAPLDLHTDPALKPSFKDAIPVKMARLFNASYVETEEDARNPLASPLFAESLQGLPDALVITAERDSLAAEGEQYAERLKQAGVKVTYKDYKGMPHGFTHAGDLAVAEHAWHLMCDKLKEAFSESCGPM

SEQ ID NO: 54781 - protein, 398 aa, Cafeteria roenbergensis
MFIKRKLKETEIKDFTLNFGPQHPAAHGVLRLILELNGETIKNADPHIGLLHRGTEKLIENRNYLQALPYFDRLDYVSMMVQEHAYSLAVERLYGINIPQRAQWIRVLFSEITRILNHLLAIGCHSMDVGAMTPLLWGFEEREKLMEFYERVSGARMHASYIRPGGVAQDLPSGFVEDVYSFILDFSVRLDEIEELLTNNRIWKQRLVNVGIVTAKQAIQNGFSGVLLRSTGIPWDLRRSQPYEIYDKVPFRIPVGTRGDCYDRYLIRMQEMRQSLRIMMACLKYLPGGSIKSDDKKFVPPLRWEMKNSMESVIHHFKYFTEGFKVPAGQTYAAVEAPKGEMGVFLISDGSNQPFRCKIKAPGFFHLQNLPEMTKHHMIADVVTIIGTQDIVFGEVDR

SEQ ID NO: 54782 - protein, 345 aa, uncultured bacterium
SAHNTIAALLDNYLFHHSGEGLLREIYWKRVLDVNDRSLRNVTIGQQGEGVERQTGFDITSASELMAILCLASSIEDLRRRIGNIILGITRDSQPFTVNDLKATGAVTALLLDAVHPNLVQTTEQTPALIHGGPFANIAHGCSSVLATKVALTYSDYVVTEAGFGADLGAEKFFDIKCRKTGLQPALTVIVVTTQGLKMHGGISIDRIKEPNMKGLEAGFRNMDRHIRNLWSFGQRVVVAINHFDFDKEEEIDCICRHCKELGVDSAINKAFAQGGEGACDLARMVVDNISHKPSQSLRYAYRDEDDITTKIEKVCKNIYGAATVTYSEKAKAQLHEMQLIFGNN

SEQ ID NO: 54783 - protein, 1499 aa, Candida albicans
MSTANTSLSQQLDEKPWVDASDNSSVQEYQGFDATASHNIQDLARKLTHDSTNGDHHSANDLARYLSHMSDIPGVSPFNGNISHEKLDPDSENFNAKYWVKNLKKLFESDSDYYKPSKLGVAYRNLRAYGIANDSDYQPTVSNALWKFTTEAINKLKKPDDSKYFDILKSMDAIMRPGELTVVLGRPGAGCSTLLKTIAVNTYGFHIGKESQITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSATILDTTPLIAIYQCSQDAYELFDNVVVLYEGYQIFFGKASKAKEYFENMGWKCPQRQTTADFLTSLTNPAEREPLPGYEDKVPRTAQEFETFWKNSPEYAELTKEIDEYFVECERSNTGETYRESHVAKQSNNTRPSSPYTVSFFMQVRYVIARNFLRMKGDPSIPLISILSQLVMGLILASVFFNLRKSTDTFYFRGGALFFSVLFNAFSSLLEILSLYEARPIVEKHRKYALYRPSADALASIISELPVKLLMTMSFNIVYYFMVNLRRTAGNFFFYWLMCALCTLVMSHMFRSIGAVTTTIATAMSLSTVFLLAMIIYAGFVLPIPYILGWSKWIRYINPVTYIFESLMVNEFHGREFECGQYIPSGPSFENLPVENKVCTTVGSTPGSTAVQGTEYIKLAYQFYSSHKWRNFGITVAFAVFFLGVYVALTEFNKGAMQKGEIVLFLKGSLKKHKRKTAASSKGDIEAGPVAGKLDYQDEAEAVNNEKFTEKGSTGSVDFPENREIFFWKDLTYQVKIKKEDRVILDHVDGWVKPGQITALMGASGAGKTTLLNCLSERVTTGIITDGERLVNGHALDSSFQRSIGYVQQQDVHLETTTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDRLLFLQKGGRTAYFGELGENCQTMINYFEKYGANPCPKEANPAEWMLQVVGAAPGSHAKQDYFEVWRNSSEYQAVREEINRMEAELSKLPRDNDPEALLKYAAPLWKQYLLVSWRTIVQDWRSPGYIYSKLILVISSSLFIGFSFFKSKNNLQGLQSQMLAVFMFFVPFTTFIDQMLPYFVKHRAVYEVREAPSRTFSWFAFIAGQITSEIPFQIVVGTISYFCWYYPVGLYANAEPTDSVNSRGVLMWMLLTAFYVYTSTMGQLAISFNELIDNAANLATTLFTLCLMFCGVLAGPNVIPGFWIFMYRCNPFTYLIQAILSTGLANAKVTCAPRELVTLKPPMGETCSSFIGPYTEAAGGYFSTNSDGTCSVCRIDSTNQFLESINALFSQRWRNFGIFVAFIGINIILTIFFYWLARVPKGNREKKMKK

SEQ ID NO: 54784 - protein, 353 aa, uncultured bacterium
IGAANNLLAAMLDNHIQQGNSLGIDVKQITWKRAVDMNDRQLRRIVDGLGGRAQGVPREDGFEITVASEIMAVLCLASDLKDLKARLARIIVGYTYDGKPVTAHDLKAEGAMTALLKDAIKPNLVQTLEGTPAFVHGGPFANIAHGCNSVIATHTALKLADYVITEAGFAADLGAEKFLDIKCRVSDLHPSAVVIVATVRALKYHGGIPKAELNAENLEALEKGLPNLLQHVSNIKNVFGLPCVVAINAFPTDTEAELKLVEKKCRELGVNVALSEVWAKGGEGGIAAGRRSRPSAVSSPTALLSPMPLEMSIEEKLETICKKIYHADGVTLDANARKQAEQLTALGFDKLPI

SEQ ID NO: 54785 - protein, 404 aa, Buchnera aphidicola str. Sg (Schizaphis graminum)
MIGKIKLITRDSFNKLILPVYNPAFFIPVKGKGSRLWDQKGKEYIDFSGGIAVTSLGHCHPVLNKVLRQQSKKLWHISNIFTNEPALRLADKLISSSFASRVFFANSGAEANEAAFKLARYYSSKIYNLKKNKIISFYNSFHGRTFFTVSVGGQAKYSDFFGPKPPAIMHAKFNEINSVKSIIDDNTCAVVMELIQGEGGIVPADVAFVREIRDLCYKYNALLIFDEIQTGIGRTSKLYAYEHYEVQPDILTIAKSLGSGFPISATLTTNGIASVIKPGIHGTTYGGNPLACSIAESVVNIVNTKKFLLGVEKKSKKIISELNIINKRFGLFTEIRGKGLLIGIVLRPELSEEIHNILNALFLEGVIVLTAGKNVIRLAPSLIISKRDIVEGMKRFYCALEKCL

SEQ ID NO: 54786 - protein, 1499 aa, Candida albicans
MSTANTSLSQQLDEKPWVDASDNSSVQEYQGFDATASHNIQDLARKLTHGSTNGDHHSTNDLARYLSHMSDIPGVSPFNGNISHEQLDPDSENFNAKYWVKNLKKLFESDSDYYKPSKLGVAYRNLRAYGIANDSDYQPTVTNALWKFTTEAINKLKKPDDSKYFDILKSMDAIMRPGKLTVVLGRPGAGCSTLLKTIAVNTYGFHIGKESQITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSAVILDTTPLIAIYQCSQDAYELFDNVVVLYEGYQIFFGKASKAKEYFKNMGWKCPQRQTTADFLTSLTNPAEREPLPGFEDKVPRTAQEFETYWKNSPEYAELTKEIDEYFVECERSNTRETYRESHVAKQSNNTRPASPYTVSFFMQVRYVIARNFLRMKGDPSIPLISILSQLVMGLILASVFFNLRKSTDTFYFRGGALFFSVLFNAFSSLLEILSLYEARPIVEKHRKYALYRPSADALASIISELPVKLLMTMSFNIVYYFMVNLRRTAGNFFFYWLMCASCTLVMSHMFRSIGAVTTTIATAMSLSTVFLLAMIIYAGFVLPIPYILGWSKWIRYINPVTYIFESLMVNEFHGREFECGQYIPSGPGFENLPVENKVCTTVGSTPGSTVVQGTEYIKLAYQFYSSHKWRNFGITVAFAVFFLGVYVALTEFNKGAMQKGEIVLFLKGSLKKHKRKTAASNKGDIEAGPVAGKLDYQDEAEAVNNEKFTEKGSTGSVDFPENREIFFWRDLTYQVKIKKEDRVILDHVDGWVKPGQITALMGASGAGKTTLLNCLSERVTTGIITDGERLVNGHALDSSFQRSIGYVQQQDVHLETTTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDKLLFLQKGGRTAYFGELGENCQTMINYFEKYGADPCPKEANPAEWMLQVVGAAPGSHAKQDYFEVWRNSSEYQAVREEINRMEAELSKLPRDNDPEALLKYAAPLWKQYLLVSWRTIVQDWRSPGYIYSKLILVISSSLFIGFSFFKSKNNLQGLQSQMLAVFMFFVPFTTFIDQMLPYFVKHRAVYEVREAPSRTFSWFAFIAGQITSEIPFQIVVGTISYFCWYYPVGLYANAEPTDSVNSRGVLMWMLLTAFYVYTSTMGQLAISFNELIDNAANLATTLFTLCLMFCGVLAGPNVIPGFWIFMYRCNPFTYLIQAILSTGLANAKVTCAPRELVTLKPPMGETCSSFIGPYTEAAGGYFSTNSDGTCSVCRIDSTNQFLESINALFSQRWRNFGIFVAFIAVNIILTIFFYWLARVPKGNREKKLKK

SEQ ID NO: 54787 - protein, 352 aa, uncultured bacterium
IGAANNPLAAMLDNHIQQGNALNIDPRRITWRRAVDMNDRQLRNIVDGLGARTDGTPRQDGFDITVASEVMAVLCLASSITDLKERLARIVVGYTYDNNPVTAGDLKAQGAMAALLKDALKPNLVQTLEHTPAFIHGGPFANIAHGCNSVTATRMALKLGDYAITEAGFGADLGAEKFLDIKCRMASLKPDAVVIVATVRALKSHGGVAKANLAEENLEALEKGLPNLLQHVRNITEVYHLPCVVAINRFPTDSEAELKLVEEKCRELGVNAALSEVWAKGGKGGKALAEEVVRLCEQKNDFEFCYDLDLPIMDKLNTIARRIYHADGVDLLASAPKQLKQLEELGYGKLPI

SEQ ID NO: 54788 - protein, 1499 aa, Candida albicans
MSTANTSLSQQLDEKPWVDASDNSSVQEYQGFDATASHNIQDLARKLTHGSTNGDHHSANDLARYLSHMSDIPGVSPFNGNISHEQLDPDSENFNAKYWVKNLKKLFESDSDYYKPSKLGVAYRNLRAYGIANDSDYQPTVTNALWKFTTEAINKLKKPDDSKYFDILKSMDAIMRPGELTVVLGRPGAGCSTLLKTIAVNTYGFHIGKESQITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSATILDTTPLIAIYQCSQDAYELFDNVVVLYEGYQIFFGKASKAKEYFENMGWKCPQRQTTADFLTSLTNPAEREPLPGYEDKVPRTAQEFETFWKNSPEYAELTKEIDEYFVECERSNTGETYRESHVAKQSNNTRPSSPYTVSFFMQVRYVIARNFLRMKGDPSIPLISILSQLVMGLILASVFFNLRKSTDTFYFRGGALFFSVLFNAFSSLLEILSLYEARPIVEKHRKYALYRPSADALASIISELPVKLLMTMSFNIVYYFMVNLRRTAGNFFFYWLMCASCTLVMSHMFRSIGAVTTTIATAMSLSTVFLLAMIIYAGFVLPIPYILGWSRWIRYINPVTYIFESLMVNEFHGREFECGQYIPSGPGFENLPVENKVCTTVGSTPGSTVVQGTEYIKLAYQFYSSHKWRNFGITVAFAVFFLGVYVALTEFNKGAMQKGEIVLFLKGSLKKHKRKTAASNKGDIEAGPVAGKLDYQDEAEAVNNEKFTEKGSTGSVDFPENREIFFWRDLTYQVKIKKEDRVILDHVDGWVKPGQITALMGASGAGKTTLLNCLSERVTTGIITDGERLVNGHALDSSFQRSIGYVQQQDVHLETTTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDRLLFLQKGGRTAYFGELGENCQTMINYFEKYGANPCPKEANPAEWMLQVVGAAPGSHAKQDYFEVWRNSSEYQAVKEEINRMEAELSKLPRDNDPEALLKYAAPLWKQYLLVSWRTIVQDWRSPGYIYSKLILVISSSLFIGFSFFKSKNNLQGLQSQMLAVFMFFVPFTTFIDQMLPYFVKHRAVYEVREAPSRTFSWFAFIAGQITSEIPFQIVVGTISYFCWYYPVGLYANAEPTDSVNSRGVLMWMLLTAFYVYTSTMGQLAISFNELIDNAANLATTLFTLCLMFCGVLAGPNVIPGFWIFMYRCNPFTYLIQAILSTGLANAKVTCAPRELVTLKPPMGETCSSFIGPYTEAAGGYFSTNSDGTCSVCRIDSTNQFLESINALFSQRWRNFGIFVAFIGINIILTIFFYWLARVPKGNREKKMKK

SEQ ID NO: 54789 - protein, 387 aa, Petroselinum crispum
MDGSTQPSDTVMSDAAPASQTAGIENIPASLSHGGRFIQYNIFGNIFEVTAKYKPPILPIGKGAYGIVCSALNLETNEHVAIKKIANAFDNKVDAKRTLREIKLLRHMDHENVVAIRDIIPPPQRGSFNDVYIAYELMDTDLHQIIRSNQGLSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVHQLRLLMELIGTPSEAELEFLNENAKRYIRQLPLYRRQSLTEKFPNVHPSAIDLVEKMLTFDPRRRLTVEDALAHPYLTSLHDISDEPVCAAPFSFDFEQHALTEEQMRELIYREALAFNPEHQQM

SEQ ID NO: 54790 - protein, 1499 aa, Candida albicans
MSTANTSLSQQLDEKPWVDASDNSSVQEYQGFDATASHNIQDLARKLTHGSTNGDHHSANDLARYLSHMSDIPGVSPFNGNISHEQLDPDSENFNAKYWVKNLKKLFESDSDYYKPSKLGIAYRNLRAYGIANDSDYQPTVTNALWKFTTEAINKLKKPDDSKYFDILKSMDAIMRPGKLTVVLGRPGAGCSTLLKTIAVNTYGFHIGKESQITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSATILDTTPLIAIYQCSQDAYELFDNVVVLYEGYQIFFGKASKAKEYFENMGWKCPQRQTTADFLTSLTNPAEREPLPGYEDKVPRTAQEFETFWKNSPQYAELTKEIDEYFVECERSNTGETYCESHVAKQSNNTRPSSPYTVSFFMQVRYVIARNFLRMKGDPSIPLISILSQLVMGLILASVFFNLRKSTDTFYFRGGALFFSVLFNAFSSLLEILSLYEARPIVEKHRKYALYRPSADALASIISELPVKLLMTMSFNIVYYFMVNLRRTAGNFFFYWLMCALCTLVMSHMFRSIGAVTTTIATAMSLSTVFLLAMIIYAGFVLPIPYILGWSKWIRYINPVTYIFESLMVNEFHGREFECGQYIPSGPGFENLPVENKVCTTVGSTPGSTVVQGTEYIKLAYQFYSSHKWRNFGITVAFAVFFLGVYVALTEFNKGAMQKGEIVLFLKGSLKKHKRKTAASNKGDIEAGPVAGKLDYQDEAEAVNNEKFTEKGSTGSVDFPENREIFFWRDLTYQVKIKKEDRVILDHVDGWVKPGQITALMGASGAGKTTLLNCLSERVTTGIITDGERLVNGHALDSSFQRSIGYVQQQDVHLETTTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDKLLFLQKGGRTAYFGELGENCQTMINYFEKYGADPCPKEANPAEWMLQVVGAAPGSHAKQDYFEVWRNSSEYQAVREEINRMEAELSKLPRDNDPEALLKYAAPLWKQYLLVSWRTIVQDWRSPGYIYSKLILVISSSLFIGFSFFKSKNNLQGLQSQMLAVFMFFVPFTTFIDQMLPYFVKHRAVYEVREAPSRTFSWFAFIAGQITSEIPFQIVVGTISYFCWYYPVGLYANAEPTDSVNSRGVLMWMLLTAFYVYTSTMGQLAISFNELIDNAANLATTLFTLCLMFCGVLAGPNVIPRFWIFMYRCNPFTYLIQAILSTGLANAKVTCAPRELVTLKPPMGETCSSFIGPYTEAAGGYFSTNSDGTCSVCRIDSTNQFLESINALFSQRWRNFGIFVAFIAVNIILTIFFYWLARVPKGNREKKMKK

SEQ ID NO: 54791 - protein, 336 aa, Rhizobium leguminosarum bv. viciae 3841
MRAVRLESIGSLTMRSVEKPVAGPGELLVRVSVAGICGSDRHMYKGEYPTAIPVTLGHEFCGIVEAIGDTVTRFTGGELVTVDPNIACGTCRACTQARPNLCESLTAIGVTRDGGFAEYVAVPQAQAFVLPADLDPVHGVFSEPLACCIHAIDKARIRPGDSVAILGGGVIGLLMVQLARLAGAGEVVLITRQQSRRQTALRLGATHAFDPAASDTIASVREVTKGGADVVIECAGVSDTLQSGLKMARRGGSFVLFGVTPAGVEVPVLPFDLLVNEVDIRPAYLNPFTHSRAAAMVASGALELDALVTKTIGLEEVADVVGNAPLPGEIKVIVRP

SEQ ID NO: 54792 - protein, 424 aa, Rhizobium leguminosarum bv. viciae 3841
MPTPSLKSHYSAVVIGGGQAGLSASYYLKSHGIDHVVFEKKTVAHKWKNERWDAFCLVTPNWQCQLPDHPYDGTDPHGFMVKDEILAYVDRFVKKVDAPIFEQTGVTSLEKHGGLFRLETSAGAVTADAVVIATSLYADPAIPRAGERLPEDITQIHTAAYRNADQLPDGGVIVVGSGQSGCQIAEDLHLAGRKVHLVTGNAPRCARFYRGRDVVDWLSDIGQYDITVEHGGMTKKKHDTNHYLTGRDGGRDIDLRKFALEGIALYGRMSGVAAGRMLFEPNLKANLDGADRVYNGINALIDRHIAEKGIEAPAGSPYVPVWEPEAEIAELDLKAEGITSVIWATGFSPDWSFVGLPIFDGNAYPVHRRGVTAVDGVYVLGLPWLWTWGSGRFLSVGRDAEHVVGHLAARHSAQTSSLKQSVSA

SEQ ID NO: 54793 - protein, 626 aa, Bordetella pertussis Tohama I
MPAATDPDIAALVARAAAVAPERRSGTLRDLDHIVILMQENRGFDHYYGALPGARGRADPHRAPTPDGDVFVQAHAGQRLAPYPLAPALPPGQPLGHLTPHTWDDAQRAWNDGRMDQWLAAKGRLGMGYYRPEELPLQTALARAFTLCEAYHCSMHAGTNPNRLFLWTGTNDPHGQAGGPALVNTHDRPGPAHEGYAWTTYPERLQAAGVDWAIYQDMADNYHDNPLAGFRQYRAELAGGAARAPLRERALSTRTLAALAEDAANGRLPQVAWIIAPAADSEHPEVSSPAQGAAFSARVLDILTRAPALWRRCALLLTYDENDCFFDHMPPPAPPGAAGGGSTADTAGEYHQARGGPSAGTPDDPRALHGRAYGLGPRVPMLVVSPFSRGGWLDARVYDHTSVIRLLESRFGVAEPNISPWRRAVCGDLSHAFDFTGAQDQAGAPGPRSRPSPYACHVEAWAADGRQRVRMANPGHATLVLHVYDCLRLAQGPRRYTIEPGRQWEDSWPDAGADLACDLWILGPDGFHRHIRRHGAAAPLAAAWRDQPPALLLENRGAQALQARIESAYGEAPALLRLAPGEQAAWPYEPASRGWYDLTASAAGQSLRLAGRMRAAGPGRPDPRLG

SEQ ID NO: 54794 - protein, 310 aa, Photobacterium sp. SKA34
MANTADYIWFNGEIVPWADANVHVLTHAMHYGTSVFEGIRCYNTPKGPAVFRHEEHMVRLKNSAKIYRFPIPYSCDELMEICRETIRVNKLDSAYIRPLGYVGNVGLGVCPPVDTKMDLIVAAFPWGSYLGEEALENGVDAMISSWNRAAPNTIPTAAKAGGNYLSSLLVGSEARRHGYAEGIALSVDGYLSEGAGENIFVIRNGVLSTPPTTSAILPGITRDTIMILAKERGYEVREENIAREALYLADEIFMTGTAAEIVPVRSVDQITVGEGKRGPITKELQAAYFGLFNGETEDKWGWLDFVYPQK

SEQ ID NO: 54795 - protein, 226 aa, Bordetella pertussis Tohama I
MLTQQELKQQAADAALELVEQVAGPDVIIGVGTGSTADLFIDGLACFKGRLRGTVASSERSAARLAGHGLAVLDLNDVQSMPIYVDGADEIDPNLHMIKGGGGALTREKIVASVARRYICIADESKLVERLGRFPLPVEVIPMARNAVARGLSRLGGQPALREGFVTDNGNIILDVAGLSIADAPGLEKTINDIPGVVTCGLFALAGADVALLATQDGIRRLERRG

SEQ ID NO: 54796 - protein, 383 aa, Mycobacterium sp. MCS
MATSSGLISVGSGPAGLSAAAAFRERHPHLRVQILTADPAMPYAKPPLSKEFLCGGEHHVDLHTPDWFDKRRLELVRGITVDHIDVDAREVITRGGRSCPYWNLVLAPGAAPVPLDVPGAENALHLRSLADAVAIRMTALQARSAVVIGGGLIGCEAAACLAANGIATTMVAGEPVPLMRRFGLDAGERIAKLLSDSGVRFIGPTRVVEVQEDGVTLDDGAALDGDLVVAATGVRPDARLAERAGIHTQGGRIVVNERMHTSAPNVFAAGDVALAYNVTAGRPIPTEHWRDAADQGEIAGASAAGSPTAWAKVPGFHCEIGEARLKYRGWGVPYDHARLVDHRDGFTVWYEAGGEVVGVLSLNADDDYRMAAALVGSHSPLPA

SEQ ID NO: 54797 - protein, 190 aa, Glycine max
MRYLSLSTFSLLCITFVVMAASVDPLVVGRVIGDVVDMFIPSVNMSVYFGSKHVTNGCDIKPSIAISPPKLTLTGNMDNLYTLVMTDPDAPSPSEPSMREWIHWILVDIPGGTNPFRGKEIVSYVGPRPPIGIHRYIFVLFQQKGPLGLVEQPPTRASFNTRYFARQLDLGLPVATVYFNSQKEPAVKRR

SEQ ID NO: 54798 - protein, 396 aa, Leptospira interrogans serovar Lai str. 56601
MELPRLENVDLSGKRVFLRVDFNVPVENGKVTDKTRIEKTLPTIELLIKKGARIIIASHLGRPKGQVNPEFSLAPVVETFQSLVKSKVYFSKTVIGEDAIKLSKELKNGEILVIENVRFHKEEEENDPGFSKKLSALADIYVNDAFGAAHRAHSSTEGIARLLPAYAGLLMHKEILELSALLHKPARPFVAIIGGSKVSTKIKVLTNLFDKVNHLLIGGGMAYTFLKSRAIPIGNSLVEKEFEVQAFQLIEKAGVAGIDLQLPVDHIIGDQFNEKAKTKSVDKMGILDGWMGMDIGSKTVSNYEKIIKNAGTIFWNGPMGVFEMDKFASGTMAIAKAVAKSKAKTVVGGGDSIAAINKAGVADKITHISTGGGASLEFMEGRKLPGVEALKKKTSE

SEQ ID NO: 54799 - protein, 335 aa, Leptospira interrogans serovar Lai str. 56601
MTRIAINGFGRIGRLVFRAGIKDPNLEFVAINDLVTPDNLAYLLKYDSTHGRFQGTVEHTEKELIVDGKKILCVSERDPEKLPWKDLKVDYVIESTGLFTDRVGAEKHIKAGAKKVVISAPAKDKDIPTFVMGVNNEKYNPSNDHIVSNASCTTNCLAPIVKVVLDNWGIEEGLMTTIHATTATQPTVDGPSKKDFRGGRGAMQNIIPASTGAAKAVGLCIPEVNGKLTGMSFRVPTPDVSVVDLTVRTTKETSLKEISAKMKAASEGAMKGILGYTEDMVVSNDFVSSTLSSIFDMDACIELNSRFFKLVSWYDNEMGYSNRVLDLIRYMAKKG

SEQ ID NO: 54800 - protein, 341 aa, Streptomyces avermitilis MA-4680
MRIGVLTSGGDCPGLNAVIRSVVHRAVVDHGDEVIGFRDGWKGLLECDYLKLDLDAVSGILARGGTILGSSRVQPAHLRDGVERARGHVAELGLDAIIPIGGEGTLKAARLLSDAGLPIVGVPKTIDNDIAVTDVTFGFDTAVGVATEALDRLKTTAESHQRVLIVEVMGRHTGWIALHSGMAAGAHAIVVPERPFDIEELAAKVGERFEAGKRFAIVVAAEGAKPRAGSMDFDEGKKDVYGHERFAGIARQLSLELEERLGKEARPVILGHVQRGGTPTAYDRVLATRFGWHAVEAVHRGEFGKMTALRGTDIVMVSLAEAVETLKTVPEERYAEAECVL

SEQ ID NO: 54801 - protein, 522 aa, Colwellia psychrerythraea 34H
MSSQRLYQIVKTFLNFGLDEMVPADMLPWYANVGRHSLFWLRNKHKDKTPEQRFRLAIESLGPVFIKFGQMLSTRRDLLPPELADELALLQDKVTPFDGEQARQLIIDAMGIDVFEQHFKDFDLVPLASASIAQVHTATLLTAEKNENIVIKVLRPNISKTILADIKVMSLFAGVVARWLPDGKRLRPKEVVEEYRKTILDELDLNREAANAIQLKRNFEQGSEYDKALYVPEIYSEYSFENVLVMERIYGIGVGEIETLNQLGVNMKLLAERGVEVFFTQVFRDSFFHADMHPGNVFVDATHPEDPTWIAIDCGIVGTLNREDKRYLAENFVAFFNRDYRKVAQLHVDSGWVPANTSVDEFEFAIRTVCEPIFNKPLSEISFGQVLVNLFNTARRFNMEVQPQLVLLQKTLLYIEGLGRQLYPQLDLWQTAKPFLENWVKEQMGVKAVLSKIKANLPFWNEKLPEMPDLIYDYLKTSRENQHQQTQIMQTLLASQSKNNQRIIYSIVAAAIIIAGAILLSH

SEQ ID NO: 54802 - protein, 113 aa, Prochlorococcus marinus subsp. marinus str. CCMP1375
MSEETIFSRILRGEIDCDEIYSDEMCLAFRDIQPQAPVHILVIPRKAIPSLREAEIQDESLLGHLLLVSAKIAKLEGLNHWRTVINSGSEAGQTVFHLHIHVIGGRKLNWPPG

SEQ ID NO: 54803 - protein, 462 aa, Sulfitobacter sp. EE-36
MSSYDVIIIGSGPGGYVSAIRCAQLGLKTACVEGRETLGGTCLNVGCIPSKALLHATHMLHEAEHNFADMGLKGKSPSVDWAQMQTYKQNTIDTNTKGIEFLFKKNKIDWIKGWATIPEAGKVKVGDEVHEAKNIIIATGSEPSALPGVEVDEKVVVTSTGALSLNKIPKKLVVIGAGVIGLELGSVYARLGAEVTVVEYLDAITPGMDGEVQKNFMRILKKQGVNFVMGAAVQGTEASKTKAKVTYKLRKDDSEHTLDADVVLVSTGRKPFHDGLGLEGLGVELTKRGQIAVSDTWETSVKGIYAIGDVIEGPMLAHKAEDEGMAAAEVVAGKHGHVNYGVIPGVIYTHPEVANVGATEEQLKEAGRAYKVGKFSFMGNARAKAVFAGEGFVKLIADKETDRILGAHIIGPGAGDLIHEVCVAMEFGASAEDLAMTCHAHPTYSEAVREAALACGDGPIHM

SEQ ID NO: 54804 - protein, 705 aa, Triticum aestivum
  misc_feature (214)..(214): Xaa can be any naturally occurring amino acid
  misc_feature (242)..(242): Xaa can be any naturally occurring amino acid
  misc_feature (248)..(248): Xaa can be any naturally occurring amino acid
  misc_feature (327)..(327): Xaa can be any naturally occurring amino acid
  misc_feature (386)..(386): Xaa can be any naturally occurring amino acid
  unsure (1)..(705): unsure at all Xaa locations
NKFVQKSRLVPVRNSRDIVDPRVRAAPTRPRGLAATSRAALALLVLLAVAAPRCRVARAQQQYEANKQLNCYGTNDSSVLGYTCNATAAARPCASYVVFRSSPPYDSPISISYLLNTTPAVLADANAVPTVSPVAASRLVLAPLNCGCAPGGYYQHNTSYTIQFSNETYFITANITYQGLTTCQALIAQNPNHDSRKLVVGNNLTVPIRCACPXSPAQAASGVRHLLTYLVTWGDGIADIAXRFRVDXRAVLHANNLTDSENIYPFTTLLIPLKSAPTPDMLVSPAPPPAPAPPQAQQPPPSGGSGSGKGVAVGVGVGVGVLALAGXLGLMFLCVRRRRRPRPGVVEDGHPGKGVLDVPSSADYDPLASGKHTSSATTNSSSSSAXVSTDARAAVESLTVYKYSELEKATAGFSEDRRVKNASVYRAEFNGDAAAVKRVAGDVSGEVGILKRVNHSSLVRLSGFCVHHGDTYLVFEFAENGALSDWLHGGGATLVWKQRVQAAFDVADGLNYLHHYTNPPCVHKNLKSSNVLLDDDLRAKVSSFALARSVPMGADGGDAQLTRHVVGTQGYLAPEYLEHGFITPKLDVFAFGVILLELLSGKEATFDAGDKRGETLLWEPAEGLLIDGEDARGKVRAFMDRRLNGDYPLDLAVTVASLAVRCVAREPRGRPSMEEVFVTLSAVYNSTLDWDPSDCGNSRSSIVGR

SEQ ID NO: 54805 - protein, 356 aa, uncultured bacterium
VTSAHNTISALLDNYIYQHRKEGFSLREIYWKRVLDVNDRALRNVVTGLRGDGVVSETGFDITSASELMAILCLATSEKDLQDRIENILLGITSDGKPFRVRDLGVAGAITVLLRDALSPNLVQTTEHTPAFIHGGPFANIAHGCSSVLATKMAMTYSDYVVTEAGFGADLGAEKFFDIKCRKAGLQPRLVVIVATTQGLKMHGGVDLSLITEPNAKGLKEGLKNLNRHINNMQGFGQPVVVTLNRYDTDTPEEIDIVRKNCEDLGVGFAVNEAFLKGGEGAMELAQKVADTIDQIQPLPIHFAYPENDTIEGKIEKACKRIYGAAAVEFTKTGKKRLDAIREIFGDDKDIARYPV

SEQ ID NO: 54806 - protein, 441 aa, Pediococcus pentosaceus ATCC 25745
MKTTESSYTEVPVTEIKPQLTEGKAAILGFQHLLAMYSGDVIVPLLIGGFLHFTAAQMTYLVSVDIFMCGIATLLQIKRTPLTGIGLPVVLGCAVQAVQPLQQIGGTLGVTAMYGAIIASGVFVFLVGGLFSKIKGLFPPIVTGSIITVIGFTLIPVAFQDIGGGNVAAKSFGDPRNLLVGLITVLIIVGINVWARGFFRSIAILIGILIGTILASFMGMVSLSPIAEASWFRIPQPFYFGVPTFNLSAILTMIMVTLTTMIESTGVFFALGDLVGKEITQDDLKRGYRSEGIAAILGGIFNTFPYSTFSENVGVLQLSGVKSRKPLYYAAGFLIVLGLLPKAGATATIVPTSVLGGAMLVMFGIVGVQGVRILQQVNFNQTKNILIVSLSVGMGLGSTIYPQLYQALPATIKMLLTNGIVIASITAVVLNLLFNGYDRDM

SEQ ID NO: 54807 - protein, 353 aa, uncultured bacterium
IGAANNLLAAMLDNHIQQGNALGIDVKKITWKRCVDMNDRQLRFVVDGLGGRANGTPREDGFDITVASEIMAVFCLASSMSDLKERLSRIIVAYTYDNQPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLVNEDLAALERGIPNLLRHVNNITNVYRLPCVVAINRFPTDTDAEIDFIVRKCRELGVNTILSTVWAEGGKGGEDLAREVVRLCEEGKGNFTFSYELDATIEEKLEALTKKIYGGAGVALTPAAKKQAEQLTRLGFDKLPV

SEQ ID NO: 54808 - protein, 1499 aa, Candida albicans
MSTANTSLSQQLDEKPWVDASDNSSVQEYQGFDATASHNIQDLARKLTHGSTNGDHHSANDLARYLSHMSDIPGVSPFNGNISHEQLDPDSENFNAKYWVKNLKKLFESDSDYYKPSKLGVAYRNLRAYGIANDSDYQPTVTNALWKFTTEAINKLKKPDDSKYFDILKSMDAIMRPGELTVVLGRPGAGCSTLLKTIAVNTYGFHIGKESQITYDGLSPHDIEHHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSATILDTTPLIAIYQCSQDAYELFDNVVVLYEGYQIFFGKASKAKEYFENMGWKCPQRQTTADFLTSLTNPAEREPLPGFEDKVPRTAQEFETYWKNSPEYAELTKEIDEYFVECERSNTGETYRESHVAKQSNNTRPASPYTVSFFMQVRYVIARNFLRMKGDPSIPLISILSQLVMGLILASVFFNLRKSTDTFYFRGGALFFSVLFNAFSSLLEILSLYEARPIVEKHRKYALYRPSADALASIISELPVKLLMTMSFNIVYYFMVNLRRTTGNFFFYWLMCALCTLVMSHMFRSIGAVTTTIATAMSLSTVFLLAMIIYAGFVLPIPYILGWSKWIRYINPVTYIFESLMVNEFHGREFECGQYIPSGPGFENLPVENKVCTTVGSTPGSTVVQGTEYIKLAYQFYSSHKWRNFGITVAFAVFFLGVYVALTEFNKGAMQKGEIVLFLKGSLKKHKRKTAASNKGDIEAGPVAGKLDYQDEAEAVNNEKFTEKGSTGSVDFPENREIFFWRDLTYQVKIKKEDRVILDHVDGWVKPGQITALMGASGAGKTTLLNCLSERVTTGIITDGERLVNGHALDSSFQRSIGYVQQQDVHLETTTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDRLLFLQKGGRTAYFGELGENCQTMINYFEKYGANPCPKEANPAEWMLQVVGAAPGSHAKQDYFEVWRNSSEYQAVRKEINRMEAELSKLPRDNDPEALLKYAAPLWKQYLLVSWRTIVQDWRSPGYIYSKLILVISSSLFIGFSFFKSKNNLQGLQSQMLAVFMFFVPFTTFIDQMLPYFVKHRAVYEVREAPSRTFSWFAFIAGQITSEIPFQIVVGTISYFCWYYPVGLYANAEPTDSVNSRGVLMWMLLTAFYVYTSTMGQLAISFNELIDNAANLATTLFTLCLMFCGVLAGPNVIPRFWIFMYRCNPFTYLIQAILSTGLANAKVTCAPRELVTLKPPMGETCSSFIGPYTEAAGGYFSTNSDGTCSVCRIDSTNQFLESINALFSQRWRNFGIFVAFIAVNIILTIFFYWLARVPKGNREKKLKK

SEQ ID NO: 54809 - protein, 352 aa, uncultured bacterium
ITSANNLLCAMLDNHLMQGNELRIDPKRIVIKRCLDMNDRALRNITVGMGKRLDGVVREDHFCITVATEVMAILCPAEDLEDLKKRLSKIIVAYNYDNEPITAADLNAVGAMTVLLKDAIRPNLIQSLENNPVFVHGGPFANIAHGCNSVRATKVALKVADYVITEAGFGADLGAEKFLDIKCRMAGLKPDAVVLVATARALKYNGGVAKADLSNENVEALNKGIVNLGKHIENLKKYNVPIVVTINRFTADTEAEMQAIKDFVEKAGCRFALSEVWAKGGEGGLGLAEQVLDAIEEGSPDFKFLYEDNLSITEKIETVSKEIYGADGVTYSPEATNAIKRLEGLGFGNMPV

SEQ ID NO: 54810 - protein, 353 aa, uncultured bacterium
PHTISALLDNYVYQHRKDGFSLREIYWKRVLDVNDRALRNVVTGLRGDGVVSDTGFDITPASELMAILCLATSEEDLQRRIENIVLGITADGKHFRVKDLGVAGAITVLLRDALNPNLVQTTEHTPAFIHGGPFANIAHGCSSVLATKMAMSYCDYVVTEAGFGADLGAEKFFDIKCRKAGLQPRLVVIVATTQGLKMHGGVSLDRIKEPNSKGLKEGLKNLNRHINNMQGFGQPVIVTLNRFDFDTDEEIDIVRKNCEDLEVGFAVNEAFLKGGESAVELAQKVVETIDRQQPLPIRFTYKEADCLEDKIEKVCKRIYGASAVEYGQKVKKKLESLRATFSDDDGAIAHYPV

SEQ ID NO: 54811 - protein, 270 aa, Triticum aestivum
  misc_feature (256)..(256): Xaa can be any naturally occurring amino acid
  unsure (1)..(270): unsure at all Xaa locations
MADPQAEARGPPEPRAEALVEPVRVNGSAAEATLSSAELAWRPTAAGRDSGGRRKLELESDVLGFQVEGRALKLATFTRGDVTGAGRPPSPVGCGGGAEDRKRGEVAVEMESEEAAERWGHAIRDRFASLGRPKRLFFIVNPYGGKRGGRKIFQTEGLPLIEAAHIHYTMQGTNYRPHAQEIAGSLDLKKYDGIVCVSGDGILVEVVNGLLQRDDWDKAIKVPLGIIPAGHRRALDVTSVVQGKTRFFSVMMLTWXLVADIDIESEKFRW

SEQ ID NO: 54812 - protein, 200 aa, Agrobacterium tumefaciens str. C58
MSEALNDLAAYVKEARGSLVVSADIAYGELTLNTTPENVIALLTFLRDDVQCGFVNIIDICGVDWPQREKRFDVVYHLLSPRQNLRVRIKLQVAEDEGVPSSTPVYMGAEWFEREAWDMYGIPFEGHKDLRRILTDYGFEGHPLRKDFPVTGFVEVRYDDVLKRVLYEPVELKQEFRNFDFLSPWEGTEYVLPGDEKAKQ

SEQ ID NO: 54813 - protein, 381 aa, Oryza sativa (indica cultivar-group)
MASSTQGQVITCKAAVAWEANKPMTIEDVQVAPPQAGEVRVKILFTAFCHTDHYTWSGKDPEGLFPCILGHEAAGIVESVGEGVTEVQPGDHVIPCYQAECRECKFCKSGKTNLCGKVRAATGVGVMMNDRKSRFSINGKPIYHFMGTSTFSQYTVVHDVSVAKINPQAPLDKVCLLGCGVSTGLGAVWNTAKVEAGSIVAIFGLGTVGLAVAEGAKSAGASRIIGIDIDSKKFDVAKNFGVTEFVNPKDHDKPIQQVIVDLTDGGVDYSFECIGNVSVMRSALECCHKGWGTSVIVGVAASGQEISTRPFQLVTGRVWKGTAFGGFKSRSQVPWLVEKYLNKEIKVDEYVTHSMNLTDINKAFDLLHEGGCLRCVLATDK

SEQ ID NO: 54814 - protein, 244 aa, Sinapis alba
EFFHGWYMEPLTKGRYPAIMRKIVGSRLPKFNKTEAKLVTGSYDFLGLNYYVTQYAKPKPNPYPSETHTAMMDAGVDLTFKNSRGEYPGPVFAEDANSYYYPKGIYYVMDYFKTKYGNPLIYITENGISTPGSENRCEAIADYKRIDYLCSHLCFLRKVIKEKGVNVRGYFAWALGDNYEFGKGFTVRFGLSYVNWDNLDDRNLKESGKWYQRFINGTAKNSAKQDFLRSSLSSQSQKKRLADA

SEQ ID NO: 54815 - protein, 243 aa, Sinapis alba
EFFHGWYMEPLTKGRYPDIMRQIVGTRLPNFTEDEAELVAGSYDFLGLNYYVTQYAKPKPNPYPSEKHTAMDDAGVDLTFKNSRGEYPGPVFAEDANSYYYPKGIYYVMDYFKTKYGNPLIYITENGISTPGSESRCERIADYKRINYHCSHLCFLSKVIKEKGVNVRGYFAWALGDNYEFGKGFTVRFGLSYVNWDDLNDRNLKESGKWYQRFINGTAKNPVKQNFLRSSLSSQNQKKRLAC

SEQ ID NO: 54816 - protein, 364 aa, delta proteobacterium MLMS-1
MKKIVISTGGGDAPGLNAVIYAVTKSAYRRGWEIYGSKSGYRGLLDPDELIRLTPEKVEDIMPLGGTILGSTNKGDPFAMPVENLAGEIQTLDLSDRIMRNFRRLGFFCHIAVGGDGSLEIAHRFAVEKGMPVIGVPKTIDNDLEATQRTFGFDTAVSTATDALDKLHSTAKSHDRVMVVELMGRDSGWIALNAGISGGADVILIPEVPFDMNVVCQKINDNDLRDKNYSIVVVAEGAKAASMKKALCKKKVELGRSEELLGGIGDWVAEQIRCQTGKDTRSLTLGHLQRGGSPTTFDRLLALRFGGAAVRMAEQELFDHMVALKTPDMVPVPLAEAIKSRKKVQLDSDKLLTAREIGICFGDA

SEQ ID NO: 54817 - protein, 176 aa, Schizosaccharomyces pombe
EFPLTVTHSNNSLRIGLIHGHQSLPLGSLDALSAIARQMDVDFLVSGATHAVQAVEYDGRFFLNPGTATGAWTGAWNSSKPGFAVSSNEGVKAAGPHGDPIPSFALLDIQGTVVVTYVYQFIDGDVKVEKVEWRKPDGYGVDERVGAKTPITPGVGSVMPQSIPSPTPMSPQNAGW

SEQ ID NO: 54818 - protein, 327 aa, Oryza sativa (japonica cultivar-group)
MGRLPLLLLLAAAAVSTAGGAPVYRADYLVDGNQLVDMQYHMGPVVSGSPTNLYLIWYGRWEAAAQAVLRDFLASLSAPAAPSPAVSDWWARAPRLYADQTGANVTGAFAVAGERSDAGYSHGASLRRIDMQSVIRSAVYAYPDPLPLDPYSGVYLVLTSPDVQVEEFCRAVCGFHYFTFASVVGVTVPYAWVGNSATQCPGKCAYPFAAPDYGGGAGGQQVLRPPNGDVGVDGMVIVLGHELAELATNPLVNAWYAGDTPTAPTEIADLCLGVYGDGGGAGGLVGNVSRAADGASYNVNGVNGRRFMVQWLWNPVRGACYGPNSSS

SEQ ID NO: 54819 - protein, 552 aa, Prochlorococcus marinus subsp. marinus str. CCMP1375
MSLKNLSADSQFKVVLEAPFTDQKPGTSGLRKSTKHFQQPHYLESFVEAIFQTLHGLEDGVLVLGGDGRFGNRNGIDVIIRMAAAHGVRKVITTVDGILSTPAASHLIRTKKAVGGIILSASHNSGGPDGDFGVKVNGPNGGPASESLTDAIYAKTQILDSYQIINHDSISLELPAKYEVGGMIVEVIDGIEDYIALMQKIFDFDRIKSFLKDDFLIAFDALNAVTGPYAKRLLEDFFGAPTGTVRNGIPLEDFGGCHPDPNLTYAKDLADLLLNGSEYSFGAACDGDGDRNMILGRNCFVNPSDSLAVLTANANCVPAYSGGLLGVARSMPTSSAVDVVAKDLDISCFETPTGWKFFGNLLDSGQITLCGEESFGTGSNHVREKDGLWAVLFWLQILAHKKCSVEELMHKHWDHFGRHYYSRHDYESIASDIAQNLYETVELRLPSLIGNSFAGRQVTTADNFTYTDPVDHSITARQGLRILLDDGSRVILRLSGTGTKGATLRVYLESYVSSQGDLTQNPQNALSQLITSIDSFAEISNRTGMSRPTVIT

SEQ ID NO: 54820 - protein, 250 aa, Erwinia carotovora subsp. atroseptica SCRI1043
MAVTKLVLVRHGESQWNNENRFTGWYDVDLSEKGRSEAKAAGQLLKDEGFAFDFAYTSVLKRAIHTLWSVLDELDQAWLPVEKSWKLNERHYGALQGLNKAETAEKYGDEQVKQWRRGFAITPPELTRDDERFPGHDPRYASLSDKELPQTESLALTIERVVPYWTETILPRIKSGERVIVAAHGNSLRALVKYLDNMGEDEILELNIPTGVPLVYEFDENFKPIKRYYLGNADEIAAKAAAVANQGKAK

SEQ ID NO: 54821 - protein, 352 aa, uncultured bacterium
IGAANNLLAAMLDNHIQQGNALGIDVKKITWKRCVDMNDRQLRFVVDGLGGKANGTPREDGFDITVASEITAVFCLASSMADLKERLSRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLVNEDLAALEKGIPNLLRHVNNIKNVYQLPCVVAINRFPTDTDAEIDFIIRKCRELGVNTILSTVWADGGKGGEELAREVVRLCEEEQGNFTFSYELDASIEEKLEAVTKKIYGGAGVMLTPAAKKRAERLTELGFDKMP

SEQ ID NO: 54822 - protein, 511 aa, Manihot esculenta
MSVAILTSLPPQWLSILAVFLLPILTLLLFRGKDDNQKKGLKLPPGPRQLPLIGNLHQLGGQPYVDFWKMAKKYGPVMYLQLGRCPTVVLSSTETSKELMKDRDVECCSRPLSVGPGQLSYNFLDVAFSPYSDYWREMRKLFIFELLSMRRVQTFWYAREEQMDKMIEILDGAYPNPVNLTEKVFNMMDGIIGTIAFGRTTYAQQEFRDGFVKVLAATMDMLDNFHAENFFPVVGRFIDSLTGALAKRQRTFTDVDRYFEKVIEQHLDPNRPKPETEDIVDVLIGLMKDESTSFKITKDHVKAILMNVFVGGIDTSAVTITWAFSELLKNPKLMKKAQEEVRRAVGPNKRRVEGKEVEKIKYIDCIVKETFRKHPPVPLLVPHFSMKHCKIGGYDILPGTTIYVNAWAMGKDPTIWENPEEYNPDRFMNSEVDFRGSDFELVPFGAGRRICPGLAMGTTAVKYILSNLLYGWDYEMPRGKKFEDFPLIEEGGLTVHNKQDIMVIPKKHKWD

SEQ ID NO: 54823 - protein, 353 aa, uncultured bacterium
IGAANNLLAAMLDNHIQQGNALGIDVKKITWKRCVDMNDRQLRFVVDGLGGKANGTPREDGFDITVASEIMAVFCLASSMPDLKERLSRIIVAYTYDDQPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLANEDLAALEKGIPNLLRHVNNITNVYQLPCVVAINRFPTDTDAEIDFIVRKCRELGVNTILSTVWAEGGKGGGDLAREVVRLCEEGKGNFTFSYELDASTEEKLEALTKKIYGGAGVALTPAAKKQAEQLTRLGFDKLPV

SEQ ID NO: 54824 - protein, 349 aa, Triticum aestivum
MGSLPVPSVQALVAATGGDDVPLRYLRPEAAAEAVTGDADGEAQIPIIDHQRLLLELDHGGEESARLHRACQDWGFFQLVNHSVPDDVVESMKANIQQFFQLSAETKKRFAQEQGQLEGYGQLFVVSEDQKLDWADMLFLYTQPPEMRNTKFWPDQPAAFRSALDRYSDAVKDVSDSLLATMAKNLGLKREAIADKCIRGMQKVRINYYPPCAQPEKVVGLSPHSDANVLTLVLQVNHVQGLQIKRNGSWLPVKPVPGAFIVNIGDMFEVFTNGRYRSIEHRAVVDPKEERLSVAAFHLPNIHATIGPLKELTAQEDDAYKTLDLESFMKIFFATKLEGKSFLEQMKLN

SEQ ID NO: 54825 - protein, 353 aa, uncultured bacterium
IGAANNLLAAMLDNHIQQGNALGIDVKKITWKRCVDMNDRQLRFVVDGLGGKANGTPREDGFDITVASEIMAVFCLASDMADLKARLARIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLATEDLAALEKGIPNLLRHVNNITKVYQLPSVVAINRFPTDTDAEIDFIVRKCRELGVNTVLSTVWAEGGRGGEELAREVVRLCEEEKGNFTFSYELDASIEEKLEAVTKKIYGGAGVALTPAAKKQAERLIELGFGGLPI

SEQ ID NO: 54826 - protein, 353 aa, uncultured bacterium
IGAANNLLAAMLDNHIQQGNALGIDVKKITWKRCVDMNDRQLRFVVDGLGGKANGVPREDGFDITVASEIMAVFCLASSMKDLKERLSRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLAEEDLGALEKGIPNLLRHVHNIKEVYQLPCVVAINRFPTDTDAEIDFIIRKCRELGVNTVLSTVWAEGGKGGEDLAREVVRLCEEEKGNFTFSYDLDMTIEEKLEAVTKKIYGGAGVALTPAAKKQAERLTQLGFDKMPV

SEQ ID NO: 54827 - protein, 506 aa, Vibrio cholerae
MIYPIPNSETSTVHFKDVYDNYIGGQWMKPHSGEYFSNTSPVNGLVFCRVARSSSQDVELALDAAHNALESWSTTSAVERSNILLRIADRIESNLETLAIVESWDNGKPIRETLAADLPLTIDHFRYFAACIRSQEGAASELDSRTLTYHLPEPIGVVGQIIPWNFPLLMAAWKLAPALAAGCTVVLKPAEQTPVSILFLMEIIGDLIPAGVINVVNGFGSEAGNALATSQRIDKLAFTGSTEIGNHILKCAADNLIPSTIELGGKSPNIYFPDIFSHEDQYLDKCIEGALLAFFNQGEVCTCPSRILVHESIYEKFIAKIIERVALIKQGNPLDTETQIGAQVSKEQYDKILGYIQIGKDEGAELIFGGHPNNQENYLSGGYYIKPTLFFGHNQMHIFQEEIFGPVIAITKFKDEIEALHLANDTVYGLGAGVWTRDINIAHRMAKNIKAGRVWVNCYHAYPAHAAFGGYKKSGIGRETHKLTLSHYQNIKNVLISHEIHPLGLF

SEQ ID NO: 54828 - protein, 352 aa, uncultured bacterium
IGAANNLLAALIDNHIFQGNELGINPSSIVWRRCVDMNDRQLRFVVDGLGGAKNGVPREDGYDITVASEVMAILCLSTSIQDLKARLGRIIVGYTYEGNAVTAADLKAAGAMAAVLKDALKPNLVQSLEGTPAFIHGGPFANIAHGCNSVLATRMALKCGEYTVTEAGFGADLGAEKFMDIKCRTTGLRPKAVVIVATIRALKMHGGLKKDNLATEDLGALEKGLPNLLRHVSVITDVYRIPCVVAVNRFPTDTEAELELIRRRCAELGVNAVLSEVWAKGGEGGRALAEEVVRLCTKESNLEFTYADSDPVETKISSIVTRIYGGAAVSYAPGVRTKIKKLEAAGFAGVPV

SEQ ID NO: 54829 - protein, 394 aa, Triticum aestivum
  misc_feature (220)..(220): Xaa can be any naturally occurring amino acid
  unsure (1)..(394): unsure at all Xaa locations
MATNGYSNGGSTKGKPIKCKAAVAWGPGEPLVMQEVEVAPPARMEVRVKVLYTSICHTDLSFWRGENERQRRFPRIFGHEAAGVVESVGEGVEDLAPGDHVVPIFNGECGTCAYCHSSATNLCGTYRVDAFKSTMVSDNGTRFSVVNTSGDTVPVYHFLNTSTFAEYTVLDAACAVKINPAAPLEKMCLLSCGISTGVGAAWNTANVSKGSTVAIFGLGXLGLAVGEGARIRGASQIIGVDINPEKFAKGKEMGITDFVNSKACGKPVHEVIRELTDGGVDYSFECSGNVDVLREAFVSTHDGWGLTVVLGIHPTPRMMPLHPMELFDGRRITGCTFGDFKGKSQLPLLVDQCMQGEVKINFDGFITHEMPFSEINEAFRLLEEGKSLRCVLRL

SEQ ID NO: 54830 - protein, 436 aa, Bordetella pertussis Tohama I
MNLSDKKATLSFSDGSAPIEFPVYKGTVGPDVIDIRKLYGQTGMFTFDPGFMSTAACASGITYIDGDKGELLYRGYPIEQLAVNCDFLDICYLILNGELPNGGQKQDFDSQVTHHTMVNEQLHFFLRGFRRDAHPMAVLTGLVGALSAFYHDSTDITNPHHRHVSAIRLIAKMPTLVAMAYKYSQGQPFIYPQNDLSYTGNFLRMMCATPCEEYKVNDVVERALDRIFILHADHEQNASTSTVRLCGSSGTNPFAAIAAGVACLWGPAHGGANEACLQMLEELQANGGVAKVGEFMEKVKDKNSGVRLMGFGHRVYKNYDPRAKLMQETCKEVLVALGLENDPLFKLAMELERIALEDDYFVQRKLYPNVDFYSGIVQRAIGIPTSLFTAIFALARTVGWIAQWNEMLSDPDYKIGRPRQLFTGSVTRDVPGMDKR

SEQ ID NO: 54831 - protein, 539 aa, Burkholderia vietnamiensis G4
MHDKILILDFGSQVTQLIARRVREAHVYCEIHPNDVSDAFVREFAPKAVILSGSHASTYEDHQLRAPQAVWDLGVPVLGICYGMQTMAVQLGGKVEWSDHREFGYAEMRAHGHTRLLDGIDDFKTAEGHGMLKVWMSHGDKVAELPPGFTLMASTPSCPIAGMADEARGYYAVQFHPEVTHTVKGRQIIERFVLQIAGAKPDWIMKNHIEEAVAKIREQVGDEEVILGLSGGVDSSVAAALIHRAIGDQLTCVFVDHGLLRLNEGKMVLDMFEGRLHAKVVHVDASEQFLGHLAGVTDPEQKRKIIGREFVEVFQAEAQKLSKAKWLAQGTIYPDVVESGGTKTKKATTIKSHHNVGGLPETLGLKLLEPLRDLFKDEVRELGVALGLPPEMVYRHPFPGPGLGVRILGEVKREYAELLRRADAIFIEELRGTTATAQDAAAGLCGEADVGKSWYDLTSQAFAVFLPVKSVGVMGDGRTYDYVTSLRAVQTTDFMTAHWAHLPYALLGRASNRIINEVRGINRVVYDISGKPPATIEWE

SEQ ID NO: 54832 - protein, 337 aa, Nicotiana tabacum
MAKVKIGINGFGRIGRLVARVALQRDDVELVAVNDPFISVEYMTYMFKYDSVHGQWKHHELKVKDDKTLLFGEKAVTVFGFRNPEEIPWGQTGADYIVESTGVFTDKDKAAAHLKGGAKKVIISAPSKDAPMFVVGVNEKEYKPELNIVSNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEATYDEIKAAIKEESEGKLKGILGYTEDDVVSTDFVGDNRSSIFDAKAGIALSKNFVKLVSWYDNEWGYSTRVVDLIKHMASVQ

SEQ ID NO: 54833 - protein, 160 aa, Mesorhizobium loti MAFF303099
MGVAGCGKSAVGIALAAALDAVFIEGDRLHPPENVARMASGEPLTDQLREGWLDAIGERIATSIGEGQGVVAACSALKRSHRERLRGFCPDIVFLYLEIDPTTARRRVASRKGHFMPASLVDSQFAILEPPGSDERALTIDATRPVADAVADAMRLLANS

SEQ ID NO: 54834 - protein, 427 aa, Rhodopirellula baltica SH 1
MHYQPLPFDRDLIDRIIEDHPTPFVLYHEDGIRARARELTDAFAWNEGFQQYFAVKATPNPHIVAMMAEEGGGADCSSVAELITCERLGITGQDVMFTSNNTTMEEFEIANKLGAIINLDTPHHIDQIAQLSPLPEMVSFRFNPGPERQGNVIIGDPKEAKFGSTREQLMDGYRRCAELGISRFGLHAMVVSNELNIEALLQTAEMLFELAAEIHRETGISVECINLGGGIGVPYQPGQEPVDLPAFGDGVRKLYESILVPAGIAPVRILMENGRAMTGPFGYLITKVINQKSSYKDYVGVDACMSNLMRPGMYGAYHHITVMGKEDQPADRTVDIVGSLCENNDKFAIDRKMPATEVGDIAVIHDAGAHGHSMGFQYNGRLRSAEIVFNDAGEFRAIRRAETFDDYFCTVDFDSVKVDRKQSATVG

SEQ ID NO: 54835 - protein, 417 aa, Arabidopsis thaliana
SMGASGKWVKSIIGLKKLEKDEIEKGNGKNKKWKLWRTTSVDSWKGFRGKHRSDSDGVDSSTVYSAAVATVLRAPPKDFKAVREEWAAIRIQTAFRGFLARRALRALKGIVRLQALVRGRQVRKQAAVTLRCMQALVRVQARVRARRVRMTVEGQAVQKLLDEHRTKSDLLKEVEEGWCDRKGTVDDIKSKLQQRQEGAFKRERALAYALAQKQWRSTTSSNLKTNSSISYLKSQEFDKNSWGWSWLERWMAARPWETRLMDTVDTAATPPPLPHKHLKSPETADVVQVRRNNVTTRVSAKPPPHMLSSSPGYEFNESSGSSSICTSTTPVSGKTGLVSDNSSSQAKKHKPSYMSLTESTKAKRRTNRGLRQSMDEFQFMKNSGMFTGELKTSPSSDPFVSFSKPLGVPTRFEKPRG

SEQ ID NO: 54836 - protein, 273 aa, Photobacterium sp. SKA34
MDKYVVFGNPIGQSKSPFIHTLFARQTSQQMTYTSQLVAIDGFVQAADTFFNDGGKGCNITVPFKEQAYQYATRLTERARLAGAVNTLKRLDDGGVLGDNTDGEGLVQDLINQQVELKDQCILLLGAGGAARGVILPLLAQQPKKLVIANRTVSKAQQLAELFSSYGNVIALEQAELENQTFDVIINSTSASLSGDVPAISPTVIGTNTTCYDMVYGSVITSFNRWAKEHGAVKVLDGLGMLVGQAAESFMLWRGLRPGAKQVQRELRRTLQE

SEQ ID NO: 54837 - protein, 559 aa, Glycine max
SGITGSTTRPLGKPADAGDRLRHNTATTSGGNNAVKVREKQKPPDAGELSGTLPAAERRKPRLDPCAVTQQGWPSWLMAVAGEAIGDWTPRRANTFEKLAKIGQGTYSNVYKARDLVTGKIVALKKVRFDNLEPESVKFMAREILVLRRLDHPNVVKLEGLVTSRMSCSLYLVFEYMEHDLAGLAAGQGVKFTEPQVKCFMKQLLSGLEHCHSRGVLHRDIKGSNLLIDNEGILKIADFGLATFYDPKIKQAMTSRVVTLWYRPPELLLGATVYGVGIDLWSAGCILAELLAGKPIMPGRTEVEQLHKIFKLCGSPSEEYWRKYRLPNATIFKPQQPYKRCILETYKDFPPSSLPLIETLLAIDPDDRCTASAALNSEFFTTEPYACEPSSLPKYPPSKELDVKLRDEEARRQKALNGKASAVDGAKKVRVRERGRAVPAPEANAEIQTNLDRWRVVTHANAKSKSEKFPPPHQDGAVGYPQDASNKGPVSFGAPDTSFSSGIFNSKPSGTVRNHGAAGLHRGRKTKKDESQMASSWKFMRPFKPSTVGLSMDLLFRSK

SEQ ID NO: 54838 - protein, 400 aa, Bordetella pertussis Tohama I
MSTSQKKPTVQQKKPAAQPAEKAAFKPKKSVALSGVVAGNTALCTVGRTGNDLHYRGYDILDFAGSAEFEEIAHLLVHGKLPNKAELKAYKEKLRALRGLPAQLQNVLECLPASSHPMDVMRTAVSVLGCVLPEKDDHNTPGARDIADRLMANLGSALLYWYHYSHNGRIIDVQTDDDSIGGHFLHLLHGAKPSDEWVRAMHTSLILYAEHEFNASTFTGRVIAGTGSDMYSSITGAIGALRGPKHGGANEVAFEVQKRYETPDEAEADIRQRVENKEVIIGFGHPVYTVSDPRNKVIKDVAKKLSRKAGSTKMFDIAERLETVMWDIKKMFPNLDWFSAVSYHMMGVPTAMFTPLFVIARTAGWSAHIIEQRIDNKIIRPTANYVGPEDQTYVPISKRA

SEQ ID NO: 54839 - protein, 429 aa, Brucella melitensis 16M
MQPRAGPSLPGAKRLPKERIAYIRRIAEIYESRLDEMAKTISMEMGAPIKLARESQAAAGLSHTKAFIAACENFEVEEVLSPKYPNQTVVHEPIGVCGLITPWNWPMNQITLKVIPAIAVGCTVVLKPSEIAPMSAMLFAEFVDQAGLPKGVFNLVNGEGPVVGEALSQHPEVDMMSFTGSTRAGTAVSRAAAATVKRVSLELGGKSPNIVFADSDLEKAISRSLAHCFENTGQSCNAPTRMLVERSVYDKAVELAKKAAESTKVGDPAQEGDHIGPLSSSIQFEKVQALIQKGIDEGARLVAGGTGRPEGFTEGDYVKPTVFADVNNNMTIAREEIFGPVLAMIPFDTEEEAIAIANDTPYGLAAYIQTGSPERAKRVARKLRAGMIQINGTSRAPGSPFGGYKQSGNGREGGKWGLEDFMEVKLISG

SEQ ID NO: 54840 - protein, 170 aa, Zea mays
MAPTVMMASSATAVAPFQGLKSAASLPVARRSTRSLGNVSNGGRIRCMQVWPAYGNKKFETLSYLPPLSTDDLLKQVDYLLRNGWIPCLEFSKLGFVYRENSTSPCYYDGRYWTMWKLPMFGCTDATQVYKELQEAIAAYPDAFHRVIGFDNVRQTQCVSFIAYKPPGSE

SEQ ID NO: 54841 - protein, 339 aa, Pseudomonas syringae pv. syringae B728a
MSQESINWDTLGFDYIKTDKRYLSHWRDGAWDQGSLTEDNTLHISEGSTALHYGQQCFEGLKAYRCKDGSINLFRPDQNAQRMQRSCSRLLMPHVPTDVFIEACKQVVKANERFIPPYGSGGALYLRPFVIGVGDNIGVRTAPEFIFSIFCIPVGAYFKGGLKPNNFVISGYDRAAPNGTGAAKVGGNYAASLMPGSEAKKHSFADCIYLDPQTHSKIEEVGSANFFAITKDDVFLTPKSPSVLPGITRLSLIELAKSRLGLTVEEGDVFIDQLGEFKEAGACGTAAVITPIGGISYKDNLHVFYSQTEVGPVTQRLYKELTGVQSGDIEAPAGWIVKV

SEQ ID NO: 54842 - protein, 187 aa, Kluyveromyces lactis NRRL Y-1140
MSITEYATELKGALRQYPNFPQEGILFEDFLPIFRDPQLFKKLIESFKLHLQEKFTGKKIDYVIGLEARGFLFGPALALALDAGFVPVRKQGKLAGEVVHAVYAKEYGEDVFEIQADSIPEHSNVVIVDDIIATGGSAKAAGDLALQLNANILEFCFVMELDFLKGTQKLQAPSFTLLSGQEEALSK

SEQ ID NO: 54843 - protein, 341 aa, Colwellia psychrerythraea 34H
MNTNLAHTKEQTTINLIADIGGTNIRLAQATAKLGTNTRDIAINDIETYQCKEFSSLADVVAHYIDVKELNNLAINACFAIACPVDNDLISMTNLPWQFSQNELKQSLNLHSLRFINDYTAIAMAIPLLSEQQKIKIGGGESIAGKPISVCGPGTGLGVANLVPLSLSGNEQWHCISGEGGHIDFAPVNEIEQQVMNFIQGIKKRVSYEQLLSGYGLEQIYQALLFINHGKEITTVEDKLTAKDITANALNATCTVCEQTLTLFCDVLGSFAGNLALIMNSQGGVYIAGGIVPRFVDYLKLSDFRARFETKGRLSSITEQAPTYVITEEQPGLLGAAACLL

SEQ ID NO: 54844 - protein, 159 aa, Brucella melitensis 16M
MVEPKGFTITTTSFRRPYLEVMPVNAKAACLYPNNARMLREAKAKGFHNALVTDVLGNVAETATSNVFMVRGGEVFTPVPNGTFLNGITRQRVIKLLREAGVSVHETTLKIEDFREADEIFSTGNMSKVVPIIGFDERKLDYGLVTKRARALYWEWAHA

SEQ ID NO: 54845 - protein, 110 aa, Oryza sativa
KGGAKRHRKVLRDNIQGIPKPPIRRLARRGGVKRISGLIYEETRGVLKIFLENVIRDAVTYTEHARRKTVTAMDVVIRSSARAAPSTASAADSFLPSFLVACGWWWWCRS

SEQ ID NO: 54846 - protein, 538 aa, Oryza sativa (japonica cultivar-group)
MEIERESSERGSISWRASAAHDQDAKKLDADDQLLMKEPAWKRFLAHVGPGFMVSLAYLDPGNLETDLQAGANHRYELLWVILIGLIFALIIQSLAANLGVVTGRHLAEICKSEYPKFVKIFLWLLAELAVIAADIPEVIGTAFAFNILFHIPVWVGVLITGTSTLLLLGLQKYGVRKLEFLISMLVFVMAACFFGELSIVKPPAKEVMKGLFIPRLNGDGATADAIALLGALVMPHNLFLHSALVLSRKTPASVRGIKDGCRFFLYESGFALFVALLINIAVVSVSGTACSSANLSQEDADKCANLSLDTSSFLLKNVLGKSSAIVYGVALLASGQSSTITGTYAGQYIMQGFLDIRMRKWLRNLMTRTIAIAPSLIVSIIGGSRGAGRLIIIASMILSFELPFALIPLLKFSSSKSKMGPHKNSIYIIVFSWFLGLLIIGINMYFLSTSFVGWLIHNDLPKYANVLVGAAVFPFMLVYIVAVVYLTIRKDSVVTFVADSSLAAVVDAEKADAGDLAVDDDEPLPYRDDLADIPLPR

SEQ ID NO: 54847 - protein, 178 aa, Glycine max
  misc_feature (83)..(83): Xaa can be any naturally occurring amino acid
  misc_feature (86)..(86): Xaa can be any naturally occurring amino acid
  misc_feature (98)..(98): Xaa can be any naturally occurring amino acid
  misc_feature (113)..(113): Xaa can be any naturally occurring amino acid
  misc_feature (137)..(137): Xaa can be any naturally occurring amino acid
  unsure (1)..(178): unsure at all Xaa locations
MASSMISAPAGTTVNRAGAGMVATFTGLKFMAGFRTRKTNSVITCIASNGGRVQCMQAWPPVGTKKTETLSYLPDLDDAQLAXKYXYLLRKGWIPCLXFELEHGLVFRDHNRXPRYYDGLYWTMSNLSIYSFADAFXVLNELHDAKTAYPNSFIHIIGFYNIHQLHYISFISYIPAVF

SEQ ID NO: 54848 - protein, 219 aa, Chromobacterium violaceum ATCC 12472
MLTQDQLKLAVAKKALEFVPEDAIIGVGTGSTVNLFIEELAGIKGRIKGAVSSSEASTARLKAHHIQVFDLNEVEKLSVYIDGADEINHHLHMIKGGGAALTREKIVAGVADEFICIADEKKYVTMLGAFPLPIEVIPMARSYVARELVKLGGHPELRQGVTTDNGNVILDVHGLQIMKPVELEETINHIAGVVTCGLFARRRADVLLLGKQDGVEVLR

SEQ ID NO: 54849 - protein, 508 aa, Pisum sativum
MGSDSNNLGFLKEIGLGATNIGSFINGQWKANGPTVHSVNPSTNQVIASVTEATLDDYEEGLRASSEAAKTWRTVPAPKRGEIVRQIGDALRAKLDPLGRLVALEMGKILAEGIGEVQEIIDMCDYSVGLSRQLNGSIIPSERPEHMMFEVWNPLGIVGVITAFNFPCAVLGWNACIALVGGNTVVWKGAPTTPLITVAVTKLIAEVFERNNLPGAIFTALCGGADIGHAIAKDTRIPLVSFTGSSKVGALVQQTVSQRFGKTLLELSGNNAIIVMDDADITLAVRSIFFAAVGTAGQRCTTCRRLYLHESVYANVLEQLTALYKQVKIGNPLEEGTLVGPLHTRSAVENFKNGISAIKSQGGKIVTGGSVLESEGNFVVPTIVEISADAAVVKEELFAPVLYVMKFKDLEEAIALNNSVPQGLSSSIFTQKPSTIFKWIGPSGSDCGIVNVNIPTNGAEIGGAFGGEKATGGGREAGSDSWKQYMRRSTCTINYGSELPLAQGINFG

SEQ ID NO: 54850 - protein, 116 aa, Zea mays
TCCLETKNLTCCLCTAGKGCEPEWNETFVFTVSDGAAALFIQLMDSDGGTDDDFVGEATIPLEAVYTEGSIPPTVYNVVKDEEYRGNNNNGRTMRGDDDRDRGSCVRVCAPVVVVV

SEQ ID NO: 54851 - protein, 117 aa, Craterostigma plantagineum
MAHSLGEQYDLGKPTEEHHESHPPAHQAPHAGGELGAGQKTSQLARSNSSSSSSSEDDGQGGRRKKPIKEKVKEKLPGGAGGKQTGECGTTTTTAAGGHEEKKGVMEKIKEKLPGQH

SEQ ID NO: 54852 - protein, 155 aa, Craterostigma plantagineum
MAQFGGEKYGGRHTDEYGNPIQQGAGAHRGGGIMGGGQQAGQHGTTGVLGHGTAGQHGTTGGGLGHGTAGTGGALGGQHRRSGSSSSSSSSESDGEGGRRKKGMKDKMKEKLPGGHGTTTDQQQYGTAATHGQAQQHEKKGIMDKIKEKLPGGQH

SEQ ID NO: 54853 - protein, 190 aa, Glycine max
MRPPRGGGGFRGRGGDRGGRFGGGGRGGGGRGRFGGGGGGFRDEGPPAEVVEVSTFLHACEGDAVTKLTNEKVPYFNAPIYLQNKTQIGKVDEIFGPINESYFSVKMFEGVIATSYNEGDKFFIDPMKLLPLSRFLPQPKGSTPRGGGRGGRGGGRGGRGGRGGFRGRGAPRGRGPPRGGGRGFRGRGRF

SEQ ID NO: 54854 - protein, 318 aa, Streptomyces avermitilis MA-4680
MPDSVETFDLITMGRIGVDLYPLQPGVPLPQVESFGKFLGGSAANVAVAAARLGRSTAVITRTGNDPFGTYLHQALEEFGVDDRFVTPVDAYPTPVTFCEIFPPDDFPLYFYRQPKAPDLEIRTEELDFFALRAARIFWITGTGLSEEPSRSATLAALKARTKGGTTVFDLDWRPMFWQDPRAARPYYAEALRHATVAVGNLDECEIATGVREPRACAEALIEAGVELAVVKQGPKGVLAVHRDGTTAEVPPVPVEVVNGLGAGDAFGGSLCHGLLAGWELERTMRYANAAGALVASRLACSSAMPTLDEVEDLVARG

SEQ ID NO: 54855 - protein, 330 aa, Flaveria linearis
MSTASAFAINAPSFVNASSLKKSSTSSARSGVLSARFTCNSSSSSSSATPPSLIRNEPVFAAPAPIITPNWTEDGNESYEEAIDALKKMLIEKGELEPVAAARIDQITAQAAAPDTKAPFDPVERIKSGFVKFKTEKFVTNPALYDELAKGQSPKFMVFACSDSRVCPSHVLDFQPGEAFVVRNVANMVPPFDKTKYSGVGAAVEYAVLHLKVQEIFVIGHSRCGGIKGLMTFPDEGPHSTDFIEDWVKVCLPAKSKVVAEHNGTHLDDQCVQCEKEAVNVSLGNLLTYPFVRDGLRNNTLALKGGHYDFVNGTFELWALDFGLSSPTSV

SEQ ID NO: 54856 - protein, 130 aa, Zea mays
  misc_feature (34)..(34): Xaa can be any naturally occurring amino acid
  unsure (1)..(130): unsure at all Xaa locations
YLPATTDAVPEAHEATDASEPISLLYRELEEPSXSADALRANQPAITNLTNYLAYENQAEDLRNLVPQLRPLFALIPKDRTANVVRGIIDADAKVPGTSQLQISLCTEMGDWTRAAKRTFLRQRAEARLA

SEQ ID NO: 54857 - protein, 233 aa, Glycine max
  misc_feature (137)..(137): Xaa can be any naturally occurring amino acid
  unsure (1)..(233): unsure at all Xaa locations
MVFPKLVITIALILVLFLFICESQGASYASASHNAGHGADINTSLAHQKVNLSVYYDSLCKTCAKFIIEDLRDIFGNNLISIVNLQLVPWANAYVNNTNKSISCQNGPDECELNSLESCALNLWSKVDIQYQFVNCXEFLAIKGTIKEWKEECLNQLGLPKEPFLNCFNMGNGTELGKTYINQIAQLDPPPSFVPWVVVNNQPVEKDYANFAHYVCKAYRGVVVPGICNTLLK

SEQ ID NO: 54858 - protein, 321 aa, Erwinia carotovora subsp. atroseptica SCRI1043
MTHFVLVGDVGGTNTRLALCDAMTGELSQIETYSGLDFPSLEGAIRDYLDSRQVTVQDACIAIACPITGDWVAMTNHTWAFSIAEMKASLGLRHFEVINDFTAVSMAVPVMGRESLLQFGGGEPVPGKPVAVYGAGTGLGVAHLVHVANQWVSLPGEGGHVDFAANSDEEDNILTILRQSLGHVSAERLLSGQGLVNIYRAIVLSDDRTPEALEPKDITERAVNNTDVDCRRALSLFCVIMGRFGGNLALNLGTFGGVYIAGGIVPRFLEFFKASGFRAAFEDKGRFKGYMQDIPVYLITHEQPGLMGAGAYLRQVLGSAL

SEQ ID NO: 54859 - protein, 326 aa, Clostridium magnum
MSISNSKIIDMYKTMLKIRKFEEVAMNASAEGRIPGFIHLYIGEEAVATGVCANLNDKDYITSTHRGHGHIVAKGGDLKLMMAELFGKATGYCKGRGGSMHIADATKGILGANGIVGAGHDLALGAGLSAQYRGTNEVCICFFGDASTNQGTFHEALNMASVWKLPIVFVCENNGYGISTSQKRHMAIKDVADRGVGYNVPGVVVDGNDVFAVYEAAGEAIKRAREGKGPTLLECKTYRHRGHFEGDPMTYKPKEEQDMWLKKDPIPRFEKHILNNEVLSEEGIKEVQDDIENQIKEAVAFADNSPIPNVETALEDVYSDIKDQGR

SEQ ID NO: 54860 - protein, 333 aa, Clostridium magnum
MKTMTYMEALREAMRIKMKEDEKVLILGEDVGAFGGCFGLTAGLFDEFGDKRVKDTPISEGAIVGCAIGAAATGLKPIAEIMMGDFVTVAMDMLVNQAAKLRYMFGGKISLPMVVRLPGGAGLSAAAQHSQSLEAWLTHVPGIKVVYPSTPADAAGLLLTAIDDDNPVAFIEHKAMYGLKGEVPDDIKPIPFGVADIKPIPFGVADIKREGNDVTIIATGKMVHEALKAAEQLSKDGIEVEVVDPRTLFPLDKETIFNSVNKTGKVVVVTEENKRGGYGGEISAMISEEIFDSLDAPVVRIGALNTPIPFAPNLESYVIPASKDIVNWVKGLF

SEQ ID NO: 54861 - protein, 443 aa, Clostridium magnum
MAKIVVMPKLGLTMTEGTLVTWKKAEGDQVKVGEIFFEVSTDKLTNEVEASDEGIVRKLLVNEGDTVECLKPVAIIGSADEDISSLLNGSSEGSESAEQNDTKAPKKEAEAPKGAVEKQQGKVKASPAAKKLAAENNIDITLVEGTGPQGRITTEDVEKYIEDSKNASKASPMASKVAAELNVDLSTIEKDGRIMKEDVLSLCKGNAPEECKVNPSEDKYTEKIVPMTQIRKIISARMHESWITSPTVTYDIKVDMTSLKRFKDALKDVCKVTYTDLIVKIVSKVLLQFPLLNCSINGNELITRNYVNMGVAVAIDGGLVVPVVKYANEKGLKEISTEVKDLAKKAKSNQLKPENMTGGTFTITNLGMFGIEYFSPIINQPEVAILGVNKITETPVVQNGEIVIKPLMNLSLTANHRAVDGSVAAQFLSKVKEYMEKPELLML

SEQ ID NO: 54862 - protein, 248 aa, Zea mays
MVKLAFGSFRDSLSAASLKAYVAEFIATLLFVFAGVGSAIAYSQLTKGGALDPAGLVAIAIAHAFALFVGVSMAANISGGHLNPAVTFGLAVGGHITILTGILYWVAQLLGASVACFLLQYVTHGQAIPTHGVSGISEIEGVVMEIVITFALVYTVYATAADPKKGSLGTIAPMAIGFIVGANILAAGPFSGGSMNPARSFGPAVAAGNFAGNWVYWVGPLVGGGLAGPVYGDVFIASYQPVGQQEYP

SEQ ID NO: 54863 - protein, 1015 aa, Erwinia carotovora subsp. atroseptica SCRI1043
MQLNRRGFFKVCAGGMAGTTLAVLGFTPTEAMASVRQYKLLRAKETRNNCTYCSVGCGVLMYSLGDGAKNAKPSIFHIEGDADHPVSRGSLCPKGAGLVDYIHSENRLLYPEYRAPGSDKWQRISWDDAIERIARLMKADRDANFQRTNAKGETVNRWLTTGMLCSSAASNETGVLDQKFARSLGMVAIDCQARLCHGPTVAALAPTFGRGAMTNNWVDIKNANVIIVMGGNPAEAHPVGFKWAVEAKTHNNAKLIVVDPRFNRSAAVADLYAPIRAGSDAAFLLGIVNYLITHEKIHREYVVSYTSASLIVREDFSFDEGLFSGYDEQTRQYDKSSWQYELDESGFAKRDNTLSHPRCVWNLLKKHVSRYTPEMVTSLCGTSAKDYETICRTLAETCVPNKTATFMYALGWTHHTNGAQIIRSAAMIQLLLGNIGMAGGGINALRGHSNIQGYTDLGLLTTNLPGYMPLPSEKQPDLKTYLTQITPTALLPDQVNYWKNTPKFFISMMKSFYGDHAQAANNWGYDWLPKWDRSYDIMVQTELMVEGKMNGYIVQGFNPVAAFSNKNKATEALSKLKYMVIIDPLITETSTFWQNYGEFNDVDTKSIQTEVFRLPSSCFAEENGSIANSGRWLQWHWAAAEPPGEAHHDGKILGKLLMRLRELYNEEGGAYSDPLMNINWNYKDPEDPTPEEIAREANGMALADIYDDSGKLILKKGQQLADFSQLRDDGTTSSFCWIYAGSWTEAGNQMDKRDNADAGLGCTPNWSWCWPQNRRILYNRASADLQGKPWDSKRKLLEWNGQRWQGIDVPDFGATVPPGKDTGPFIMLPEGLARLFSVDKLVDGPFPEHYEPIESPIGTNPLHPSVISSPVARLFARDAKTMGTAKDFPYVATTYSITELFRHWTKHARLNAIVQPEQFVEIGENLAKSKGIKAGDEVKVSSKRGYIKAKAVVTKRIKTLEIAGHSVETVGIPCHWGYEGTTRKGFLANTLTPSVGDANSQTPEYKAFLVNVEKV

SEQ ID NO: 54864 - protein, 478 aa, Chromobacterium violaceum ATCC 12472
MHHPSLKPFPDDFLWGAASAAYQVEGAFDADGKGPSVWDVFVREPGRTFQGSNGDVAVDHYHRMEEDVALMAEMGLTAYRFSVSWPRVLPRGRGEPNEAGLAFYDRLIDALLARGIEPVLTLYHWDMPQALQDEYGGWEDRRIVDDFGDYCALLFRRYGDRVKTWVSLNEQNYNLSNAYLLATHPPAAADRKRFYAANHIAFLANARAIRLFRQWVPDGRIGPSFAYSPAYPASCAPADMLAFDNAEEFTNHWWLDVYCRGRYPQIALAWLRERGEAPDIRPGDIEALAAARPDFIGLNYYYTLSYAHNPPDGVGMQRINTTGQKGSTPASGVPGLYRTAPNPALETSNWDWAIDPAGLRIALRRLTSRYGLPVLITENGLGEFDRLEDGDRVRDDYRIAYLRSHLHACREAISDGVALLGFCAWSFTDILSWLNGYQKRYGFVYVNRDETDARDLRRVRKDSFFWYQRAIASGGREL

SEQ ID NO: 54865 - protein, 655 aa, Burkholderia vietnamiensis G4
MCGIDGFLNSVAFDEETARGTLARMTASLAHRGPDGQGMWVDPEAGIALGHRRLAIVDLSVQGRQPMASACGRYVLVFNGEIYNHRELRAELERTGRAPAWRGRSDSEVLVAAIAAWGVDATLRRATGMFAFALWNRASRVLTLARDRIGEKPLYYGRIGDALVFASELKALRGYPGFDGAVDRDALCLYLRQSSVPAPHTIYRGISKLPPGTFIQFEHARDTPRVRAYWALEQAIEAGRERPFDGNADDAVGQLDAVLRQAVARQMEADVPLGAFLSGGIDSSAIVALMQAQSAKPVDTFTIGFHEAGYDEAGYAKAVARHLGTRHTELYVTADHALAVVPKLPSIYDEPFSDASQIPTFLVSDLTRRHVKVSLSGDGGDELFGGYTRYFLTPRLWRKLHRVPAAVRARIAAALHALRPDHADQLAAVAQGAWGGVDARDGASRIGDRLHKLGHVMTAESRIGLYRLLMSSVHHPERLALAGQEPPTPLDTVSAWPAHLSFAEQAMAIDTLTYLPTDILAKVDRAAMAVGLETRMPFLDHHVVEFAWRLPAAVRLPQGQPKALLRRLLDQYVPRALIDRPKQGFCAPVDHWLRGALRDWAEALLEPSRLRAEGFFDAAAVERLWRQHLTGRMNWQHQLWTVLMFQAWLEGQRAA

SEQ ID NO: 54866 - protein, 327 aa, Triticum aestivum
MAASLQAAATVMPAKIGGRASSARPSSHVARAFGVDAGARITCSLQSDIREVASKCADAAKMAGFALATSALLVSGATAEGAPKRLTFDEIQSKTYMEVKGTGTANQCPTIDGGVDSFPFKAGKYEMKKFCLEPTSFTVKAEGIQKNEPPRFQKTKLMTRLTYTLDEMEGPLEVRRRRTLKFEEKDGIDYAAVTVQLPGGERVAFLFTVKQLVATGKPESFRPFLVPSYRGSSFLDPKGRGGSTGYDNAGALPRGGRGDEEELAKENVKNASSSTGNITLSVTKSKPETGEVIGVFESVQPSDTDLGAKAPKDVKIQGVWYAQLESN

SEQ ID NO: 54867 - protein, 261 aa, Glycine max
  misc_feature (226)..(226): Xaa can be any naturally occurring amino acid
  unsure (1)..(261): unsure at all Xaa locations
MGRISRTKSYAIASSIVQDNQQQTPPSITCTTFNILAPIYKRLNHEDQSCRESDYKACWLTRNQRILDWLLYERSSIICLQEFWIGNDEFVNLYDKRLGDAGYINLKLGRTNNRGDGLLIAVQKEYFTVVNHKELHFNDCGDRVAQLLHLELAFPFSQCQNSDVRHEILIVNTHLLFPHDSSLCLVRLHQVYKILQYVESYQKEYQLKPLPIMLCGDWNGSKRGHXYQFLRSQGFVSSYDAAHHYTDADAHKWVSHRNHLG

SEQ ID NO: 54868 - protein, 203 aa, Clostridium tetani E88
MMNKDVLFSIKEVMEEEIKAIKNVCENLDENYEKAVDLIHNCKGKVVFTGVGKSGHIGEKLAATFASTGTPAFFVHSTEALHGDLGMIEEKDIVIAISNSGETKEVLSIISSIKYIGSKIISITGNNNSSLAKESDVALEAKVDHEADPLNLAPTSSSTVALVLGDALAITLSQLKEFKRENFAVFHPGGSLGKRLFNEMKKL

SEQ ID NO: 54869 - protein, 334 aa, Eustoma grandiflorum
MEVQRVQEIASLSKVIDTIPAEYIRSENEQPVISTVHGVVLEVPVIDLSDSDEKKIVGLVSEASKEWGIFQVVNHGIPNEVIRKLQEVGKHFFELPQEEKELIAKPEGSQSIEGYGTRLQKEVDGKKGWVDHLFHKIWPPSAINYQFWPKNPPAYREANEEYAKRLQLVVDNLFKYLSLGLDLEPNSFKDGAGGDDLVYLMKINYYPPCPRPDLALGVAHTDMSAITVLVPNEVPGLQVYKDGHWYDCKYIPNALIVHIGDQVEIMSNGKYKSVYHRTTVNKEKTRMSWPVFLEPPPDHEVGPIPKLVNEENPAKFKTKKYKDYAYCKLNKLPQ

SEQ ID NO: 54870 - protein, 337 aa, Malus x domestica
MGVESVERERESNEGTIPAEFIRSENEQPGITTVHGKVLEVPIIDFSDPDEEKLIVQITEASSNWGMYQIVNHDIPSEVISKLQAVGKEFFELPQEEKEAYAKPPDSASIEGYGTKLFKEISEGDTTKKGWVDNLFNKIWPPSVVNYQFWPKNPPSYREANEEYAKHLHNVVEKLFRLLSLGLGLEGQELKKAAGGDNLEYLLKINYYPPCPRPDLALGVVAHTDMSTVTILVPNDVQGLQACKDGRWYDVKYIPNALVIHIGDQMEIMSNGKYTSVLHRTTVNKDKTRISWPVFLEPPADHVVGPHPQLVNAVNQPKYKTKKYGDYVYCKINKLPQ

SEQ ID NO: 54871 - protein, 335 aa, Citrus unshiu
MEVERVQAIASLSHSNGTIPAEFIRPEKEQPASTTYHGPAPEIPTIDLDDPVQDRLVRSIAEASREWGIFQVTNHGIPSDLICKLQAVGKEFFELPQEEKEVYSRPADAKDVQGYGTKLQKEVEGKKSWVDHLFHRVWPPSSINYRFWPKNPPSYRAVNEEYAKYMREVVDKLFTYLSLGLGVEGGVLKEAAGGDDIEYMLKINYYPPCPRPDLALGVVAHTDLSALTVLVPNEVPGLQVFKDDRWIDAKYIPNALVIHIGDQIEILSNGKYKAVLHRTTVNKDKTRMSWPVFLEPPADTVVGPLPQLVDDENPPKYKAKKFKDYSYCKLNKLPQ

SEQ ID NO: 54872 - protein, 435 aa, Rhodopirellula baltica SH 1
MSDIIPVEVPTVGESISEVQIGNWLKQEGDWVKSGEDLVEIETEKASVQIPAPASGYLQSITKQSDEFAEVGQQIASIQVAEQPAGGDGGSSNGGSAPAAGNTASAPAPTASAPAPSSPAKSGGGFVMPAAQRLLDEHKLDASQVPATGPGGRLLKEDVLAYIRNGSSRPAPAAPPAAPAAPVAPTQQMSSPETASLMTSGGYRSEEVKPMSMLRRTIASRLVQAQQTAALLTTFNEINMAPVMAIRSKYKDAFAKKHGVKLGFMSFFAKATVEALRRYPAVNAEIRGDSMVYRNYQDIGIAIGGGKGLVVPVLRNVERMSFAEVEGSIAEYARLAGENRLQPSDLMGGTFTISNGGIYGSLLSTPIVNPPQSGILGLHSIQERPVAEDGQVVIRPMMYVALTYDHRIVDGREAVGFLVAIKETIEDPARLFLEV

SEQ ID NO: 54873 - protein, 190 aa, Flaveria linearis
NPTLYGELAKGQSPKFLVFACSDSRVCPSHILDFQPGEAFVVRNIANMVPPYDTIKHSGAGAAIEYAVLHLKVENIVVIGHSCCGGIKGLMSIPDDGTPASDFIEQWVKLGLPAKSKVKANCNNLEFADLCTKCEKEAVNVSLGNLLTYPFVRDALVNKKLSLKGAHYDFVNGAFDLWNLDFGISPSLLQ

SEQ ID NO: 54874 - protein, 244 aa, Rhodopirellula baltica SH 1
MSPEVLSARPGFVRNLMDVMMKPVLQLPPMTCQRIREIDSLAMEQFQMPGIILMENAGRGAAELIEELAPEGNVLILCGKGNNGGDGFTIARHLQLAGREVMILAMAATNELQGDAAIQAKIAEAAGIKIQVVGEAVEAGRLPATDIVVDGLLGTGAKPPLRGRYAEVVEAANASSAIRIALDIPTGMNGDTGETGETTFRADHTLTFAAPKVGFEKLGAARFTGEVHVISIGVPLELLRQFSV

SEQ ID NO: 54875 - protein, 268 aa, Triticum aestivum
  misc_feature (160)..(160): Xaa can be any naturally occurring amino acid
  misc_feature (175)..(175): Xaa can be any naturally occurring amino acid
  unsure (1)..(268): unsure at all Xaa locations
MAAGGMSREERWSLAGATALVTGGSKGIGHAIVEELAGHGARVHTCARSAAELEECRRRWEAKGLPVTVSVCDVSLRAHREQLVETVKQVFDGKLDILVNNAAQILAKPGVEWTSEEYSHLMATNFESCFHLSQLAHPLLLRASIAGGGSIVNISSLGGXLGFPGLTIYSMTKGXINQLTRSLATEWAQNKIRVNCVAPGATKSDMLNSVGTDRLPPKIKENELTRTPMRRAGEPEEVAAVVSFLCMPAASFVTGQVITVDGGRTISA

SEQ ID NO: 54876 - protein, 308 aa, Bacillus cereus E33L
MKEVLEVLPKTMKQLVESCKQYDALEEIRVRIGRPLECIAHGEVFFYDYIVTAEDAIYLLNKLSQFSIYTMEEELKRGYVTLRGGHRIGLAGKVITEKSAVKMIRDVSSFNIRIARQKIGIAEPLLPYLYESRWLNTMVIGPPQTGKTTLLRDVARCMSQGVSASKIPSCKVGIVDERSEIAGCVKGIPQYDFGTRVDVLDACPKAEGMMMMIRSMSPDILIVDEIGRKEDSEAIMEAVHAGVQLFISAHGFSYDDVVKRPSLKAVLELGIFDRFVELSKARGPGTVMQVKDKNGKSVLPHRKAEGVW

SEQ ID NO: 54877 - protein, 142 aa, Glycine max
MAKVSLFVVCVVCILALASAQSATNVRATYHLYQPEQHNWDLLAVSAYCSTWDADKSLAWRSKYGWTAFCGPSGPQGQQSCGRCLRVTNTRTNAQETVRIVDQCSNGGLDLDIGPFQKLDTDGNGIAQGHLIVNYDFVDCGD

SEQ ID NO: 54878 - protein, 428 aa, Bordetella pertussis Tohama I
MSAIVDIIGREILDSRGNPTVECDVLLESGAMGRASVPSGASTGSREAIELRDGDKGRYLGKGVLRAVENLNTEISEALMGLDAQEQTFVDRTLIELDGTDSKERLGANAMLAASMAVARAAADESGLSLYRYFGGSGPMSMPVPMMNVINGGAHANNTLDLQELMILPVGAASFREALRWGAEVFHMLKKLIHDQGMSTAVGDEGGFAPNVASHEAAIQLILKAITEAGYEPGTQIALGLDCASSEFYRDGKYTLAGEGGVSLSSQEFANLLATWCDKYPIISIEDGMAENDWDGWKLLTDQLGKKVQLVGDDLFVTNTRILREGIQKGVANSILIKINQIGTLTETFAAIEMAKRAGYTAVVSHRSGETEDSTIADIAVATNAMQIKTGSLSRSDRMAKYNQLLRIEEELAEVASYPGLEAFYNLR

SEQ ID NO: 54879 - protein, 330 aa, Flaveria brownii
MSTASAFATNVPSFVNASSLKKSSTSSARSGVLSAKFTCNSSSSSSSATPPSLIRNEPVFAAPAPIITPNWTEDGNESYEEAIDALKKMLIEKGELEPVAAARIDQITAQAAAPDTKAPFDPVERIKSGFVKFKTEKFVTNPALYDELAKGQSPKFMVFACSDSRVCPSHVLDFQPGEAFVVRNVANMVPPFDKTKYSGVGAAVEYAVLHLKVQEIFVIGHSRCGGIKGLMTFPDEGPHSTDFIEDWVKVCLPAKSKVVAEHNGTHLDDQCVLCEKEAVNVSLGNLLTYPFVRDGLRNNTLALKGGHYDFVNGTFELWALDFGLSSPTSV

SEQ ID NO: 54880 - protein, 329 aa, Flaveria pringlei
MSTASAFAINAPSFVNASSLKKSSSSARSGVLSARFTCNSSSSSSSATPPSLIRNEPVFAAPAPIITPNWTEDGNESYEEAIDALKKMLIEKGELEPVAAARIDQITAQAAAPDTKAPFDPVERIKSGFVKFKTEKFVTNPVLYDELAKGQSPKFMVFACSDSRVCPSHVLDFQPGEAFVVRNVANMVPPFDKTKYSGVGAAVEYAVLHLKVQEIFVIGHSRCGGIKGLMTFPDEGPHSTDFIEDWVKVCLPAKSKVVAEHNGTHLDDQCVLCEKEAVNVSLGNLLTYPFVRDGLRNNTLALKGGHYDFVNGTFELWALDFGLSSPTSV

SEQ ID NO: 54881 - protein, 405 aa, Arabidopsis thaliana
MAAALQTNIRTVKVPATFRAVSKQSLAPFRVRCAVASPGKKRYTITLLPGDGIGPEVVSIAKNVLQQAGSLEGVEFNFREMPIGGAALDLVGVPLPEETISAAKESDAVLLGAIGGYKWDNNEKHLRPEKGLLQIRAALKVFANLRPATVLPQLVDASTLKREVAEGVDLMVVRELKGGIYFGEPRGIKTNENGEEVGFNTEVYAAHEIDRIARVAFETARKRRGKLCSVDKANVLEASILWRKRVTALASEYPDVELSHMYVDNAAMQLVRDPKQFDTIVTNNIFGDILSDEASMITGSIGMLPSASLSDSGPGLFEPIHGSAPDIAGQDKANPLATILSAAMLLKYGLGEEKAAKRIEDAVLVALNNGFRTGDIYSAGTKLVGCKEMGEEVLKSVDSQVPASV

SEQ ID NO: 54882 - protein, 151 aa, uncultured Frankia sp.
SRDPRNTAKKAEAYLRGTGFADTAYFGPEAEFYIFDDVRYDYNPYGSLHAVDSIEAAWNTARKEEGGNLGYKPRFKGGYFPVPPTDHFTDLRSEMSRALIRAGITVEMQHHEVGTAGQAEIDIRYDTLLRTADNLMLYKYIIRNVALSRGK

SEQ ID NO: 54883 - protein, 413 aa, Candida albicans SC5314
MNSRHSLPIVILRTAFITPLFILGCLSISLTQFLTLLIFKNNPDVKQAIINNTKNHFVILISYITTIVNPCKIEITIDETTVPNSDHFTVDESNNIHTMFQPNSVLISNHQIYTDWLYLWFLTYTSKFGNSVFIILKDLSKIPVLGYGMTNYNFYFLSRKWEKVKIVLTNQLLEIDANARGMGPANGVQLIGSSSTTNTEFTKWPQGSNVNKIWPYELILFPEGTVPSDRTTKKSAEFIASRGLPPLKHVLLPRIRGLFLALKKLKNSVEIVYEITTAYSGLTEDQYGEIEYSLKRFYLKGYGPSKINYYIKGWKLKDIPLGEDVDDIDNISEQDLKKFEDWLLKIWYEKDKLMDNHYKLGNWGESNHKTTRSIIGDFKLRNQFEIFLPFSATIATILFLRIAYILIRRIINV

SEQ ID NO: 54884 - protein, 211 aa, Glycine max
YFTLSGPYHKSLPMVYFPVPMETTSLRALALAPLPWPRKGVALRVPELVVAAINVAAMTTRPIPSYPQVSLVDQYFFFFLLGSSEDQIQMAMATAVVCPQNITGAIVGSPKKRVVHVRGLNSFGGLKASNGVVSLGLPMSTEKCFAKVVSSVKAATSNGKGKGGGALSSTCNAAGEIFTIAAIINGLVLVGVAVGFVLLRVEAWVEESEAE

SEQ ID NO: 54885 - protein, 578 aa, Clostridium magnum
MAKIVVMPKLGLTMTEGTLVTWKKAEGDQVKVGEILFEVSTDKLTNEVESSDEGIVRKLLVNEGDVVECLNPVAIIGSADEDISSLLNGSSEGSGSAEQSDTKAPKKEVEAVKGGDNLVVIGGGPGGYVAAIRAAQLGAKVTLIEKESLGGTCLNVGCIPTKVLLHSSQLLTEMKEGDKLGIDIEGSIVVNWKHIQKRKKIVIKKLVSGVSGLLTCNKVKVIKGTAKFESKDTILVTKEDGVAEKVNFDNAIIATGSMPFIPEIEGNKLSGVIDSTGALSLESNPESIAIIGGGVIGVEFASIFNSLGCKVSIIEMLPHILPPMDREISEIAKAKLIRDGININNNCKVTRIEQGEDGLKVSFIGDKGEESIDVEKVLIAVGRRSNIEGLDVEKIGVKTEGGSIIVNDKMETNVEGIYAIGDCTGKIMLAHVASDQGVVAAENIMGQNKKMDYKTVPACVYTKPELASVGLTEEQAKEKGIDYKVGKFQLAANGKSLIMNETGGVIKIITDKKYEEILGVHILGPRATDLITEAALALRLEATLEEIITTVHAHPTVGEAMKEAALAVNNQAIHMMNK

SEQ ID NO: 54886 - protein, 634 aa, Triticum aestivum
MKHMKLGSKPDVFQTEGSNIRFVATELATDIVISIGDVKFYLHKFPLLSKSSRLQRLVASSNQESDDEVNISDIPGGASAFEICAKFCYGMIVTLNAYNVLAARCAAEYLEMFETIDKGNLIYKIDVFLTSSIFRTWKDSIIVLQSTKSLLPWSENLKVINHCIDSIASKASIDPSEVEWSYTYNRKKLQSKNGVDSHWNGVRMQQMVPKDWWVEDLSELEMDLYKRVLLTIKAKGRTPAVVIGEALRVYAFRWLFGSLEDAVSNGIDCTKRRAVLESIVFLLPTEKGSVSCGFLLKLLNAACLLESGEFYRDNLVKRIGTQLDGASVADLLIPATSAENGVYNVDLIMAIVEQFMSHHSDNGKMTFQDDDEIVEVEKFASVSSTSKLAVAKLVDEYLGEIAKDPNLPVLKFIALAEMVSASSRQMHDELYHAIDMYLKEHPSLSKSEKKRLCGLMDCKKLSQEACMHAVQNERLPLRVVVQVLFFEQVRASAASARSDSGADLSSAVHSLLPRENGNSYGSSRSAATTTTEEEGSGVPTSSDINSFRSMRLANNCGGSERSSTSSDINKNGEDKSTTTGKAKVMLMPKMLSKLWSGKTHVGENSSSDASVSPGSANPEEVKSTPSRNTRQSTS

SEQ ID NO: 54887 - protein, 308 aa, Clostridium tetani E88
MNVKKILVIGSFMMDLVAQTPRAPIEGETIIGKSFSQFTGGKGANQAVAAARLGAYVTMIGKLGKDSFGEAHIESLRREGINHDYVLFDDVESSGVGHITLEENGNNRIIVIPGANLKLTPKEVEDLEDNIKSSDIVILQLEIPFETVYKTIELAHKHGKTIILNPAPAAKLKEHFVELVDYIVPNESEASLLTGIKVNSIESARKAAKSLLNLGCKNVIITLGEKGVLLVNNNEEIFQESFKVKPVDTTAAGDSFIGAFAYSLANGLGNVKSLEFACAVGALTVTKIGAQPSLPKLTEVEMFMKENR

SEQ ID NO: 54888 - protein, 313 aa, Arabidopsis thaliana
MASLISFSLLPKPKAVRSSISAPQTQTINTEKLEDKFGRKGIKFSESNNIPMVELKVRNGSSLKLSLSDAHVLSYKPKVYWKDEGFEEVLYTVDGDESRGGVGVVIVNGEEPKGGSSVISGCDWSVKDTDSDAIDALQIELSCTAGVLDITYIVSLYPVSMATALVVKNNGRKPVTLKPGIMSYLRFKKRSGAGIQGLKGCSYCPNPPLSSPFELLSPSEAMKAESSGWFGSEEGEKPGIWAVEDSVITLLEKKMSRIYGAPPAERLKAVYNTPPSKFETIDQVPFVYIQYDHSFLHLDATSIWYICSKLHLE

SEQ ID NO: 54889 - protein, 499 aa, Arabidopsis thaliana
MATRLLRTNFIRRSYRLPAFSPVGPPTVTASTAVVPEILSFGQQAPEPPLHHPKPTEQSHDGLDLSDQARLFSSIPTSDLLRSTAVLHAAAIGPMVDLGTWVMSSKLMDASVTRGMVLGLVKSTFYDHFCAGEDADAAAERVRSVYEATGLKGMLVYGVEHADDAVSCDDNMQQFIRTIEAAKSLPTSHFSSVVVKITAICPISLLKRVSDLLRWEYKSPNFKLSWKLKSFPVFSESSPLYHTNSEPEPLTAEEERELEAAHGRIQEICRKCQESNVPLLIDAEDTILQPAIDYMAYSSAIMFNADKDRPIVYNTIQAYLRDAGERLHLAVQNAEKENVPMGFKLVRGAYMSSEASLADSLGCKSPVHDTIQDTHSCYNDCMTFLMEKASNGSGFGVVLATHNADSGRLASRKASDLGIDKQNGRIEFAQLYGMSDALSFGLKRAGFNVSKYMPFGPVATAIPYLLRRAYENRGMMATGAHDRQLMRMELKRRLIAGIA

SEQ ID NO: 54890 - protein, 421 aa, Peptoniphilus asaccharolyticus
MTDTLNPLVAAQEKVRIACEKLGCDPAVYELLKEPQRVIEISIPVKMDDGTVKVFKGWRSAHSSAVGPSKGGVRFHPNVNMDEVKALSLWMTFKGGALGLPYGGGKGGICVDPAELSERELEQLSRGWVRGLYKYLGDRIDIPAPDVNTNGQIMSWFVDEYVKLNGERMDIGTFTGKPVAFGGSEGRNEATGFGVAVVVRESAKRFGIKMEDAKIAVQGFGNVGTFTVKNIERQGGKVCAIAEWDRNEGNYALYNENGIDFKELLAYKEANKTLIGFPGAERITDEEFWTKEYDIIVPAALENVITGERAKTINAKLVCEAANGPTTPEGDKVLTERGINLTPDILTNSGGVLVSYYEWVQNQYGYYWTEAEVEEKQEADMMKAIKGVFAVADEYNVTLREAVYMYAIKSIDVAMKLRGWY

SEQ ID NO: 54891 - protein, 466 aa, Cryptococcus neoformans var. neoformans JEC21
MATIPGGGTIMDPMHLYRARRDKERRGVLKTYKILGFISSGTYGRVYKAVLLPPPKTASAKSALPSSTRAALSLPKDKLPSPSFTEDSDPLNNPEMCMRPGDRPAKRGDVFAIKKFKPDKEGDVLTYAGISQSGAREIMLNRELHHRNLVSLREVILEDKSIYMVFEYAEHDFLQIIHYHSQTARASIPPSTLRRLLHQLLCGVHFLHSNFVLHRDLKPANILVTSQGVVKIGDLGLARLWHKPLAQQGLYGGDKVVVTIWYRAPELILGAKHYTAAVDIWAVGCIYAELLSLRPIFKGDEAKMDGKKSLPFQRDQMGKICEVLGPVKPEQWPGIVHMPEYRTYQATGPYPHSNPLAPWYHARSNSSEGYDILVKMFEWDPARRITARDALRHPWFQEEGGVDTKSVFEGSSITYPTRRVTHEDNGDAKMGSLPQSMAGGRLPSSSNFRPASGNIVQPAARKKARI

SEQ ID NO: 54892 - protein, 257 aa, Pseudomonas putida
MQLKDAQLFRQQAYINGEWLDADNGQTIKVTNPATGEVIGTVPKMGTAETRRAIEAADKALPAWRALTAKERSAKLRRWFELMIENQDDLARLMTTEQGKPLAEAKGEIAYAASFIEWFAEEAKRVYGDTIPGHQPDKRLIVIKQPIGVTAAITPWNFPAAMITRKAGPALAAGCTMVLKPASQTPYSALALVELAHRAGIPAGVLSVVTGSAGEVGGELTGNSLVRKLSFTGSTEIGRQLMEECAKDIKKVSLELG

SEQ ID NO: 54893 - protein, 361 aa, Myxococcus xanthus DK 1622
MRLGVLTGGGDCPGLNALIRGLVKRGTHEFGYEFVGIENGYMGLVEPGLAHPLTEEDTRGILPKGGTILGTSNKANPFSYATREDGHWVERDVSDQVLLRCEELGLDGLIAVGGDGTLSIAHRLVEKGLKVVGCPKTIDNDLSGTDQTFGFDTARLIVTEALDRLHSTAEAHDRVMVVEIMGRHAGFLTLESGIAGGADVILIPEIPYSVESVVEKIRRRSTRRRSFSIIAISEGAFPQGGELAVLDTAEAIPGRGVVRLGGSGKALADLLARHIEAEIRVTVLGHLQRGGSPSAADRVLATRYGCKVLDLVSAGQWDHMVALRAGEIIAVPLSESRKERRVDPAGELVRFTKSMGISFGD

SEQ ID NO: 54894 - protein, 496 aa, Pastinaca sativa
MIGVWCMLLAYTLVSIGRIRAKATRKLPPGPFPLPIIGNIHKLGKHPHKSLANLAQVYGPIMRLKLGHMTTVVISSSTTARQVLRKQDIAFSNRALPNAVRALDHNKYSAVWLPVGSQWRGLRKIMSMNLFTANKLDANQHLRSQKVHDLIRYCEKCSQSGEAVDIGGAAFLTSLNLMSNTIFSKDMIDSYENSEAKVFRDLVWNIMVEIGKPNLVDYFPLLQWMDPQGIKRRLAYNFDTLIKLFDVMVDERLELNGPQNSRDVLDELLKLVNTDEIDKSHIQHMFLDLFGAGTDTSSSTVEWAMSEILRKPATVLVKAKAELDQVIGNGKIVEEADISKLDYLRCIVKETLRLHPPAPLLVPRQVQEEVELCGYTVPKNSQVLVNAWAIGRDPMLWENPLSFQPERFVDSEIDINGHGYELIPFGAGRRICPGMPLAMRMVPIMLGSLLNCFDWKLQGGIAPEDLNMEDKFGLTLAKLHPLRVVPTSRPTHLFAF

SEQ ID NO: 54895 - protein, 571 aa, Candida albicans
MPEDYEKYRMGSSNESHQKSVQPISSSISKSNKKTKHQTDFVQDSDIIEASSINDEFGEVKRDLKARHVSMIAIGGTIGTGLFISTGSLLHTTGPVMSLISFLFVTTICFSVTQSLGEMATYIPISGSFAQFVTRWVSKSCGAANGWLYWFSWAVTFGLELSVVGQVIQFWTDAVPLAAWISIFFVILTIFNFFPVKFYGEVEFWIASIKIIAVFGWIIYAFIMVCGAGKTGPVGFRYWRNGYAWGDGILVNNNGKYVAAFVSGLINSIFTFQGSELVAVTAGEASPRALRSAIRKVMFRILVFYVLCMLFMGLLVPYNDPKLTQDGGFTRNSPFLIAMENSGTKVLPHIFNAVIVTTIISAGNSNIYSGSRILYGLAQAGVAPKFFLRTNKGGVPFFAVAFTAAFGALGYLACSSQGNKAFTWLLNITATAGLISWGFISVSHIRFMKTLQRRGISRDTLPFKAFFMPFSAYYGMVVCFIVVLIQGFTVFWDFNASDFFTAYISVILFVVLWVGFHFFFYGFGKDSFKMSNILVPLDECDIDSGVRDINDAEFDIPPPKNAWDKFWANVA

SEQ ID NO: 54896 - protein, 707 aa, Mesorhizobium loti MAFF303099
MSFRERLQSWRYNLVPDHLVGEILTKRWTDNAIPFLALVVTLATFGSIIPGFFKLNALQESTRQLGEFSMVVTGMTVVMLGGGIDLSVGSIFALSCFSAVYVFFILEQSIWLALAASLATGLIFGAINGYLVGYLRLRAFLTTLVTFIFGRALFDILVTTYAADVQLSTATSDVLDFIGDSTFWGLSVSVWLAIILAIVTHIALTRSRPGWHVLAVGGSRRSAHNAGIRVRRTVFMTYVFSGFCASIGGFLIACRLSGAGPGTGLNLEIMALTAAVVGGVSLGGGRGSVIKGLMGAIIVLTMTNGLIRLGYGTGTNQMVLGIMLAVAVTIDIRWLKNRHKVLNEVYVAPVYLKMGETQSAVPGSGTPYELDNRLSAADHIGLGELEGPEDVILDRDDHLYCGTRHGEIVRFFAPDYVKSEVFAHIGGFPLGLAFDKSGNLISCVGAMGLYSVSPQREVKRLSAETARSWTSIVDDARLRDPNDCDIAPDGRIYFTDSTKRYDAHDWALDSIENRATGRLLVYDPKDGSTKTLLDGYRYTNGVCMAHDGKSLFFAESWACRVHRYWLEGPKAGTAECVIRDMPGYPDNINRASDGNYWMAWLGMRTPSFDLSLRHPDMRKRMTRRLPQDEWLFPNINTGGVVKFNEKGGIVEAMGDLSGGAHPMVTSMREHKGYLFVGGILNNRVGRYKISGADPNWTSPASYWGAKP

SEQ ID NO: 54897 - protein, 151 aa, uncultured Frankia sp.
SRDPRNTAKKAESYLRGTGFADTAYFGPEAEFYIFDDVRYDYNPYGSLHAVDSIEAAWNTARKEEGGNLGYKPRFKGGYFPVPPTDHFTDLRSEMSRALIRAGITVEMQHHEVGTAGQAEIDIRYDTLLRTADNLMLYKYIIRNVALSRGK

SEQ ID NO: 54898 - protein, 592 aa, Bacillus thuringiensis serovar konkukian str. 97-27
MAETLAKRGPDDNKVWIKGNVAFGHKRLIVVDPEGGKQPMTCLKDEANYAICYNGELYNTEDIRKELLRRGYTFKGHSDTEVLLASYIEWKEECVDHLNGIYAFAVWDEQKEQVFIARDRLGVKPLFYKYDSGRLLFGSELKAILAHPDVKAEVTLEGLSEIFGLGPSRTPGHGIYAGIKELRPGHAMTFSKNGLCIWRYWNVESKKHEDSFEETVEKTRFLLQDAITRQLVSDVPLCTFLSGGVDSSAITAIAAKEYERSGKGQLHTYSVDYEDNDKYFKANAFQPNSDAPFIHLMTETFQTIHHRCVISNEQLAQYLTEAVLVRDLPGMADIDSSLLWFCREIKQDFVVGLSGECADEIFGGYPWFYREDDLQSSAFPWMRSTEAREQLLKKEWRNKLNLQQYVQQRYEESIQEVPILDGESPLEAKRRQLFYLNMVWFMTTLLDRKDRMSMGASLEVRVPFADHRLVEYAWNIPWEMKMYKNREKGLLRKALEGLLPNEILYRKKSPYPKTHNPHYTKAVTVWIQDLLTDKGSILHELFDKEQLSGLIESGGSAFQTPWYGQLMTGPQLLAHLAQIHVWFKEYGVNIKE

SEQ ID NO: 54899 - protein, 892 aa, Nocardioides sp. JS614
MTTANLPHDPIDWHDERAEWLDSVSGLVRTHGPHAASLLLRDVATHAGRLGVATGPRTPYLNTIPTQEWAAYPGDLALEERIDAYLRWNAMAMVVRANKRHAGLGGHLSTYASTLTLWEVGFQHFFRGRGSAGEAVVPGDQVFFQGHASPGIYARAFLEGRLSAEQLDHFRREVAGAGQGLPSYPHPRSMAGFWEFPTVSLGIGPLHAVYQARFNRYLAARGLADTAAARVWCFVGDGEIDEPETLAAIRLAAREHLDNIVFVVNGNLQRLDGPVRGNSRVLDELEGIFAGAGWHVLKVLWGSRWTSLFERPGGEALLDRLEAMNDGDLQRLAILEPAELRATLFGGGDAALEALGATLSDADLAGLRRGGHDPRAVYAAYAEAVAHRGEPTVVLAQTIKGYALGPNFEGRNATHQMKKMTPDQLRIFRDILRVPVTDEELADGLPPYLPLPEGSPELEYLHAHRRTLGGALPRRPLRPAVLAAQPADAPFTQFDAGSGKRTVSTTVAYTRLLHSLMRDPEVGRRIVPIVPDEGRTFGYEPLYSEFGIYAPDGQQYTPVDAGLPLSYRESADGQVLQEGITEAGGLAELTAAATAGHTWDTAVVPFFTYYSMFGFQRVGDLIWALADARGRGFLVGATAGRTTLAGEGLQHTDGSSQLAALAVPSCHAYDPAFAYETATIVRDGIRRMYDAGEESFYYLTVYNEDYVQPVKPVDSGVRSVSVDEAIVAGLYRVDATEGNRLPQVRLLASGPAVRTAQQAAADLAARDGVTAEVWSVTSWKALRDDALETERWNREHPHEPARVSYLRRALGDLPVPVVAVSDYVSALPDQIARFVDAPFVSLGTDGYGLSDTREELRAHFGVDAEGIRATAAGVADRPATHRAARPDEGLVA

SEQ ID NO: 54900 - protein, 972 aa, Arabidopsis thaliana
MDIGPKDKISNLPEALICHILSFLPIEDSALTSVLSKRWRYLFAFRPNLVFDDSVCLRPPCGHGVIPDYVTSWILNVLERGVLDLDLQVNVNGVRLPSKVFVSKSLVRLRIESGNVRGIDVDDVFLPKLKSLYLHTIMLGKGEDCFEKLTSGCHVLEELVLNNVYSNVWNRSVSSKTLKRLTLWCTESYDKNPHSVLFDTPNLVYLKYSDYVAAKYPKVNFSSLVDATIGLAMTSDQDANASYDALVGNATDFLMGICNVQILCLSANSLAVLTFCCESIPVFNNLIQLTIKTNQSVGWESLPALLKNCPILETLVFEGLLHMYTIKCGDVDGCLCKYSGEVPSCLSSSPVKVLKILRFGEYGIVNQIEMIKIFLETMPHLEQLTVYYNTPIGGDLIEEVSSQLKNFAREASPNCEIQSYQSPPADSSQTDHTDPQVRLPIGSPAINRNLNGFEVRNCLRSVTMNSTKMDDICCKDIISDLPEALICHLLSFVPTKEAALTSLLSEKWRYLFAFAPILDFDDSVWMQSPLVYMNEVHRKFMDFVDRVLGLQGNSTLVRFSLNCRNGIDRECIFRWISNVIERGVSDLDLGGNFVSNRSMPSSVFVSKSLVKLRIRTENCTIIDLEDVFLPKLKTLDLSSIWFRDGDTCLLKLISGCQVLEDLTMSDLWWDGYWNRSMSSKTLKRLTVHCSDWDRSPGSISFDTPNLVYFEYFDLVADKYEVVNFDSLVEASIGLRMRHHQRAHASYGDLVVNATNLFMGISNVRILQLFSNALEVLTFCCAPIPVFKKLIHLTVETDKDVGWESLPALLKNCPNLETLVFKGLHHRSTSKCQDTDGCLCKSSKDIRSCLSSSPVKVLKILKFGEVASYFGDEEKQLELVKYFLETMPNLEQMILHYNTRISEGVKSQLDWLVPRVSSSKCSVQLICDNAPTYPFYGGIICDNFITPAPTYPFFGDPLHGMVIPYMGDQPHFI

SEQ ID NO: 54901 - protein, 567 aa, Oryza sativa
GIRRSPTPPTQGEELLAASPAGPRGGRKGRAVVLPLSAAALVACAVVLLLLAGGSAARRGQFVGADPTVLPSRGGGVGDLHLSQSKSNDGENVTIASSEVVNDKLLGGLLTTGFDEQSCLSRYQSVLYRKASSHFPSAYLLERLREHEALQKKCGPHTESYKKAIEQLKAGQGAKVMECNYLVWVAYSGLGNRILTMASAFLYAILTRRVLLVDSDKGTADLFCEPFPETSWLLPPKFPIKQFKNFSNGSPESYGNMLKNKAIRSNPAFLYLHMAHDYSDYDKLFFCEDNQQYLRNIPWLILKSDNYFVPSLFLIPAYQEELTRLFPQRDSVFHHLGRYLFHPSNVVWGMVTRYYDSCLARADERLGIQIRVFDPEPGPFQHVLDQVLACTLKENLLPAINSKQPIVSTRHSRLKSVLITSLNSGYYEKIRSMYWEHPTTNGEMISFHQPSHEEHQNSDKKMHNMKAWAEIYLLSLSDVMVTSAWSTFGYVAQGLSGLRPWLLFKPENRIAPDPPCRQVLSMEPCFHAPPFYDCKAKRGADTGKFVPYVSHCEDMSWGLKLVDQSEW

SEQ ID NO: 54902 - protein, 482 aa, Escherichia coli W3110
MSAIDSQLPSSSGQDRPTDEVDRILSPGKLIILGLQHVLVMYAGAVAVPLMIGDRLGLSKEAIAMLISSDLFCCGIVTLLQCIGIGRFMGIRLPVIMSVTFAAVTPMIAIGMNPDIGLLGIFGATIAAGFITTLLAPLIGRLMPLFPPLVTGVVITSIGLSIIQVGIDWAAGGKGNPQYGNPVYLGISFAVLIFILLITRYAKGFMSNVAVLLGIVFGFLLSWMMNEVNLSGLHDASWFAIVTPMSFGMPIFDPVSILTMTAVLIIVFIESMGMFLALGEIVGRKLSSHDIIRGLRVDGVGTMIGGTFNSFPHTSFSQNVGLVSVTRVHSRWVCISSGIILILFGMVPKMAVLVASIPQFVLGGAGLVMFGMVLATGIRILSRCNYTTNRYNLYIVAISLGVGMTPTLSHDFFSKLPAVLQPLLHSGIMLATLSAVVLNVFFNGYQHHADLVKESVSDKDLKVRTVRMWLLMRKLKKNEHGE

SEQ ID NO: 54903 - protein, 1533 aa, Arabidopsis thaliana
  misc_feature (824)..(824): Xaa can be any naturally occurring amino acid
  misc_feature (898)..(898): Xaa can be any naturally occurring amino acid
  unsure (1)..(1533): unsure at all Xaa locations
MTSLKKHTDKSPITGKSILYLNRHQTEEWKGWMQVLFLMYHYFAAVEFYNAIRVFIAGYVWMTGFGNFSYYYIRKDFSLARFTQMMWRLNFFVAFCCIILNNDYMLYYICPMHTLFTLMVYGALGIYSQYNEIASVMALKIASCFLVVILMWEIPGVFEIFWSPLAFLLGYTDPAKPDLPRLHEWHFRSGLDRYIWIIGMIYAYFHPTVERWMEKLEECDAKRRMSIKTSIIGISSFAGYLWYEYIYKLDKCLHLSAKLHPTATEIFPDTLCVAGQDNSRDLHFTVSHLVKIECAKWAAKVAIINHPRIPNAQLHAHHGHLRLGKKASSRHRQNLEEEEEEEAKMRNHCLELSSNCSSIFASSKSNPRFSPSKLSYSTFFSRSAIYYRSKPKQASSSSSFSTFPPCLNRKSSLTHVLKPVSELADTTTKPFSPEIVGKRTDLKKIMILGAGPIVIGQACEFDYSGTQACKALREEGYEVILINSNPATIMTDPETANRTYIAPMTPELVEQVIEKERPDALLPTMGGQTALNLAVALAESGALEKYGVELIGAKLGAIKKAEDRELFKDAMKNIGLKTPPSGIGTTLDECFDIAEKIGEFPLIIRPAFTLGGTGGGIAYNKEEFESICKSGLAASATSQVLVEKSLLGWKEYELEVMRDLADNVVIICSIENIDPMGVHTGDSITVAPAQTLTDREYQRLRDYSIAIIREIGVECGGSNVQFAVNPVDGEVMIIEMNPRVSRSSALASKATGFPIAKMAAKLSVGYTLDQIPNDITRKTPASFEPSIDYVVTKIPRFAFEKFPGSQPLLTTQMKSVGESMALGXRTFQESFQKALRSLECGFSGWGCAKIKELDWDWDQLKYSLRVPNPDRIHAIYAAMKKGMKIDEIYELSMVDKWXFLTQLKELVDVEQYLMSGTLSEITKEDLYEVKKRGFSDKQIAFATKTTEEEVRTKRISLGVVPSYKRVDTCAAEFEAHTPYMYSSYDVECESAPNNKKKVLILGGGPNRIGQGIEFDYCCCHTSFALQDAGYETIMLNSNPETVSTDYDTSDRLYFEPLTIEDVLNVIDLEKPDGIIVQFGGQTPLKLALPIKHYLDKHMPMSLSGAGPVRIWGTSPDSIDAAEDRERFNAILDELKIEQPKGGIAKSEADALAIAKEVGYPVVVRPSYVLGGRAMEIVYDDSRLITYLENAVQVDPERPVLVDKYLSDAIEIDVDTLTDSYGNVVIGGIMEHIEQAGVHSGDSACMLPTQTIPASCLQTIRTWTTKLAKKLNVCGLMNCQYAITTSGDVFLLEANPRASRTVPFVSKAIGHPLAKYAALVMSGKSLKDLNFEKEVIPKHVSVKEAVFPFEKFQGCDVILGPEMRSTGEVMSISSEFSSAFAMAQIAAGQKLPLSGTVFLSLNDMTKPHLEKIAVSFLELGFKIVATSGTAHFLELKGIPVERVLKLHEGRPHAADMVANGQIHLMLITSSGDALDQKDGRQLRQMALAYKVPVITTVAGALATAEGIKSLKSSAIKMTALQDFFEVKNVSSLLV

SEQ ID NO: 54904 - protein, 244 aa, Streptococcus pyogenes M1 GAS
MEIKGKNIFITGSTRGIGLAMAHQFASLEANIVLNGRSAISEELVASFTDYGVTVVTISGDVSEASEAKRMVNEAIESLGSIDVLVNNAGITNDKLMLKMTEEDFERVLKINLTGAFNMTQSVLKPMIKARQGAIINVSSVVGLTGNIGQANYAASKAGMIGFTKSVAREVAARNICVNAIAPGFIESDMTGVLPEKMQEQILSQIPMKRIGKAQEVAHLASFLVEQDYITGQVIAIDGGMTMQ

SEQ ID NO: 54905 - protein, 342 aa, Zea mays
  misc_feature (248)..(248): Xaa can be any naturally occurring amino acid
  misc_feature (275)..(275): Xaa can be any naturally occurring amino acid
  unsure (1)..(342): unsure at all Xaa locations
MDLVPHPDSPHSDNSGGGGGSECGALSPADHIYLPPLATCSAPLPAQSWDEFRSRPLASAPDPSSHPLLLAGMRRADLVELVFALRGDRQVTERAMEVAGVVASAADSPGAAAARPSRYESQKRRDWHTFGQYLRNHRPPLELARCSGAHVLEFLRYLDQFGKTKVHAARCPFFGHPSPPAPCPCPLKQAWGSLDALVGRLRAAFEEHGGRPEANPFGARAVRLYLREVRDSQAKARGIAYEKKRRKXPPAGAPPAQAAAAAGRPAPAPVARRAXTVAEPPAPHFLIPHAHFLHGHFLAPATEPIDPAAGGGGGTGDDIALAMAAAAEAHAAGFLMPLSVFN

SEQ ID NO: 54906 - protein, 541 aa, Oryza sativa (japonica cultivar-group)
MTETPRRSYRKLLTSVIGEKLRDECEQDNRSIFRAVTMPPSSPAPTREVSLALVPMKVHRRESPEVATGWSFLRKKFLPDRKPASHDRSKMSVVQWAMRLPSRYSSASPVCSEYRTTTPDGITSASRILRDRVAVPSRSNSGKSSVVIEELDNSSDKEIPEELIALREKFPSVYSTFSHSELAKITSDFSPECIVGQGGTSQVYKGCLENGKELAVKILKYSDEVLKEFVSEIEIVSSLSHKNIISLAGFCFKDTDLLLVYEYLRRGSLEEILHGEKGCDNLFGWTERFNVALGVAHALDYLHGSGNNRPVIHRDVKSSNILISQDFEPKLSDFGLALWDTDATSQITCNDVAGTFGYLAPEYFMHGKVNDKIDVYAFGVVLLELISGKKPLCTGCPKGQESLVMWANSIIQGGKLTQLVDPNLPTEDHANKVERMTLAASLCIRPTPQRRPHIAVVLKLLNGDNGILKWARSEVGLSYESDGDEPVVTLPENNRNIQSYINLAFDVDDDSASVSSNDFIAANTSLEEYLRGRWSRSSSFD

SEQ ID NO: 54907 - protein, 787 aa, Neisseria gonorrhoeae FA 1090
MQFSYSWLKTQANPDLSADKLEHLLTMAGLEVEEIDTAAPAFSGVVVAEVKSVEKHPDADRLNVTQVDAGTGELVQIVCGAPNVKPGIKVPCSLPVAVLPGNFKIKPTKMRGVPSNGMLCSTNELGLPDDGVDGLHILPEDAPVGTNIREYLDLDDMLFTLKITPNRADCLSVKGIAREVSALTQCAFTPVEIQTAPIGSEKKQAVRIDAPADCGRFISRVIENVNAKAATPDWMKQRLERSGIRSISALVDIGNYVMLEIGQPMHVFDADKLSGSLIVRRAQNGETLACLNEKTVTLADNTLVVADEKGALSLAGLMGGAASAVSDGTQNIVLEAAWFEPEIIVGKSRQYGFGSDSSFRFERGVDYRLQADAIERATELVLQICGGAAGEMVEAQGKLPEAKQVGLRLGRLKTVLGVDIPAEQVETILQHLGLQPEKTAEGFRITAPSFRFDIEIEADLIEEIGRVYGYENIPDDYTSGRLKMSELPETRRPRFAVYNEMAARGYREVISYAFVDEQWELDFAANAAPIRLQNPLAAQYAVMRSTLIGGLVEILQNNLNRKQNRVRVFEIACVFGKGSDGRFVQNERIGGLWYGAAMPEQWGEKTRNADFYDIKADVENLLKNKAVEFVKTGHPALHPGRAANIVSDGKVIGFVGELHPKWLQKYDLPQAPLVFEIDMAAVLECGKTRYRAVSKFQPVRRDLAFVMPEVMNHDDLLLVLKGAANKLVQEISVFDVYRGTGLPEGMKSVAVKVILQDMENTLTDEAVEPLIGKLIGVATEAGARLRS

SEQ ID NO: 54908 - protein, 459 aa, Emericella nidulans
MSNLPVEPEFEQAYKELASTLENSTLFEQHPEYRRALQVVSVPERVIQFRVVWENDKGEVQINRGYRVQFNSALGPYKGGLRFHPSVNLSILKFLGFEQIFKNALTGLNMGGGKGGSDFDPKGKSDSEIRRFCTAFMTELCKHIGADTDVPAGDIGVTGREVGFLFGQYRRIRNQWEGVLTGKGGSWGGSLIRPEATGYGVVYYVQHMIKHVTGGKESFAGKRVAISGSGNVAQYAALKVIELGGSVVSLSDSKGSLIVKDESASFTPEEIALIADLKVARKQLSELATSSAFAGKFTYIPDARPWTNIPGKFEVALPSATQNEVSGEEAEHLIKSGVRYIAEGSNMGCTQAAIDIFEAHRNANPGDAIWYAPGKAANAGGVAVSGLEMAQNSARLSWTSEEVDARLKGIMEDCFKNGLETAQKFATPAKGVLPSLVTGSNIAGFTKVAEAMKDQGDWW

SEQ ID NO: 54909 - protein, 523 aa, Chlorella sorokiniana
CRPPSSPSLSWPPGLRSPALPRAVACARGRSAKRDVAAKRLRSRSPRMDATTGDFTALQKAVKQMATKAGTEGLVHGIKNPELRQLLTEIFMKDPEQQEFMQAVREVAVSLQPVFEKRPELLPIFKQIVEPERVITFRVSWLDDAGNLQVNRGFRVQYSSAIGPYKGGLRFHPSVNLSIMKFLAFEQIFKNSLTTLPMGGGKGGSDFDPKGKSDAEVMRFCQSFMTELQRHISYVQDVPAGDIGVGAREIGYLFGQYKRITKNYTGVLTGKGQEYGGSEIRPEATGYGAVLFVENVLKDKGESLKGKRCLVSGAGNVAQYCAELLLEKGAIVLSLSDSQGYVYEPNGFTREQLQAVQDMKKKNNSARISEYKSDTAVYVGDRRKPWELDCQVDIAFPCATQNEIDEHDAELLIKHGCQYVVEGANMPSTNEAIHKYNKAGIIYCPGKAANAGGVAVSGLEMTQNRMSLNWTREEVRDKLERIMKDIYDSAMGPSREYNVDLAAGANIAGFTKVADAVKAQGAV

SEQ ID NO: 54910 - protein, 435 aa, Halobacterium salinarum
MTMASKSDSTHDESGDEAADSTEPESALETARRQLYHAASYLDIDQNIVERLKYPKKVHEVTIPIERDDGTVEVFTGYRAQHDSVRGPYKGGLRYHPDVTRDECVGLGMWMTWKCAVMDLPFGGAKGGVAVNPKELSPEEKERLTRRFTQEIRDVIGPNQDIPAPDMGTDPQTMAWLMDAYSMQEGETTPGVVTGKPPVVGGSEGREEAPGRSVAIITQLVCEYYDQPLDETTVAVQGYGSVGANAARLLDKWGATIVAISDVNGAMYEPDGIDTASVPSHDEEPEAVTTYADTVISNEELLTLDVDVLIPAALGNVITKENAEAIAADLVVEGANGPTTSTADSILADRDVAVIPDILANAGGVTVSYFEWLQDINRRAWSLERVNDELEAEMQAAWRAVKDEYENRDVTWRDAAYIVALSRIAEAHEARGLWP

SEQ ID NO: 54911 - protein, 112 aa, Thermosynechococcus vulcanus
MKKRFISVCAIAIALFVSLTPAALAADLANGAKVFSGNCAACHMGGGNVVMANKTLKKEALEQFGMYSEDAIIYQVQHGKNAMPAFAGRLTDEQIQDVAAYVLDQAAKGWAG

SEQ ID NO: 54912 - protein, 890 aa, Arabidopsis thaliana
MNGLDFFFSPSPIVDTSTGNNGGDDDWGDFVDSSDAFDSDRNGADSSHNRIESEKKSQANWVTSRGPVPLSVFGEEEEDDTESSASVPSFGFSFDSFSSKRNDSNGSVNRVVDSNTNHTVEISGLIPNLYRKNGHSDNNHGNSGGFNVDLSSSNRKIENSAVSLETNPLNLGTERSVKASNVLNSSTIEVTLDPNYSDLGFADKSDDDLDGWEFKTAESMFGTLGGSYKEEREKAVQNTADVSSGVWSSPAINGTGPNFDTAKVDAVKLVAERENGDDDPWDNGGWEFKVAEAKEPKRDLTNKESNGWGFGFGFEPVSKLETTNSFQSSVEKETKKMENGSISFPSNGDVNSGGTSWAFKQPSLEIGNEKEEKEVQTGKPKGVLPLSFFEDEKSETSDTLVHEDSFVLASDFPVREKTKAPSPTVSISDLISRLYSQVEEKNAVNILENSATASNEVNGEDDSWEFQGPKMPITDSGIAEGADDFDSTWEFQGPSPALKMSDVTEVVDEFDDDSWEFQGPTQPVKDSMSRIGDNGLWEYKHSSVENEVGNQSSVPNGFGELHDKTVIRIEPNDYQDLFHKLKIELYHIALYHLEKLKEARDKAADSDEVQKCDSEIEDLQNLLNNDVLISGVNLESLQPGSSGMTELYKALQEPKFRELDSEDLLTERLLSAEKDWKSTIELLKHATLTLKIINLGSLEQQSKYASTWFEISSTCAQELRHAASIWKQVIKNDVQEEILSKPQGKSYALSVGEIYRVVKILRASTRLYKPWILLAPTSSNVLAVLDECLKLWLSSGLVEALLNSHDDSADQLLESIKYINEVDAFTLYTCITSATSPTCYISGLNTDIVPGIKTVEWNGEHYLLPLANIWANLISRDPPNLPGHHFPIVS

SEQ ID NO: 54913 - protein, 511 aa, Oryza sativa (japonica cultivar-group)
MGLPEQCITLSSVVVVPLINLAKAMAMASANVLLLPEAGSGHLMSLIEAGKRLLAHGGRGDGEGPAVTVTVLVVRPATSESAAEVDAHVGRVEASGLGVRFHRLPAVEPPPMGCAAGNVQEFKSRYMQLQAPHVRAAAAELGAAALVVDFFATGVLDAAREAGVPTYVYFTSTAALLALMLRLPALEEEVPVDFEEFDGTVDVPGLPPVPAGSLPAFMGRKESPNFKWFLYHGRRFMDADGIIINTVAELEPALLAAIADGRCVPGRTAPPLYPIGPVLDLEDKPSSNARCVRWLDAQPPASVLFLCFGSMGWFDAAKAREVAAGLERSGHRFLWALRGPPAAGTVHPTDASLDELLPEWFLERTKGRGLVWPTWAPQKEILAHAAIGSFVTHCGWNSTLESLWHGVPLVPWPLYAEQRLNAFELVRDMGVAVPLGVDGKRRDSFVEAAELERAVRSLMDDASEVGRKVREKAAEMKAVCRNAVAPGGGSSYAALQRLLGAIRGGFSTMTQ

SEQ ID NO: 54914 - protein, 472 aa, Xanthomonas campestris pv. campestris str. ATCC 33913
MHRHVHEPEILADPAAFEAAEHWRQRDLAVVWHPCTQMREHPHTLPLVPIARGDGAWLIGHDGRHYLDAVSSWWTNLFGHAEPRIGAAIAQQAGRLEQVMLAGFTHAPAVQLAERLLAIAPRQPDRAPLAKVFYADNGSAGVEVALKMAFHYFHNRDEHRRTRFIALENGYHGETIGALSVGDIPLYRRVYAPLLLESIFAPSPDAYLAEPGQSAEDYALQAADALQHLLEQSPGEICALILEPRVQCAGGMRMYHPAYLRRARELCDAHGVFLIADEIATGFGRTGTLFACEQAGVMPDLLCLSKGLTGGFLPLSAVLATQQLYDAFLDDSRERAFLHSHSYTGNPLACAAALATLQIFADDDIIARNQRTAAHMTQLAAQIGEHSAVADVRQAGMIVAFELTQGGDKRTPFPAAARVGLQAYRAALARGVVLRPLGDVLYWMPPYCVDDAQLALLADTTRHAIAKAVACA

SEQ ID NO: 54915 - protein, 592 aa, Zea mays
MKKCSGVLFILTLAVVLFLLSPSPSPTPPPNTAPNGPITDLLPTLPGLSDLYPPAPNSTAHLSWGLLRPLLCRSDALPGTSAGVLEAAEAWRNLTLAVTAAASEEEARLQGLRCSSSVGGDLRTGRATLPCGLSEGAALTVVGILREGAAKFWVEMLGANGEVVLHVNVSLGAAGVLVEQNSWTPEEGWGEWERCPPVGDVGSSNSSLQLSPVDGLVHCNEKVGARIVQESNNTVVNITGNQPEDWQSQTGHGQLSGRFSIVEGEPFTVTLWAGVEGFHMTVNGRHETSFAYRERSEPWLVAEVMFSGDLELLSFLANELPVSEDIDMENVAVLKAPPLPKKQTFLLVGVFSTGNNFKRRMALRRTWMQYEAVRSGDVVVRFFTGLHKNEQVNMELWREAQLYGDIQLMPFVDYYTLITLKTISICIFGTKIVPAKYIMKTDDDAFVRIDEVISSLKKSNSNGLLYGLISFQSSPHRDKGSKWFISRKEWPFDMYPPWAHGPGYVISRDIAKFVVQGHQELTLQLFKLEDVAMGIWIQQYKNSGQQVNIVTDDRFYNEGCEADYVLAHYQTPRLMMCLWEKLKTEYHAICCE

SEQ ID NO: 54916 - protein, 585 aa, Arabidopsis thaliana
MEVEEEVSRWEGYADWRNRAAVKGRHGGVLAASFVLVVEILENLAYLANASNLVLYLREYMHMSPSKSANDVTNFMGTAFLLALLGGFLSDAFFSTFQIFLISASIEFLGLIILTIQARTPSLMPPSCDSPTCEEVSGSKAAMLFVGLYLVALGVGGIKGSLASHGAEQFDESTPKGRKQRSTFFNYFVFCLACGALVAVTFVVWLEDNKGWEWGFGVSTIAIFVSILIFLSGSRFYRNKIPCGSPLTTILKVLLAASVKCCSSGSSSNAVASMSVSPSNHCVSKGKKEVESQGELEKPRQEEALPPRAQLTNSLKVLNGAADEKPVHRLLECTVQQVEDVKIVLKMLPIFACTIMLNCCLAQLSTFSVQQAASMNTKIGSLKIPPASLPIFPVVFIMILAPIYDHLIIPFARKATKTETGVTHLQRIGVGLVLSILAMAVAALVEIKRKGVAKDSGLLDSKETLPVTFLWIALQYLFLGSADLFTLAGLLEYFFTEAPSSMRSLATSLSWASLAMGYYLSSVIVSIVNSITGSSGNTPWLRGKSINRYKLDYFYWLMCVLSAANFLHYLFWAMRYKYRSTGSRS

SEQ ID NO: 54917 - protein, 143 aa, uncultured Frankia sp.
SRDPRNTAKKAEAYLRGTGFADTAYFGPEAEFYIFDDVRYDYNPYGSLHAVDSIEAAWNTARKEEGGNLGYKPRFKGGYFPVPPTDHFTDLRSEMSRALIRAGITVEMQHHEVGTAGQAEIDIRYDTLLRTADNLMLYKYIIR

SEQ ID NO: 54918 - protein, 808 aa, Arabidopsis thaliana
MQNPSTVTQESAAPVFDFFPRLRGLTSRNRSPCSNSDGYALSSSNALYFNGFRTLPSRRMGKTLASLSFNTKSSAGSSLRRFISDFNSFIRFHCDKVVPESFASVGGVGLSSDENGIRENGTGGVLGEEGLPLNGVEADRPKKVLILMSDTGGGHRASAEAIRAAFNQEFGDEYQVFITDLWTDHTPWPFNQLPRSYNFLVKHGTLWKMTYYGTSPRIVHQSNFAATSTFIAREIAQGLMKYQPDIIISVHPLMQHVPLRVLRSKGLLKKIVFTTVITDLSTCHPTWFHKLVTRCYCPSTEVAKRAQKAGLETSQIKVYGLPVRPSFVKPVRPKVELRRELGMDENLPAVLLMGGGEGMGPIEATARALADALYDKNLGEAVGQVLIICGRNKKLQSKLSSLDWKIPVQVKGFITKMEECMGACDCIITKAGPGTIAEAMIRGLPIILNGYIAGQEAGNVPYVVENGCGKFSKSPKEISKIVADWFGPASKELEIMSQNALRLAKPEAVFKIVHDMHELVLFLSVVREAEEMLYIIGLGLGDEKDITLRGLEAVKKSQKVYMEAYTSLLSFGLSADGLSNLEKFYGKPIILADREMVEEKAGDMIDEAIDNDVAFLVVGDPFGATTHSDLVVRAKTLGVKVEVVHNASVMNAVGICGLQLYHYGETVSIPFFTETWRPDSFYEKIKKNRSLGLHTLCLLDIRVKEPTFESLCRGGKKQYEPPRYMSVNTAIEQLLEVEQKHGDSVYGEDTQCVGFARLGSEDQTIVAGTMKQLESVDFGAPLHCLVIVGETHPVEEEMLEFYKYKSGN

SEQ ID NO: 54919 - protein, 338 aa, Xanthomonas campestris pv. campestris str. ATCC 33913
MSASSPMEAVAFPRPETFVAADVGGTHVRLALACESNDPRKPVTVLDYRKYRCADYPGLAEIMAAFFAELSCAPVRRGVIASAGYALEDGRVITANLPWVLAPEQIRQQLGMQALHLVNDFEAVAYAANYMTGNQVMQLSGPAQGAPGPALVLGPGTGLGAALWIPNGGNSVVLPTEAGHAALAAASDLEVALLQELRRTRTHVATEHFLSGPGLLTLYTALATLRDAPAVHATPAAVTAAALAGDDVLAHEALQTFCGFMGSVVGDMMLLYGVRSGVYLAGGFLPQIADFIARSDFAARLLDKGPLRPALEQVPVRIVEHGQLGVIGAASWFLQHGR

SEQ ID NO: 54920 - protein, 664 aa, Thermosynechococcus elongatus BP-1
MPAVTQSLDELCINAIRFLAIDAVQKANSGHPGLPMGAAPMAYVLWNQFMRFNPKNPQWFNRDRFVLSAGHGCMLQYALLYLTGYDSVTIEDIKQFRQWGSHTPGHPENFETPGVEVTTGPLGQGICNAVGLAVAEAHLAARFNKPDIKLVDHYTYVILGDGCNMEGVSGEACSLAGHWGLGKLIALYDDNHISIDGSTDIAFTEDVCKRFEAYGWHVQHVADGNTDLAGIAKAIEAAKAVTDKPSLIKVTTTIGYGSPNKANTAGVHGAPLGPEEVKLTRENLGWNYEPFVVPEEVLNHFRKAIERGASYEAQWNQTLATYRQKYPEEAAEFERLLRGELPANWDANLPSYTPEDKAVATRKHSEICLNAIAPNLPELIGGSADLTHSNLTELKCSGDFQKGQYQNRNIRFGVREHGMAAICNGIALHNSGLIPYCATFLVFADYLRPALRLSALSQAGVIYVMTHDSIALGEDGPTHQPVETLASLRAIPNLLVIRPADGNETSGAYQVAVQRRKQPTLLALTRQNVPNLAGSSAANVAKGAYTLVDCEGTPDLILIGTGSEVALCVKAAETLTANGKKVRVVSMPSWELFEEQSPEYKASVLPAGVKRLAVEAAASFGWCRYADATVAIERFGASAPGNVLMEKFGFTVDNVVAKANALLG

SEQ ID NO: 54921 - protein, 139 aa, Prochlorococcus marinus subsp. marinus str. CCMP1375
MDSVNESLFDSAMSRYKSGADASEVIKDFVSITNAAPNQSSGWTCLSWLQLLCDQQYEALKSARIAVKLNAQDPQSRINLSVALLETNSKGVREHIEFVKRALLLVPELQEELKESIEDGLNRKPNWDALKKIQVWLDL

SEQ ID NO: 54922 - protein, 462 aa, Oryza sativa (japonica cultivar-group)
GTGHLMSLLDAGKRLLGCRGGGGLSLTVLVMQPPRKEYASAVAATVRREEASGLDIRFRHLPAVEPPTGCAGVEEFVSRFVQLHADHVRAAVSGLDCPVAGLVIDFFCTTLLDVARELAVPAYVYFTSNAACLALLLRLPALEGEVTVEFEEMDGEVDIPGLPPVPPSSLPMPVMDKKNPNYTWFVYHGRRFMEANGIIVNTVREIERSVLAAIADGRVTPGVRAPVIHPVGPVISFTPPSDDPPHECVRWLDAQPPASVVFLCFGSMGSLAPPQVLEVAHGLERSGHRFLWVLRGAPAAGGSMNPTDADLDELLPEGFLERTTGRALVWPTWAPQKEILAHAAVGGFVTHGGWNSTLESLWFGVPMVPWPLYAEQHLNAFTLVAAMGVAVAMKVDRKRNNFVEASEVERAVRSLMGGSEEGRKAREKAAEMKAVCRKAVEEGGSSDMAVHKLYEELSTQTA

SEQ ID NO: 54923 - protein, 406 aa, Zea mays
MEAARQQQEECPCGGAEAADQFERLHDAVLLDVLNRIGDVKALGRCALVSRRFHALVPLVDSVFVRVDCVIPDDPPPSSSSSSSSSSAAPGTPPRQAPAPTARGRGALAHIVRVLLGGIARPIHALGQILSPAAAAVSRRSEALPASPRAPVADVSHHSPSEVLRSFKELRRLHIELPTGELGIDDGVLLKWKADFGSTLVSCVILGASSISSKPPTGYTQAESETATAATPDTSRETEEPGSLPDSLYTNGGLKLRVVWTISSLIAASARHYLLQPIIWNHELLESLDLTDADGQGVLTMDKRQLQELRVRPVFPSGSSHRTLMPALSMRLHYAPLIELPGGTLLKGATLVAIKPSEDALREGQGAGAAGPVGTCWISEAFEEPYRTAAKVLLKRRAYCLEMNSF

SEQ ID NO: 54924 - protein, 81 aa, Zea mays
  misc_feature (10)..(10): Xaa can be any naturally occurring amino acid
  misc_feature (39)..(39): Xaa can be any naturally occurring amino acid
  unsure (1)..(81): unsure at all Xaa locations
KAKRFEIKKXNAVSLWAWDIVVDNCAICRNHIMDLASSXQANQASATSEECTVAWGICNHAFHFHCISRWLKTRQVCPLGR

SEQ ID NO: 54925 - protein, 135 aa, Chlamydomonas reinhardtii
MARTKQTARKSTGGKAPRKQLATKAARKTPATGGVKKPHRYRPGTVALREIRKYQKSTELVIRKLPFQRLVREIAQDFKTDLRFQSQAVLALQEAAEAYLVGLFEDTNLCAIHAKRVTIMPKDIQLARRIRGERA

SEQ ID NO: 54926 - protein, 490 aa, Debaryomyces hansenii
MAPLQAIRKYDYLVIGGGSGGVASARRAASYGAKVLLIELKFNKMGGTCVNVGCVPKKVMWYAGDLAEKRHHLKSYGLSTTDDKVKYGDFDWSTFKDKRDAYVKRLNGIYERNLKNEGVDYIYGFAHFANSNGDVEVTLTGDQELSFLEEGKEFKKDEKLVFAGSKTLIATGGYAINPPNVEGHELGTTSDGFFELQKQPKSVAVVGAGYIGVELSGIFKALGSETHLVIRGDTVLRSFDESIQNSITDYYTDKLGVNIIKQSGSVSKVEKIDGDRKKITLGNGQVLEVDELIWTMGRKSLINIGLDKVGVTLNDKQQVDVDQFQQTANPNIFSLGDVIGKVELTPVAIAAGRRLSNRLFSGDKAFENDHLDYSNVPSVIFSHPEAGSIGLSCKEAKEKYGEDQIKIYKSKFNAMYYAMMEDDSLKSPTSYKVVCAGEDEKVVGLHIVGDSSAEILQGFGVAIKMGATKKDFDSCVAIHPTSAEELVTMK

SEQ ID NO: 54927 - protein, 227 aa, Haemophilus influenzae R2846
MELVFIRHGFSEWNAKNLFTGWRDVNLTERGVEEAKAAGKKLLDKGYEFDIAFTSVLTRAIKTCNIVLEESHQLWIPQVKNWRLNERHYGALQGLDKKATAEQYGDEQVHIWRRSYDISPPDLDPQDPNSAHNDRRYANIPSDVVPNAENLKLTLERALPFWEDQIAPAMLSGKRVLVVAHGNSLRALAKHIIGISDAEIMDFEIPTGQPLVLKLDDKLNYVEHYYL

SEQ ID NO: 54928 - protein, 529 aa, Cryptococcus neoformans var. neoformans JEC21
MPLPKLAVILGAFASFSGFLFGYDTGYISGCKEMETFVRTFGLLQPDGTYVLSSGRDSLITSILSVGTCLGALCGSMVGDRIGRRFGIVFYICLFFIGVALQTGCKNLAGFAIGRVFAGLGVGGTSCLVPIYQAECSPKAIRGFVVAAYQFFVTVGLLVAACVVYATKGRPDNSAYEIPIAIQFVWGALIIGGMCILPESPRWLLLKDKQDQAKKNLSRLLGQAENSQAVITEFAEISANLEHERSLGKGTWMDCFKYGESKTRLRIFTGMALQALQQLTGVNFIFYYGTTFFSNSGISNPFLTTIATNVVNVGMSVPGMLAADRIGRRPLMMYGAAGMAVSQLIVAAVGVAVDTSNQAGQKALVAFVCIYIAHFASTWGILAWVITSEIYPYELRGKGMSLSTATQWLFNFAIGYATPYLVDVAPGSAGLKTNVFWIWGGCCCIAFVFAYFFIPETKELSLEQCDLLYRNSTVLKSAAYRRQILEHDMHDDEIAHYDSNKMPRTEHVEDSKAVEDVKAQQSQLDEWDA

SEQ ID NO: 54929 - protein, 446 aa, unidentified prokaryotic organism
MEYAVSVESFLSSLQRHNPHQPEYLQAVREVFTSLWPFIERNPAYREQALLERLVEPERIIQFRVSWVDDRGQVQVNRAFRVQFNSAIGPYKGGMRFHPSVNLSILKFLGFEQTFKNALTTLPMGGGKGGSDFDPKGKSQGRIMRFCQALMTELYRHLGPDTDVPAGDIGDGGREVGFMAGMMKKLSNNTACVFTGKGLSFGGSLIRPEATGYGLVYFTDAMLQRHGLGFEGMRVAVSGSGNVAQYTIEKALELDARVITVSDSGGTLVDEDGFTTEKLAHLAEIKNQRYGRVADYAAERGLTYLAGQQPWNVPVDIALPCATQNELDLEAARVIRNGVKAVAEGANMPTTIQATDAFLDAGVLFAPGKAANAAGLATSGLEMAQNAARIGWRAEKVDVRLQHIMADIHHACVEYGGEGKQTHYVHGANIAGFVKVAEAMLAQGVL

SEQ ID NO: 54930 - protein, 344 aa, Hyoscyamus niger
MATFVSNWSTKSVSESFIAPLQKRAEKDVPIGNDVPIIDLQQHHHLLVQQITKACQDFGLFQVINHGFPEELMLETMEVCKEFFALPAEEKEKFKPKGEAAKFELPLEQKAKLYVEGEQLSNEEFLYWKDTLAHGCHPLDQDLVNSWPEKPAKYREVVAKYSVEVRKLTMRMLDYICEGLGLKLGYFDNELSQIQMMLTNYYPPCPDPSSTLGSGGHYDGNLITLLQQDLPGLQQLIVKDATWIAVQPIPTAFVVNLGLTLKVITNEKFEGSIHRVVTDPTRDRVSIATLIGPDYSCTIEPAKELLNQDNPPLYKPYSYSEFADIYLSDKSDYDSGVKPYKINV

SEQ ID NO: 54931 - protein, 1155 aa, Cryptococcus neoformans var. neoformans JEC21
MLRSLPRARAALPLRSRPLAPFSRSPLLSRNYAVAAPAVGSYAQVDGEPTLNSPSELARKISAKVLPKLEKPDVKKVLVVGSGGLSIGQAGEFDYSGSQAIKALRESNIETILINPNIATIQTSHHLASEIYFLPVTADYVAYVLEKERPDGILLTFGGQSALNVGIQLDKMGVLERLGVKVLGTPIRTLEVSEDRDLFVQALNEIEIPAAQSTAVSTIQAALDAAKEIGYPIILRSAFSLGGLGSGFAHDEEELRNLAAKSLSLSPQVLIEKSLKGWKEVEYEVVRDAADNTIICCNMENFDPLGTHTGDSIVVAPSQTLTDDEYHMLRSAAIKIVRHVGVVGECNVQYALDPVSRDYRVIEMNARLSRSSALASKATGYPLAYTAAKIALGHTLPELPNAVTKTTTACFEPSLDYIVTKIPKWDLAKFQHVERNVGSAMKSVGEVMAIGRTFEESLQKAIRQVDPNFTGFDAYWKPEDMTAALTHNNDRRLFAIAHAMLNLDYTVDHLHDLTKIDKWFLYKLENIVNVYKTLQSTPFDKIDRELFLTAKKTGFSDLHISQLVGAKEGEVRAARKAAGVTPFVKRIDTLAAEFPAYTNYLYTTYNASTHDLEFNENGTMVLGSGVYRIGSSVEFDWCAVTCSRAIRSMGKKTIMINYNPETVSTDFDEADRLYFEELGWERVMDIYELEGADGVVVSVGGQLPQNIALRLKKTGVNVLGTDPEQIDNAEDRHKFSSILDSIGVDQPAWTEATSLQAAKEFANKVNYPVLIRPSYVLSGAAMNVVWDERQLEEKLTAAADVSPLHPVVVSQFIDNAQEIDIDAVAHEGKLLVHAVSEHVENAGVHSGDATLVLPPFSLKERDMDRLREIAEKVAKAFNISGPYNMQIIRKPEEEGKEAELKVIECNLRASRSFPFVSKVLGKNFIDVAAAAIMGENIPEPVDLMKEQRDYVAIKVPQFSWTRLPGADPFLGVEMASTGEVASFGKDIHEAYWAALLSVNGFKLPKANSGILLGGDISRVELPEIASNLISLGFKLYTYDANVEEFINKQPYLAIKKILVPVKDKRKLREVLEENEISCVINVSRSRAATTADADYASRRAAVDFGIPLINNAKLAVLFTETLQQKFKNSPLPYVEGQQPSEVKSWREFVGEERAY

SEQ ID NO: 54932 - protein, 131 aa, Oryza sativa (japonica cultivar-group)
MAGKASIALFLAVNLVVFSLGSACGGHCPTPTPPTPSTPTPTPAAFGKCPRDALKLGVCANVLGLIKAKVGVPPAEPCCPLLEGLVDLEAAVCLCTAIKGNILGINLNLPVDLSLILNYCGKRVPTGFKCF

SEQ ID NO: 54933 - protein, 1065 aa, Bacillus caldolyticus
MPKRRDIETILVIGSGPIVIGQAAEFDYAGTQACLALKEEGYKVILVNSNPATIMTDTEIADKVYMEPLTLDFVARIIRKERPDAILPTLGGQTGLNLAVELAKAGVLEECGVEILGTKLEAIEKAEDREQFRALMNELGEPVPESAIIHSLEEAYAFVEQIGYPVIVRPAFTLGGTGGGICTNEEELVEIVSTGLKLSPVHQCLLERSIAGYKEIEYEVMRDANDNAIVVCNMENIDPVGIHTGDSIVVAPSQTLSDREYQLLRNASLKIIRALGIEGGCNVQLALDPDSFRYYVIEVNPRVSRSSALASKATGYPIAKLAAKIAVGLTLDEMINPVTGKTYACFEPALDYVVTKIPRFPFDKFESANRRLGTQMKATGEVMAIGRTFEESLLKAVRSLEIGVHHLELNEAKTAADDVMEKRIRKAGDERLFYIAEALRRGVTVETLHEWSQIDRFFLHKIQNIIEMETVLKNHPGDLDVLKKAKGLGFSDAAIAALWNKTERDIYAVRRQRGIMPVYKMVDTCAAEFTSETPYYYSTYEEENESIVTEKPSVIVLGSGPIRIGQGIEFDYATVHCVWAIKQAGYEAIIINNNPETVSTDFSTSDKLYFEPLTAEDVMHVIDLEQPIGVIVQFGGQTAINLAAELEARGVRLLGTTLEDLDRAEDRDKFEQALSELGIPKPAGKTAVSVEEAVAIAEEIGYPVLVRPSYVLGGRAMEIVYNRGELLHYMEHAVRVNPQHPVLVDRYITGKEVEVDAIADGETVVIPGIMEHIERAGVHSGDSIAVYPPQTLSAEVIDKIADYTIRLARGLHIVGLLNIQFVVSGSDVYVLEVNPRSSRTVPFLSKITGVPMANLATKAILGTKLAEMGYETGVCPVRPGVYVKVPVFSFAKLRNVDISLGPEMKSTGEVIGKDVTFEKALYKGLVASGIHIQPHGAVLLTVADKDKEEAVELARRFADIGYQLLATNGTAETLKAAGIPVTVVNKIHSASPNILDVIRQGKAQVVINTLTKGKQPESDGFRIRREAVENGIPCLTSLDTARAMLQVLESMTFSTTAMTEGLVRS

SEQ ID NO: 54934 - protein, 1176 aa, Trichosporon cutaneum
MLRSISIASRAAGPVRPVARARTAVGVVAPPRVCCCAPAVGNYGQVDGKATLNSLRRLPAGYRPRSCPSSRSPDVKKVLVVGSGGLSIGQAGEFDYSGSQAIKALRESNIETILINPNIATIQTSHHLASEIYFLPVTADYVAYVLEKERPDGILLTFGGQSALNVGIQLEKMGVLERLGVQVLGTPIRTLEISEDRDLFVQALNEIDIPAAQSTAVSTIQDALDAAKTIGYPIILRSAFSLGGLGSFPHDEEELRNLAAKSLSLSPQVLIEKSLKGWKEVEYEVVRDAADNTIICCNMENFDPLGTHTGDSIVVAPSQTLTDEYHMLRSAAIKIVRHVGVVGECNVQYALDPNSRDYRVIEMNARLSRSSALASKATGYPLAYTAAKIALGHTLRELPNAVTKSTTACFEPSLDYIVTKIPKWDLAKFQHVERNVGSAMKSVGEVMAIGRTFEESLQKAIRQVDPNFAGFEAYWKPEDMITALTNNNDRRLFAIAHAMLNLDYSVDYLHDLTKIDKWFLYKLENIVAVHKQLRSTPFEQLDKELVMTAKKTGFSDLQIAQLTGKTEAEVRTLRKQFGVTPFVKRIDTLAAEFPAYTNYLYTSYNATTHDVKFDNGTMVLGSGVYRIGSSVEFDWCAVTCSRAIRDLGKKTIMINYNPETVSTDFDEADRLYFEELGFERVMDIYDLEGASGVVVSVGGQLPQNIALRLKKAGVQVLGTDPEMIDSAEDRHKFSSILDSIGVDQPAWTEASSLASAKEFANRVGYPVLIRPSYVLSGAAMNVVWDEAQLEHNLTLATNVSPDHPVVISQFIDNAQEIDVDAVAHKGKLLVHAVSEHVENAGVHSGDATLVLPPFSVNQHDLGRLKTIAEKVAQAFQISGPFNMQIIRKPPTGEEDAELKVIECNLRASRSFPFVSKVLGHNFIDTASAAIMDTNVPAPIDLMAQKRDYVAIKVPQFSWTRLPGADPFLGVEMASTGEVASFGKDIYDAYWAALLSVNGMKLPKANSGILLGGDITRPEMTEVAKNLINLGFSLYTYDPKVEAHINDQPYLSIKKILVPVKDKKKLREILEEHEIQTVINMARSRAATTLDEDYAARRAAVDFGIPLINNPKLAVLFTETLEKKFVKNNPIPYSEGFKPSEVGSWRDFVGEAATTKLEGIAWTGEAYCIILIPGIGV

SEQ ID NO: 54935 - protein, 487 aa, Arabidopsis thaliana
MMSTTVRLNRFTYLTSTAKLTRYFCSHHLVDRSETALHEVIRIVSSPVGGLDDLEENLNQVSVSPSSNLVTQVIESCKNETSPRRLLRFFSWSCKSLGSSLHDKEFNYVLRVLAEKKDHTAMQILLSDLRKENRAMDKQTFSIVAETLVKIGKEEDAIGIFKILDKFSCPQDGFTVTAIISALCSRGHVKRALGVMHHHKDVISGNELSVYRSLLFGWSVQRNVKEARRVIQDMKSAGITPDLFCFNSLLTCLCERNVNRNPSGLVPEALNIMLEMRSYKIQPTSMSYNILLSCLGRTRRVRESCQILEQMKRSGCDPDTGSYYFVVRVLYLTGRFGKGNQIVDEMIERGFRPERKFYYDLIGVLCGVERVNFALQLFEKMKRSSVGGYGQVYDLLIPKLCKGGNFEKGRELWEEALSIDVTLSCSISLLDPSVTEVFKPMKMKEEAAMVDRRALNLKIHARMNKTKPKLKLKPKRRSKTKKKNLQH

SEQ ID NO: 54936 - protein, 219 aa, Festuca arundinacea
MDIFRSYYSDPLAECSSISDSSSSSCNRANLSDEEVILASNNPKKRAGRKKFRETRHPVYRGVRKRNSDKWVCEVREPNKKSRIWLGTFPSAEMAARAHDVAAIALKGRSACLNFADSAWKLPIPASTDAKDIQKAAAEAAEAFRSSEAENMPEYSGEDTKEVNSTPENMFYMDEEALFCMPGLLANMAEGLMLPPPQCSQIGDHMEDDFDMPLWSYSI

SEQ ID NO: 54937 - protein, 439 aa, Bacillus cereus E33L
MAVENITMPQLGESVTEGTISKWLVNVGDHVNKYDPLAEVMTDKVNAEVPSSFTGIVKELIAGEGDTLAVGEVVCVIQVEGADEVAATAVEEKTKEEPKAEVATPEKAPKAKQPTDGKPRFSPAVLKLAGEHNVDLDLVEGTGANGRITRKDILKLVESGNIPQAGAAKNEEAVAAVVEARPEAPKAAPVAQKVEAAKPVSVPTMPGDIEIPVTGVRKAIAANMLRSKHEAPHAWMMIEVDVTNLVSYRNSIKGDFKKREGFNLTFFAFFVKAVAQALKEYPQINSMWAGDKIVQKKDINLSIAVATEDELFVPVIKHADEKTIKGIAREITELAGKVRTKSLKADEMQGGTFTINNTGSFGSVQSMGIINYPQAAILQVESIVKRPVIMENGMFGARDMVNLCLSLDHRVLDGLICGKFLGRVKEILENTSENNTSVY

SEQ ID NO: 54938 - protein, 101 aa, Arabidopsis thaliana
LWIEGHSNSFMLSSATMVLSPAETTTGAPLIGVRASAGFPANGKSSCNMDFRLEERGRETCVLVRAPIVNTQDETLGYIPDLSDDEWQCGADCLIRPRCCP

SEQ ID NO: 54939 - protein, 376 aa, Triticum aestivum
  misc_feature (198)..(198): Xaa can be any naturally occurring amino acid
  unsure (1)..(376): unsure at all Xaa locations
LRRQASSVSSSLGSRQACELESKRPETMDLVNGALNWAAMPAMVASLLLFYPPYYLFKLCYSFLSYLFPDDLKRKVVLITGASSGIGEQLAYQYATKGACLALLARREWSLRQVADRAFELGAPDVIILPGDVADPDDCNRFVQATIDHYGRLDHLVCNAGIASVGAFQEIPDVTNYSPQLDVNFWGAVQSTFAALPXFKRTRGRIVVTASATGWNPVPRMVFYNAANAALINFFETLRSELGSEVGITIVTPGWIESEMSKGKFLKEHGGVEVDQEYRDAQIGLFPVEYAKNCARAMVQAARQGDRYLTVPSWFGTMYLWRVFAPEVVEFCYRLLYMHGHGGGDQTDAPSKTMAQGGGKQMLYPSSLRSSDVKND

SEQ ID NO: 54940 - protein, 479 aa, Dunaliella salina
MATVQEYIDKHQLQKKTEDVLNIAVKSKPDEPLSFLAKELLRMAPSEILKVVGRQIIDSRGNPTVEADVHTHKGMFRAAVPSGASTGIHEAVELRDGDKTKFLGKGVQKAVESINTIISPALKGMDPKNQSEVDQKMIDLDGTPNKAKLGANAILAVSLATAKAGAAEKEVPLYRHIADLAGNPKLYLPVPAFNIINGGSHAGNALAMQEFMILPTGASSFSEAMRMGTEVYHTLKGIIKAKYGQDATNVGDEGGFAPNIQSNDDGLSLVTDAIEKAGYTGKVKIGMDVAASEFITEDKMYDLNLKQQPNDGSHKKTAAQMLEMYKEFCTKYPVISIEDPFEQDDWEPAKSLTAENICQVVGDDMLVTNPIRVKRGIEQKAVNSLLLKVNQIGSLTESIEAVRMSKEAGWGVMTSHRSGETEDCFIADLAVGLSTGQIKTGAPCRSERNAKYNQLLRIEEELGENAVYAGEKWRFIEWQ

SEQ ID NO: 54941 - protein, 327 aa, Mesostigma viride
MTVRFLFEALNMAIDEEMARNDKVALLGEDIGHYGGSYKVTQNLYAKYGEHRVIDTPIAENSFVGAAIGAAMTGLVTVVEGMNMGFILLAFSQISNNMGMLSATSGGHYHIPIVLRGPGGVGKQLGAEHSQRLECYFQSVPGLQIVACSTPYNAKGLLKSAIRSKNPIFFLEHVLLYNLKAEVPDNDYVLPLEKAEIVRQGNDITILTYSRMRYNVIQAVKVLVEKGYDPEIIDLISLKPFDIETIGKSIQKTHKVLIVEESMMTGGISNVLQSLILENFFDDLDNRPMCLSSPNVPTPYSGPLEEVSIVQTADIIESVEQILTNKM

SEQ ID NO: 54942 - protein, 585 aa, Oryza sativa (japonica cultivar-group)
MPPSPPPLLLLLAVLLAAAPAAAQSATPREDDVRCLKEESRIIGLSLSGFGLQGGIPSALQFCSAATTLDLSNNALVGVIPPALCDWIPFVVNLDLSGNQLSGQLPSELANCRFLNSLKLSGNSFSGQIPDSLGRLDRLKSLDLSDNRLDGQIPPQLATFGKDSFAGNKGLCGRPVSSRCGRALSGAGLGIVIAAGVFGAAASLLLAFFFWRCTGKSKGGRRRRRGGSESGGGSAEDGSWWAERLRAAHNRLAPVSLFQKPIVKVKLADLMAATQDFSTSHIVVAGSSRAGTAYRAVLRDGSALTVKRLHSCPLSEKAFRAEMGRVGQLRHPNIVPLLGFCVVEDERLLVYKHMESGALSSVMKEPGEAPLDWATRLRIAVGAARGLAWLHHGFQVPQIHQNLSSSAVLLDEDYEARFTDVGLTRLVRMAPGEGGDTSPFLNGDFGEYGYVAPECASNPVATMKGDVYAFGVILLELVSGQEAATVTGDAAGEGFKGTLVDWVNQLKASGRIGDAVHKSLRGNGHDSEIDEFVKIAFACIMVHPRERFSMYRVYHSLKSIGQGRDVSEQFDEFPLAYNKDESDTM

SEQ ID NO: 54943 - protein, 199 aa, Solanum tuberosum
MGSVQDENKDEFKQSLTRGKLKPSSSSSFRLRSPSLNSIRLRRIFDVFDRNHDCLISVEELSQALNLLGLDADLSEIESMVKLHIKPENTGLRFEDFETLHRSLNDVFFGSKCEDKLGLNPDPAQDESDLKEAFDVFDENGDGFISAKELQVVLEKLGLPEGSEIDRVEMMISSVEQDHDGRVDFFEFKDMMRTVIVPS

SEQ ID NO: 54944 - protein, 566 aa, Magnaporthe grisea 70-15
MSTTDDISAGNVSTTPGSLLMSKLGIDDIIMPLISRVHGNPLIRTLILVNQSLGAYLPTALVTATSFAWVTYHLTRQFCSVVWHLTLEYITSKISVSSDDEIFEHVMAWLAAQPRTARSRRLIAETAFQSVWEDGTRQVDLATISENGIEYLNFSQQKSTTPIRYTPSSGPHIFSFQGKYFSIDRQQRSVMDNSNTGSEAVTIREKETFIISTFGLSPEPIKQFLAHARKHHHKDHGDKTLIMRPNSLPQRRFHDRAWREVAKRPVRPISTVVLDQEQKTAVLSDMNEYLQPKTECWYSNRGIPLRRGYLFHGPPGTGKTSLSFALAGVFGLEIYVISLIEPQLSDEDLSTLFNGLPRRCIVLLEDIDTAGMSRAEGEIRTETKTEGPSEWKVADLARALKVGRGHGDDQKGISMSGLLNVIDGVAAHEGRIFIMTTNKPEILDEALIRSGRVDLQVAFRNATQQQASELFQRLYSTEKSVKSSRCLSPLDATDKKDDLETSITDADELIEMAAEFGSKIVPDQMSPAEIQGFLLKRKTCPRKALRDVEAWVKTSLDHKASKTTSG

SEQ ID NO: 54945 - protein, 151 aa, uncultured Frankia sp.
SRDPRNTAKKAEAYLRGTGFADTAYFGPEAEFYIFDDVRYDYNPYGSLHAVDSIEAAWNTARKEEGGNLGYKPRFKGGYFPVPPTDHFTDLRSKMSRALIRAGITVEMQHHEVGTAGQAEIDIRYDTLLRTANNLMLYKYIIRSVALSRGK

SEQ ID NO: 54946 - protein, 379 aa, Oryza sativa
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 54947 - protein, 146 aa, uncultured Frankia sp.
SRDPRNTAKKAEAYLRGTGFADTAYFGPEAEFYIFDDVRYDYNPYGSLHAVDSIEAAWNTARKEEGGNLGYKPRFKGGYFPVPPTDHFTDLRSEMSRALIRAGITVEMQHHEVGTAGQAEIDIRYDTLLRTADNLMLYKYIIRNVA

SEQ ID NO: 54948 - protein, 402 aa, Nocardioides sp. JS614
MMVETEDPVVVLGGGMAGGRAAEFLAMRGRGTRVVLVSDEDHRPYQRPPLSKESTWDDPVREELFFRDEEFYASKGVQLALGTRVEGLLPDSDVLITNQGEKIAFSRLLIATGCRVRRLQVPGSDLRGVHYLRSIPDAKGLWDAVHGGGPVVVVGAGYVGCELAAVMAGLQVDVTVVEAGSEPLGISLGAEVGAWVRSFHERRGVKFVTGRTVVHMDGEDRVGSVRLDDGTRLPASTVVVGIGVVPDVEWLSGSGVEIGDGILVNERCETSRPGVFAAGDAVRWTHPQYGSIRLEHETNAQAQAVVAARNILGGSTEYNHLPYVWSDQYGDTLEYVGYTRGWNEAVVQTDETSFTAAYLTGGAVAAVAAYARPDVIALAKQVLSDGPVARELWRAAAKDLGV

SEQ ID NO: 54949 - protein, 879 aa, Listeria monocytogenes EGD-e
MRKFVYQFSEGSKEMKNLLGGKGANLAEMTNIGLPVPPGFIISTDACNDYTANNKHLSEAIFDEVKIHLAELEKQTGKIFGFAENPLLVSVRSGAPFSMPGMMDTVLNLGLNDQAAEGLANLTGDARSAYDSYRRFIQMFGDVVFEIPSYHFEQALSRIKKANDYRLDTELTATDLSELIDAYKLIFSQATGTDFPQDPLEQLRLAIIAVFDSWMNPRAVIYRRLHDIDASFGTAVNIQAMVFGNTGETSGTGITFTRNPSTGEKKVFGEFLLNAQGEDVVAGIRTPEPISALEERMPTVYKELLHTCELLENHYLDMQDIEFTIEKGKLYVLQTRSGKRTAKAAIQTAVDFVQEGKITRQEAIMRVETKQLHQLLHPTFDESALKNGQVIATGLPASPGAATGQIFFAAKEAVQATERGIPVILVRNETSPEDIEGMARSNAILTAHGGMTSHAAVVARGMGKCCIAGCAELTINEKEKTIILPTGDTLHEGDALSLDGSSGKVYLGEIALREAQIGGHFDELMAWADTEKRLMIRVNADTPPDFKKALLFGAEGIGLCRTEHMFFDEKRIHYVRQMILAESLSERESVLTTLKEMQKADFSELFRIADGRAVNIRLLDPPLHEFLPKTKQEIEQLASAMNRTVPQITKRINELSEANPMLGHRGCRLAITFPEIYRMQTEAIIESAVTLHDEGIDVHPEIMIPLIATKSELSYIKKEMKHAIHTIFDRERVMLPYDIGTMIEIPRACVTADEIAEEAEFFSFGTNDLTQLTYGFSRDDATKFLADYYEKDILSKDPFVSIDKNGVGALVEMAVTRGRMTSEHLKMGVCGEHGGDPESIQFFHQLGLTYVSCSPYRVPIARLAAAQAALAEKHLIPTI

SEQ ID NO: 54950 - protein, 258 aa, Thermosynechococcus elongatus BP-1
MTTVLITGATGGLGQAFAQAFADRQHHLILTGRSLDTLEALKTRLSQKVSVVCLPQDLSEPGAAGRLYEQIQSLGLAVDVLVNNAGFGDYGAFGDRDRQQLTAMLQVNITALVELTHLVLQEMRPRRQGTIINVSSIAAFQPLPYLAVYAASKAFVRHFSEALWAEVKPLGIRVLAVCPGPTATNFFERADMTRNPALIAQQDTPEQVVAETLAALQTDVATVIPGQPANRFLALAGRLVPRQWLVQQLEPRFRPPAQ

SEQ ID NO: 54951 - protein, 145 aa, uncultured Frankia sp.
SRDPRNTAKKAESYLRGTGFADTAYFGPEAEFYIFDDVRYDYNPYGSLHAVDSIEAAWNTARKEEGGNLGYKPRFKGGYFPVPPTDHFTDLRSEMSRALIRAGITVEMQHHEVGTAGQAEIDIRYDTLLRTADNLMLYKYIIRNV

SEQ ID NO: 54952 - protein, 349 aa, Arabidopsis thaliana
MVKGTKRKIAIETIQKRDSLRVTCTKRRKGLYSKASQLCLLSDAQIAILATPPSSESDVSFYSFGHSSVDAVVSAFLSGKRPVSAPKDNKETREDVGICLTRKNLGLGFWWNDESLVRSENPQEISEAIGSMWTLLSNLKELRADEACVNDHKDLKKNEKSDVHGTQDQTLIFQSASAVCCIPENLNDITQEPNQTLDIQSSSSAICCVPDKSPEIFNEITEEQDQILSICETFCVTDNNNNNNNNAALPEVNLYYNQDMAIDQLIDFNTPFESSIDDWFSDNTTHQETTSASILNDVGVDDQVSVDTNPFSYFQSLEDADLVFQRCLDGDNLRFSDCFNDFANTIAAV

SEQ ID NO: 54953 - protein, 272 aa, Streptomyces violaceoruber
MTTATATATATPGTAAKPVALVTGATSGIGLAIARRLAALGARTFLCARDEERLAQTVKELRGEGFDVDGTVCDVADPAQIRAYVAAAVQRYGTVDILVNNAGRSGGGATAEIADELWLDVITTNLTSVFLMTKEVLNAGGMLAKKRGRIINIASTGGKQGVVHAVPYSASKHGVVGLTKALGLELARTGITVNAVCPGFVETPMAERVREHYAGIWQVSEEETFDRITNRVPLGRYVETREVAAMVEYLVADDAAAVTAQALNVCGGLGNY

SEQ ID NO: 54954 - protein, 387 aa, Zea mays
MIPSVRLSPGPAAFSGSSLRSKLPSIPSISSLKPSKYVVSSLKPLYLAPLDGPRTAELKSRRQPLEFRCSASAADDKESKTQVVPVQSEGAQRLKISIYFATWWALNVIFNIYNKKVLNAFPYPWLTSTLSLACGSAMMLFSWATRLVEAPKTDLDFWKVLFPVAVAHTIGHVAATVSMSKVAVSFTHIIKSAEPAFSVLVSRFFLGETFPIPVYLSLLPIIGGCALAAVTELNFNMVGFMGAMISNLAFVFRNIFSKRGMKGKSVSGMNYYACLSIMSLVILTPFAIAMEGPQMWAAGWQKALAEVGPNVVWWIAAQSVFYHLYNQVSYMSLDQISPLTFSIGNTMKRISVIVSSIIIFHTPVRAVNALGAAIAILGTFLYSQAKA

SEQ ID NO: 54955 - protein, 249 aa, Coccidioides immitis RS
MARKFFVGGNFKMNGTQKSITDIITNLNSANLDPNTEVVISPPSLYLILSRSLADPKIGVASQNVFDKPMGAYTGELSVEQLQDCGISWTLVGHSERRVILKEDDDFAARKTKSAIDGGLSVILCVGETLEEREADKTVDVVTRQLGAVASRLSAQDWSKLVVAYEPVWAIGTGKVATTEQAQEVHAAVRKYIAESVSPSVAENLRIIYGGSVNEKNCKELAKQADVDGFLVGGASLKPAFVDIVNARL

SEQ ID NO: 54956 - protein, 355 aa, Xanthomonas campestris pv. campestris str. ATCC 33913
MPLSRLLTCLVASLAAYAVQAKSPMPPPSPIMLSEFIADQAPTPQAHASTLLETRDGTLLAAWFGGAHEGAADVGIWLAQRGPQHWQTPRRIADGAHAGVDGAALPAWNPVLFQSATGPVQLYYKLGPNPRDWWGLRITSSDNGAHWSPPQRLPNGILGPIKNKPVQLPSGRILAPSSGEDRGWRAHLEWSDDDGAHWQRGLPLNDAATIGAIQPSLLLHADGRLQALGRSQQNKLFSAFSDDGGLHWQPMQLLDVENPNSGTDAVMLHDGRALLVYNPGIAGKQWWDGRGTLAVAVSDDGVQWRRVLTLEDSPKDEFSYPAVIQTRDGLVHISYTWKRQRIKHVVIDPAKLKVR

SEQ ID NO: 54957 - protein, 299 aa, Arabidopsis thaliana
MVTKTEEIQLNQLENQVENGGGGVWEYLCLVRKLKVRRSEIVLKHGLSILNDSGKRSALGPDEWTLYEQVAIAAMDCQSLGVAQVLKKKFPESKRVGKLEALLLEAKGMWEEAEKAYTSLLEDNPLDQVIHKRKVAMAKAQGKSSLAIEHLNKYLEVFMADHDAWRELAEIYVSLQMYKQAAFCYEELILTQPTLPLYHLAYADVLYTIGGLENLIAARKYYAATIDLTGGKSTRALLGICLCGSAIAQISKGRNKEDKDMAAPELQSLAATALEREYKQKAPAKLNLLTSALRNLKIA

SEQ ID NO: 54958 - protein, 426 aa, Listeria monocytogenes EGD-e
MSNKVKSDIEIASKAEILPVTTIAEHLGLDADALELYGKYKAKLSYDTIHSLKDKEPGKLVLVTAINPTPAGEGKSTVTVGLGDALSKKDKKTVIALREPSLGPTMGIKGGATGGGYAQVIPMEDINLHFTGDFHAITAANNALSAFIDNHMQQGNDLEIDGRRIVWKRVVDLNDRALRKVVVGLGGPIQGVPREDGFDITVASEIMAIICLASDLKDLKKRLSEIVIGYNYKKEPITVGEMGYEGALTLLLKDALKPNLVQTLEHTPAIVHGGPFANIAHGCNSVSATSTALRLGDYVVTEAGFGADLGAEKFLDIKVPALGKAPDCVVIVATIRALKMHGGALKTELSEENVDALAKGFTNLQKHTESIQTFGIPYVVAINKFITDSDAEVAKLEALCEEHGIPFSLTEVWEKVAMAAWNSRIK

SEQ ID NO: 54959 - protein, 232 aa, Triticum aestivum
MVGMAVVGQWTLCVASPSPRVKSATCNSNSCPTTVNLRSELSAFRPQFRLFSRVSPTRRRRLCASSSADSGIFLPHLVASMEQVEETYIMVKPDGIQRGLVGEIISRFEKKGFKLIGLKMFQCPKELAQEHYKDLSAKSFFPSLIEYITSGPVVCMAWEGVGVVASVRKLIGKTDPLQAEPGTIRGDLAVQTGRNIVHGSDSPENGKREIALWFKEGELCGWDSALAKWLRE

SEQ ID NO: 54960 - protein, 245 aa, Bacillus thuringiensis serovar konkukian str. 97-27
MIFVQQFEEVRLILEKAKKITVLTGAGASTESGIPDFRSANGLYADANVEMYLSRGYYNRSPKEFWKHYKEIFQINTFHQYKPNRGHRFLAELEEQGKDITILTQNIDGLHQLGDSKHVIDLHGTLQTAHCPKCKTGYDLQYMIDHEVPRCQKCNFILNPDVVLYGDTLPQYQNAIKRLYETDVLIVMGTSLKVQPVASFPQIAKREVGATTILVNEELTGQEYNFDYVFQNKIGEFVEGLSSIK

SEQ ID NO: 54961 - protein, 467 aa, Leptospira interrogans serovar Copenhageni str. Fiocruz L1-130
MSAEFDVVVIGAGPGGYVCAIRCAQLGFKTAIIEKRKTLGGTCLNVGCIPSKALLDSSEEYHKTLHKLEVHGISVGKVDLDLNKLMNRKDQIVKEVTDGVDFLMNKNKIKRYEGFGKVLSAGKVEVAFNDGKKETLSAKHIVVATGSVPIDIPGLTVDGKNIITSDHAIDVRKLPKKMIIIGAGVIGLELGSVWGRLGTSVTVVEFLPGLISNVDRQMGSLLERSLTSQGMEFLFEHKVKGATTTKNGVKVQIEDSKGESKDLEADVVLVAVGRRPFLEGVGLEEVGVAFTQRKRIQVDAHFKTSVPGIYAIGDAIDGPMLAHKAEEEGVALAELLAGQSGHVNYNAVPYVIYTWPEMAWVGKGEEELKAAGIEYKVGKSLFRPNARSKAMNEAEGQVKILADKKTDKLLGAFVFGPRASDMVAELAVAMEFGASAEDIARSFHAHPTLSEVIKEAAMAVDKWAIHA

SEQ ID NO: 54962 - protein, 421 aa, Leptospira interrogans serovar Copenhageni str. Fiocruz L1-130
MSVEIKVPEMGESITEATIANWVKKEGESVKQDEILLELETDKATMEVPAPSSGVLQKIHKKAGETVKVKEIIGLIDSSATASSPSPSASAPTNSAQTTQTSGNGTINETLPPAVRKLIEDNGLNPASITGSGKNGQITKEDVLKAIETKATSSVSNASVNVGTPAAVKATLTLPEIPKAVPAARRTDLPRENVVPMTRLRKVIAERLVSAQHNAAILTTFNEVDMSAVMELRNRYKDKFKEAHNVSLGFMSFFTKAAIHALKTIPAINAEIRGSDIVYKNYYDIGVAVGGPKGLVVPVVRDADLLSFAGVEQEIIRLANRVKDGKIELAEMEGGTFTISNGGIYGSMMSTPILNPPQSGILGLHNIVKRAVVVNDQIVIRPMMYLALSYDHRIVDGKEAVTFLVKVKEAIEDPSRLLLEL

SEQ ID NO: 54963 - protein, 266 aa, Zea mays
SCPRRSLRRVFIGSFARSPSVRSPATSIHQECNGRADQSATTPLRRSPRLHVEDKSLGKSPLPPNRRETSANRKTKNAHRKYKNQESLKRNSASAALSPRKDISDVSNKKSDKHELKPNRCEVLTGKRKRGTERRLSSKKQRCQDPKLLPAVCQEIAPCNEPRKSTHRRIEKDPSIEEFEVKLKVANERLTNIDENINKLSGTEREEMGNFCGSDWTKEQDMALRKAYFSARPSPHFWKRVSKMVPGRSAEDCFNRIYNDLSTRLQ

SEQ ID NO: 54964 - protein, 174 aa, Wolbachia endosymbiont of Drosophila ananassae
IWKQRTVGISEISIKQALDWGFSGPMLRAAGLAWDLRKSQPYEIYDQLDFDIPIGQNGDCYDRYLVRMAEIRQSISLVKQCIEKMPEGQIKTEDRKISPPSRAEMKKSMEALIHHFKLYSEGYHVPEGEAYAVVEAPKGEFGVYIVSDGTNRPYRCRIRAPGFAHLHLFAKAVC

SEQ ID NO: 54965 - protein, 441 aa, Salmonella enterica subsp. enterica serovar Paratyphi A str.
MPQPGLTTPDNDALPWQTTLLLALQHVLVVAATPITSVFLIAKALHFTDTVTASVLSATFLMCGLGAILQSLGVKGVGARLPFIMVPGGAPIAIFVAIALQTNIQTAIGAVILTSLFYFIALPIFRRCLHHFPPFIIGIMLLMVSINLIRLYGGLIIGQPGSADFAHPTSIILSLGTILITLIFALAFSGILRQLAVMFGLLAGTLLGMALGSTDFSGVSHGPLFSFPQLLPFGWPIFDLSASLPLLIYAVISMAEATGQTIATAEIVNSTQNVQQAIPRTIRGDAVMSLLGGIFGTSLIITSGENIGVVRTTNVKSRFVTAAAGGLLILIAIFAPLVRLATCLPGSVVCGTAVIVFSIIGVIGIDMIAREPLHTPGKTYALAMGLAMGMLPILVPGLYQNFPAGVQMVFGNGMAAGTLTAILVNSLFNWSEKRTQARAKS

SEQ ID NO: 54966 - protein, 183 aa, Brassica napus
RKRQRTRGRTRGRTRGRTRGRTRGRTRGRIKVVSFSATMSKKIILKSSDGESFEVDQAVALESQTIKHMVEDDCVADGIPLPNVTSAILAKVIEYCKKHVDAAAEANAGDKDIYGNTEDTELKNWDTEFAKVDQPTLFDLILAANYLNITGLLDLTCKTVADMMVGKTPEQMREHFNIKNDYT

SEQ ID NO: 54967 - protein, 469 aa, Arabidopsis thaliana
MLPCLLVVLHRIYDYIVEILEISDLTFSFKGPWFAGMDTLLTVDPANIHHMMNSNFSNYIKGSDFKEVFDVFGDGIITTDSELWKNLRKSYQEMLHHQAFQSFSLSTTRSKLKDGLVPLLNHFAEEGTTVDLQDVLGRFTFDTILILITGSDPRSLSIEMHEDELAKALDVVGEGIFFRHVKPKFLWKLQNWMGFGHEKKMIEANATFDRVCAKYISDKRGEIIRSQRFSDISYGEPEDLLSSFMKLDTTKYNLLNPSDDKFLRDTILAFILAGRDTTASALTWFFWLLSENAQVVSKIRQEIINTNPSKNGNGQENLDKLVYLHGALCEAMRLYPPVSFGRKSPIKSDVLPSGHKVQANSKIIICLYALGRMRAVWGDDALEFKPERWVSDKGSLRHEPSFKFLSFNSGPRTCLGKHLAMTQMKMVAVEILHNYEIKVIKGQKIKPVLGFILSMKHGLRITITKRCPY

SEQ ID NO: 54968 - protein, 401 aa, Pisum sativum
MISSLRQPSISISGSDVVLRKRHATLIQLRPQSFSPFSSREKSQRSVVSTKKPLHLACLGVGNFGSVKNFESEASFGQSDLVKCGAYEADRSEVEGGDGTPSEAAKKVKIGIYFATWWALNVVFNIYNKKVLNAYPYPWLTSTLSLACGSLMMLISWATRIAEAPKTDLEFWKTLFPVAVAHTIGHVAATVSMSKVAVSFTHIIKSGEPAFSVLVSRFILGETFPVPVYLSLLPIIGGCALAAVTELNFNMIGFMGAMISNLAFVFRNIFSKKGMKGKSVSGMNYYACLSILSLAILTPFAIAVEGPAMWAAGWQTALSEIGPQFIWWVAAQSIFYHLYNQVSYMSLDEISPLTFSIGNTMKRISVIVSSIIIFHTPIQPVNALGAAIAVFGTFLYSQAKQ

SEQ ID NO: 54969 - protein, 565 aa, Arabidopsis thaliana
MGGFRGEQAREIAKALDRSSHRFLWSLRRASSNIFKESQKESMNIEEVLPFSQKQETGACLLPEIRRRTNMKFELVFIPYPGIGHLRSTVEMAKLLVDRETRLSISVIILPFISEGEVGASDYIAALSASSNNRLRYEVISAVDQPTIEMTTIEIHMKNQEPKVRSTVAKLLEDYSSKPDSPKIAGFVLDMFCTSMVDVANEFGFPSYMFYTSSAGILSVTYHVQMLCDENKYDVSENDYADSEAVLNFPSLSRPYPVKCLPHALAANMWLPVFVNQARKFREMKGILVNTVAELEPYVLKFLSSSDTPPVYPVGPLLHLENQRDDSKDEKRLEIIRWLDQQPPSSVVFLCFGSMGGFGEEQVREIAIALERSGHRFLWSLRRASPNIFKELPGEFTNLEEVLPEGFFDRTKDIGKVIGWAPQVAVLANPAIGGFVTHCGWNSTLESLWFGVPTAAWPLYAEQKFNAFLMVEELGLAVEIRKYWRGEHLAGLPTATVTAEEIEKAIMCLMEQDSDVRKRVKDMSEKCHVALMDGGSSRTALQKFIEEVAKNIVSLDKEFEHVALK

SEQ ID NO: 54970 - protein, 103 aa, Neisseria gonorrhoeae FA 1090
MASIHDQIKEVVTTHRVVLFMKGTKQFPQCGFSSRAVQILNAAGCTDYVAVNVLENPEVRQGIKEYSDWPTIPQLYVNGEFVGGSDILMEMYEAGELQELLKA

SEQ ID NO: 54971 - protein, 393 aa, Solanum tuberosum
YAFSTNFDPLQQNLWGSKPPISSLSIKDIDFKQCDKHNILSKKPLYISAVLSGFGHADESKEFKSRDPLVQCNAYEASQPQSIPIDIEFGQEAQAAATQKLKIGLYFATWWALNVVFNIYNKKVLNAFPFPWLTSTLSLAAGSLMMLVSWATKIAETPKTDFDFWKALFPVAVAHTIGHVAATVSMSKVAVSFTHIIKSGEPAFSVLVSRLLGETFPLPVYLSLLPIIGGCGLAAITELNFNLIGFMGAMISNLAFVFRNIFSKKGMKGKSVGGMNYYACLSMMSLLILIPFAIAVEGPQVWALGWQNAVSQIGPNFIWWVVAQSVFYHLYNQVSYMSLNEISPLTFSIGNTMKRISVIVSSIIIFQIPIQPINALGAAIAILGTFLYSQAKQ

SEQ ID NO: 54972 - protein, 423 aa, Corynebacterium glutamicum ATCC 13032
MENPSLRELDHRNIWHPYAAPGVRNRLVTKTDGVFLTLEDGSTVIDAMSSWWSAIHGHGHPRLKAAAQKQIDTMSHVMFGGLTHEPAIKLTHKLLNLTGNSFDHVFYSDSGSVSVEVAIKMALQASKGQGHPERTKLLTWRSGYHGDTFTAMSVCDPENGMHSLWKGTLPEQIFAPAPPVRGSSPQAISEYLRSMELLIDETVSAIIIEPIVQGAGGMRFHDVALIEGVATLCKKHDRFLIVDEIATGFGRTGELFATLSNGLQPDIMCVGKALTGGFMSFAATLCTDKVAQLISTPNGGGALMHGPTFMANPLACAVSHASLEIIETGMWQKQVKRIEAELIAGLSPLQHLPGVADVRVLGAIGVIEMEQNVNVEEATQAALDHGVWIRPFGRLLYVMPPYITTSEQCAQICTALHAAVKGK

SEQ ID NO: 54973 - protein, 508 aa, Arabidopsis thaliana
MASVSLLDVAIAIICLFFFYYMYFKKPHGQVFRNWPVIGMLPGFLMVLHRIYNFGVEALEMSHLTFLFKGPWFAEMDMLFTVDPANIHYILSSNFSNYTKGADFKEVFDVFGEMIFSSDSELWKNQRKAAQFMLNHQGFQKLSLSATRSKLYDGLVPLFNQCCEEEKVVDLQQVFQRFTFDTTFFIVTGFDPKSLSIEMPEVEYAKALDDLGEGIFYRHIKPKFFWKLQNRFGLGQEKRMTEADATFDRVSAKYILAKREEIRSQGIDHHANGESEDLLTSHIKLDTTKYELLNPSDDKFLRDTILAFNLAGRDTTSSALSWFFWLLSENPQVVTKIRKEIIDKNISKDGRNGQENLDKLVYLHAALYESMRLYPPVAFQRKSPIKPDVLPSGHKVEANSVIIIFLFALGRMRAVWGEDATEFKPERWVSESGGLRHAPSFKFLSFNAGPRTCPGKQLAMTLMKTVVVEILQNYDIDVIKGQKIEPEPGLMLHMKHGLRVTITKRCSA

SEQ ID NO: 54974 - protein, 160 aa, Glycine max
MDCKKRVRDDSDESILESPEAKRLRDDLLEFFDDADDAASTQDLDSVMKSLQEEISGVTSDYGESQAQIGYLLEASDDDLGLPPAGNSSAPQEKNVEAELVRVASDSSGIGELWEFEDQIPRYDSFDLGMGFGYECDATEYAAFGELFDHSDVYYDSWRQ

SEQ ID NO: 54975 - protein, 627 aa, Pseudomonas aeruginosa UCBPP-PA14
MSATQKNNITRLEQLDRQSTQPFPNSRKVYLTGSRPDIRVPVREISLADTPTAFGGEKNPPVFVYDTSGPYTDPEVRIDLRKGLPDVRSRWIDERGDTEILPGLTSEFGQARLADASLDALRFAHVRTPRRAKPGANVSQMHYAKKGIITPEMEYIAIRENMKLQEARAAGLLDQQHPGHSFGANTPKEITPEFVREEVARGRAIIPANINHTELEPMIIGRNFLVKINGNIGNSALGSSIEEEVEKLTWGIRWGADTVMDLSTGKHIHETREWILRNSPVPIGTVPIYQALEKVNGVAEDLTWEIFRDTLIEQAEQGVDYFTIHAGVLLRYVPLTAKRVTGIVSRGGSIMAKWCLAHHQENFLYTHFEEICEIMKAYDVSFSLGDGLRPGSVADANDAAQFGELETLGELTKIAWKHDVQVMIEGPGHVPMQLIKENMDKQLECCDEAPFYTLGPLTTDIAPGYDHITSGIGAAMIGWFGCAMLCYVTPKEHLGLPNKDDVKTGIITYKIAAHAADLAKGHPGAQIRDNALSKARFEFRWEDQFNLGLDPDTARAFHDETLPKDSAKVAHFCSMCGPKFCSMKITQEVRDYAKENGLSDESKAIEAGFQEQAARFKDEGSVIYRQV

SEQ ID NO: 54976 - protein, 401 aa, Oryza sativa (japonica cultivar-group)
MQRNGVMECSVCHSKVVAPSPRSVSRAYDKHRSKISSKYRALNFLLVSGDCILVGLQPILVFMSKVDGKFQFSPISVNFLTEVTKVILAIVMLIIQSRKQKVGEKPLLSLSTFVQAARNNALLAVPALLYAINNYLKFIMQLYFSPATVKMLSNLKVLVIAILLKFIMRRKFSIIQWEALALLLIGISVNQLSSIPDGTKSFGLAVTTIAYIYTLIFVTVPSLASVYNEYALKSQFDTSIYLQNLFLYGYGAIFNFLGILGTVIFQGPESFDILRGHSRATMFLICNNAAQGILSSFFFKYADTILKKYSSTVATIFTGLASAAFLGHTLTVNFLLGISIVFISMHQFFSPLAKVKDDKPAGALEPEDAQNHRSSDSSFVNMTAGAADDCLLDENVTLLQL

SEQ ID NO: 54977 - protein, 393 aa, Pseudomonas aeruginosa UCBPP-PA14
MRYSDFTQRIAGDGAAAWDIHYRALARVEQGEEILLLSVGDPDFDTPAPIVQSAIDSLLAGNTHYADVRGKRALRQRIAERHRQRSGQAVDAEQVVVLAGAQCALYAVVQCLLNPGDEVIVAEPMYVTYEAVFGACGARVVPVPVRSENGFRVQAEEVAALITPRTRAMALNSPHNPSGASLPRATWEALAELCTAHDLWMISDEVYSELLFDGEHVSPASLPGMAERTATLNSLSKSHAMTGWRVGWVVGPAALCAHLENLALCMLYGSPEFIQDAACTALEAPLPELEAMREAYRRRRDLVIECLADSPGLRPLRPDGGMFVMVDIRPTGLSAQAFADRLLDRHGVSVLAGEAFGPSAAGHIRLGLVLGAEPLREACRRIALCAAELLGQA

SEQ ID NO: 54978 - protein, 251 aa, Burkholderia mallei ATCC 23344
MSKQRIKRVIGNWKMHGRLSGNEALLDEVAQGAQAVPEHVGIGVCVPFPYLAQARARLHGGRVAWGAQDVSAHEQGAFTGEVAAGMVAEFGAAYAIVGHSERRAYHGESNEIVAAKAQRALAAGLTPVVCVGETLAEREAGATEQVVGVQLDAVLAVLSQDEAARIVVAYEPVWAIGTGRSATAEQAQQVHAFLRGRLAAKGAERVSLLYGGSVKADNAAELFGQPDIDGGLIGGASLKSGDFLAICRAAQ

SEQ ID NO: 54979 - protein, 470 aa, Pseudomonas aeruginosa UCBPP-PA14
MADGKERLQLTRALASRHIFMLSLGGVIGTGLFMGSGVTINQGGPAGAVLAYLVAGVLMYLVMVCLGELSVQMPVSGSFQAHATRFIGPATGFMIGWVYWMSWASTVGLEFTAAGMLMTRWFPEVPVWLWSGFFVVVLFSLNALATRAFGEAEYWFAGIKVAAILVFIVVGGLVIFGGIELKSGAPAPMFSNLVGERLFPNGLSAVFAVMMTVVYAFQGCEIMGVAAGETERPEKSIPRAVRNVVFRVLIFYVLAIVVLSAIIPWQQAGLVESPFVQVFDMVGIPYAADLMNFVILTAILSVGNSGLYASTRILWAMSRTGMAPRGLSKLSARGVPLYALLITLCFALLSLLTSVIAADTLFMVLMAVSGMSGTVTWIVIAYAQYRFRREHMASGGTVAELKYAAPLFPLVPLACIAVCCSLFVFLALDPTQRPSLYWGFGFIAACYLAYYVVRRRQPQGLGDPALGRAG

SEQ ID NO: 54980 - protein, 152 aa, Triticum aestivum
  misc_feature (100)..(100): Xaa can be any naturally occurring amino acid
  unsure (1)..(152): unsure at all Xaa locations
MASEQTFIMIKPDGVQRGLIGEVISRFEKKGFYLKGLKLQNVEKSFAEQHYADLSSKPFFAGLVEYIVSGPVVAMVWEGKSVVSTGRKIIGATNPLASEXPGTIRGDFAVDIGRNVIHGSDSVESARKEIALWFPEGIAEWRSSQHNWIYEA

SEQ ID NO: 54981 - protein, 435 aa, Listeria monocytogenes EGD-e
MLGKGKIAALGFQHVLAMYAGAVIVPLLIGGALGFNGEEMTYLVSIDIFMCGIATLLQLTVNRFFGIGLPVVLGCAVQAIAPIILIGQDMGIGAIYGSIIVSGLFVLLIAPFFSKVVRFFPPVVTGSVVTVIGLTLIPVAINNLAGGEGAKDFGSMYNLGLGFGTLLLIILVYRFGQGFSKAIAVLIGLVGGSLFAALYKGISLGPVSEASWFHMPKPFYFGTPTFEWPAIITMILIALVSMVESTGVYFALSDITERKLTQKDLTRGYRAEGLAIMLGGVFNTFPYTAYSQNVGLVQLSGIKTRKVIYAAAGFLIVLGLIPKIGAVTTIIPTPVLGGAMVAMFGMVVAQGIKMLGKVNFTSQENLLIIACAVGVGLGVTVVPDLFNAFPSFVRLFTSNGIVAGSVTAITLNIIFNMIPHRKDKKVADPEPQHAK

SEQ ID NO: 54982 - protein, 765 aa, Bacillus thuringiensis serovar konkukian str. 97-27
MIGDIILKKKYMKALVVATTLAIPFAAYSTPALAAIKIEANQSVAASDRTYDTEIKIYKDQTDEPSMVSQYIKDPKVAIVAGKKIVTVTMQDSDYFQYLRIEDRNQPGVFHDVKVLSEDKRKNGTKVIQFEIGEFEKKHNMQMHILIPAIGYDHKYQVQFEIKDPTVGDKETEKPDDNSNSGNTETDKPVDNQNMITDNKLRELVNKKVFNRKDVNTPITKEELLQVKNLFLNTNEILDYSALKYMPNLKSLTVANAKIKDPSFFANLKQLNHLALRGNEFSDVTPLVKMDHLDSLDLSNNKITNVAPLIEMKNVKSLYLSGNQIEDVTALAKMEQLDYLNLANNKITNVAPLSALKNVTYLTLAGNQIEDIKPLYSLPLTDLVLTRNKVKDLSGIEQMKQLEELWIGKNEIKDVTPLSKMTQLKQLHLPNNELKDITPLSSLVNLQKLDLEANYISDLTPASNLKKLVFLSFVANEIRDVRPVIELSKTAYINVQNQKVFLEETEVNKEVKVPIYEKDGKISTKIRLKDEGGTYSNDAVKWSTPGEKVYEFGVKDPFADTGIFFTGSVIQNVVESKADNTSKEDAKVEVVEFKDVPKGHWSEEAIHYLAKENIFKGYGNGQFGFGDSITRGQVASLVQRYLKLENKVEQKERFTDTKGHMFEQDIATVAQAGIMQGDGTGEFRPDGVLTRYEMSVVLYKVFQLKEDGNNKVNFKDVPTGHWAEGYVKALVDNNISKGDGKERFLGDDFVTREQYAQFLYNAITK

SEQ ID NO: 54983 - protein, 571 aa, Magnaporthe grisea 70-15
MADEKGTVGSGTLPTYGASPDASHQDMAMDGREENFYTRNGLNLESFKCRSYGQGIVELDRSMKKRHLHMIAIGGSIGAGFFVGSGAAFAKGGPGAVFIDFAIIGVMMFNVVYALGELAVMYPVSGGFYTYSVRFIDPSWGFAMGWNYVFQWAVVLPLELTVCGLTLNYWEGTQAVPLWGWILIWWFAIIIINIFGTLGYAEEEFWSSCLKLSAIVIFMIIAFVLVLGGGPKGGKYDSYWGARHWYEPGAFQNGFKGFCAVFVTAAFSFSGTELVGLAAAESANPAKALPGAIKQVFWRITLFYILGLFFVGLLVSSTDDRLLSSNPYADGTSPFVIAAKDAGLVGFDHFMNVIILVSVLSIGVSCVYGGSRTLTALAQQGYAPKVFTYVDKSGRPLASVFVIIACGALAFLNLDAGAEKVFSWLLSLSGLAALFTWGSICLAHIRFRQAWKAQGHTLDEIPFQAALGVTGSWIGLILCVLVLIATFYSALFPYNKPGVGTAESFFQEWLSVPVILFFWACGYIWKREGGLKLEQIDVDTGRREHDWDQINAYKAELAAMPSWKRFVKKIF

SEQ ID NO: 54984 - protein, 309 aa, Arabidopsis thaliana
MSSSAKKQTLFISTLIISWYSSNIGVLLLNKFLLSNYGFKFPIFLTMCHMSACAILSYISIVFLKLVPLQHLKSRSQFLKVATLSIVFCASVVGGNISLRYLPVSFNQAVGATTPFFTALFAYLMTFKREAWVTYGALVPVVAGVVIASGGEPGFHWFGFIMCISATAARAFKSVLQGILLSSEGEKLNSMNLMLYMSPVAVIALLPVTLFMEPDVISVTLTLAKQHQYMWILLLVNSVMAYSANLLNFLVTKHTSALTLQVLGNAKGAVAVVISILIFQNPVTVMGIGGYSITVLGVVAYGETKRRFR

SEQ ID NO: 54985 - protein, 348 aa, Nicotiana tabacum
GDVTTRQNWQIRGVVLPDVPEILKGLDEVGLTSLQSGMDNVRNPVGNPLAGIDPHEIVDTRPYTNLLSQYVTANFRGNPAVTNLPRKWNVCVIGSHDLYEHPHINDLAYMPASKDGRFGFNLLVGGFFSPKRCAEAVPLDAWVPADDVVPVCKAILEAYRDLGTRGNRQKTRMMWLVDELGVEGFRAEVVKRMPQQKLDRESTEDLVQKQWERREYLGVHPQKQEGYSFVGLHIPVGRVQADDMDELARLADNYGSGELRLTVEQNIIIPNVENSKIESLLNEPLLKNRFSTNPPILMKNLVACTGNQFCGQAIIETKARSMKITEEVQRLVSVTKPVRMHWTGCPNS

SEQ ID NO: 54986 - protein, 456 aa, Nicotiana tabacum
MMRLKLPNGVTTSAQTRYLASVIRKYGKEGCADITTRQNWQIRGVVLPDVPEILKGLAEVGLTSLQSGMDNVRNPVGNPLAGIDPEEIVDTRPYTNLLSQFITGNSRGNPAVSNLPRKWNPCVVGSHDLYEHPHINDLAYMPATKDGRFGFNLLVGGFFSAKRCDEAIPLDAWVPADDVVPVCKAILEAFRDLGFRGNRQKCRMMWLIDELGVEGFRAEVEKRMPQQQLERASPEDLVQKQWERRDYLGVHPQKQEGYSFIGLHIPVGRVQADDMDELARLADEYGSGEIRLTVEQNIIIPNIETSKIEALLKEPVLSTFSPDPPILMKGLVACTGNQFCGQAIIETKARSLKITEEVQRQVSLTKPVRMHWTGCPNTCAQVQVADIGFMGCLTRDKNGKTVEGADVFLGGRIGSDSHLGEVYKKAVPCDDLVPLVVDLLVNNFGAVPREREETED

SEQ ID NO: 54987 - protein, 296 aa, Bradyrhizobium japonicum
MAAKTKFRGSFTALVTPFKNGSLDEAAFRSLVNWQISEGTNGLVPVGTTGESPTLSHDEHKKVVEWCIEEAKGRVPVVAGAGSNSTKEAIELAQHAEKAGADAVLVVTPYYNKPTQEGMYQHFKAINDAIGIPIIIYNIPPRSVIDMSVDTMKRLWELKNIAGVKDATASMVRVSQQRAAMGEDFNQLSGEDATILGYMAHGGHGCISVTSNVAPRLCSEFHTAWQKGDHATALKLHDKLMPLHNNLFIESNPAPIKYAMSLLGKLDETLRLPMVPVTEPTRVAVRSAMVHAGLIN

SEQ ID NO: 54988 - protein, 543 aa, Ralstonia solanacearum GMI1000
MEKHVQRNLGAWPLMLTGLGSIIGSGWLFGAGHAAKVAGPAAIFTWVIGAVVILAIALTYAELGAMFPESGGMVRYARYSHGSLVGFVAAWANWIAIVTVIPIEAEASIQYMSSWPWPWAQGLFQHGELTPLGLALSAVLVIIYFLLNYWGVKVFAKANTTITVFKFVIPGLTAVALIGAGFHPSNFGGTDAASFAPYGWSSVLTAIATCGIVFSFNGFQSPINLAGEARNPGRNVPLAVIGSIVLAAIIYVALQIAFLGAVPAESLVKGWHGIDFHSPFAQLAIALNLNWLAIVLYLDAFVSPSGTGSTYMATTTRMIYAMERNNTMPAMFGRVHPIFGVSRSAMWFNLAVSFIFLFFFRGWGALAAVISVATVISYLTGPTSVMSLRKSSPGLHRPLRLPGLSLIAPFAFVCASLILYWAKWPLTGEIIVLMLVALPVYFYYQAKAGWPDFKRELKGAWWMIGYLPAIAALSYFGSTEFGGLGLLPYGWDMVIVSAVSLFFYYWGVASGWHTRYLDEVEYVHEDAVAPAGERVPGGVPQGV

SEQ ID NO: 54989 - protein, 1273 aa, Azoarcus sp. EbN1
MREAVQPCKNLVHPSHARRARSRAQVTAGCVRERQPQSPIALSGVLLAMKPEIPDPATAALPAAARSELRRRIDTAWRTPEPECVPPLIRAARIDAALQARIRAQARELVAGLRATRTHSSGVDALMKEFSLSSQEGVALMCLAEALLRVPDSATADRLIRDKLAHRDWHAHLGHSPSLFVNAATWGLLVTGRLVGTSSAQGLSSALTRMLARGGEPLIRRGMDLAMRLLGEQFVTGRNIAEALERSAAARRRGYRYSFDMLGEAAMTAADAQRYLAGYEQAIHAIGKASAGRGVVDGDGISVKLSALHPRYVWSQRGRVLAELLPRLKSLCMLARHYDLGLNIDAEEADRLELSLDLLEALALDDELAGWQGLGFVVQAYQKRAPRVVDWIIELARRSGRRLMVRLVKGAYWDAEIKRAQVEGLAGYPVFTRKLYTDVAYLACARQLLAARDVLYPQFATHNAHTLSAVFQLAGDDYAAGDYEFQCLHGMGEPLYDQVVGDTGSRRRVRIYAPVGSHETLLAYLVRRLLENGANSSFVNRIVDENVSIDALVADPVEEALPLAGAPHPRIPLPADLYGSERRNSAGHDLASEPVRQRIGAALQLSRSVVRRAGPLLANGPASPASRDNVLPVRNPADHSDVVGMVVHADEIDVERALAAASGAAPGWAMRAAAARAACLERAAELIERDTDELVALAVREAGKSWANVLAEVREAVDFCRYYAARVRDFDNASHAALGPVLCISPWNFPLAIFTGQIAAALAAGNPVLAKPAEQTPLIATAAVALFREAGVPAAVLQLLPGRGDIVGAALVADPRVRGVLFTGSVEVATRINRALARRGGDVPLIAETGGQNAMIVDSTALAEQVVADAIASAFDSAGQRCSALRVLCLQDDVADAVLAMLRGALDEMRLGDSSDVRNDIGPVIDADAQAALERHVAAMQASGARITRLALPQRCSRGTFVAPTIIEVGDIRDVGDEHFGPILHVLRYRAEELDRLLDAINATGYGLTMGVHSRIDETIDAVIAHARVGNLYVNRNMIGAVVGVQPFGGEGLSGTGPKAGGPLYVHRLLRRSPGPALEGRDRLPDGEAFGCLVTWLDGAGRTLIDDAGRAFLHERIAACRATRLAGLRLALPGPTGEDNSLRFVPRGLVAGVATTTVGRLHQLLAALASGNRIVFTDDAAHRALFDALPGPARKAVTLDTDWPGHPFGALLLDGTAAEADAWRVRLAERDGPIVPLLQPEPDYDAARLVHERTVSINTAAAGGNASLMALGA

SEQ ID NO: 54990 - protein, 381 aa, Bacillus sphaericus
MAKQLEKSSKIGNEDVFQKIANHEQIVFCNDPVSGLQAIIAIHDTTLGPALGGTRMYPYKNVDEALEDVLRLSEGMTYKCAAADIDFGGGKAVIIGDPEKDKSPALFRAFGQFVESLNGRFYTGTDMGTTMDDFVHAQKETNFINGIPEQYGGSGDSSIPTAQGVIYALKATNQYLFGSDSLSGKTYAIQGLGKVGYKVAEQLLKAGADLFVTDIHENVLNSIKQKSEELGGSVTIVKSDDIYSVQADIFVPCAMGGIINDKTIPKLKVKAVVGSANNQLKDLRHANVLNEKGILYAPDYIVNAGGLIQVADELYGPNKERVLLKTKEIYRSLLEIFNQAALDCITTVEAANRKCQKTIEGQQTRNSFFSRGRRPKWNIKE

SEQ ID NO: 54991 - protein, 343 aa, Arabidopsis thaliana
MAKSFEKPKFSLRLLIDEEKNRVILAEAGKDFVDVLCSLLTLPMGTIVRLLEKHQNPQSSVVGCLHNLYKSVADMDVDNFESQACKHFLLHPRSAKGSHGRDLKLNIDDTEATKFFVCPNFVSTEACRKLFSNVSTMKCRCGSSMHREIPVEEQQADGVFPSCRTSFVITDDLKVALNSMGLVLNVLNDFGYSGFDKLQEMLIDVGFEEILTLLGCLFTSEAPLTDTFLRKHCMSRKRKMLTPLVQESSVAGAADNLLTLKVYVRKTDRAVLYAECREEFVDFLFTFLAIPIEFAWELSIDIGNMGCVGNLCRSVKDLSFEKQKAATVSQCMLPYFYWKGTTS

SEQ ID NO: 54992 - protein, 390 aa, Burkholderia vietnamiensis G4
MSETKDAAAPAAAGGFKPKKSVALSGVTAGNTALCTVGRTGNDLHYRGYDILDVAESCDFEEIAHLLVHGTLPNLTELAAYKTKLRALRGLPNALKAALEQIPASAHPMDVMRTGVSVLGTVLPEKDDHNLPGARDIADRLMASLGSMLLYWYHFSHNGKRIETETDDDSIGGHFLHLLHGKAPSKSWVEAMHTSLILYAEHEFNASTFTGRVIAGTGSDIYSAITGAIGALRGPKHGGANEVAYDIQSRYDSPDEAELDIRRRVENKEVVIGFGHPVYTISDPRNKVIKGVAHKLSKEAGDLKLYNIAERLESVMWDAKKMFPNLDWFSAVSYHLMGVPTAMFTPLFVISRTSGWSAHIIEQRIDNKIIRPSANYTGPEDLQFVPIDKR

SEQ ID NO: 54993 - protein, 222 aa, Coccidioides immitis RS
MNIVEWAFGKRLTPAERLRKHQRALEKTQRELDRERIKLENQEKKLVQDIKKNAKNGQIGACKIQAKDLVRTRRYIQKFYSMRTQLQAISLRIQTVRSNEQMMQSMRGATILLGSMNRQMNLPALQRIVMEFERENEIMDQRQEMMDDAIDEATGLDDEEEGEEIVKEVLDEIGVDLGQALGETPTGLQTTGIQEGRIAQAVGGGGTAEDDDLQARLDSLRR

SEQ ID NO: 54994 - protein, 462 aa, Bacillus cereus E33L
MTFSKSTTDKPSYTYEELSEKNKAYVWHPFTQMKDYLEEDPVIIERGEGRKLYDVNGNEYWDGVSSIWLNVHGHQVPELDEAIREQLNKIAHSTMLGLANVPSILLAEKIIEVVPEGLKKVFYSDSGSSAVEIAIKMAFQYWQHKGKPKKQRFVTLKEAYHGDTIGAVSVGAIDLFHQVYSSLLFEAIKMPYPYTYRSPYGNDKAEIVKKHLEEMEELLKDKHEEIAAIIVEPLMQGAGGMITMPKGYLRGLRNLCTKYNVLFITDEVATGFGRTGKMFACEHENVTPDILTAGKGLTGGYLPVAITVTTDEIYNAFLGGYEEQKTFFHGHSYTGNPLGCAVAIANLELYEKTNLIEEVARKTEYVAMQLDELFACKHVGDIRQCGLMVGIELVKNKETKEAFEWTERVGVQVCKRSRELGMILRPLGNTIVFMPPLASTIDEIDEMLRILYKAISDITEGE

SEQ ID NO: 54995 - protein, 656 aa, Coccidioides immitis RS
MRCSFVLANYNWLSSRVVGIQPATVLSVSAIHSKLVLSLVACEPCLGAIFGNEGFKLAGSKRLSFSGQGGLLNRMFGGSSSPNKDKNTSIASPSTITSTTRARVTESPPAREGKGSSSDILKRSNDKRDQNGDKKRRGSSVSRAAAFFANAKNSLHISGLREPHKSPQVAQTPLQILGKMDPALVVPQGSLNNSAGESLPTPRSSFRVGVTEDKNKKCRRTMEDTHAYLYNFLGTPLSINQGESSPQSSQPKEPGGPESGDSTPIIETDNGYFAIFDGHAGTFAAEWCGKKLHLILEETIRRNPTIPVPILLDQTFTLVDQQLEQLPLKNSGCTAVIAVLRWEDRAPNSTISTPDAVNNKIQNPEPKGDRGETLQIPGNSTTETPSARDSRTMSASKPENPTVRQRVLYTANVGDARIILCRNGKALRLSYDHKGSDENEGMRITNAGGLILNNRVNGVLAVTRALGDSYMKDLVTGHPFTTETVIQPEADEFLILACDGLWDVCTDQEAVDLIRNAHDPQEASKILVDHALSQFSTDNLSCMVVRFDSKAHADGVNIKSAGESEVLNKTSVSETDKIVAQAKRESHRNSASNLDPAITEADSSREVEVAAAKLDEEPGPELSLPEKPKNDVDAMSSTAPSELTSAPNKGSPPKVK

SEQ ID NO: 54996 - protein, 260 aa, Thermosynechococcus elongatus BP-1
MIPYNLSDPRLFGIMVGVMFLMVVSRLLLVAGFFSLVYVVASWTPLRKRRVNLRPYQRGQFWQEFGWSLVTAAIFALAGAIAAVMWQRGWTAVYLELNSPWDYMYFPVSIGLVLLLHETYYYWLHRWMHQPKIYRRVHRVHHHSIVASPWTAFSFHPWEACLQAIFLPLIIVLVPLHPYAIVIQLSLMTLSSVINHLNLEIYPRGFAEHWLGQWLIGATHHSLHHSQFRCNYGLYFTFWDRWLGTESRDYLPLFRDRTQG

SEQ ID NO: 54997 - protein, 445 aa, Gossypium barbadense
MAATIVSVKARQIFDSRGNPTVEVDVETSNGIKARAAVPSGASTGIYEALELRDGGSDYLGKGVSKAVANVNTIIGPALIGKDPTEQTAIDNFMVQQLDGTQNEWGWCKQKLGANAILAVSLAVCKAGAEVKKLPLYKHIANLAGNSKLVLPVPAFNVINGGSHAGNKLAMQEFMILPVGASSFKEAMKMGVEVYHHLKSVIKKKYGQDATNVGDEGGFAPNIQENKEGLELLNTAIAKAGYTGKVVIGMDVAASEFYGTDKTYDLNFKEENNDGKQKISGDALKDLYKSFVAEYPIVSIEDPFDQDDWEHYSKLTKEIGEKVQIVGDDLLVTNPKRVAKAIAEKTCNALLLKVNQIGSVTESIEAVKMSKQAGWGVMASHRSGETEDTFIADLSVGLATGQIKTGAPRRSERLAKYNQLLRIEEELGAKAVYAGASFRAPVAPY

SEQ ID NO: 54998 - protein, 326 aa, Bacillus thuringiensis serovar konkukian str. 97-27
MIKDSSVQVEGQEKVYLDQWVAHYRTYAAKGRSASYIPALGEINVSQLGICIVKPDGTMIKAGDWEVPFTLQSISKVIGFIAACLSRGISYVLERVDVEPTGDAFNSIIRLEIHKPGKPFNPMINAGAITIASLLPGTSVQEKLESIYVLIEKMIEKRPAINEIVFQSEWETAHRNRALAYYLKENGFLESDVEETLEVYLKQCSIEINTEDIALIGLILAHDGYHPIRKEQVLPKEVARLTKALMLTCGMYNASGKFAAFIGLPAKSGVSGGIMTLVPSKSKKDVPFLDGCGIGIYGPAIDEYGNSLPGIMLLEHIAKEWDLSIF

SEQ ID NO: 54999 - protein, 122 aa, Oryza sativa (japonica cultivar-group)
MASTGGRSMALSLLLFAVTLSLLEMYRGRFASSELMTIAGGFVSSLLFLFLLTFIGNYQEANGVKTGWGAVVVAELTALIVAGTVHRVCITTCFLFSAGFLYEVDKLSGMILAKSESKARRH

SEQ ID NO: 55000 - protein, 347 aa, Musa acuminata
HVHELEPVEVVADQVAVALSHAAILEESMRARDLLMEQNVALDYARQEAELAIRARNDFLAVMNHEMRTPLHAIITLSSLLLETELNPEQRSMVETVLKSSSLLATLINDILDLSKLEDGSLELEIGIFNLHSVFREVVNFIKPIAAVKKLSVSLTLSPDLPLCAIGDEKRLMQILLNIVGNAVKFTKEGHISLTASVARADYLRDFRASEFYPVSSDGHFYLRVQVKDTGCGISSQDLPHLFTKFAHGRNVASRGFSGSGLGLAICKRYVSLVQGHIWLESEGIGKGCMATFVVKLGICENPDGSQQKIVLLPWTKHGQEDTSSSRGMPKDPKAFIPLKPRYQRSV

SEQ ID NO: 55001 - protein, 558 aa, Arabidopsis thaliana
MDQNSYRRRSSPIRTTTGGSKSVNFSELLQMKYLSSGTMKLTRTFTTCLIVFSVLVAFSMIFHQHPSDSNRIMGFAEARVLDAGVFPNVTNINSDKLLGGLLASGFDEDSCLSRYQSVHYRKPSPYKPSSYLISKLRNYEKLHKRCGPGTESYKKALKQLDQEHIDGDGECKYVVWISFSGLGNRILSLASVFLYALLTDRVLLVDRGKDMDDLFCEPFLGMSWLLPLDFPMTDQFDGLNQESSRCYGYMVKNQVIDTEGTLSHLYLHLFHDYGDHDKMFFCEGDQTFIGKVPWLIVKTDNYFVPSLWLIPGFDDELNKLFPQKATVFHHLGRYLFHPTNQVWGLVTRYYEAYLSHADEKIGIQVRVFDEDPGPFQHVMDQISSCTQKEKLLPEVDTLVERSRHVNTPKHKAVLVTSLNAGYAENLKSMYWEYPTSTGEIIGVHQPSQEGYQQTEKKMHNGKALAEMYLLSLTDNLVTSAWSTFGYVAQGLGGLKPWILYRPENRTTPDPSCGRAMSMEPCFHSPPFYDCKAKTGIDTGTLVPHVRHCEDISWGLKLV

SEQ ID NO: 55002 - protein, 530 aa, Arabidopsis thaliana
MAESTKSKKLSVRLLIDELKNKVVLAESGKDFVDVLFSFLALPMGTIVRLLEKHQKSPQVGIGCFNNLYKSVSEMDLESFQTEACKQVLLYPRSVNLEKFRNMKLKIDDTRAVKYFVCSGFKESCRHHYSISNTEECECGEIVDSKVVKRVMNREIKGLEEEQVQGRILRKDNDGVFFSCKASSFIITDDLKVEASSMDNVLNTLRGLGYADTSKLSEILLHVGVSEVFFTVSSYVGLRSLNIYVLLSVCLCHQQVLTLLECFFTSDLPLTDTFLKKQSSLQMIRSRIPLSPTLQGSGDGAVPGQTITFKAFVRKPNIKILCVECGADFIDLLFTFLALPLESVWNISAGNISLGCIGNLFRSFKRIDASSSSKTKLPSFYSCPKQLLDVVTEQQEIYCSFKCVVETNNEYDFKFTRKMPPRPNSLKEKNQNMFFTNKTSVLYLTSFGFMKQNTRFLVTDDLVIKPKNLVSNISLLKLNMHLDKEDVEEHVITIGKLEAISLLRASLMTSSALTSSFWSLISKKAKAETQ

SEQ ID NO: 55003 - protein, 1032 aa, Oryza sativa
MASAAAAAASDEPPRKRARSAGAEDRLSELPDCLLHDILALVGSRQAVRTSVLSRRWRGLWRSAPRVDIDQREFRRACGGEEGEPVVDCDGFEDFADGILSPTLLGGTGTPPLDAFRLHLLYEGRFITFGRWVRRALTRRPASVDIHVEYGGTVDWPPALTLGDGAGTGRLKRLHLFGVHLGFISGDGGRLAELLPVLEDLRMESCTFGHEPSSPTTTIAIPTLRSLALAVVPRRTARPYALTVASPRVASLRLFLPFSRTRAAAVRVAPAEEGEALASLVTASITVLETDQELNRRMNKHKLDFLASTRNMLDRFPNALLDKASQEFPTLPSLTTLLLSECDVGANCYVLKSVLRNAPNLEHLRLHRCKFLGTPKRKRGNSRSKGKSSSTCLDSLSSKCKSLQSVEIKFRPIDNARHHDLVGLGYLEADHPEAAPGPAAPEAGAGASPGEIFVPTPAQLPRHRVGSTLDPSWATGDGEGAAASRRRRRGGRDSSAAASAPPSAAELALPRDELRRLQGAGIRLRNRLKVGKAGVTEGIVNGIHERWRNAELVKIRCDDVSAMNMKRTHEILERKTGGLVIWRSGSTIILYRGTDYKYPYFHDREMKNDMDESSEHTSSDDEDADLAIIASEQSGSEEDSDNPAEHGSNHTEEGDDLTRRFGVDALEGNLDIGSAEQSINSATKDQQAILHTSTNVSRPSEISGRARSTLVAGVGSPNKFRLQLPGEVKLAEEADKLLDGLGPRFSDWWGYDPLPVDADLLPAIVPGYRRPFRLLPSGVPPRAESLNVFAQNVEARLSQAIAEKEKTEKLIEELEMSSEPSRAETREVISEEERYMLRKVGLKMKSFLLLGRRGVFDGTVENMHLHWKYRELVKIICKEHNIKDVEYAARTLEAESGGILVAVERVSKAHAIIIYRGKNYQRPSTLRPKSLLNKKDALKRSVEYQRYKSLKLHVLNLSKNIDYLKDQMEATGSVLVSREPNKVILYRGWGADVAQNSLSGNNSTEQVEKEVISPQLLEAVRLECGLHPGESE

SEQ ID NO: 55004 - protein, 224 aa, Burkholderia mallei ATCC 23344
MRRRHRTHKKESSMNRPKSMLVANIAWARETSERSPDFFDALSRGQNPRVLWIGCADSRVPAEAITQSAPGELFVHRNIANIFQPDDDNCASVLEYAVKVLKVDHVIVCGHYGCGGVRASLLPPSPELPHVNRRIAPLCALAGRHRAELDGVPPDAAADRLAELNVLEQVRLLRSSPIIRDAAPAPLVHGWIFSLADGRLKELASGYPAAQRPPQAERAQAAAA

SEQ ID NO: 55005 - protein, 239 aa, Zea mays
  misc_feature (21)..(21): Xaa can be any naturally occurring amino acid
  unsure (1)..(239): unsure at all Xaa locations
MEVEADGIQEATAGAGDGGGXGTHVFFCVAATSRGNKNSISYFHTNAVGEDAESALALAALCLDHAPDHHRWHHHTVAGAKTFAFLSADDGRTYFAAADPSPGAAEVVRFLERVRDACDAAPRKRLRDEAVAPVARQFARTLRAAAAGPSSGAELPEASLQAKEPSTPLAPVCEKDEEERQRAGERRRAFLQPEESASALPGWRPWWRHASVVIVVDVVLCLVLFAVWMGVCKGFGCLR

SEQ ID NO: 55006 - protein, 251 aa, Bacillus thuringiensis serovar konkukian str. 97-27
MRKPIIAGNWKMNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFDLVAGQVTKALAGLTEEQVKATVIAYEPIWAIGTGKSSSSADANEVCAHIRKVVAEAVSPEAAEAVRIQYGGSVKPENIKEYMAQSDIDGALVGGASLEPASFLGLLGAVK

SEQ ID NO: 55007 - protein, 394 aa, Bacillus thuringiensis serovar konkukian str. 97-27
MNKKSIRDVDLKGKRVFCRVDFNVPMKEGKITDETRIRAALPTIQYLVEQGAKVILASHLGRPKGQAVEELRLTPVAARLGELLGKDVKKADEAFGPVAQEMVAAMNEGDVLVLENVRFYAGEEKNDAELAKEFAALADIFVNDAFGAAHRAHASTAGIADYLPAVSGLLMEKELEVLGKALSNPERPFTAIIGGAKVKDKIGVIRHLLDKVDNLIIGGGLAYTFVKALGHEIGLSLCEDDKIELAKEFMQLAKEKGVNFYMPVDVVITEEFSETATTKIVGIDSIPSNWEGVDIGPKTREIYADVIKNSKLVVWNGPMGVFEMTPFSQGTKAVGQALADAEGTYSVIGGGDSAAAVEKFGMADKMSHISTGGGASLEFMEGKELPGVVCLNDK

SEQ ID NO: 55008 - protein, 256 aa, Corynebacterium glutamicum ATCC 13032
MTLTIEEIAKTKKLLVVSDFDGTIAGFSKDAYNVPINQKSLKAVKDLSQQADTDVVILSGRHLEGLKTVLDLGQYDITMVGSHGSEDSSRPRTLTPEEVARLAKIEADLEKIVDGIEGAFVEIKPFHRVLHFIRVSDKDKVQGILAQAAHVDSSGLKVTNGKSIIEYSISSTTKGTWLKEYVDRTEPTGVIFLGDDTTDEHGFKALENDDRALTVKVGEGDTAAKTRVDDVDNVGIFLEKLAYHRMQYAESVRLGI

SEQ ID NO: 55009 - protein, 643 aa, Glycine max
MSRKLDSPVQTQMAVAVIRSSPLGREYHGKQPAGRRRVFVQTEKGCVLGMDLDRGDNVHTVKRRLQLALNVPVDESYLTFGDMVFKNDLSAVRNDTPLLLTRGKNTHMPRSSSTPCLSPKGRDIDKSGPIEILGQSNRLDGIKHMIKDIMKAIKMGIEPIPVHSGLGGAYYFRNSKGDSVAIVKPTDEEPFAPNNPKGFVGKALGQPGLKRSVRVGETGFREVAAYLLDYDHFANVPPTALVKITHSVFNVNDGVNGNNLWRKRLFSKIASFQQFIPHDFDASDHGTSSFPVASVHRIGILDIRILNTDRHAGNLLVRKLDGIGSFGQVELIPIDHGLCLPETLEDPYFEWIHWPQASIPFSEDELAYIEDLDPYHDCEMLRRELPMIREACLRVLVLCTIFLKEAAAYGLCLAEIGEMMTREFRRGEEEPSELEVVCLEARKIVVERDREELSPRSEMRDDEFLFDIDYYDEFGSDFTPKMAIDDPLTRATFLPALGNGQSRNPLSKLDECIEEEEEEEEEAEGESPQGFVTSAAEEKIPSVSELSVSLKNTMLDGKNQNQQKYSGGKVENGHFANTSSGHKSANEQLPPSISFVDVTEMTEDEWPLFLEKFQELLYPAFAKRKSITLGQRQRQRLGTSCQF

SEQ ID NO: 55010 - protein, 554 aa, Yersinia pestis CO92
MCSIFGVLELKTDPIELRKKALEMSRLMRHRGPDWSGVWANDKAILAHERLSIVDVNTGAQPLYNAAHTHILAVNGEIYNHQALRQQYSDRYAFQTGSDCEVILALYQEKGPAFLDDLQGMFAFVLYDTEKDAYLIGRDHLGIIPLYMGHDEHGNMFVASEMKALVPVCRTIKEFPAGSYLWSQDGEIREYYHRDWFDYDHVKDNVTDKIQLANALEDAVKSHLMSDVPYGVLLSGGLDSSVISAITKKFAARRVEDNERSEAWWPQLHSFAVGLIGSPDLRAAQEVANHLGTVHHEIHFTVQEGLDAIRDVIYHIETYDVTTIRASTPMYLMSRKIKAMGIKMVLSGEGSDEVFGGYLYFHKAPNAKELHEETVRKLLALHMYDCARANKAMSAWGVEARVPFLDKNFLDVAMRINPQDKMCGNGKMEKHILRECFESYLPHSVAWRQKEQFSDGVGYSWIDTLKEKAAEQVTDQQMETAHFRFPYNTPGSKEGYLYREIFEELFPLPSAAECVPGGPSVACSSAKAIEWDESFKNMDDPSGRAVGVHQDAYK

SEQ ID NO: 55011 - protein, 154 aa, Aquifex aeolicus VF5
MSSELLRKIEQKYLPKKEYPDFRVGYTVRVYYKIKEGDKERIQPFEGVVIRIRGSGAGKTFTVRRESFGVGIERTFPYYSPNIEKIEVVKIGKVRRAKLYYLRELKGKEAERKIKEIKQWEYEAMQRRKEEARKQREEEQKQAQEQAQEQEQNA

SEQ ID NO: 55012 - protein, 344 aa, Xanthomonas campestris pv. campestris str. ATCC 33913
MAATSHSACASALPVVPAPTTFLAADVGGTHVRVGRVSHGADAPIELSQYRTYRCADHASLDAILADFLRDSRAVDAVVIASAGVALDDGRFISNNLPWTIAPRQLRDTLGVRAVHLVNDFEAVAYAAPQMEQRAVVQLSGPTPRHAQPGGPILVVGPGTGLGAAVWINGPRQPTVLATEAGQVALASNDPDTAQVLRILARDASYLPIEHVLSGPGLRNLYLALCELHAATPIHPLPADITHAALHSDDALARRCLQLFCALLGSAVGDMALAYGASGGVYLAGGILPSIGQFLAASDFRERFLAKGRMRPVLERIPVKLVEHGQLGVLGAASWYLQHHTEVS

SEQ ID NO: 55013 - protein, 297 aa, Saccharomyces cerevisiae
  misc_feature (287)..(287): Xaa can be any naturally occurring amino acid
  unsure (1)..(297): unsure at all Xaa locations
MPIKETDKEVVLTHPADETTSVHILKYGATVYSWKLKSEEQLWLSTAAKLDGSKPVRGGIPLVFPVFGKNSTDEHLSKLPQHGLARNSTWEFLGQTKENPPTVQFGLKPEIANPELTKLWPMDYLLILTVELGSDYLKTAIEVENTSSSKELKFNWLFHTYFRIEDIEGTMVSNLAGMKLYDQLLKESYVDKHPVVTFNQETDVIYQNVSAERAIQIVDKGVQIHTLKRYNLPDTVVWNPWIEKSQGMADFEPKTGYQQMICIEPGHVHDFISLAPGKKWNAYQLLXKEELKYQAIQ

SEQ ID NO: 55014 - protein, 480 aa, Musa acuminata
RSTLDRHTILKTTLVELGRTLDLAECALWMPSRSGLNLQLSHTLHHQMPLGSVVSINLPVVNQVFSSNRAVRIPHTCPLARIRPQTGRYVPPEVVAVRVPLLHLSNFQINDWPELSAKSYAIMVLMLPSDSARKWHIHELELVEVVADQVAVALSHAAILEESMRARDLLMEQNVALDSARREAEMAIRARNDFLAVMNHEMRTPMHAVIALSSLLLETELTPEKRLMIETVLKSSNLLAALINDVLDLSKLEDGSFELEIANFNLHAVFREVINLIKPIAAIKKLSVSVTLAPDLPLCAIGDEKRLMQTILNVAGNAVKFTKEGHISITASVARSDSSRDPRAPEFSPVTSDRHFDLRVQIKDTGCGISPQDLPHIFTKFAHSRNSANKASNGSGLGLAICRRFVSLMEGQIWLESEGIGKGCTATFIVKLGICDPSGNLQQILQTTPSHGDANLPGPRAKFDDENGKFTPMMRYQRSV

SEQ ID NO: 55015 - protein, 289 aa, Glycyrrhiza uralensis
MEGKEQDVSLGANKFPERQPIGTAAQTQDDGKDYKEPPPAPLFEPNELTSWSFYRAGIAEFVATFLFLYITILTVMGVNRSESKCKSVGIQGIAWAFGGMIFALVYCTAGISGGHINPAVTFGLFLARKLSLTRAVFYMVMQCLGAICGAGVVKGFEGKTLYGKYNGGANFVNSGYTKGDGLGAEIVGTFVLVYTVFSATDAKRSARDSHVPILAPLPIGFAVFLVRLATIPITGTGINPARSLGAAIIFNKDRGWNDHWIFWVGPFIGAGLAALYHVVVIRAIPFKSK

SEQ ID NO: 55016 - protein, 127 aa, Dechloromonas aromatica RCB
MAKTIIATPNAPAAIGTYSQAVRVGDTVYMSGQIGLDPASMQMVDGIDAQIVRVFDNLKAVAEAAGGSLADVVKLNVFLTDLANFAKVNETMAKYFSEPFPARAAVGVKELPRGALVEADAVMVIGN

SEQ ID NO: 55017 - protein, 864 aa, Cryptococcus neoformans var. grubii
MPRQQSEDEHRICGQAFRSPRSPQGNPLERNSKLEDEEELDLIRRYEDFSTVDWIQDSLHERTFQNKAPRSRVIAQLDRSDGAIGYLWRLIRRTLEEGEAYVVISLVGVIIGVSAALISIITTWLSDIKLGHCTTGWWLSRKFCCLEVSDELEACAEWKNWGGVEPFRWIAYVLFAAAFSFSAAYLVKNFAPYAAGSGISEIKCILGGFIINGFLSVETFFIKGLTLPLAIASGLAVGKEGPSVHVACSVGNVVAKWFNRYERSHLKMREIVTASSAAGVAVAFGSPIGGVLFSIEEMNQTYSNRTMWRSFVCALVATFTLASMDPFRTGKLVIFNVSYDRDWHYFEIPAYVLIGIFGGLYGAFVIKFNVQMAAFRRKHLSGHGIFEAVALASITAIIGYLNGFLRIDMTEMLSVLFRECEGGGDYNGLCQASSQWRMVNSLLLATIIRTVFIIVSYGCKVPAGIFVPSMAVGATFGRMIGILVKAMYNSYPSAPWFAACAPDAPCITPGTYAFLGAAAAMGGITRLTVTVVVIMFELTGALTYILPTMIVLLVTKAVSDQFGGGGISDHMIKFNGYPFLEKEDKEDPTDHAFIEPIANVMKKDLIILEATGVPLNHVVDIVQHTNYQGFPVVKSHEDQTIVGFVRKNELRIALEKTRRVRNLSFNATCTFQCIRAIPEDAHELLERPDILIPNREGRMTANTGTENREDDGGEISHVDFGQYVDDIPLTVAPKMPLEIVMQLFRRMGPRVILVSDQGRLTGLVTVKDVLRHELSEAHHRSRSTHTPITPSHPAYAQSNGWDTEWTVDDERGHGLEIVLEEGLEWTRSKATWAYGAALERWRDIRGQDRRAATFDYELDEGIQG

SEQ ID NO: 55018 - protein, 550 aa, Zea mays
MAATVRRAASSVLSRFLLTKPSPSPASAAGNKSALLGAGAAALHRFSTAPASAAAAAEEPIQPAVEVKHTQLLINGNFVDAASGKTFPTLDPRTGEVIARVAEGDSEDIDRAVAAARRAFDEGPWPRMTAYERCRVLLRFADLIERHAEEVAALETWDNGKTLAQAAGAEVPMVARCVRYYAGWADKIHGLVAPADGAHHVQVLHEPVGVAGQIIPWNFPLLMFAWKVGPALACGNTVVLKTAEQTPLSALYVANLLHEAGLPEGVLNVVSGFGPTAGAALCSHMGVDKLAFTGSTGTGQIVLELAARSNLKPVTLELGGKSPFIVMDDADVDQAVELAHQAVFFNQGQCCCAGSRTFVHERVYDEFVEKSKARALKRVVGDPFRDGVEQGPQIDGEQFNKILRYVQSGVDSGATLVAGGDRVGDRGFYIQPTVFADAKDEMKIAREEIFGPVQTILKFSGVEEVIRRANATPYGLAAGVFTRSLDAANTLSRALRAGTVWVNCYDVFDATIPFGGYKMSGVGREKGIYALRNYLQTKAVVTPIKNPAWL

SEQ ID NO: 55019 - protein, 331 aa, Azoarcus sp. EbN1
MPTGCSDTYPRLIGDIGGTHARFAVIDSPGSPPTRFRTLCCDDHAGLLEAVQAYLLLERGLAGPRVAAFGIANPVEGDRVRMTNHDWSFSIEQLRIELGLARLVVLNDFTALALSLPRLQAGERRQIGGGNECAGRPVALIGPGTGLGVSGLVRCGNGYAPLEGEGGHVTLAASTPREAELIAVLAARFDHVSAERALSGPGLIALHDAIRQLAGAPPLALEADEISARAMAASCPWCAEALQVFCGMLGSVAGDLALTLGAFGGVYIGGGIVPKLGDFFDRSDFRRRFEQKGRFSEYLARIPCYVILAEYPALLGAATALDNALAGETGT

SEQ ID NO: 55020 - protein, 303 aa, Pseudomonas syringae pv. tomato str. DC3000
MPTSPVEPLVESVQYDELNCWRIRHGEAELLVAQQGAHILSYQVAGQPPLVWLNEEAAFKKGKAIRAGMPICWPWFGNLERNPQSVQAMRDSSEPAKAHGEVRALDWQLLGIGADGDALLVEFVLPEAEGHLPGWPHNVALKLSIRLDHALNVSLVSYNCGAEPVTFSQALHTYFAVSDVRQVSIEGLDGLRYIETLANWEEREQTGDLTFTGETDRIYQDTPGVLSIIDPEWQRRIHIRSTGSKSAILWNPWIEKTGTFTDMAADGWQRMVCVETANVLDDVVTLAPDQMHVLGVSIWGESL

SEQ ID NO: 55021 - protein, 163 aa, Crocus sativus
SHAPGRHGRGIFDGDGMGMNMVSKGVQNVLDYLQTDFPDMEVISISGNFCADKKPAAVNWIEGRGKSVVCEAVIKEETVKRVLKTTVPALVELNTMKNLVGSAVAGSLGGFNAHASNIVTAVFIATGQDPAQNVESSQCITLIESVNDGKDLHISVTIPSPSK

SEQ ID NO: 55022 - protein, 205 aa, Aquifex aeolicus VF5
MLKLKFNEEGLIPVIAQDYRTGEVRMLAYANEEAIKKTLETGYAHYYSRSRKKIWKKGETSGELQKVIEVRVDCDEDALIYVIEQEKDRACHTGERNCFFRDIEGNKVEKPLPFEVLPRLQDVIREKIERKEENSYTAKLVSQGKERVFQKFGEEAVETLIALMKGEKEEVIYESADMLYTFLVSLSVSGIDIKEVMEELIRRFK

SEQ ID NO: 55023 - protein, 553 aa, Burkholderia thailandensis E264
MTQKFEEGLGKREANYVPLTPIDFIARAAEVYGERLAVVHGDIRRTWGETYARARRLASALERAGVERGDTVAALLPNIPPMIEAHFGVPMAGAVLDALNTRLDIASMLFMLRHGEAKVLIVDTEYAEFAHRAALEVPGLAIVSVADAMPADPARFPAAIDYEAFLAGGDPTYTWTPPSDEWEAIALNYTSGTTGDPKGVVYHHRGAYLAAISNILEWDMPKHAVYLWTLPMFHCNGWCFPWAVAARAGVNVCLRKFDAKLVLDLIRRERVTHYSGAPIVQSAIANAPAEWRAGIEHEVHAFVAGAAPAPAVIAKMKEIGFDLTHVYGLTEVYGPATVCAKQAHWASLPDDELAQLNARQGVRYHLQAGATVLDPDTMAPVPADGETLGEIMFRGNICMKGYLKNPHATDEAFAGGWFHTGDLGVLTPDGYIRIKDRRKDIIISGGENISSIEVEDALYRHPAVAVAAVVALPDPKWGEVPCAFVELREGMSATEEEIIAHCRLLLAAYKIPKTVRFGELPKTSTGKIQKFQLRAQVGSRSAIDLVADAAKKG

SEQ ID NO: 55024 - protein, 547 aa, Listeria monocytogenes EGD-e
MTLKSGFDYMNNPLLNKGTAFSKEERASYQLDGLLPPIIETIEQQAVRIETQIENLETPLHKHRLLTNLYNENRTLYYYVVTKNVTDYLPIIYTPTIGDAVIQYHKDYTAPDEALFVDAFAPEKLSASIKNYAKNNPNIDMIVITDGEGVLGIGDWSVNGVKIAVGKLAVYTVAAGLAPDRVLPVVIDAGTNNETLLNDPLYLGNKRPRLSESEYDAFIASFVNVMKEVFPKAILHWEDFGRANASRILHNYRDKICTFNDDIQGTGAMVVAAVLATIQVSRIPLSEQKIIIFGAGTAGIGIADQLSAQLMRETGLPFEKAKKHFYLVDRKGLVLDNMTDLTTGQKKYAHPSAEWSNVPTDTLENLVEAVHPTMLIGCSGVTGAFKESIVKKMTQYTERPAILPLSNPTKLAEATASDLIQWTDGKALIVTGSPSKPVEYQNTTYEIGQANNALLYPGLGLGALVTRAKYITDDMLAAASMAVAEQISPNKAGAALLPHVRTLRETSRAVAIAVANQAIKENIHQVELTNVIEAIELEMWQPIYKGV

SEQ ID NO: 55025 - protein, 474 aa, Rhodococcus sp. RHA1
MSEVLDRTKIYIDGSWIDSQGTGRIDVVNPATEDVIAVVAEGTADDVDRAAKAARAAFPAWSALSGKERGEYLRKAAALIQERLDDFTALVSRDMGMPLGFAKPVQIGMPLANLAAFAELAATYDFDAHEVGNSLIVREPIGVVGAITPWNFPLHQVVLKVGGALAAGCTVVLKPTEVAPLATYALADIFDEIGLPAGVFNLVSGFGPVVGEAIAGHPEVDMVSFTGSTRAGKRVAVVAAETVKKVALELGGKSANVILDDADLTKAVTDGVAKCFLNSGQTCSALTRMLVPAGKVDEAAAIAAKVAQNYSVGDPTAATSVLGPLVNSNQLKRVRGYIEQGISEGAHAVLDGRETGQESGYFVGPTVFSGVTEDMTIAKEEIFGPVLSIIGYQDEDDAVRIANATEYGLAAGVWSGDQDRADRVARQLRAGQVEVNGGAFNTNAPFGGYKQSGIGREAGVLGFEEFLEIKSIQR

SEQ ID NO: 55026 - protein, 272 aa, Wolbachia endosymbiont of Drosophila ananassae
LDVGAMTPLLWLFEEREKILEFYERASGARFHAAYIRPGGIAADVPEDLIEDIAKFIEQFPKYIDDVDELLTENRIWKQRTVGISEISIKQALDWGFSGPMLRAAGLAWDLRKSQPYEIYDQLDFDIPIGQNGDCYDRYLVRMAEIRQSISLVKQCIEKMPEGQIKTEDRKISPPSRAEMKKSMEALIHHFKLYSEGYHVPEGEAYAVVEAPKGEFGVYIVSDGTNRPYRCRIRAPGFAHLQALDFMAKGHMLADVAAIIGSLDIVFGEIDR

SEQ ID NO: 55027 - protein, 325 aa, Pseudoalteromonas tunicata D2
MTRLISFGEILIDMLPADSRCTQFLAIAGGAPANVAVGFAKLGGQAFFAGGLATDGFAPILQNALHDYGVDTRYLVAVANSQTAMAVVTLDDLGERSFSFYRHNTADIQVNLAHFSAIHWQDDGIFHFCSNTLTDDTIAKVTYQLIQQAQKNQQLISFDVNLRPALWQKPTEIGSYVEQCFQWVDVIKLSQDELTHLAKLKGVNESDYLAGILHQGVKVIVLSNGPLPAKIVTQTETISLAAPTINAIDTTAAGDSLIAGFLFELSTFAKQQQLTLNQSLRNIACLQQALQFGLHCGALTCAQKGAFPALPELSAVLAFVESAKN

SEQ ID NO: 55028 - protein, 478 aa, Agrobacterium tumefaciens str. C58
MHTYPDIKLLIDGEWRDAVSGKTIAVSDPATDEIIGAIAHAEKEDLDLALAAAERGFKLWRDTSPYERSKIMRKAADILRERKDKIAYIMTREQGKPLAQSATEIMGAADTIDWFAEEARRTYGQVIPARATGVSQLAIKVPVGPVAAFTPWNFPLNQIVRKLSAALATGCSIIVKAPEETPASPAELIRAFVDAGVPAGVIGLVYGVPSEISEYLIPHPVIRKISFTGSTPIGKHLAALAGKHMKRATMELGGHAPVMIFDDADIEKAIEVTSLAKFRNAGQVCVAPTRFLVQDGVADRFLEGFVEATKAIKVGNGLEEGVIMGPLANERRIPALEGLINDAVSHGAELKTGGRRIGNKGNFFEPTVLANVPVTAKIMNDEPFGPVAIINRFSSFDDAITEANRLPFGLASYAFTGSVKTAHALGQQVEAGMLTINHNGLALPEVPFGGIKDSGYGTEGGSEAVQAYLETKFVSQMS

SEQ ID NO: 55029 - protein, 346 aa, Pyrococcus abyssi GE5
MYRVAVIKGDGIGPEVVDSAIRVVNSVTDRIRFYEFEGGFEVFKRIGSPISEDDLKEIRKMDAILFGATTTPFNVPGYRSLIVTLRKELDLYANLRIIPDLSNGKEIVIVRENTEGLYARDGIGFSDRAIDFRIITLEGARRIAKFAINLAKERNSFITFVHKANVLKGDRFFREIVLEIAEREGVEVREAIIDSFMIKLVKNPWDHGVILTENMFGDIISDLATIHAGSIGIVPSGNYGDEIALFEPIHGSAPDIAGKGIANPIGAILSAAMMLDYLGLNGKVVWEATRRYVRYGNLTPDMGGTATTSEVTKGIISEIYSFDPFDIDEIWVEEIRLGRIPLTLWR

SEQ ID NO: 55030 - protein, 312 aa, Corynebacterium glutamicum ATCC 13032
MASATFTGVIPPVMTPLHADGSVDVESLRKLVDHLINGGVDGLFALGSSGEAAFLTRAQRKLALTTIIEHTAGRVPVTAGVIETTTARVIELVEDALEAGAEGLVATAPFYTRTHDVEIEEHFRKIHAAAPELPLFAYNIPVSVHSNLNPVMLLTLAKDGVLAGTKDSSGNDGAIRSLIEARDDAGLTEQFKILTGSETTVDFAYLAGADGVVPGLGNVDPAAYAALAKLCLDGKWAEAAALQKRINHLFHIVFVGDTSHMSGSSAGLGGFKTALAHLGIIESNAMAVPHQSLSDEETARIHAIVDEFLYTA

SEQ ID NO: 55031 - protein, 461 aa, Myxococcus xanthus DK 1622
MSPKSKREDLPHVVILGGGFAGLYAARHLYRAPVRVTMVDRQNHHLFQPLLYQVATATLSPSEIAAPLRAVLGHHQVAVVLAEVTGVDTAGKRVLLSDGELNYDYLVIATGATHSYFGNDAWAQFAPGLKSIEDALAIRRRILVAFELAERETDPEIRRSLLNFVIIGAGPTGVELAGSLAEISRHSLHGDFRNFDPRDARIILIEGMDKVLPVYPDDLSQKACRTLEKLGVEVRTGARVTNITEQGVFIGQEFIPARTVLWAAGVAASPVAKSLGVELDRSGRVLVTPELTIPGHDDVFVVGDLSLLKDAEGKPVPGLAPVAMQEGKHAAHNIRRQLQGKPMVPFSYWDRGSYAVIGRGHAVGIAFRRFKQAGFGAWMAWLLIHITFLIGFRSRLAVLLNWAFSYLTFGKSARIITGPSPRLDRLQPTHALPEGGQTPSIAEPRFQTTTSHAESATTGTH

SEQ ID NO: 55032 - protein, 265 aa, Sulfolobus solfataricus P2
MSINLLHKDDTRIDLVFEGYPLEFVNAIRRASMLYVPIMAVDDVYFIENNSPLYDEILAHRLALIPFMSEEALDTYRWPEECIECTENCEKCYTKIYIEAEAPNEPRMIYSKDIKSEDPSVVPISGDIPIVLLGTNQKISLEARLRLGYGKEHAKFIPVSLSVVRYYPKVEILANCEKAVNVCPEGVFELKDGKLSVKNELSCTLCEECLRYCNGSIRISFVEDKYILEIESVGSLKPERILLEAGKSIIRKIEELEKKLVEVVK

SEQ ID NO: 55033 - protein, 413 aa, Burkholderia thailandensis E264
MSTTDPYLIAGGGHAARRAAETLRERDPAARIVMIGEEPELPYDRPALSKEALVGGDEGERRAFVRDAAWYRERGVELRLGVRVEAIERGTQRVRLSDGASLGYARLLIATGSRVRRFRGPVDAGVPIHYVRTVADARALRAALAPGRRVAVLGGGFIGLEVAASAVRLGCRATIVDPAPRLLQRGMPEVVGAFALALHARHGVDVRLGALPERIRRGANGAAVVETSAGDIAADVVVAGIGVVPNVELAQAAGLHVDDGISVDERCRTADAAIFAAGEVTRHFNPLVGRRLRIESWQVAEHQPAVAAANILGGHDTYEEWPWLWSDQHDCNLQTLGVFDGEQTLVLRGSPELDRAFCVFALNARRELRAVAAVNAGREIAACRRLMTANVALDPARLADPTVALRSMLRDGA

SEQ ID NO: 55034 - protein, 613 aa, Magnaporthe grisea 70-15
MATVIGDFASDPSRFRHNMVFQPQPPQLSQSHSHHHHQQQQHQQHHQQSYRSSNQPWESAHTTSSVPRQEPQPTETSPSIPTPSSSVASSTPRSNYTTSAPIANQTRPSSADRQLQKQPAPPDDDSGASRFPTPPDSSSPSVSNLGGVHSQKHVGTDQPHPHSQPDPEYMDTSADATEVAVVTAPSSDPPSTAASDATVVPPFSDTTAAPAAAAGPTEQFSAASSASSKPAHSIPSPVSDSFPSHWAPSPAPNSPTRAAQTQQTTVRIRDLSHIQSLARADLVTGGNNNGGILNVDPPLSQMKYDISEMPIGDVIEMVAALLTKITTTNDLQHDALSRNATHQRQAQAAQQQQQQDGNGEGSSKGDGVITANSNSSGNGSSPYANSVLAFHGKNVPAITILSYLSRIHKYCPTTFEVFLSLLVYFDRMTERVNDLVVRSEQEKKEAEAKAKNQGDVVMDNDGGGAQDDEMDEDLADSDDEGEAPTKHSSNNGDAGVAGSREALRESATSTPPPPALSSTATYFVVDSYNIHRLIIAGVTCASKFFSDVFYTNSRYAKVGGLPLAELNHLELQFLLLNDFRLAVPVEDLEAYATMLVEFYARDVVAQRSRPSSD

SEQ ID NO: 55035 - protein, 247 aa, Triticum turgidum
MACRFLLVALLLVVAPLAPADARDIPATATAKTAKTTATTTTTKSVAAVVAAPATATAKTTTTTAMTTTSAKSVGVAAAAPAGLGDQKTFLGSGLGGGYGGGVGGFAGAGGVGGLGGAMGGIGGVLGGVGGGVGGIGGVGGLAGVGGVGGLGGAGGGVGGLGGAGGLGGLGGGGAGGLGGLGGGSGGLGGLGGGSGGLGGLGGGGGGLGGVGGGGGGLGGLGGGGGGLGGGGLGGGAGGLGGGCIHP

SEQ ID NO: 55036 - protein, 282 aa, Chlamydomonas reinhardtii
MKSAQSLLMKLQAPIKGCLQQGTSEGLRSFAARALGSAMETSLIPEANSASTSASSASQLQQTRSMGYAYARKTTDKDYIASEHMQAFGNTQLTDYIIKTVPKFVKMAVTGPAQSSVLYQEPTIYTTPESLVPLMVFLRDHTNTQFKCLLDVTAVDFPSRAARFEVVYHLLSPRWNNRIRVKVCVDEVTAVPTLCKVFNTANWFERETWDMFGVFFSGHPDLRRILTDYGFTGHPLRKDFPMTGYQEVRYDYGKKRVVSEPLELTQEFRYFDFNSPWETLNR

SEQ ID NO: 55037 - protein, 440 aa, Achromobacter denitrificans
MSAAKLPDLSHLWMPFTANRQFKANPRLLASAKGMYYTSFDGRQILDGTAGLWCVNAGHCREEIVSAIASQAGVMDYAPGFQLGHPLAFEAATAVAGLMPQGLDRVFFTNSGSESVDTALKIALAYHRARGEAQRTRLIGRERGYHGVGFGGISVGGISPNRKTFSGALLPAVDHLPHTHSLEHNAFTRGQPEWGAHLADELERIIALHDASTIAAVIVEPMAGSTGVLVPPKGYLEKLREITARHGILLIFDEVITAYGRLGEATAAAYFGVTPDLITMAKGVSNAAVPAGAVAVRREVHDAIVNGPQGGIEFFHGYTYSAHPLAAAAVLATLDIYRREDLFARARKLSAAFEEAAHSLKGAPHVIDVRNIGLVAGIELSPREGAPGARAAEAFQKCFDTGLMVRYTGDILAVSPPLIVDENQIGQIFEGIGKVLKEVA

SEQ ID NO: 55038 - protein, 147 aa, Listeria monocytogenes EGD-e
MEQTYVMVKPDGVERGLIGEIVTRIEKKGLKIVAGKLMQIDRELAEKHYAEHIGKSFFEDLIGFITSGPVFAMVLEGDDAIATARRMMGKTNPLEADPGTIRADYAIHTNRNVIHGSDSPESAQREIQLFFAPDEILSYQKAVDTWI

SEQ ID NO: 55039 - protein, 321 aa, Listeria monocytogenes EGD-e
MKLNFLYANMQKDIDSVEKELKKALSGAAADTTSAAALHLLEAGGKRIRPMFVCLSARLAANADFNAVKNASVAIELIHMASIVHDDVVDDADLRRGRETIKSKWGNHIAMYTGDFLFAKSLEYMTEIKDVAAHKMLSHVTVELSTGEIEQLKDKYNFDQSVRNYLRRIKRKTALLIAASCGLGGVVSGQSEADYQKLYRFGYYVGMAFQITDDVLDFVGTEKELGKPAGEDLRQGNVTLPVFFAMEDPFLKKRISQITEETPAEEIAVLVEEVKKTGAKQAEDVATTYLKKAVEILDSLPQVPELKPLKQIVRVLDKRNY

SEQ ID NO: 55040 - protein, 473 aa, Nicotiana tabacum
MASRIVLQQQNRGEAVPGAVKQKRNMAPEGRNRKALGDIGNVATGRGVEGKKPLPQKPVAVKVKGAIVAKVPPVRKPAQKKATVKPNPEDIIEISPDTQEKLKENMQRTKADKDSLKQKATLTSTLTARSKAACGLSKKPKEQIVDIDAADVNNELAVVEYVEDVYSFYKLAENETRVHDYMDSQPEINDRMRAVLIDWLVEVHQKFELNPETLYLTINIVDRYLAVKTTSRRELQLVGISAMLIASKYEEIWAPEVNDFVCISNKSYTRDQVLAMEKEFLGQLEWYLTVPTPYVFLARFIKASPPDSEIKNMVYFLAELGLMNYATIIYCPSMIAASAVYAARHTINRTPFWNETLKLHTGFSESQLIECARLLVSYHSAAATHKLKVIYKKYSSPERGVVSLLTPAKSLLAASSSSVSSGRSDLAKSTKAAATSSSPMVVVGCQRCHMYVMVTEADPRCPQCKSTTTRKMT

SEQ ID NO: 55041 - protein, 367 aa, Nicotiana tabacum
MVFPLDTQLLNPIFDGLFCEEDRFLDDDDLGEWSCTLEQVENNVKKTLPLLECDMFWEDDQLVTLLAKEKESHLGFDCLISDGDGLLVEVRKEALDWMLRVIAHYGFTAMTAVLAVNYFDRFVSGLCFQKDKPWMSQLAAVACLSIAAKVEETQVPLLLDLQVADSRFVFEAKTIQRMELLVLSTLKWKMNPVTPLSFIDHIMRRFGFMSNLHLDFLRRCERLILGIITDSRLLYYSPSVIATAVMFFVINEIEPCNAMEYQNQLMSVLKVKQDSFEECHDLILELMGTPGYNICQSLKRKHQSVPGSPSGVIDAYFSCDSSNDSWSVASSISSSPEPQYKRMKTQDQTMTLAPLSSVSVVVGSSPR

SEQ ID NO: 55042 - protein, 468 aa, Streptococcus mutans
MSKTLPKDFIFGGATAAYQAEGATHADGKGPVAWDKYLEDNYWYTAEPASDFYHQYPVDLKLAEEFGVNGIRISIAWSRIFPKGYGAVNPKGLAFYHNLFAECHKRHVEPFVTLHHFDTPEALHSNGDFLNRENIEHFVNYAEFCFKEFSEVNYWTTFNEIGPIGDGQYLVGKFPPGIQYDLAKVFQSHHNMMVAHSKAVKLFKDGGYSGEIGVVHALPTKYPYDPNNPADIRAAELEDIIHNKFILDATYLGKYSEKTMEGVNHILAVNGGQLDLREEDFAALEAAKDLNDFLGINYYISDWMRAFDGETEITHNAKGEKGSSKYQIKGVGRREAPVNVPKTDWDWIIYPQGLYDQIMRVKQDYPNYKKIYITENGLGYKDEFVNHTVYDDARIDYVKKHLEVLSDAIADGANVKGYFIWSLMDVFSWSNGYEKRYGLFYVDFDTQERYPKKSAYWYKKLAETQIID

SEQ ID NO: 55043 - protein, 59 aa, Metarhizium anisopliae
EAYNERMHLLTFMKMCEPGWFMKLMIIGAQGVFFNALFITYLLHPRIVHRFVGYLEEEA

SEQ ID NO: 55044 - protein, 367 aa, Arabidopsis thaliana
MKGKKPSIEIATSNPSLPEDLVVSCLARVSRLYYPTLSLVSKSFRSLIASPDLYKTRSLLGRTESCLYLCLRYSPEDNPRWFTLCRKPNRRTLSKEKNESSGNLLVPIPIINSPPLEWSSIVAVGSHLYAINGPIEDAPCSNVSFLDCRSHTWLEAPSMRVAHTNSQLDGKMYLAGSSENVDSLNCIQVFSTKTQTWKPVPFQKRIFGVGDLEGKIYTICRTECGQGVTIKPKDLTCDVVGFCGEKDWSSVCMIGNIVYFYRPNGEFLWIYSGKGESARRNLKGLEGLPKFDDYASVKLVDYGGKLMVLWDTYVPESESKEKMIWCAEISLQKKCNNEEIWGTVEWFDAVLTVPEDCKFVRAIAATV

SEQ ID NO: 55045 - protein, 215 aa, Pyrococcus abyssi GE5
MIATVILADSIKEAIEKIKSSSSDLYELRADSLKDYSKLELLEPYSEKLVVTIRSKDEGGFKELSDEKRLELYSKFLEIKPRYVDVEFRSKIKDEVMEIAKRVGSRVILSYHNFRETPPFGVLYNLLEDMESEGADIVKIVTHASSPKDNIRIIRLYEFADNLIAFCMGSKGKISRIFSSMYSPITYVALDKKAAPGQLTLEELRVILKILGEGR

SEQ ID NO: 55046 - protein, 530 aa, Coccidioides immitis RS
MLTGNIYFIAAVAVIGGGLFGFDISSMSAILGTEQYRCYFDQYPKEPGRDCGGPKPDVQGGITASMAGGSWLGALVSGFLSDWMGRKRAIMAGAVIWVVGSIIVCASQNIAMLIVGRIINGFSVGICSAQVPVYISELAPPSKRGRLVGCQQWAITWGIMIMFYISYGCSFVKGTAAFRIPWGLQAIPAVLLFLGMLFLPESPRWLARKDRWDECRAVLAQVHGKGDASSPFVEREFQEIRDMCEFEKRNADVTYWELLKPNMINRTHVGVFTQIWSQLTGMNVMMYYITYVFAMAGLTGNTLLLSSSIQYVINVGMTVPALLWVDRWGRRPTLLVGAFLMMTWLFVNAAVLATRGSPAPPGGLGGVEAQSWQIYGPPSKVIIACSYLFVASFAPTWGPVSWIYPPELFPLRVRGKAVALCTSANWAFNFALGYFVPPSFVNIQWRTYVLFGVFCATMFIHVFFMFPETAGKTLEEVENIFTKGDVPYVGTPAWRTRVDYRKAAHLEQTGVRDEEDKQAAEHISTTRKGD

SEQ ID NO: 55047 - protein, 264 aa, Pyrococcus abyssi GE5
MKVYGLIGKPVSHSLSPVMHNALFRKYGIDAVYVTFEVEELGKAIDGVRALGISGLNVTMPYKEVVTKFLDELSEDAREINSVNTIINLEGSLIGYTTDGVGARKALERFTEIEGRNVLILGAGGAGKAIAYELSKIANIVVLNRTPSKAKSLEKFGVKGGSLDELPNYVGWADVLINATSVGMGTNESLVPRRLLRRELIVMDIVYKPLKTRLLRDAESVGCRVIDGLWMLIYQGAESFKLWTGIYPDVELMRRVSLERLGKG

SEQ ID NO: 55048 - protein, 223 aa, Glycine max
MAALLARQAAMALRARQTARLGPSATAMQGHLRTYMDAGAPKRFKEDEEKEQLAKELAKDWSAVFERSINTLFLTEMVRGLMLTLKYFFERKVTINYPFEKGPLSPRFRGEHALRRYDTGEERCIACKLCEAICPAQAITIEAEEREDGSRRTTRYDIDMTKCIYCGFCQEACPVDAIVEGPNFEFSTETHEELLYDKEKLLENGDRWETEIAENLKSEALYR

SEQ ID NO: 55049 - protein, 406 aa, Zea mays
MSDQALFSNKRAPHDKPRAAVGRRRIQTESRRRHHYYHPRPNELLPTPTPAQSDPRTTPCARAASRPSSPARRAARAAARISPSPCPSARSPPPSPSRSLSRQPPPPPGGPPRRASPRPPPRRSSSSSRPPLAELERVRRVGSGAGGTVWMVRHRGTGRPYALKVLYGNHDDAVRRQIAREIAILRTAEHPAVVRCHGMYERGGELQILLEYMDGGSLDGRRIAAEPFLADVGRQVLSGIAYLHRRHIVHRDIKPSNLLIDSARRVKIADFGVGRILNQTMDPCNSSVGTIAYMSPERINTDLNDGSYDGYAGDIWSFGLSILEFYLGRFPFGENLGRQGDWAALMCAICYNDPPEPPPTASREFRGFIACCLQKNPAKRLTAAQLLQHPFVAGPHPQPLAAPPPS

SEQ ID NO: 55050 - protein, 276 aa, Burkholderia thailandensis E264
MNGADSKRATPCGRLVADFRGRAALVTGGAQGIGAAIAGAFAAAGASVAIADLQGDAAAALAARLAARGTADGQTVRGYRVDAARRDELFALVEQAEADSGRLDIVVHNAAYFPLTPFDAIAPDVLERTLAVNLSALFWLTQAALPAFERAGRGRVLATSSVTGPRVAYPGLAHYAASKAGVNGFIRAAALELARRNVTVNGVEPGMIRTPAAGNLGDAAHGERIARGVPLGRLGEPEEIAAAMLFLASDAAGYITGQTIVVDGGATLPETTAATG

SEQ ID NO: 55051 - protein, 89 aa, Glycine max
INIWLTNNFPEAEASYCKGATEANIQELENVLKVKLPLPSRILYRFHNGQEIAKADPETTTYGSSLGLIGGYSFYSHLVNVYLLPIRQI

SEQ ID NO: 55052 - protein, 521 aa, Triticum turgidum
MMVERWAGFGSAAATVIFLWPVVQKYVPPTFRLYLTAWAAKLAACFNPYLQITISEYGAERFQRSDFFLAVEAYLSDACARRARKLKAELVKDSKNLRVTVDDHEEVTDDFSGTTIWWYASKRQSKANVISIYPGEDERRFYQVVFHRRHRDLVVDSYLPFVLGEGRAVTVKNRQRRLFTNNASRNWNPYRSKSVWSHVAFEHPATFDTLAMHPDEKEAIVDDLMAFQESKDYYAKVGKAWKRGYLLYGPPGTGKSTMIAAMANFLDYDVYDLELTAVKNNTELRKLFIETTGKSIIVIEDIDCSIDLTGKRRKDKKASSDKDSDDDDKPKLPMDPEKDDATKVTLSGLLNFIDGLWSACGGERIIIFTTNHKEKLDPALIRRGRMDKHIEMSYCRFEGFKVLAKNYLDVIKHELFGEIQQLLEETNMSPADVAENLMPMSKKKKRDPDLCLSGLVKALKQAKEDAAAAAAKAKEEEEAKEAEAKKVKEKEEAEVKKVNEENKGKDKAPKEANGDIKEGDK

SEQ ID NO: 55053 - protein, 575 aa, Camptotheca acuminata
MDVRRRHHLKSLRPEKTSTAGEPLKPHLHHSPSDALPLPLYLTNGVFFALFFTVVYFLLHRWREKIRTSTPLHIVTLSELAAVVSLFASLIYLLGFFGIDFVQSFISRSSHDAWDLEDDTTEHLIIKEDSHRGPCVAAIVPMANPKSVPVVEETITTMPEEDEEMIKSVVAGRIPSYSLETRLGDCKRAAAIRREALQRLTGKSLEGLPLEGFDYETILGQCCEMPVGYVQIPVGIVGPLLLDGREYSVPMATTEGCLVASTNRGCKAIYASGGATSILLRDGMTRAPVVRFSTAKRAAELKFFLEDPMNFDTLAVVFNKSSRFGRLQGIKCAIAGKNLYMRFTCSTGDAMGMNMISKGVQNVLDFLQNDFPDMDVLGISGNFCSDKKPAACNWIEGRGKSVVCEAIIKEEVVRKVLKTNVAALVELNMLKNLTGSAMAGALGGFNSHASNIVSAVYIATGQDPAQNVESSHCITMMEAVNDGKDLHISVTMPSIEVGTVGGTQLASQAACLLLLGVKGANKESPGSNSRLLATIVAGSVLAGELSVMSAIAAGHLVMSHMKYNRSSRDVTKVSS

SEQ ID NO: 55054 - protein, 209 aa, Prochlorococcus marinus str. MIT 9313
MGIMTSLRQGDVHRVTAETDVLVRVGLDGCGQCNVSTGVAFLDHMLHQLSSHGLLDLEITATGDTHIDDHHTNEDVGIAVGQALSQALGDRRGIHRFGHFVAPLDEALVQVVLDCSGRPHLSYGLQIPAERIGSYDSELVKEFFVAVVNNSGLTLHIRQLAGTNSHHIVEACFKAFARALRMAIEIDPRRAGAVPSSKGVLEQAGGQKS

SEQ ID NO: 55055 - protein, 589 aa, Camptotheca acuminata
MDVRRRPTKSLRPAKTAAAGEPLKPHHQNHSSLKASDALPLPLYLTNGVFFTLFFSVAYFLLHRWREKIRTSTPLHIVTVSELAALISLIASVIYLLGFFGIDFVQSFITRASHDSWDVEYDNDDRFILEEDSRPGPCAAAIDRSLVPPQVAAVAPPKPKVVEDPVPVIAPTSEEDEEIIKSVVAGTTPSYSLESRLGNCKRAAAIRREALQRLTGKSLAGLPLDGFDYESILGQCCEMAVGYVQMAVGIAGPLLLDGREYLVPMATTEGCLVASTNRGCKAIYASGGATSVILRDGMTRAPVVRFGTAKMSAELKFFLEDPRNFDTLAVVFNKSSRFGRFQGIHCALAGQNLYMRFSCSTGDAMGMNMVSKGVQNVLDFLQNDFSDMDVIGISGNFCSDKKPAAVNWIEGRGKSVVCESIIKEEVVRKVLKTNVASLVELNMLKNLTGSAMAGALGGFNAHASNIVSAVYIATGQDPAQNVESSHCITMMEAVNDGKDLHVSVSMPSIEVIVGGGTQLASQSACLNLLGVKGASKESPGSNSRLLATIVAGSVLAGELSLMSAIAAGQLVKSHMKYNRSSKDITKVSS

SEQ ID NO: 55056 - protein, 369 aa, Zea mays
MERRLSATSRRSAPSAIQRLSHLAQRVGAVNLAEGFPDFPAPPHVKAAAVAAIAADLNQYRHVQGICDILANTMKRDHDLDVDPLTDFVICCGQSEAFAAAIFAIIDQGDEVLIFDPAYETYETSIELARGVPVYVPLDPPSWTLNEEKFLKSFTSRTKALVLNSPHNPTGKVFSKEELLIISQACQKMDCFVITDEVYEYITYDANKHISLASLPGMQERTIITSSLSKTYSVTAASIASAIRNIHIKLTDSAPAPFQEAALIALTSTADYYISLRKDYEVKRDFILLLLKDLGFKISVKPQGSVFVFAELPRSCQLSDDFQVGCYRNRPNSAQLKFSYLLAKQPLKTSFASFSPQQPASCSGKLGVH

SEQ ID NO: 55057 - protein, 498 aa, Rhodococcus sp. RHA1
MPDPTTLDDWTRLAATITPRRELFIDGAFRPAKSDETFDSINPATGELLARVAAADAPDVDAAVRSAREAFDSGVWSRSPASHRKRVLLRLAELILEHRHELALLDSLDMGKLVVEALTVDVPSAADLFRFYAEALDKIGGEIAPTDPGSLALVSREPLGVVGAVVPWNFPLDLAVWKLAPALAAGNSVVLKPAEQAPLSVLRLAELAAEAGLPDGVLGVVPGFGATAGAALGLHPDLDVLAFTGSTATGKRFLRYAADSNLKQVWLECGGKSPNLVFADADLDEAVEKAVFGAFYNQGAVCSANSRLLVEESVAEQVTEALVRRASSIRPGNPLDPASTLGAIVDENHARTVTGFIDRARSEGRVLLGGNKTTVDARGSFVEPTIFADVAPTAEVVTREVFGPVLTVQTFTDEAEAVRMGNDSIYGLAASVWTENLNRAHRVSAALRAGTVSVNTVDAISAQTPFGGFKQSGFGRDLSLHATDKYTGLKTTWIRLRQ

SEQ ID NO: 55058 - protein, 449 aa, Haemophilus influenzae R2866
MSKVASLDAFLTKVAQRDGYQPEFLQAVREVFTSIWPFLEANPKYRSEALLERLVEPERAFQFRVAWTDDKGQVQVNRAFRVQFNSAIGPFKGGMRFHPSVNLSILKFLGFEQIFKNALTTLPMGGAKGGSDFDPKGKSDAEVMRFCQALMTELYRHVGADTDVPAGDIGVGGREVGYLAGYMKKLSNQSACVFTGRGLSFGGSLIRPEATGYGLIYFAQAMLAEKGDSFAGKVVSVSGSGNVAQYAIEKALSLGAKVVTCSDSSGYVYDPNGFTTEKLAALFDIKNTKRGRVKDYAEQFGLQYFEGKRPWEVQVDIALPCATQNELELSDAQRLIKNGVKLVAEGANMPTTIEATEALLAADVLFGPGKAANAGGVATSGLEMAQSSQRLYWTAEEVDAQLHRIMLDIHANCKKYGTIEGQENINYVVGANVAGFVKVADAMLAQGVY

SEQ ID NO: 55059 - protein, 475 aa, Streptococcus mutans
MTKQYKNYVNGEWKLSENEIKIYEPASGAELGSVPAMSTEEVDYVYASAKKAQPAWRALSYIERAAYLHKVADILMRDKEKIGAILSKEVAKGYKSAVSEVVRTAEIINYAAEEGLRMEGEVLEGGSFEAASKKKIAVVRREPVGLVLAISPFNYPVNLAGSKIAPALIAGNVIAFKPPTQGSISGLLLAEAFAEAGLPAGVFNTITGRGSEIGDYIVEHQAVNFINFTGSTGIGERIGKMAGMRPIMLALGGKDSAIVLEDADLELTAKNIIAGAFGYSGQRCTAVKRVLVMESVADELVEKIREKVLALTIGNPEDDADITPLIDTKSADYVEGLINDANDKGATALTEIKREGNLICPILFDKVTTDMRLAWEEPFGPVLPIIRVTSVEEAIEISNKSEYGLQASIFTNDFPRAFGIAEQLEVGTVHINNKTQRGTDNFPFLGAKKSGAGIQGVKYSIEAMTTVKSVVFDIK

SEQ ID NO: 55060 - protein, 328 aa, Rhodococcus sp. RHA1
MLPVIDFAELDTPAGRERLREITHHVGFFYLDGHGVDRELLDRVFTVAREFFALPDDSKQSIAMLNSPHFRGYNRVGDELTNGETDWREQIDIGPERQPIPGADGYLRLQGPNQWPADLPDLEKTIEALDAALADVGMRLLRHWAASLDADPAIFDDAFAHAPATLIKVVRYPERPSADHTGEQGVGAHKDSGVLTMLLLEPGSSGLQVETETGDWIDAPARAGSFVVNIGELLEVATGGYLRATRHRVLTPAGAPERLSVPYFLNPALDATVPTIELPPHLAERARGIELDPANPLYRTYGENAWKSRTRAHPDVYARWYPDEAEPE

SEQ ID NO: 55061 - protein, 919 aa, Synechococcus elongatus PCC 7942
MSEAEWVTIEGSPSILDVLVSQTETAFSLDVATLFPFELDDFQKEAIAALDQGRSVVVCAPTGSGKTLIGEYAIYRALARGKRVFYTTPLKALSNQKLRDFREQFGSDRVGLLTGDTSIARDAPIVVMTTEIFRNMLYGTRIGEVGTSMIDVETVVLDECHYMNDQQRGTVWEESIIYCPPTVQLVALSATVANGGQLTDWIDQVHGPTDLIYSDYRPIPLAFSFCGNNGLFPLLDETGKSIHPSFKVRRKTKGAKHDRKGREIPEIPSLGFVVGQLQQRQMLPAIYFIFSRRGCDKAVRDLGPISLVNADEAARLKQRVNAFLAQSPEAARSGHVEPLLRGIASHHAGVLPAWKGLIEELFQEGLVKVVFATETLAAGINMPARTTVIASLSKRTDSGHRLLLPSEFLQMSGRAGRRGLDDQGYVVTVQSRFEGSQEAAHLATVGPDPLVSQFTPSYGMVLNLLQKHSLEEAKELVERSFGRYLASLSLKPEQEKIAAIAAERDRLQAELADVDFATLAEYDKLYGRLKEEKRLLKILHEQAEEVVHRDLAMALSFAVAGTILSLKGRHVPVPEPLPAVLIAKIPGSGQFPWLLCLGMDNRWVVATTSDVVGLHAELARISAVDFLHPPAQLHKPGQHHKGDEATAWIAEKLWELSQRHHLALAGSDLAEEVVQQAEQVEAVNTLLINHPVHCWQNRKRLHKRQQQLQALEDEIGDRRARLEKLGQRHWQEFLSLMSILENFSCLEDLKPTEMGQNVAALRGDNELWLGLVLMSGELDGLTPAEFAAASEALVTEVSRPDLWTRFDVPPAVEDALMGVRGLRRQLQQQQSRRNVFTPIWLELDLTGLVKAWAEGMEWNELCAATSLDEGDIVRVLRRTIDFLAQIPHMPYLQGGVKNTASTALGLINRFPVKDMEDEA

SEQ ID NO: 55062 - protein, 507 aa, Salmonella enterica subsp. enterica serovar Paratyphi A str.
MVLVILDGYGYREEQQDNAILNAKTPVMDALWAKRPHTLIDASGLEVGLPDRQMGNSEVGHVNLGAGRIVYQDLTRLDVEIKERTFFANPVLTNAVDQAKNAGKAVHIMGLLSAGGVHSHEDHIMAMVELAAERGAEKIYLHAFLDGRDTPPRSAEASLKKFEDKFAALGKGRVASIVGRYYAMDRDNRWDRVEKAYDLMTLAQGEFQADTAVAGLQAAYARDENDEFVKATVIRAEGQADAAMEDGDTLIFMNFRADRAREITRAFVNADFDGFARKKVVNLNFVMLTEYAADIKTAVAYPPASLANTFGEWMAKNDKTQLRISETEKYAHVTFFFNGGVEEPFAGEERILINSPKVATYDLQPEMSSAELTEKLVAAIESGKYDTIICNYPNGDMVGHTGVMEAAIKAVEALDNCIEQVTKAVESVGGQLLITADHGNAEQMRDPATGQAHTAHTNLPVPLIYVGEKNVKAVEGGKLSDIAPTMLSLMGMEIPQEMTGKPLFIVE

SEQ ID NO: 55063 - protein, 389 aa, Azoarcus sp. EbN1
MLAGLIDLPWWGYILVALGLTHVTIASVTIFLHRHQAHRALELHPIASHFFRAWLWLTTGMVTKEWAAVHRKHHAKCETADDPHSPQVLGIRKVLFEGAELYRAEAGNKETLARYGHGTPDDWLERHIYRHSIVGISIMLITDLVLFGPLGLTIWAVQMMWIPIWAAGVVNGLGHYIGYRNFDCSDAATNLVPWGILIGGEELHNNHHSFATSAKLSAKWYEFDIGWMYIRMLALLGLAKVRKVIPSPKFGEAKNVPDLDTLQAIITHRYDVMTRYVASLKRLCGDEIERLAATHGRSFNPRALRRWVLSGEDRNLAPDDRRTLELVIVDSAALSTIASMRRDLVAIWGRSTASREQLLKQLHDWIARAEQSGIAQLQEFSFRLRQYTA

SEQ ID NO: 55064 - protein, 206 aa, Prunus persica
HGTEVAVKILMEQDFHAERFKEFLREVTIMKRLRHPNIVLFMGAVTKPPNLSIVTEYLSRGSLYRLLHKPGATEALDEKRRLNMAYDVAKGMNYLHRRNPPIVHRDLKSPNLLVDKKYTVKVCDFGLSRLKANTFLSSKSAAGTPEWMAPEVLRDEPSNEKSDVYSFGVILWELATLQQPWGNLNPAQVVAAVGFKNKRLEIPRDL

SEQ ID NO: 55065 - protein, 467 aa, Triticum aestivum
  misc_feature (124)..(124): Xaa can be any naturally occurring amino acid
  unsure (1)..(467): unsure at all Xaa locations
MERKSAILMNRYELGRMLGQGTFAKVYHARSLATNQSVAIKVIDKEKVLRVGMIDQIKREISIMRLVRHPNIVQLHEVMASKTKIYFAMEYVRGGELFARVAKGRLKEDAARKYFQQLIGAVDXFCHSRDVYHRDLKPENLLVDEHGNLKVSDFGLSALKECQKQDGLLHTTCGTPAYVAPEIINKKGYDGEKADIWSCGVILFVLLAGYLPFQDSNLMEMYRKISKGDVRHPQWFSSDARKILSRLLDPNPNTRITMDKLIEHPWFKKGYKPAVTLGTPTPRASKDLNDVQAAFSTDHKDGEGNRAEQPNGPLKPASLNAFDIISLSKGFDLSGLFEKDQEQKSNSRFMTQKPASAIVSKLEQIAETESFKVKKQDGLVTLQGSKEGRKGQLAIDAEIFEVTPSFYVVEVKKSAGDTLEYERFCKMGLRPSLKDICWNGPSEEKLPSVSESVPPTPSSKSTKRNVI

SEQ ID NO: 55066 - protein, 322 aa, Paenibacillus macquariensis
MTIKKIAVLTSGGDSQGMNAAVRAVVRSGLFYGLEVYGIQRGYQGLLNDDIFSMDLRSVGDIIQRGGTVLQSARCKEFMTPEGQQKGADILRKRGIDGLVVIGGDGSYHGANKLSKLGINTMALPGTIDNDISYTDFTIGFDTSVSIVVDAINKLRDTMSSHERSSIVEVMGRHCGDIALYAGLASGAETIIVPEVPFDMDEIAERMKQNFAHGKRHSIVVVAEGAGNGENVAKQLVERCETLEPRVTVLGHIQRGGTPTPADRNLASRLGDFAVRMLIAGESAKACGIISNELVLTDIDKVVNSKKEFNMELYELAARLSQ

SEQ ID NO: 55067 - protein, 229 aa, Oryza sativa (japonica cultivar-group)
MESAPASRVRREDVARAVAALLRWLQHQPTPAPEPIYLLVTLKRAPARRFEHTLRLPRSPFPSISLVSDRLPADLPDDIDPGPPRRPRAKPAAKAARVVPVDLADQAWAESAREAARRVELRVEGGTCRAVRVGHAAMAREEAVENVVAAVEAAAACVPRKWRNVRALHVKAPESVALPLYSAVGTGGGDDGGNGEAEDAKRKGVAVKEQGIVKRRKKSSSVSVGGDQL

SEQ ID NO: 55068 - protein, 512 aa, Burkholderia mallei ATCC 23344
MDKTKQPPRAAKRCCRATLLAAAAFACCCGSYAAAQEAASAAPSTTTQPRDEAPLSAPLQVVQDAISAGTADVSANASADADVAMPLAEVAPPCSAPGACGAELRLAGGMGGNGEGAGAGGIGSGGDNAGSGRGSSGGANDGNGAIGAAGIGVGGTTGSTAGGTAATGRGNSVGNASGGGTSGGGASGHGTSGRGAAGGGASSGGASGGGTSGGGASSGGASGGGASGGGASGGGASGGGASGGGASGGGASGGGASGGGASGGGASGGGASGGGASGGGTSGGGASGGGASGGGASGGGASGGGTSGGGTSGGGASGGGTSGGGTSGGGTSGGGTSGGGTSGGGTSGGGTSGGGTSSGAGHGGHGGGTGGGGNSGGHGNGNGGGASGGSGSGNGHGSGNGGGNGNGGGGGNGGGSGNGTGNGGNNGGGHGNGSSGGGTSGGNGHGNGGGTSSGSGNGGGNGNGSGHGNGGHGNGGGHGNGNGSGGAGNGGANGVGSGNGGHGNGGGHGNGR

SEQ ID NO: 55069 - protein, 317 aa, Burkholderia mallei ATCC 23344
MTTALDQLKQYTTVVADTGDFQQLAQYKPQDATTNPSLILKAVQKDAYRPILEKTVRDHAGESVGFIIDRLLIAFGTEILKLIPGRVSTEVDARLSFDTQRSIDKGREIIKLYEAAGVGRERVLIKLASTWEGIRAAEVLQREGIRCNMTLLFSLVQAAACAEAGAQLISPFVGRIYDWYRKQKGADWDEAQDGGANDPGVQSVRRIYTYYKHFGYRTEVMGASFRTTSQITELAGCDLLTISPELLQKLHDSTEAVARKLSPDEARDARLERVAIDESSFRFQLNDDAMATEKLAEGIRLFSADAVKLEKMIEALR

SEQ ID NO: 55070 - protein, 220 aa, Yersinia pestis CO92
MTDKSTARKKITRIGIGGPVGSGKTAIIEVITPILIKRGIKPLIITNDIVTTEDAKQVKRTLKGILDEEKILGVETGACPHTAVREDPSMNIAAVEEMEERFPESDLIMIESGGDNLTLTFSPALADFYIYVIDVAEGEKIPRKNGPGLVQADILVINKIDLAPYVGASLDVMESDTKVVRGNRPYILTNCKTGQGIEELVDMIMRDFLFTHVQPEGEQA

SEQ ID NO: 55071 - protein, 1165 aa, Streptococcus pyogenes
MKKKVNQGSKRYQYLLKKWGIGFVIAATGTVMLGCIPSILTHQVAAKTIVGLARDEAQQGDGNAKSGDGFQSSSKEAKPVLDSSSANPASIAEHHLRMHFKTLPAGESLGSLGLWVWGDVDQPSKDWPNGAITMTKAKKDDYGYYLDVPLAAKHRQQVSYLINNKAGENLSKDQHIPLLTPKMNEVWIDENYHAHAYRPLKKGYLRINYHNQSGHYDNLAVWTFKDVKTPTTDWPNGLDLSHKGPYGAYVDVPLKEGANEIGFLILDKSKTGDAIKVQPKDYLFKELDNHTQVFVKDTDPKVYNNPYYIDQVSLKGAEQTTPNEIKAIFTTLDGLDEDAVKQNIKITDKAGKTVAIDELTLDKDKSVMTLKGDFKAQGAVYTVTFGEVSQVARQSWQLKDKLYAYDGELGATLAKDGSVDLALWSPSADSVKVVVYDKQDQTKVVGQADLTKSDKGVWRAHLTSDSVKGISDYTGYYYLYEITRGQEKVMVLDPYAKSLAAWNDATATDDIKTAKAAFIDPSKLGPTGLDFAKINNFKKREDAIIYEAHVRDFTSDKALEGKLTHPFGTFSAFVEQLDYLKDLGVTHVQLLPVLSYFYANELDKTRSTAYTSSDNNYNWGYDPQHYFALSGMYSANPNDPALRIAELKNLVNEIHKRGMGVIFDVVYNHTARTYLFEDLEPNYYHFMNADGTARESFGGGRLGTTHAMSRRILVDSITYLTREFKVDGFRFDMMGDHDAAAIEQAFKAAKAINPNTIMIGEGWRTYQGDEGKKEIAADQDWMKATNTVGVFSDDIRNTLKSGFPNEGTAAFITGGAKNLEGLFKTIKAQPSNFEADAPGDVVQYIAAHDNLTLHDVIAKSINKDPKVAEEEIHKRIRLGNTMILTAQGTAFIHSGQEYGRTKQLLNPDYKTKVSDDKVPNKATLIDAVAQYPYFIHDSYDSSDAVNHFDWAKATDSIAHPISNQTKAYTQGLIALRRSTDAFTKATKAEVDRDVTLITQAGQDGIQQEDLIMGYQTVASNGDRYAVFVNADNKTRKVVLPQAYRYLLGAQVLADAEQVGVTAIAKPKGVQFTKEGLTIDGLTALVLKVSSKTANPSQQKSQTDNHQTKTPDGSKDLDKSLMTRPKRAKTNQKLPKTGEAPSKGLLAAGVALLLLAISLLMKRQKD

SEQ ID NO: 55072 - protein, 352 aa, Oryza sativa (japonica cultivar-group)
MRRLDLPARDLRLLEPVFVLPFAILGRERAVVCNLERIRCIITADEALILRDPDVAGEGAETEEAVRRYVAELQRRLVDRADDLPFEFIALEVALEAACSFLDAQAVELEADAYPLLDELTTKISTLNLERVRRLKSKLVALTRRVQKVRDEIEQLMDDDGDMAEMYLTEKKRRMEASLLEEQAFQGMGNSGFGSSFSAPVSPVSSPPASRRLEKELSFARSRHDSFKSADSSQYSIEELEMLLEAYFVVIDYTLSKLTSLKEYIDDTEDFINIQLDNVRNQLIQFELLLTTATFVVAIFGVVSGVFGMNFEVDLFNVPHAFEWTLVITGVCGLVIFCCFIWYFKKRRFFPL

SEQ ID NO: 55073 - protein, 826 aa, Pisum sativum
MTPLLKGTVVLVQKNSLHFNAHSAAQKFGGFIESVIDAPDDIDDSILDTVDSFLSNSVALRLISASNSNENGQGKVGKQTFLEGVLTSIPTLEDKQTAFNILFEWDHNMGIPGAFYIENFKQDEFFLVSLTLEDVPKHGNLNFVCNSWVYNVEKYKTDRIFFTNKTYIPNETPFPLVYYIHEELKTLRGDGTGERQVWERIYDYDVYNDLGEPDKDDTLARPTLGGSSTLPYPRRGRTGRKPTEKDPKSESRSGYFYIPRDELLGHVESSDFLVDVFKLVSQNVIPQIRSVDQPEFNTFEDVLSLFYGESSNFSVPKVIQVDHSAWMTDEEFAREMIAGVNPNVIEKLSEFPPESKVDRQLYGDNTTTITKEQLEANMDGVNVEQAIQNNRLYILDHYDSLFPFLRKINATGAKAYATRTILFLQDDGTLKPLAIELSIPHPKGDIFGPVSKVYLPATEGVEASIWLLAKAYVVVNDSCYHQLISHWLHTHAVVEPFIIATKRHLSVVHPIHKLLLPHYRNIMNINAGARNTLISAAGIIESTYLLGKYTMEMSAVVYKDWVFTQAGLPTDLIKRGVAVEDPSSPYGLRLLIEDYPYAVDGLEIWAAIKSWVEEYVNFYYKSDATIVHDSQLQAFWKEVVEVGHGDLKNATWWFKMQTRAELIEACSILIWIASTLHASVNFGQYPYGGYIVNRPTKSRRFMPEEGSPEYEELAKDYEKAYLSTITPKNETLLNMTVMEVLSTHVSDEQYLGHRIEGDLWTSDSQPIEAYKRFGSKLAEIEKKLIERNNDETLRNRYGPVKMPYTILYPSSEAGLTFRGIPNSISI

SEQ ID NO: 55074 - protein, 122 aa, Gloeobacter violaceus PCC 7421
MTLFVGNLPFSATEQEIVEAFTEYGEVKSVKIPMDRETGRPRGFAFVDLESETAEQAAIDDLDGATWNNREIRVNKAEPRPDRRAGGGGGGGNRSGGGGGGYRGSGGGGGGAGGGGGRDRRY

SEQ ID NO: 55075 - protein, 496 aa, Coccidioides immitis RS
MAKRGVEETDALSGALKAGERPMPDAPPNEMGEFEDEFEDEFESEDEIFEAGVDGRPDAEREEEERDAMDVDKQTFIPGRTKLAPGETLSPDPSTYDMLHTLTTPWPCLSFDIVRDNLGDNRKTYPATVYAVAGTQADRPRSKENQLMVLKLSGLSRMERERGEESDAESDSDDDSPSEPILESKSIVLNSTTNRIRAHQTPHSSNDPTKAPQTLTASMLENSQILIHDVSPYLASFDNPGLVIPPSASKPLSTLRMHKSEGYALDWSPLYPLGKLLTGDNDGAIYVTTRSEGGGWITDTRPFTGHTSSVEEIQWSPNERNVFASASSDGSVKVWDVRSKSRKPAVDVKISNTDVNVMSWSKQTFHLLATGADDGQWAVWDLRNWKPDNNKPSQLRPQSVACFNFHQEPITSIEWHPTDDSVVAVASADNTLTLWDLAVELDDEEVRDAGLADVPPQLLFVHCMEMVKELHWQGQMPGTLMATGSDGFGVFKTISV

SEQ ID NO: 55076 - protein, 921 aa, Oryza sativa (indica cultivar-group)
MEEGAMDGAGGGVAEEGCSGEEREGVADVAVGGGGGEGEREGRTLVVGVRADAASRTLLTWTFINVAAPGDRIVAVHVVLASAPVAAATTAVDFDTMLAVYEGFCNLKQINLKLKICKDSSVRKALVREANLFGASKVIVGIAKKKRGISSLHSVAKYCSKKLPAKCAVLAVDSGKIVFRRESNVHSGKVSAEIPGCGDNELYCEVPFLARQCKEEPLPLHEPPRDGGGSAGEEEEEHDVGTKETEPVNAVSGEQQPSGVDPAELSPDQVQGDVDPSDKGEESTADQKDEISELPGEGASVLYCVLPERNGHSAASTSSRQSNDSTEPPTEGNGELYCILPPRNDHSGRSSGDSSRSTASRKHDDSASLSAEGDGELYCRLPRTGHSGRSSGGSKRSFGAKGLIRRSSSFSSDIQKDVSVCTTTTEQTSSMVSTEAEDSPKNAARDVDTPSSSPMSLRRMIEGRPDRCRLRRRIFNHQRSSSFEWAKISMVQWAMRLPSRYTSVADNKSFKSDASPRLNCDSECESTSAVDTESMFSFSLYDISWPPNEVESLQEKYSSTCRLFTYEELKLATSNFSPDMLIGKGGTSQVFKAQLFDGTLSAVKILKPSVDAIQEFVTEVEIATSLQHDNIVSLRGFSSDNYSLVLVYDYMLQGSLDKALHGKHDSKDSLSWEKRNKIAIGIAMALEYLHHGSVTQSVIHGDVKSSNILLSEDFQAQLCDFGLAKQVSASTPHLTCTDITGTFGYLAPEYFSHGKVNEKIDVYAFGVVILEIISGRRPIRTGCSKGQESLVGWAKPLLSSGEIKQLVDPFLGNDYDCDEMERMTLAASLCTRTSSHSRPEMSQMLKLLEGDDETIHWARTQVTASFDGSDEEAVAAPDSNMQSHLNLALLGVEDDTLSHCSTEQTMDTSADGYWSRSSSFD

SEQ ID NO: 55077 - protein, 427 aa, Azoarcus sp. EbN1
MSKHDEAASRSLLIHAARVLGMVLTFEHPADVVLSRYFRENREIGHRDRGFIAEAVYGIVRRLRWLRRLVGEDVRPRTLLLAWLARGEGWPMRHFEGLASATERDWISGIKARELDEGSFAERADLPDWLAERLLATHGEAEVLELAHSLNRPAPLDLRVNVLKADRGEVLEKLKFAGIEAKPCPFSPHGIRLGAKPALQKHPLFLEGAFEVQDEGSQLLGFLVQPKRGELVVDFCAGAGGKTLQLGAMMRSTGRLYAFDVSEKRLAKLKPRVARAGLSNVHPVLIAHERDAKVKRLAGKADRVFVDAPCSGLGTLRRNPDLKWRQTPESVAEMVAKQGAILESAARLVKPAGRLVYATCSLLVEENDAVVDAFLAAHPEFREIDATEVLKKQGIALDTGARLRLSPRKHDTDGFFAAVLERAPADA

SEQ ID NO: 55078 - protein, 458 aa, Glycine max
  misc_feature (41)..(41): Xaa can be any naturally occurring amino acid
  misc_feature (103)..(103): Xaa can be any naturally occurring amino acid
  misc_feature (255)..(255): Xaa can be any naturally occurring amino acid
  misc_feature (445)..(445): Xaa can be any naturally occurring amino acid
  unsure (1)..(458): unsure at all Xaa locations
MDSACATLNGRHLAKVSEGIGRNRTSGFWGESTRGSVNTKXLSVQSCKTSRTNRNLRNSKPGSGIARAVLTSDIDEDSMAFQGVPTFEKPEVDPKSVASIILXGGAGTRLFPLTGRRARVSYVSAPPHRLIDIPMSNCINSGIRKIFILTQFNSFSLNRHLSRAYSFGNGMTFGDGFVLAATQTPGEAGKKWFQGTADAVRQFIWVFEDAKNKNVEHILILSGDHLYRMDYMDFVQRHVDTNADITVSCVPMDDXGRIIQFAEKPKGSDLKAMRVDTTLLGLLPQEAEKRVSYVGPPPHVFRTETLLQLLRWKCSSCNDFGSEIIPSAVNEHNVQAYLFNDYWEDIGTIKSFFDANLALTEQPPKFEFYDPKTPFFTSPRFLPPTKVEKCKIVDAIISHGCFLRECSVQHSIVGVRSRLESGVELQDTMMMGADYYQTEYEIASXVAEGKVPIGVGAN

SEQ ID NO: 55079 - protein, 619 aa, Exophiala dermatitidis
MFNATQHRGNPNMGPAPPGQPNHRLNEIMDSLRAEFENQSRASEQVENQVAQQIQEMELIRNKVYQLEQNQLKMKQEYEAEIRMLRHELELRGGPQVQSHLTGPPQHGGPAQAPPSLGHGQGGLFSGIMANQGQGGPGLAPPPEQPPQQQQHPLQPPPAAGQPQGPPQPPNSFPGYQQGPTLNGYAPQPQPPTNSPGLGKNRTMAARGGPGPATPQQHPNQPQPMPYQNDRGRHPRIPRPVPPGGDMQHGHRHQMPGLPNVGNVLADLNPDDLPEHLKRTGPNGEWHAVFNPNVPRTLDIQLLHNLVHESVVCCVRFSNDGKYVATGCNRSAQIFDARDGRKVCELLDESVQDKDGDLYIRSVCFSPDGKLLATGAEDKRIRVWDIENKRIRTTFDGHEQDIYSLDFSRTGRLIASGSGDKTVRLWDIESNQQVMVLSIEDGVTTVAMSPDGRFVAAGSLDKSVRVWDCSTGYLIERLEGPQGHKDSVYSVAFSPSGRELVSGSLDKTIKMWELTPQRNLIPSTAKDGKCIRTFEGHKDYVLSVCLTPGGEWVMSGSKDRGVQFWDPTTGNAQMMLQGHKNSVISVAPCPTGQLFATGSGDMKARIWQYTTWRGAHQGI

SEQ ID NO: 55080 - protein, 826 aa, Pisum sativum
MTPLLKGTVVLVQKNSLHFNAHSAAQKFGGFIESVIDAPDDIDDSILDTVDSFLSNSVALRLISASNSNENGQGKVGKQTFLEGVLTSIPTLEDKQTAFNILFEWDHNMGIPGAFYIENFKQDEFFLVSLTLEDVPKHGNLNFVCNSWVYNVEKYKTDRIFFTNKTYIPNETPFPLVYYIHEELKTLRGDGTGERQVWERIYDYDVYNDLGEPDKDDTLARPTLGGSSTLPYPRRGRTGRKPTEKDPKSESRSGYFYIPRDELLGHVESSDFLVDVFKLVSQNVIPQIRSVDQPEFNTFEDVLSLFYGESSNFSVPKVIQVDHSAWMTDEEFAREMIAGVNPNVIEKLSEFPPESKVDRQLYGDNTTTITKEQLEANMDGVNVEQAIQNNRLYILDHYDSLFPFLRKINATGAKAYATRTILFLQDDGTLKPLAIELSIPHPKGDIFGPVSKVYLPATEGVEASIWLLAKAYVVVNDSCYHQLISHWLHTHAVVEPFIIATKRHLSVVHPIHKLLLPHYRNTMNINAGARNTLISAAGIIESTYLLGKYTMEMSAVVYKDWVFTQAGLPTDLIKRGVAVEDPSSPYGLRLLIEDYPYAVDGLEIWAAIKSWVEEYVNFYYKSDATIVHDSQLQAFWKEVVEVGHGDLKNATWWFKMQTRAELIEACSILIWIASTLHASVNFGQYPYGGYIVNRPTKSRRFMPEEGSPEYEELAKDYEKAYLSTITPKNETLLNMTVMEVLSTHVSDEQYLGHRIEGDLWTSDSQPIEAYKRFGSKLAEIEKKLIERNNDETLRNRYGPVKMPYTILYPSSEAGLTFRGIPNSISI

SEQ ID NO: 55081 - protein, 233 aa, Zea mays
  misc_feature (139)..(139): Xaa can be any naturally occurring amino acid
  unsure (1)..(233): unsure at all Xaa locations
MGSKAPFCLTLLLLLAAACGPAAHANDAVLKEHISSTKIPARLKRGSGLCSACENFTSEAVTYLGKEQTQDRIVEFLHDACSQSFSFEQKCVELMDSYATLLFAKITEIRPEAFCKRYGLCRDTALLSGVGSDSTCEKXKHHLLDEIMSKLKDPDAEFEIVQILVKECNKIEGHVQQCKRLVLQYIPLILVNGEKFLEKNDVCALAQACPASSRKTFSSMLKGALWSDAWLEG

SEQ ID NO: 55082 - protein, 544 aa, Sulfolobus solfataricus P2
MVTIVLNKYKLLNKIGIGQQKLEDLLFNLKSEIKPVDESNIEIEINADRLDLLSSDGIARAIKGLLEKELGEAKYDITDTEYKLIVDNVRTRPYALAAVIYNAKIDLQELIQFQEKLHSTIGRKRKKVAIGIHDLKKIDSKRIEYREVPLSYKFIPLYEKEELTISEVLEKTEQGKLYGNISISNGVSPAIVQEDGEVLSIPPIINSDKTKLDESTKDLFIDVTGTSFEAVAQTLDIIVSNLAEAGGTIGRVKVIKTDNSFQQSSPLLIHKIQNVREEYANKILGIKISEEEICKHITRMRMNCNVENGIIRVTVPQYRVDIINEIDIVEDIAMSIGYNNLEPSKYISTNYGSYDYLTLLERKMRELSIGAGFVEVFNFVLIKNEKILDSKYVKILNPISEEYNAVRNSLIPILLDFLSKNQHAKFPIRIFETGDVVIYDSSTDTGFRNDKRAAYAIMDNKVSYEDVQAPIHYILKTLGIEVNYKEENNDIFIEGRSASIVYENEKIGVIGEINPDVLIRFGIEYPTVIAELYITEIAKKLNKR

SEQ ID NO: 55083 - protein, 764 aa, Oryza sativa
  misc_feature (177)..(177): Xaa can be any naturally occurring amino acid
  misc_feature (189)..(189): Xaa can be any naturally occurring amino acid
  misc_feature (408)..(408): Xaa can be any naturally occurring amino acid
  unsure (1)..(764): unsure at all Xaa locations
MASRSSRGERVGVVFVLVVVVLCVDVSTLVAAQPLVSSQAKTLLWVRRLLGFPPALDALAGAPDACALPPTPSLTVACAGGQVTELSVLGGRAPGAALPANFSADALFTTLTRLPALSRLTLASLGVWGELPGAKLHRLQALRVLNLTGNCLYGAVPEHFSRMYSLQSLVLSRNRLXNGAVPNLSGLAXLDELDLGHNRLGPAFPEVGNAVVRLVLADNNFTGRIPAAMSSLGQLQFLDVSGNRLQGWIPSSIFALPALRHIDLSRNQLAGQLPASTACADALAFVDVSDNLLAGARPACMRGNSSARTVLDAGNCFRDARSQRPSTYCNPGALAAVLPPAQGTGGEQGSGGKGGQVGMALGIVGGVAARAALIALVMMAVLRRARRQNPEVSVLPKSPLASTPAKKXAAADGGKAPAKVTQRIVTPAEKRHASQAARVNTLEVPAYRVYTLEELQEATNNFGSSNLIKSSPVVKHYNGQLQDGSRVSLRCLKLKPKYSPQSLTQYMEIISKLRHRHLVSIIGHCIVEDQENPNIASSLCLLSECVTNGSLRSHLTEWRKREMLKWPQRVSAAIGVARGIQFLHDVTAPGIVHNDLSIENILLDKTLTSKISNFNLPLISTSKNGKIFSESPFATSEDNDLGSVPSTEQGDKDDIYQFGLILLEVITGKPTESPKDLDSLKTQISEAIAEDPDLLKDMADPTIRGTFAVESLSTVAEIALNCIASDTSSRPSIEDVLWNLQYSMQVQDGWASSESLSLSTRSQG

SEQ ID NO: 55084 - protein, 422 aa, Pseudomonas aeruginosa UCBPP-PA14
MSDLKTAALEYHAQPRPGKLSVELTKPTATARDLSLAYSPGVAEPVREIARDAELAYQYTGKGNLVAVISDGTAILGLGNLGPLASKPVMEGKGVLFKRFAGIDVFDIEVDAESPQAFIDTVKRISITFGGINLEDIKAPECFEIERALIEQCDIPVFHDDQHGTAIVTAAGMLNALELAGKKLEEAKIVCLGAGAAAISCMKLLVSMGAKVENIYMIDRKGVIHAGRDDLNQYKSVFATETDKRTLADALEGADVFVGLSGANLLEPEDLKRMAPNPIVFACSNPDPEIKPELAHATRNDVIMATGRSDYPNQVNNVLGFPFIFRGALDVRATRINEEMKIAAALALRDLAKQPVPEDVCAAYGVDKLEFGREYIIPKPMDKRLITVVSDAVAKAAIETGVATLPYPKNYPLKSVDEVFNG

SEQ ID NO: 55085 - protein, 436 aa, Listeria monocytogenes EGD-e
MTFERLGTMNVNAEGHLEIGGVDTLKLADKYGTPLYVYDVALIRDRARGFKKTFEELGVKAQVAYASKAFSAVAIYQLMAEEGLSLDVVSGGELFTAIKANFPPERIHFHGNNKSAEEIHMALDYGIGCFVIDNYYEISLLEDILIERNEKASVLIRVTPGIEAHTHDYILTGQDDSKFGFGLTNGQAEKAIKQVLHASASFDLIGLHCHIGSQIFETTGFKLAARRIMDKLVEWHQTLGFDSKVLNLGGGFGVRYTAEDEPLEPSEYVRQIMDEVRDVAESNDIDIPEIWIEPGRSLVGEAGTTLYKVGSRKEVPGIRNYIAVDGGMSDNIRPALYDAHYDAVLAANPEKVAEETVAIAGKCCESGDMLIWDLPLPKSNAGEVLAVFCTGAYGYAMASNYNRIPRPPVVFVENGVDKLIVARETYENLVQNDLSL

SEQ ID NO: 55086 - protein, 141 aa, Zea mays
TKVLLMARTKQTARKSTGGKAPRKQLATKAARKSAPTTGGVKKPHRYRPGTVAPREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 55087 - protein, 219 aa, Oryza sativa (japonica cultivar-group)
MEWAYYGSGYSSSGTPSPVGGDGDEDSYMTVSSAPPKRRAGRTKFKETRHPVYKGVRSRNPGRWVCEVREPHGKQRIWLGTFETAEMAARAHDVAAMALRGRAACLNFADSPRRLRVPPLGAGHEEIRRAAVEAAELFRPAPGQHNAAAEAAAAVAAQATAASAELFADFPCYPMDGLEFEMQGYLDMAQGMLIEPPPLAGQSTWAEEDYDCEVNLWSY

SEQ ID NO: 55088 - protein, 285 aa, Mesembryanthemum crystallinum
FATEKFSMEFSSFVYGKEWRFDHEALPADLISRGMAVEDPSAPHGLKLAIEDYPFANDGLLLWDTMKQWVTDYVNRYYPEPNLVESDQELQAWWDEVRNEGHKDLKDETWWPTLKTPDDLINIVTTIIWVSSGHHAAVNFGQYAYGGYFPNRPTIARKKMPCEDPTEEEWKKFLDNPIDMVLQTFPSQLQALKVMIILNALSNHSPDEEYIGDQIEPSWAEDPTVKTAFDNFNGKLKELEKTIDARNADSKLKNRYGAGTVPYELLKPFSKSGVTGMGVPNSISI

SEQ ID NO: 55089 - protein, 276 aa, Oryza sativa
MAPTVMASSATSVAPFQGLKSTAGLPVSRRSNSADLGSVSNGGRISCMQVWPIEGIPPPISLSLSPPHHHHRRRRAPVAAGERRRAIREMPPLTGPKSGDALFGSVERVNAELFTLTYGAIVRQLLTDLEEVEEVNKQLDQMGYNIGTRLVDEFLAKSNVSRCVDFKETADVIAKLGFKMFLGVTATVTNWDAEGTSCSFVLEDNPLVDFVELPDTCQGLQYCNVLSGVIRGALEMVSMKTEVTWVRDMLRGDDAYEMRVKLTKQVPEEYPYKDDD

SEQ ID NO: 55090 - protein, 520 aa, Oryza sativa (japonica cultivar-group)
MHLIISSIHTYTIMALSLTPSLQDLVSSLMILLVLLYISYWRSKYQSLFPVDWPIVGLLPTLVANLHRLHDKITEYLAASGHSFTGNGPAASNMRLFVTCDPDNVRHIFTTNHDNYPKGHEFAEIFDIMAGAFFTMDGDLYRRQRAKTHSILSDPRMVASMASSCVDKVRDGLLPLLTSMASTRTPFELQDLATRLMFDVTAMTVFGVDPGRLSPDMPSMHVSAAMDTIMEVGLFRHTVPPSCWKAMRRLKIGPERKLAAAHAALHVFVSEMMEKARKQEAAPSSMSMDVLSSYINDPDYVGLLHSILITYMVAGRDTVGTTLPWFFYNLAMNPRVVSGIREELAHNIATSTCNGDGVPVMFSPEDTKSLVYLHAALFETLRLYPPGWIERKTVVADDVMPSGHEVRAGDAVLISIYSMGRMESLWGEDCRVYRPERWLYDSRGGRKMRHVPSHKFLSFNSGPRMCPGKNIAVMQMKIIAAAVVWNFDLEVVEGQAVVPKLSCLLQMKNGVMVKVKKRAV

SEQ ID NO: 55091 - protein, 320 aa, Vibrio fischeri ES114
MVKKIGVLTSGGDAPGMNAAVRGVVRTALTEGLEVFGIHDGYLGLVEDRIEKLERHSVSDMINRGGTFLGSARFPEFKEVAVREKAIENLKKHDIDALIVIGGDGSYMGAKKLTEMGYPCIGLPGTIDNDIAGTDYTIGYLTALNTVIDAIDRLRDTSSSHQRISIVEVMGRHCGDLTLMSAIAGGCEYVITPETGLNKEALIQNIQDGIAKGKKHAIIAITELMTDVNQLAKEIEAETGRETRATVLGHIQRGGQPGAFDRILASRMGNYGVKLLIDGHGGRCVGIQNEQLVHHDIIDAIENMRRPEKLELYKVAEELF

SEQ ID NO: 55092 - protein, 430 aa, Brassica napus
EGNPESKHLPPTRSWIRRLDLIDPYYTCSPLIVRETSIVEPSPFFPSFIHDDEDLAFPLGFPSPSPLDLFESVTDLVKIEKSPSSCKYQLVRRRAEPEYPLQYLCDRVSELEIKFERLVGPKGRDSDRKYKLTKEIKGSGERKYKWEAEIQGPPGRKYKWEAEFEGPGERKYTWTTEIKGGKEDGVAPKKAKAKAKAEAEAEKKMKKKKSYNWTTELKSERENGELQHTYTIKASSGGEKKKKEKPRVVEIEEDEEEHGAILLRKAYSRRSGAVRTKKGKNKEMPPEYAAVMIQRAFRAYLIRRSKALRALRDLAIAKTKLKELRASFHNFNFRRVISRDAEERQKFSQKIIVLLLTADAIEGVVVLVRGARGPMVDELEAMLEVVDPQPQQGKSLSMLRRTFDMPDRMIRNEFAEGVTQIVQMLETEEE

SEQ ID NO: 55093 - protein, 795 aa, Pseudoalteromonas tunicata D2
MKFSEKWLREWVNPAIETEALSEQLSMAGLEVDGLDPVAGAFSGVVVGEVVECGQHPDADKLRVTKVNIGQEELLDIVCGAANCRQGLKVAVATVGAVLPGDFVIKKAKLRGQPSHGMLCAFSELGITDNSDGILELPADAPIGQDIRQYLGLDDFIVDVDLTANRSDCLGIKGLAREVGVLNSLDVTPITITPVAATIDDTLNIELVAPASCPRYLGRVIKGINLAATTPLWMVERLRRSGVRAIDPVVDVTNYVLLELGHPMHAFDLAKIEGGIKVRNASQDEELVLLDGNTVKLHADTLVIADHQKPLAMAGIFGGLDSGVTETTQDILLESAFFSPLAIAGQARRYGLHTDASHRYERGVDYQLQHDAMARATELLLEIVGGQAGPVVEALSQSHLPAEKSVVLRQSRLDKVIGYAIAPETVTDILTRLGLTVVHTDGQWTAVVPSFRFDISIEEDLIEEVARVFGYNNIPNVAPKASLKMTTHNEATLSVKTIRNTLVTRGYQEAITYSFVDPKVQNLIHPQADALVLPHPISIEMSAMRVSLLPGLLSSLMYNQNRQQSRIRLFEHGLKFIKDEQAENGVAQQAVIGGVITGSVMGDHWAVPSRHVDFYDLKGDVEALFALTADKASFELKNEAIEGLHPGQSAAIYRDGKKIGFLGTLHPEIQAKLSINSQTFVFEIEMLGLEKRQLPQAKEISKFPANRRDIAIVVKDEVKLADILAVIEKVGANQLVDLNLFDVYKGKGIESDHKSLAIALTLQNGDRTLEEQDIKLVVDQVVAVLAEEFNASLRD

SEQ ID NO: 55094 - protein, 132 aa, Zea mays
  misc_feature (34)..(34): Xaa can be any naturally occurring amino acid
  misc_feature (109)..(109): Xaa can be any naturally occurring amino acid
  unsure (1)..(132): unsure at all Xaa locations
MVCLAADSFKAAAIKGLAGSCIFGRKLADARPCXRCMRRPRAAAVVAKYSDKSDYYDLCDISNATGQWDLYGSDAPSSYHPLQSKPFETFADPFTKRGLLLKFLLLGGXGSLLAYVSTYAIPDLLSIMKGPK

SEQ ID NO: 55095 - protein, 361 aa, Pyrococcus abyssi GE5
MQAVLLAGGMGTRLLPLTIYRPKPMIPFFNKPLMEYMVNNLVEVGVDEIIVLVGYLKEKIIEHFGDGKEFGVEIKYSNGENVKFGTAGALKRAEKFIEGTFIVASSDVLTNLDFKSLLEFHAKKGGIATMALTKVEDPSPYGVAVLDDEGKILYFKEKPRREEAPSNLVNAGIYVFEPEILDLIPKGKPFDFSLNLFPKMLEEGIPIYGFPFDEYWNDVGRPSTYLQATEDVFLGKLKLPQISVGRLKGNVERGGSLFTGSRCILRNPKVSGFAVLGDNVEIGRDVKIERSVIFSNVTIEDGAEIREAIIGENVYIGKGVTIEPGSVIGDNSIIEEHSRIGANVKIWADSRVGRESIILPD

SEQ ID NO: 55096 - protein, 143 aa, Ehrlichia ruminantium str. Welgevonden
MLERTLSILKPDVVKRNIAGQVNSYIENSGLKIIIQKMCLLTRYQAEKFYEIHKSQVFFVPLINFMISGPVVVQVLEGENAISLYREIMGATDPKKANSGTIRGDFAENIDANCVHGSDSLENAIREIRFFFSEYELLSLYEC

SEQ ID NO: 55097 - protein, 511 aa, Geobacillus stearothermophilus
MSKKPVALIILDGFALRDETYGNAVAQANKPNFDRYWNEYPHTTLKACGEAVGLPEGQMGNSEVGHLNIGAGRIVYQSLTRINIAIREGEFDRNETFLAAMNHVKQHGTSLHLFGLLSDGGVHSHIHHLYALLRLAAKEGVKRVYIHGFLDGRDVGPQTAPQYIKELQEKIKEYGVGEIATLSGRYYSMDRDKRWDRVEKAYRAMVYGEGPTYRDPLECIEDSYKHGIYDEFVLPSVIVREDGRPVATIQDNDAIIFYNFRPDRAIQISNTFTNEDFREFDRGPKHPKHLFFVCLTHFSETVAGYVAFKPTNLDNTIGEVLSQHGLRQLRIAETEKYPHVTFFMSGGREEEFPGEDRILINSPKVPTYDLKPEMSAYEVTDALLKEIEADKYDAIILNYANPDMVGHSGKLEPTIKAVEAVDECLGKVVDAILAKGGIAIITADHGNADEVLTPDGKPQTAHTTNPVPVIVTKKGIKLRDGGILGDLAPTMLDLLGLPQPKEMTGKSLIVK

SEQ ID NO: 55098 - protein, 224 aa, Oryza sativa
  misc_feature (10)..(10): Xaa can be any naturally occurring amino acid
  unsure (1)..(224): unsure at all Xaa locations
MEKAAANQAXGKVLKKGKKKQAKDELDRQKQAEKKRRRLEKALANSAAIISELEKKKQKKREEQQRLDEEGAAIAEAVALHVLIGEDSDEPCHLMLNKHRRCNHWDHSAGFDFAVDAQGADIYPPDGLIQCADHVYAPKGRCIDWGIGQPLPSWGEVKDLQLQAPCYQGMFHQSVACPGFIAAQAVSSLQIGGDSSDITSPSQGATVVNRMLGATNRLNLYREI

SEQ ID NO: 55099 - protein, 159 aa, Campylobacter jejuni
ATLVMGDALAAALMKVRNFKPDDFALFHPGGSLGRKLLTKVKDLMVSSNLPIVHPDTEFNDLVDVMTSGKLGLCVVLENEKLIGIITDGDLRRALKASDKPRFDFKAKEIMSTNPKVVDADAMASEAEEIMLKHKIKEIVVSKEDKVVGIIQLYAIGNV

SEQ ID NO: 55100 - protein, 231 aa, Brassica napus
MLYFFKLLNPFDLKFLTFANQATSFHFSTGKVSSFRSQSRLCVVLTKGVSGSMAASDEVNLIDSKTVVPLNTWVLISTFKLSYNLLRRSDGTFNRHLAEYLDRKVTANANPEDGVFSFDVVIDRTTSLLSRVYRPAYASDQEGPVSVLDLEKPLDDEIVPVILFFHGGSFAHSSSNSKIYDTLCRRLVGACGGCVVVSVNYRRAPESPYPGAYEDGWTALNGVNSRRGLES

SEQ ID NO: 55101 - protein, 588 aa, Arabidopsis thaliana
MDGDELTEQETALYDRQIRVWGAGAQRRLSKSHVLVSGIKGTVAEFCKNIVLAGVGSVTLLDDRLVTTEVFNANFLILPDENAYVGKTVAEICCDSLKDFNPMVHVSIEKGDLSTLGVDFFEKFDVVVIGYSSRATKKAVNEKCRNLAKDVAFYTVDCRGSCGEIFVDLQNYKYTKKKLDETVECELTFPSFEEAVSVPWKPMPRRTAKLYFAMRVIELFEETEGRKPGECSLSDLPRVLKLKKELCEGNSVSENHIPDILLERLVSNNTEFPPACAIIGGILGQEVIKVISGKGEPLKNFFYFDAEDGKVFMPFSIFFKLLQFIRGCKESEKVNGKVVIITGSSSGIGEHLAYEYARRGAYLTLVARREDRLQVVADRCRKLGSPDVAVVRGDVSVIKDCKRFVQETISRFGRLDHLVNNAGIAEAKFFEDYSEISDVLPIVNTNFWGPVYATHFAIPHLKKTKGKIIAVASPAGWSGVPRMSIYAASKAAMINFYETLRIELHPEVGVTIVFPGLIENGNTNPDLLAEKQDWSQVVTIESAAECAKAVVNGICRGKTFVAEPSWVRVLFWLSAICPELLISKPKRN

SEQ ID NO: 55102 - protein, 347 aa, Prochlorococcus marinus str. MIT 9313
MAVVCRRITASSRTYSLSALTRCLQEEAAAIAVAAERLSSSQVEKALVLLERCSDQRAKLVITGVGKSGIVARKIAATFSSIGLMALYLNPLDAMHGDLGVVAQEDVCLLLSNSGETAELLEVLPHLKRRGTARIALVGKPDSSLARGSDVVLEASVDREVCPLNLAPTASTAVAMAIGDALAAIWMERRNISPADFAFNHPAGSLGKQLTLTASDLMVPVEKVQPLQPNTSLQEVICKLTQDGIGSGWVEDPSTAGLLLGLITDGDLRRALRDHSAENWASLSAAELMTADPITVDADLLAVEAIKQMECNRRKPISVLPVVGPDSSGNLLLGLLRLHDLIQAGLT

SEQ ID NO: 55103 - protein, 462 aa, Mesembryanthemum crystallinum
MGEQELLLQQQIKEDRNVSRETEMKHPALQGKYELGRVLGQGTFARVYHARNLVTGNSLAIKVVAKDKVIKVGMMEQMKREISVMKRVKHPNIVQLHEVMASKSKIYLAMDLVRGGELFSKVSKGGKLDEDVARSYFKQLISAVDFCHSRGVYHRDLKPENLLLDEHGNLKITDFGLSASFENEDHHQTLLRTSCGTPHYVAPEVISRKGQQGYHGAKSDIWSCGIILFVLLAGFLPFHDDNIIRMYRKVFKGDFTCPSWLSSQARDLITRLLDINPATRITVSEIMQSDWYCMDTSSMTAVTTDEFDLDHNNNNNNNSNYNNIHHHKKEPEMLNAFHIISLSQGFDLSPLFEEKHREERQDMRFATTKSASTVVSRLEEVAAKAGKFIVKKFCGDSVVRLQGQERGRKGKLAIAAEIMSVSPSLLVVEVKKDNGDTLEYNQFCTKQLRPALKDIVWTCPSS

SEQ ID NO: 55104 - protein, 140 aa, Triticum aestivum
  misc_feature (70)..(70): Xaa can be any naturally occurring amino acid
  misc_feature (99)..(99): Xaa can be any naturally occurring amino acid
  misc_feature (104)..(104): Xaa can be any naturally occurring amino acid
  misc_feature (107)..(107): Xaa can be any naturally occurring amino acid
  misc_feature (116)..(116): Xaa can be any naturally occurring amino acid
  unsure (1)..(140): unsure at all Xaa locations
MNARGYRSTRTALFDGIEEGGIRASAYSSHEIDEHENERAMDGLQDRVSILKRISGDINEEVEAHNRMLXDRMGNDMGFLKGVLSGNSGQFKTVFRTNXARRMXEPXAHSFLFMLXYYLTSRPWFTSSYSSILDWGSQDI

SEQ ID NO: 55105 - protein, 197 aa, Triticum aestivum
MSSMASSKGLLVFALLLAAAILVASSPSTDEHPEAKKEENEAGIENFHFGHGGHHGHGGGGGGYGGGGGGYGGGGGGGYGGGSGGYGGGGYPGGGGGYGGGGGYPGHGGEGGGGYGGGGGYPGHGGEGSGGYGGGGYPGGGGGYGGGGGYPGHGGKGGGCHWGCCGHGLFHHHGCRCCARADEVPEPMYRAPAEVRN

SEQ ID NO: 55106 - protein, 492 aa, Candida albicans SC5314
MNVNPHLQYLQQQQQQQQQQQQQQQQSQPSQSNQSQSNQSPQFSQLQLQQLQRQQLLNQHLQQQQSQSQSSQVPPQLTQQSMGTPTSTNPLLAVLNGGANSNATSTGNGSLSSNPVLQQLQLQQLQQQVQLQQLQAQQQQQQQQQQQQQAIPIIKEVWSSNLEHEFQALRTFINDKTSKVFIAIHQEIPGIVARPVGTFKSSSDYHFQTLRANSDLLNLIQLSLCVIKISKNETISTPVIWQFNFLYDLTKEMYNEEHLAMLAQTSQINFQLLSTHGIPHFEFAELMIESGLILDDNINWVSFHAGYDLGFFVSLLSNDDLPVDEPDFYWWCAKYFPNFYDLKYIGNQILNKSTTNGAGGTNSNTLDEKTNKPSIEYLAEELHLLPISPAIRQHFTNSTFHSQQLTSTLHAYLSMECFKELLRRSNMTLLSSFKGTIWGLGTFSGGTSINNTNNNGVTEDEIVASRINGISTPSTPVGIISKSGMVHFGGRV

SEQ ID NO: 55107 - protein, 302 aa, Arabidopsis thaliana
MDSYNPFSQASGFMDLLHSQQESHNNETNQYEVGSSEIPVFGTQRCQESHEERYASRVAIARKKWAAKEDIVLISAWLNTSKDPVVGNEQKAPAFWKRIASYVAANPDLDGVPKRASAQCKQRWAKMNELVMKFVGCYATTTNQKASGQTENDVMLFANELFENDMKKKFSLDHAWRLLRHDQKWLISNAPKGKGIAKRRKVRVGTQAASSQPIDLEDDDVMRRPPGVKAAKAKAKKTPTVKGEEVNSVEHLTSLWDLKERDWDRKDKQSKNQMLESLLSRTEPLSECDLVLKKKLIEELFS

SEQ ID NO: 55108 - protein, 368 aa, Sulfolobus solfataricus P2
MKDIVKFLSTVLYYVEQKNYPLAIAFKRAYLHNKPRKIDSNLLYEYSKRLILSYYALPQSKRSAKVRYWLKNRENIEIKFPKWMEDKLFTLLDVNALKRKLTERWIWARINLLKTDIDKVYRMLESQNIEFEPDKDFYYMIKINRSSVRLSSLSIVKDFKLILHDKASSIVVEALKPEISEKLVDLSSAPGIKASLYMMLTENRAETFLADVDLKRLSKEYNLLKRCGVDLRKVHIIYQDSTKNSIIKSDKILLDAPCSSSGMINNDPSILLKLRNGEKIEKFTKLQKSLLNEALKIKSNKLVYAVCSLFPEEGEKVIEDYYEIAEKPFSNYQSGYSLFKSGKRSNRTFPHIDSTEGFFISTLNLTKL

SEQ ID NO: 55109 - protein, 513 aa, Corynebacterium glutamicum ATCC 13032
MSDLGPIWRWLLLVSVSICAASGLVYELALVSLSTSLNGGGIVETSLIVAGYVAALGLGALLVKPFLNWPAQTFLGVETLLGLIGGCSALVLYFTFATIGQSLWILVIATAAIGILVGAELPLLMTMIQQGRLADAKTTGSLVATLNAADYLGALLGGLAWPFVLLPWLGMMRGAAAAGMINLVAALFVGCVLLRHLLPRTHFFVSVVALLLAIAALATVLVKSDGIVATARAQLYRDPVIYSHQSDYQDIVVTERGKDRRLYLNGGLQYSTRDQHRYTESLVYPSLNPEAESVLIIGGGDGLAARELLRFPSMQITQVELDPEVIEVANTVLRSDNGGAMEDPRVSIIVDDAFTWLRSGGNNGETYDSIIIDLPDPNNDTMARLYSEEFYTLARARLNEQGRMVVQSSSAYTTPDVFWRVGATLKSAGCEQVIPYHVHVPTFGDWGFQLCGPADMELELREDTPPLTFLNDEVLVAAGVFGLDNQPRELEPSTLDHPRVVEDLRKGYRESGD

SEQ ID NO: 55110 - protein, 377 aa, Zea mays
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFSVPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELETAKSSSSVEKSYELPDGQVITIGAERFRCPEVLFQPSMIGMEAPGIHETTYNSIMKCDVDIRKDLYGNIVLSGGSTMFPGIADRMSKEITALAPSSMKIKVVAPPERKYSVWIGGSILASLSTFQQMWISRAEYEESGPAIVHRKCF

SEQ ID NO: 55111 - protein, 550 aa, Bradyrhizobium sp. BTAi1
MSHDRKSPLIGQMMSDPLLISGIIQHADRHFGGNEIVSREADGSLHRYNYRDCHRRARQMAHVIKHLQVEMGDRVATLAWNDFRHLELYYAVSGSGAVVHTINPRLHVDQIAYIVNHAEDKCLFFDPAFLPLVEAVVDRCPTVKAFIALSSRERMPVSTVIPDLLCYEELISSASDAYRWPVFDENAASGLCYTSGTTGNPKGVLYSHRSTVLHSYASAMRDGLDVSAREVVMPVVPMFHVNAWGLPYSALMTGAKLVLPGAGLDGKSLYDLFESEGVTFSAGVPTIWLGLLGYVEQNKLRFSTFKRTVIGGAACPPSMMKAFRHEHGVEVVHGWGMTEMSPLGTTGTLQNHHLNLPSEAQDAILQKQGNAIFGVDLKIVDDHGQELPWDGKTYGNLLVKGSWIVESYFKNEGGSILDNGWFPTGDVATITHDGYMQITDRSKDVIKSGGEWIGTVELENIAMDHPAVQQAACIGVAHPKWDERPLLLVVKRPGAAVSKDELIGFYAGKVAKWWVPDDVCFVESLPIGATGKVLKNRLREQFKDFRSSAT

SEQ ID NO: 55112 - protein, 363 aa, Anthurium andraeanum
MATEVMTAVPAGSRVESLASSGIQAIPLEYVRPAEERVSLTDALEAARRAEDGPQIPTVDVAGFSSGDEAARRACAEAVRRAATDWGVMHVVNHGIPLELIRRMQAAGEAFFALPIEEKEKYANDQSSGNIQGYGSKLANNASGQLEWQDYFFHLIFPEDKADFSIWPKQPANYVEETREFGRQLRVVASKMLAMLSLGLGVEEGKLEAEVGGIEDLLLQMKINYYPRCPQPELAVGVEAHTDVSALSFILHNMVPGLQVHNEGQWVTARCVPDSIIMHVGDVVEILSNGQYKSILHRGLVNKEKVRVSWAVFCEPPRDKILLQPLPDILGQGRPAQFPPRTFSQHIQHKLFRKTQGDFATPN

SEQ ID NO: 55113 - protein, 509 aa, Nitrosomonas europaea ATCC 19718
MTSYLSEEAGPDLTQGISLSDFGNQPLLRGHVGDEPVILARIGDEITAVGATCTHYGAPLTEGLVVGETVRCPWHHACFSLRSGEALGAPAFDPLPCWQVERDGDRIMVRDKITPKPRSIPVAAANQPANVVIIGGGAAGFACAEMLRRRGYQGQLTMLSEDSDAPCDRPNLSKDYLAGNAPEEWIPLKSDDFYVRNRIDLQLHTTVTKINTTGHTVTTADGRIFPFDRLLLATGAEPVRLPIPGANQSHVFTLRTLADSRAIIERAKHAKAAVILGSGFIGLEAAAALRARELDVHVVSLDKHPLEKILGSEPGDFIRSLHEQHGVQFHMGTSLAHIEPHKVVLSNGKELTADLVIIGVGVRPCVSLAEAAGITVDNGILVNEYLETSVPGIFAAGDVARWRDEASGKTQRIEHWVLAERHGQIAAENMLGANTAFQDVPFFWSAHYDISIRYVGYAGPWDTLEIEGDMAAYDCLISYKTGGKTVAVAAIGRDKQALEYRALIAQQQH

SEQ ID NO: 55114 - protein, 542 aa, Oryza sativa (japonica cultivar-group)
MAMEAEALLPEPEPESPPLLAVDHLGGPASRGSSGRWPAAFFLIGAEVGERFAYSGIMGNLVIYLTGPLRQPTAAAAAAVNVWMGTSMLLPLLGSAVADSWLGRYRTIVCASLLYILGLGMITVSSVLAPEESSESSNLAAHVAFFYFSLYVVAFAQGGHKPCAQALGADQFDENDPGELASRSSFFNWWFFASYGGNTVTVPILNYVQESVSWQLGFAIPCIAMAVSLAIFLIGTRSYRFYPPKSKGNPFGEVAEWIRRWIASSCSKLPDSSDELLPSSSSEGDVSNSSSEFVPKEAAELVKLFPIWASSLIYAAVMAQCITFFTKQASTLDRRVGSLVLPAASNGALFNATIMVFLPIYDRIFIPVARRYTKNPSGITTLQRIGVGLVLSIITMIVAAMVEMRRLRIARDFGLVDKPEAVVPMSFLWIVPQNILAAISDMFAVIGLQEFFYGEAPESLRSFSMALFLSIIGVGNFISSFIVYAIDRVTSSFGDSWFSNNPNRGHVDYFYLLITVLNALSLACFLYFAKMYEHRKKVISVQ

SEQ ID NO: 55115 - protein, 590 aa, Arabidopsis thaliana
MAFTFPPSYRTLVGLYYIFTLMHTAVSTPPDDPVKCVSGNTNCTVTNSYGAFPDRSTCRAANVAYPKTEAELVSVVAAATQAGRKMRVTTRYSHSITKLVCTDGTEGLFISTKFLNHTVQADATAMTMTVESGMTLRQLIVEAAKVGLALPYAPYWWGLTVGGMMGTGAHGSSLWGKGSAVHDYVTEIRMVSPGSVNEGFAKIRILSETTTPNEFNAAKVSLGVLGVISQVTFELQPMFKRSLTYTMRNDSDFEDQAVTFGKKHEFADFIWLPSQGKVVYRRDDRVAVNTSGNGLFDFLPFRSQLSAAIAIIRTSEETQERFRDANGKCVGATIISSTLFAPSYGLTNNGIIFTGYPVVGSQNRMMSSGSCLDSLQDGLITACAWDSRIKGEFFHQTTLSVPLTQVKSFISDIKSLVKIEQKSLCGLELHYGILMRYVTSSPAYLGKETEALDFDITYYRAKDPLTPRLYEDFIEEIEQIALFKYNALPHWGKNRNLAFDGVIRKYNNAPAFLKVKDSYDPKGLFSSEWTDQILGIKGNASIVKDGCALEGLCICSKDAHCAPAKGYLCRPGKVYKEARVCTRVDGIISV

SEQ ID NO: 55116 - protein, 333 aa, Vibrio fischeri ES114
MKIKVGINGFGRIGRLALRAAFDWPELEFVQINDAAGDAHTLAHLLEFDSVQGRWHHEVISNGSDMIIAGQTLKTTQEKDIDAVDWSGCDVVIEATGVHRKRVFLDKYLAQGVKRVVVSAPVKEEGVVNIVVGVNDDIFDPAVHQIVTAASCTTNCLAPIVKVINKGLGIENAAFTTIHDLTNTQTILDAPHKDLRRARACGMSLIPTTTGSAKAIVEIFPELKDKIDGHAVRVPLANASLTDIIFEVKRDTTVEEVNQLLKDAAQGDLKGILGYEERPLVSIDYKGDQRSTIVDAPSTMLVGKRMVKIYAWYDNEMGYATRTAELVRNVGLA

SEQ ID NO: 55117 - protein, 348 aa, Clostridium perfringens ATCC 13124
MEGKMKVAVMNGIGKMDLIERDIPIVKENEVLVKLDYVGICGSDLHYYENGRIGDYIVEPPFVLGHEPGGVVVEVGNKVKHLNIGDRVALEPGKTCGHCEFCKTGRYNLCPDVIFFATPPVDGVFQEYVAHEADLCFKLPENVSTLEGALIEPLAVGFHAAIQGGARIGQTAVVMGAGCIGLVSMMALKAMGVSNVYIVDIMEKRLEKALELGATGIINAKEKNAIEEVMKITNNNGCDLVIETAGTEITTVQAIHMAKKGSNIVLVGYSKSGEMTLPMSLVLDKELTFKTVFRYRHIYNMAIEAVASGKVNLKGIITNEFDLDDVQKAMDYSVNNKADIVKAVIKIR

SEQ ID NO: 55118 - protein, 128 aa, Yersinia pseudotuberculosis IP 32953
MSRVISTELAPAAIGPYVQGVDLGSMIITSGQIPVDPKTGLVADDIAAQARQSLENVKAIVEAAGLNVADIVKTTVFVKDLNDFSTVNATYEAFFTEHSAPFPARSCVEVARLPKDVKIEIEAIAVRR

SEQ ID NO: 55119 - protein, 184 aa, Oryza sativa (japonica cultivar-group)
MLRRRGFCCCSGAPAAAAAALLLLAVAAAAPRAAGFHLGGDESVLVRGMLAAIRREQAEAEDAARFAVAEYNKNQGAELEFARIVKAKRQVVTGTLHDLMLEVVDSGKKSLYSAKVWVKPWLDFKAVVEFRHVGDSQSQSATAADDNAGQDTADPTVASRNDLHNTENNKVSVVLSTFSQTYSV

SEQ ID NO: 55120 - protein, 350 aa, Frankia sp. EAN1pec
MIAARLHGPGDLRVEEVDEPEAAAGEVKIAVAHNGLCGTDLTEIFSGPRACTTVPHPLTGGVLPQIVGHEFAGVVAAVGAGVTDVAVSERVSVEPLYSCGDCDRCQASLPELCRQVMTHGICSNGGGLAQFTTVPRAMVHRLPASMSLAEGALVEPMAVAFNGVLRSGVEAGGSALVFGAGPIGMGVVFGLRAVGVADILLVEPASARRAAAERLGVADVLDPNTTDVADEVRRRTGGRGVDVVLDAAGAPGTFGLAPAVLRARGRYVGIAVAERPVEFAPWVLARGEIELTGSLGYGPGVFTRVIDLIAGGAYPTAGWVDHVGLSDLHDALQDLRDGRRMKVLVDLPAG

SEQ ID NO: 55121 - protein, 699 aa, Debaryomyces hansenii CBS767
MTNYPGSHKSNLSIAIQKADSTTGNQNYNDNNNNNNNNNHDFGNENLQPASLLPNLIQHNGSTSATTSPVVKSFKPELSPLKTDFLEAGKNENSGQREHAENHDDKHDDDEEDDDEDDEPVHPENEEDLKDYVPGGYHTCYIGENYKSNKYTLVRKLGWGHFSTVWLAKDNDKHCHVAMKIVRSAKHYTETAIDEIKLLDKITTSDIHHPGHEHAIQLLDTFTHKGPNGVHVVMVFEVLGENLLGLIRRYKHRGIPVVFVKQIAKQLLSALDFLHRKCGVIHTDLKPENVLIEIGDVEQIVKMVEVETNEAKKQKKLQKSKYKSDNSLNATPDTSFQENAQAQPSTSTAASTKPTTNSPSLGRNGRRSRRQTLITGSQPLPSPLSTFNKSFSNVYARSSSTANTPLKTFFEGAQPTLINQTASSQIAMASSNTNIPNYDNQDTLNSSLSSMSISNAGRSNTTTDPLQIPSGFDSSMQQTESNENSLIINEDELISVKIADLGNACWTSHHFTDEIQTRQYRSPEVLLGYHWGSLADLWSFACLIFELLTGDYLFDPRDGKTYTKDDDHIAQIIELVGPFPRAMLKEGYYTRDFFNSRGELHRIQKLKPWSLKDVLMEKYKFSLADAVEIADFLQPMLTLQPELRADAGGMVNHSWLSDALGLENVVLERPVGGSGEDIPGWSKEVLNLNIGGKHYHHRN

SEQ ID NO: 55122 - protein, 392 aa, Malus x domestica
MSQVRESETPEDQVVEILSRLPPKSLMRFKCIRKSWCTIINSSSFVAKHLSNSIDNKLSSSTGILLNRCQVHVFSDRSWKQDVFWSMINLSIDSDKNNLYYDVEDLNIPFPMEDQDNVELHGYCNGIVCVIVGKNVLLCNPATGEFRQLPDSSLLLPLPKGRFGLETVFKGLGFGYDCKAKEYKVVRIIENCDCEYSEGEESYYERILLPHTAEVYTMTADSWKEIKIDVSSDTDPYCIPYSCSVYLKGFCYWFACDNGEYIFSFDLGDEIFHIIELPSRREFGFKFYGIFLYNESITSYCSRYEEDCKLFEIWVMDDYDGVKSSWTKLLAVGPFKDIDYPLTLGKFDEVLMLGSYGRAAFCNSSTGNLKYLHIPPIINWMIDYVKSIVPVK

SEQ ID NO: 55123 - protein, 466 aa, Oryza sativa (japonica cultivar-group)
MNLAGFLATPATATATRHEMPLNPSSSASFLLSSLRRSLVASLRKASPAAAAALSPMASASTVAAENGAAKAAAEKQQQQPVQVAKRLEKFKTTIFTQMSMLAIKHGAINLGQGFPNFDGPDFVKEAAIQAINAGKNQYARGYGVPELNSAIAERFLKDSGLQVDPEKEVTVTSGCTEAIAATILGLINPGDEVILFAPFYDSYEATLSMAGANVKAITLRPPDFSVPLEELKAAVSKNTRAIMINTPHNPTGKMFTREELEFIATLCKENDVLLFADEVYDKLAFEADHISMASIPGMYERTVTMNSLGKTFSLTGWKIGWAIAPPHLTWGVRQAHSFLTFATCTPMQAAAAAALRAPDSYYEELRRDYGAKKALLVNGLKDAGFIVYPSSGTYFVMVDHTPFGFDNDIEFCEYLIREVGVVAIPPSVFYLNPEDGKNLVRFTFCKDDETLRAAVERMKTKLRKK

SEQ ID NO: 55124 - protein, 392 aa, Malus x domestica
MSQVRESETLEDKVVEILSKLPPKSLMRFKCIRKSWCTIINSPSFVAKHLNNSMDYKLSSTTCILLNRCQVHVFPDRSWKQDVFWSMINLSIDSDEHNLHYDVEDINIPFPMEDQDNVELHGYCNGIVCVIVGKNVLLCNPATGEFRQLPNSPLLLPLPKGRFGLETTFKGMGFGYDCKSKEYKVVRIIENCDCEYSDDGESYYERILLPHTAEVYTMTANSWKEIKIDISIETRWYCIPYSGSVYLNGFCYWFAYDNGEYVFSFDLGDEIFHKIDLPSRRESDFKFYGIFLYNESVTSYCYRHEEDCELFEIWVMDDYDGVKSSWTKLLTIGPLKDIDYPLTLWKCDEVLMLGSYGRAASCNSSTGNLRYLHIPPIIKWMMDYVKSIVPVQ

SEQ ID NO: 55125 - protein, 248 aa, Neisseria meningitidis Z2491
MSTQDLSGKIALVTGASRGIGAAIADTLAAAGAKVIGTATSESGAAAISERLAQWGGEGRALDSAEPETIESLIADIEKAFGKLDILVNNAGITRDNLLMRMKEEEWDDIMQVNLKSVFRASKAVLRGMMKQRSGRIINITSVVGVMGNAGQTNYAAAKAGLIGFAKSMAREVGSRGITVNCVAPGFIDTDMTRALPEETRQAFTAQTALGRFGDAQDIADAVLFLASDQAKYITGQTLHVNGGMLMP

SEQ ID NO: 55126 - protein, 447 aa, Corynebacterium glutamicum
MTVDEQVSNYYDMLLKRNAGEPEFHQAVAEVLESLKLVLEKDPHYADYGLIQRLCEPERQLIFRVPWVDDQGQVHVNRGFRVQFNSALGPYKGGLRFHPSVNLGIVKFLGFEQIFKNSLTGLPIGGGKGGSDFDPKGKSDLEIMRFCQSFMTELHRHIGEYRDVPAGDIGVGGREIGYLFGHYRRMANQHESGVLTGKGLTWGGSLVRTEATGYGCVYFVSEMIKAKGESISGQKIIVSGSGNVATYAIEKAQELGATVIGFSDSSGWVHTPNGVDVAKLREIKEVRRARVSVYADEVEGATYHTDGSIWDLKCDIALPCATQNELNGENAKTLADNGCRFVAEGANMPSTPEAVEVFRERDIRFGPGKATPEAVEVFRERDIRFGPGKAVNVGGVATSALEMQQNASRETCAETAAEYGHENDYVVGANIAGFKKVADAMLAQGVI

SEQ ID NO: 55127 - protein, 195 aa, Streptococcus suis 89/1591
MEINTHNAEILLSAVSKAQYPGDDIPEIALAGRSNVGKSSFINTLLGRKNLARTSGKPGKTQQLNFYNIDDKIRFVDVPGYGYAKVSKTERAKWGKMIEEYLTTRENLRVVVSLVDMRHEPSADDVQMYDFLKYYEIPVIIVATKADKIPQGKWNKHESMIKKKLDFDKNDQFVIFSSETRHGYDQAWDAILSNI

SEQ ID NO: 55128 - protein, 521 aa, Neisseria meningitidis Z2491
MTQDKILILDFGSQVTQLIARRVREAHVYCELHSFDMPLDEIKAFNPKGIILSGGPNSVYESDYQADTGIFDLGIPILGICYGMQFMAHHLGGEVQPGNQREFGYAQVKTIDSELTRGIQDDTPNTLDVWMSHGDKVSKLPTGFTVIGDTPSCPIAMMENAEKQFYGIQFHPEVTHTKQGRALLNRFVLDICGAQPGWTMPNYIEEAVAKIREQVGSDEVILGLSGGVDSSVAAALIHRAIGDQLTCVFVDHGLLRLNEGKMVMDMFARNLGVKVIHVDAEGQFMAKLAGVTDPEKKRKIIGAEFIEVFDAEEKKLTNAKWLAQGTIYPDVIESAGAKTKKAHAIKSHHNVGGLPENMKLKLLEPLRDLFKDEVRELGVALGLPREMVYRHPFPGPGLGVRILGEVKKEYADLLRQADDIFIQELRNTTDENGTSWYDLTSQAFAVFLPVKSVGVMGDGRTYDYVVALRAVITSDFMTAHWAELPYSLLGRVSNRIINEVKGINRVVYDVSGKPPATIEWE

SEQ ID NO: 55129 - protein, 137 aa, Streptococcus suis 89/1591
MERTFFIIKPDALKRGLAGQILSRIERRGFQIRDLKMVTATEELISQHYDHLTDKPFFPQLVQYMTSGPMIAGIIEGPEVIKSWRDMMGATNPVNALPGTIRGDFATAPVEGIVANVVHGSDSAEAAEREIGLWLGK

SEQ ID NO: 55130 - protein, 307 aa, Clostridium perfringens ATCC 13124
MDINLDALVEANRRYTKEGHVATYIPALAKVNPDQLGVCIYDLKENKEFSAGEYDVRFAIESISKVPTLILAILDNGIEKVFSEVGTEPSGFAFNSIMNMQINHKNKPSNPFINAGAIKVVSLLKGKNDEERFKRILDFYRKIMNDDEITLDTEIYLSERETGDINRSLAYYMKGNGIMEGDVTDILDSYFKQCSVLVTAKDLARLGAVLANEGVMPWNGERLFSVETATVVKSLMTTYGLYDESGAFSVHIGLPSKSGVGGGILSSVPNKCGIGLFSPALDVPGNSVASMKLLKEIADKLKLDIFR

SEQ ID NO: 55131 - protein, 903 aa, Desulfotalea psychrophila LSv54
MSQCIYEFGPKKTDGDSSQKDLLGGKGANLAEMAKLGLPVPPGFTISTECCNDYFELGGNLPDILDAQIFAAMANVESQMGMGFGDFENPLLVSCRSGARSSMPGMMETILNVGLCSTTIPGLIKKTGNEWFVYDAYRRLIMMYSDVVMEKAEELKPKDGMGIRLSLEMMMNNLKNDKGYANDTDISIEDMKNLCERFKKKISEDLGLDFPDDPREQLMGSIGAVFKSWNGRRAVAYRRIEHIPNSWGTAVNVQSMVFGNMGDTSATGVAFTRDPATGQNSFYGEWLVNAQGEDVVAGIRTPNPLNLDTKNSQNGHLSSLEEMMPELYTQLFDIRNLLEDHYQDMQDIEFTIQEGRLYMLQCRIGKRTATAALNMAMDMLDEGRIDEKTMLCRLEPKILDDLLHPIVDPEAEKHAAVVAEGLPAGPGGAYGQIVFTSEDAVRWAKADKKVILVREETNPEDIEGMRAAIAVLTARGGMTSHAALVARGWGKCCIVGAGVLKINLETKELRVGTRVFKEGDLFTLNGTKGTVYEGQLKMKDATENPKFKRFMEIADSHRTLRVRANADTPEDAKIAREFGAEGVGLFRTEHMFYGTDSDRPLFLLRKMILSKTVAERKEALAELFPFVKEEIGKTLAIMDGMPVTMRLLDPPLHEFVPQLVENQQEIADALRIDLEEVIKRSEQLKESNPMMGHRGVRLGITYPEIIEMQVLSIFEAAAELIQAGKTPQPEIMVPVTCNEKELDFARKIVDRCYEQTLEKYGLESIGYMYGTMIEIPRAALIAEKMAEHAQFFSFGTNDLTQMTFGFSRDDVGALMNDYLDNGILVADPFETLDQEAVGSLITTAVDGGRRARPDIKLGICGEHGGDPASVEFCHRAGLTYVSCSPYRVPIARLAAAQAAIKFN

SEQ ID NO: 55132 - protein, 490 aa, Nitrosomonas europaea ATCC 19718
MDNLFDVAVIGAGPGGYVAAIRCAQLGLNTVCIDDWKNEQGKPSLGGTCLNVGCIPSKALLESSENFERAGHKFAEHGIKVDGLSIDVPAMIARKNKIVKAFTGGIGMLFKKNKVTALHGRGTLQKHDQARDGGDDSWEIQVSADGKEQSVHARHVIIATGSTPRTLKVAPVDGNNVLDNAGALALQQTPGKLAIIGAGVIGLELGSVWRRLGAEVTLLEAQADFLPAADEQVAKEAYKALTRETGLTIHTGVEIKSTRASENGVEIDYVDRDKNAQNLKVDKLIVAVGRVPNTSGLGAEAAGLKLDERGYISVDEFCQTSLQNVYAIGDVVRGPMLAHKASEEGVAVAERIASGRQGATDSSGHVDLGMMPWVIYTAPEIAWVGKTEQTLKAEGVAYKAGQFPFMANGRARALGETTGFVKILADAESDRILGVHMVGPYVSEMIAEAVVAMEFSASSEDLARIVHAHPSLSESLHEAALGVDKRAIHI

SEQ ID NO: 55133 - protein, 292 aa, Brassica napus
  misc_feature (201)..(201): Xaa can be any naturally occurring amino acid
  unsure (1)..(292): unsure at all Xaa locations
MAGGLDMSLDDLIKSNRKPTGSRGRGNGGASSGGRGFGGGSSGPSRRFANRVGNRTAPYSRPIQQQAHDAMWANDVFATDASVAAAFGHQSAGVGVGGSSIETGTKLYISNLDYGVSNEDIKELFSEVGDLKRYGIHYDRSGRSKGTAEVVFSRRGDALAAVKRYNDVQLDGKLMKIEIVGTNLSAPAPPMLAPVQIPFPXNGLLGNFNENYNGNFNGNYNGNFRGRGRGGFMGRPRGGFGGGNFRGGRGARGGGGGGGRGSGRGGRDEKVSAEDLDAELDKYHKEAMEETS

SEQ ID NO: 55134 - protein, 503 aa, Oryza sativa (japonica cultivar-group)
MATAIPQRQLFVAGEWRAPALGRRLPVVNPATESPIGEIPAGTAEDVDAAVAAAREALKRNRGRDWARAPGAVRAKYLRAIAAKIIERKSELARLETLDCGKPLDEAAWDMDDVAGCFEYFADLAESLDKRQNAPVSLPMENLKCYLRKEPIGVVGLITPWNYPLLMATWKVAPALAAGCTAVLKPSESASVTCLELADVCKEVGLPSGVLNIVTGLGSEAGAPLSSHPGVDKVAFTGSYETGKKIMASAAPMVKPVSLELGGKSPIVVFDDVDVEKAVEWTLFGCFWTNGQICSATSRLILHKKIAKEFQERMVAWAKNIKVSDPLEEGCMLGPVVSEGQYEKIKQFVSTAKSQGATILTGGVRPKHLEKGFYIEPTIITDVDTSMQIWREEVFGPVLCVKEFSTEEEAIELANDTHYGLAGAVLSGDRERCQRLTEEIDAGIIWVNCSQPCFCQAPWGGNKRSGFGRELGEGGIDNYLSVKQVTEYASDEPWGWYKSPSKL

SEQ ID NO: 55135 - protein, 528 aa, Synechococcus sp. CC9605
MSQPSSDTQRQPAIVILDFGSQYSELIARRVRETEVFSVVLGYSTSAEELRRMAPKGIILSGGPSSVYAEHAPLCDPGIWDLGIPVLGVCYGMQLMVQQLGGVVEAATGKAEYGKAPLEVDDPTDLLTNVDNGSTMWMSHGDSVKALPEGFVRLAHTANTPEAAVAHLQRKLYGVQFHPEVVHSTCGMALIRNFVYHVCGCDPDWTTAAFIDEAVALVREQVGDKRVLLALSGGVDSSTLAFLLKKAIGDQLTCMFIDQGFMRKGEPEFLMDFFDRKFNIHVEYINARQRFIGKLEGITDPEEKRKIIGTEFIRVFEEESKRLGPFDYLAQGTLYPDVIESAGTNVDPKTGERVAVKIKSHHNVGGLPKDLQFKLVEPLRKLFKDEVRKVGRSLGLPEEIVRRHPFPGPGLAIRILGEVTDEKLDCLRDADLIVRQEIKEAGLYHDIWQAFAVLLPVRSVGVMGDKRTYAWPIVLRCVSSEDGMTADWSRLPYDLMETISNRIVNEVKGVNRVVLDITSKPPGTIEWE

SEQ ID NO: 55136 - protein, 489 aa, Yersinia pseudotuberculosis IP 32953
MPAQNPLQHQRQHDGIYHIGYFVGGKWSQAQEQFDVCNPATGELVARVAKSGKQETEAAIKAASEAFPAWRKTPAKQRAEILQRWYLLIMEHQQSLAELMVSEQGKPLKEALVEVAYAASFIQWFSEQAKRANGEIIPSAKEGARILATREPIGVVAAITPWNFPLAMLTRKLGPALAAGCTGLIKPANNTPLSAFALLALAEQAGVPAGVLNGVVGDTHAISDAIMASSDVRKISFTGSTNVGKTLMRNAAATMKRISMELGGNAPYIVFDDADLEAAVAGAMACKFRNAGQVCVCVNRFYIQDAIYDEFVNRLAAEVKKLKVGNGMDKDVNMGPLINLAGLEKVEEHVKDALEKGGRLLAGGHRHALGGNFFQPTVIADANEQMKVASEETFGPLAACFRFSTEAEVIQRANNTPFGLAAYFYTQNLQRVFRVSEALESGMIGVNECSVSTELAPFGGVKESGLGREGSVLGLDEFMEVKTLHLGNL

SEQ ID NO: 55137 - protein, 394 aa, Malus x domestica
MSHVRESETPEDRVVEILSRLPPKSLMRFKCIHKSWFSLINNLSFVAKHLSNSVDNKLSSSTCILLNRSQAHIFPDQSWKQEVFWSMINFSIDSDENNLHYDVEDLNIPFALKDHDFVLIFGYCNGILCVEAGKNVLLCNPATREFKQLPDSCLLLPSPPERKFELETNFQALGFGYDCNAKEYKVVRIIENCEYSDDERTYYYRIALPHTAELYTTTANSWKEIKIDISSTTYSCSRSVFMKGFCYWYATDGEEYILSFDLGDDTFHIIQLPSRRESGFRFYYIFLRNESLASFCSRYDRSEDSESCEIWVMDDYDGDKSSWTKLLNIGPLQGIKKPLTFWRSDELLMLDSDGRATSYNYSTRNLKYLHIPPILNRVVDFEVLIYVKSIVHVK

SEQ ID NO: 55138 - protein, 393 aa, Malus x domestica
MSQVHESETPEDKVVEILCRLPPKSLMRFKCIRKSWCTLINRPSFVAKHLNNSVDNKLSSSTCILLNRSQAHIFPDQSWKQEVFWSTINLSIDSDEHNLHYDVEDLIIPFPLEDHDFVLIFGYCNGIVCVDAGKNVLLCNPATREFRQLPDSCLLQPPPKGKFELETTFQALGFGYDCNAKEYKVVRIVENCEYSDDEQTFYHRIALPHTAEVYTTAANFWKEIKIDISIKTYHCSCSVYLKGFCYWFASDNEEYILAFYLGDETFHIIQLPSRRESGFTFDYIFLRNESLASFCSPYNPSEDSKLFEIWVMDDYDGVSSSWTKLLTVGPFKGVEYPLTLWKCDELLMLASDGRATSYNSSTGNLKYLHIPPILNKVVDFEGLIYVKSIVPLK

SEQ ID NO: 55139 - protein, 225 aa, Bradyrhizobium sp. BTAi1
MQKYRPVMLVVLDGWGWREEVADNAIRQARTPNFDHLWGTGPHALVQTSGLDVGLPQGQMGNSEVGHLNIGAGRVVMQDLPRISAAITDGEIKSASALIDLMERLRRTGGTCHLLGLISPGGVHSHQDHATALAEILAETGVSAVVHAITDVRDTPPRSADVYVSRLSAALPLSIPIVSVCGRYYAMDRDHRWERVAKAYCTIVEAYAYDEGRLIDACARARRGL

SEQ ID NO: 55140 - protein, 392 aa, Pyrus pyrifolia
MSQVHESETPEDKVVEILSRLPPKSLIRFKCVRKSWCTIINSPSFVAKHLSNTVDNKFSSFTCILFNRSQVHVFADRSWKRDVFWSMINLSIESDEHNLDYDVEDLNIPFPMEVQDNVQLYGYCNGIVCVIVGENVLLCNPATREFKQLPDSSLLLPLPTGKFGLETLFKGLGFGYDCKTKEYKVVRIIENCDCEYSEGKESYYERILLPYTAEVYTTAANSWKEIKIDTSSDTDPYCIPYSCSVYLKGFCYWFANDNGEYIFSFDLGDEIFRRIELPFRRESDFNFYGLFLYNESVASYCSRYEEDCKLLEIWVMDDHDGVKSSWTKLLTVGPFKDIESPSTFWKCDEVLILSSYGKATSYNSGTENLKYLHIPPIINWMIDYVETIVPVK

SEQ ID NO: 55141 - protein, 396 aa, Pyrus pyrifolia
MTQVRESETPEDRVAEILSRLPPKSLMRFKCIRKSWGTIINNPSFMAKHLSNSVDNKFSSSTSILLHRSQMPVFPDRSWKREYFWSMINLSHDSDEYNLYYDVEDLNIQFPLEDHDHVSIHGYCNGIVCLIVGKNAVLYNPATRELKQLPDSCLLLPSPPEGKFELESTFQGMGFGYDSKAKEYKVVKIIENCEYSDDMRTFSHRIALPHTAEVYVTTTNSWRVIEIEISSDTYNCSCSVYLKGFCYWFASDDEKYVLSFDLGDEIFHRIQLPYRKESGFLFYDLFLYNESIASFCSHYDNDNAGILEILEIWVMDDCDGVKSSWTKLLTLGPFEDNENLLTFWKSDELLMVTSDKRAISFNSSTGNLKYIHIPPIMNKVTDFEALIYVESFVSVK

SEQ ID NO: 55142 - protein, 661 aa, Triticum aestivum
  misc_feature (392)..(392): Xaa can be any naturally occurring amino acid
  misc_feature (596)..(596): Xaa can be any naturally occurring amino acid
  unsure (1)..(661): unsure at all Xaa locations
MPLRPYLGDTYRTSLYKKPRLVPVRNSPGYRRPTRPPLNTSIIHSLLRLQPHPPPKPASSVAASTTMCGILAVLGCADWSQAKRARVLSCSRRLKHRGPDWSGLFQCEGNFLAQQRLSVVSPLSGDQPLYNEDRTVVVVANGEIYNHKKIRKQFAAKHTFTTGSDCEVIIPLYEEYGENFVNMLDGVFSFVLYDTRNKTYMAARDAVGVNPLYFGRGSDGSVWIASEMKALHEDCPKFELFPPGNLYSSAAGGFRRWYNPQWFAEHVPATAYQPLVLREAFEKAVIKRLMTDVPFGVLLSGGLDSSLVASVTKRHLIETEAAKKFGTELHSFVVGLEGSPDLKAAREVADYLGTIHHEFHFTVQDGIDAIEEVIYHNETYDVTTIRASTPMXLMARKIKALGVKMVLSGEGSDELLGGYLYFHFAPNKEEFHKETCRKVKALHQYDCLRANKATSAWGLEVRVPFLDKEFIDVAMSMDPEWKLYDANLGRIEKWVLRKAFDDEKEPYLPRHILYRQKEQFSDGVGYNWIDGLKAFTEQQVTDEMMKNAAEEYPYNTPINKEAYYYRMIFERLYPQESARETVPWGPSIACSTPAAXIEWVAQWKASNDPSGRHIASHNDAAPAHAHANGNGNGAVANGKANGNGTANGNANANANGTLVPC

SEQ ID NO: 55143 - protein, 718 aa, Arabidopsis thaliana
MMMSDLPHDLVEEILSRLPLISLKAMRSTCKTWNVLSKHRSFANKHIGNVTASGKRDLIMIKDCKVYSIGVNLHGIQNNNNIIDLSIKNKGILHLENLDLIFKEIFNVFHCNGLLLLYGSITDDSIRLVVCNPYWGKREWVKRINNFASFDKLAFGYDKSCGCHKILRVFDSYPNRLEIYNLRSNSRMVSSFPLKWDIAFMQDGVSLKGNTYWYAKDRRSEDCYLICFDFTRERFGPRLPLPQPFIDEFLGSLYVVREEKLAVLVKRWRGGKSEIDIWVTNKIEPDEVSWSKFLKVDNTPRFFLTEGYLIYDEEKVVVFFNKEETEGLKSTVHIAYIVGENGYFRRADLREPLYQPLCRLIYKLSNYKTERQQVTSKRSAMASSTLFKLNSQTFKALNPSPPSLSPPNSRIFHLHFSKSLSQQHSKLNHKSTTTRLFAPLCSSLPSPSSSSPPLSKEEAINQAKTCLLSCLIKPLNNPKLASPKLRKLKQPRFRLEIPILDDDSPSSLSQLAFSIFHDLPISRRGSNVKLLFLWPNPSFIDPAVKAFRSDSIHHIAMSPVSDSLKTALRSADVAIFMAPEKSQLEDVKTASEAFSTKPVVMINPRWLFEEEKSFGDGFIGSFEVIYAFTGLEVRGVFSKRKGVIFKCVRDGVVSGERWNVLVEEEEGNGTLKVVSQFNSRPSIEEVELVLYNLMAMNSPITKSAKFLSDLVSNITGKK

SEQ ID NO: 55144 - protein, 279 aa, Mycobacterium leprae TN
MTITRTERNFYGVGGVRIVYDVWMPDTRPRAVIILAHGFGEHARRYDHVAHYFAAAGLATYALDLRGHGRSAGKRVLVRDLSEYNADFDILVGIATRDHPGLKRIVAGHSMGGAIVFAYGVERPDNYDLMVLSGPAVAAQDMVSPLRAVVGKGLGLVAPGLPVHQLEVDAISRNRAVVAAYKDDPLVYHGKVPAGVGRVMLQVGETMTRRAPVLTTPLLVVHGSEDRLVLVDGSHRLVECVGSTDVELKVYPGLYHEVFNEPERDQVLEDVVCWILKRL

SEQ ID NO: 55145 - protein, 125 aa, Desulfotalea psychrophila LSv54
MKVQIKTDKAPNAVGPYSQAIKSGNTLYISGQLPINPETGKMCEGSIEDCTRQSLNNLKAVVEEAGGTLDQVVKTTVFLADLKDFVRANIVYAEFFSEPFPARSAFEVAKLPLDGCIEIEAIVNL

SEQ ID NO: 55146 - protein, 287 aa, Nitrosomonas europaea ATCC 19718
MNETSPKIGWFEHISTLLSRKPEDREQLLALLHSAYERNLLDADALAMIEGVMQVSEMQVRDVMIPRSQMDTIDISEKPEGFIPFVMETAHSRFPVTDGSKDQIIGVLLAKDLLRYYASREEFNIRDMLRPVIYIPESKKLNILLKDFRSNRSHIAIVVDEYGGVAGLVTIEDVLEQIVGDIEDEFDFDEDDAYIVADTDGHYRVRAITEISSFNETLGATFSDKEFDTIGGLVINKFGRLPKNGESITIEGFNFTVTRADSRRLHLLKVERIEPGVVEDADSHDSV

SEQ ID NO: 55147 - protein, 114 aa, Synechococcus elongatus PCC 7942
MSEDTIFGKIIRREIPADIVYEDDLCLAFRDVAPQAPVHILVIPKQPIANLLEATAEHQALLGHLLLTVKAIAAQEGLTEGYRTVINTGPAGGQTVYHLHIHLLGGRSLAWPPG

SEQ ID NO: 55148 - protein, 155 aa, Triticum aestivum
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRFRGEGLIPLNIVTKHESWVIVTGAL

SEQ ID NO: 55149 - protein, 353 aa, Saccharomyces cerevisiae
MPKRIVYNISSDFQLKSLLGEGAYGVVCSATHKPTGEIVAIKKIEPFDKPLFALRTLREIKILKHFKHENIITIFNIQRPDSFENFNEVYIIQELMQTDLHRVISTQMLSDDHIQYFIYQTLRAVKVLHGSNVIHRDLKPSNLLINSNCDLKVCDFGLARIIDESAADNSEPTGQQSGMTEYVATRWYRAPEVMLTSAKYSRAMDVWSCGCILAELFLRRPIFPGRDYRHQLLLIFGIIGTPHSDNDLRCIESPRAREYIKSLPMYPAAPLEKMFPRVNPKGIDLLQRMLVFDPAKRITAKEALEHPYLQTYHDPNDEPEGEPIPPSFFEFDHHKEALTTKDLKKLIWNEIFS

SEQ ID NO: 55150 - protein, 472 aa, Streptomyces coelicolor A3(2)
MASTSQAPSPGAGTAHPDHLGHVIFIAAAAAMGGFLFGYDSSVINGAVEAIRDRYDVGSAVLAQVIAVALIGCAIGAATAGRIADRIGRIRCMQIAAVLFTVSAVGSALPFALWDLAMWRIIGGFAIGMASVIGPAYIAEVSPPAYRGRLGSFQQAAIVIGIAVSQLVNWGLLNAAGGDQRGELMGLEAWQVMLGVMVIPAVLYGLLSFAIPESPRFLISVGKRERAKKILEEVEGKDVDFDARVTEIEHAMHREEKSSFKDLLGGSFFFKPIVWIGIGLSVFQQFVGINVAFYYSSTLWQSVGVDPADSFFYSFTTSIINIVGTVIAMIFVDRVGRKPLALIGSVGMVIGLALEAWAFSFDLVDGKLPATQGWVALIAAHVFVLFFALSWGVVVWVFLGEMFPNRIRAAALGVAASAQWIANWAITASFPSLADWNLSGTYVIYTIFAALSIPFVLKFVKETKGKALEEMG

SEQ ID NO: 55151 - protein, 392 aa, Pyrus pyrifolia
MSQVHESETPQDKVVEILSRLTPKSLMRFKCVHKSWCTIINSPSFVAKHLSNTVDDKFSSFTCILFNRSQVHVFADRSWKRDVFWSMVNLSIDSDEHNLHYDVKDLNIPFPMEVQDNVQLYGYCNGIVCVIVGENVLLCNPATREFKQLPDSSLLLPLPTGRFGLETLFKGLGFGYDCKTKEYKVVRIIENCDCEYSEGKESYYERILLPYTAEVYTTAANSWKEIKIDTSSDTDPYCIPYSCSVYLKGFCYWFANDNGEYIFSFDLGDEIFRRIELPFRRESDFNFYGLFLYNESVASYCSRYEEDCKLLEIWVMDDYDGVKRSWTKLLTVGPFKDIESPSTFWKCDEVLILSSYGKATSYNSSTGNLKYLHIPPIINWMIDYVETIVPVK

SEQ ID NO: 55152 - protein, 223 aa, Magnetospirillum magnetotacticum MS-1
NHWSRVIRVFEDAARQIVEDAGEHGAEVKFLVQGTLYPDVVESGGGEGAANIKSHHNVGGLPDDLQFSLVEPLRTLFKDEVRAVGRELGVPEEIVARQPFPGPGLGIRIVGEVTADRLETLRAADAIAREELTKAGLDQEIWQCPVVLLADVRSVGVQGDGRTYGHPIVLRPVSSEDAMTADWTRLPYDVLSVISTRITNEVSEVNRVVLDVTSKPPGTIEWE

SEQ ID NO: 55153 - protein, 397 aa, Pyrus pyrifolia
MTQVCESETLEDRMAEILSRLPPKSLMRFKCIRKSWCTVINNPSFMAKHLSNSVDKKFSSSTCILLHRSHMPVFPDGSWKREYFWSMINLSRDSDEHNLYYDVEDLNVQFPLEDHEHISVHGYCNGIVCLIVGKNALLYNPATRELKQLPDSCLLLPSPPEGKFELESTFQGMGFGYDSKAKEYKVVKIIENCEYSDDERTFSHRIALPHTAEVCITTTNSWRVIEIEISSDTYNCSCSVYLKEFCYWFASDDEECILSFDLGHEIFHRIQLPCRKESGFLFCDIFLYNESIASFCSHYDESDNSGILKILEIWVMDDCDGVKSSWTKLLTLGPFKGNENLLTFWKSDELLIVTSDQRAISYNSSTGNRKYIHIPPIINKITDLEALIYVESIVSIK

SEQ ID NO: 55154 - protein, 216 aa, Zea mays
TRTALKNTPSNTPHTHYPQEPPHRANSPHNEPTHIPPQPASFFLSTKTPPQPTQINPQTITPPTTKSQHQKPTKHHHTTTNPHLKRGVSHIDHTSHFAKKIPSTVEVIPMAKLLLGLLLALAILGTTSAAGCVQDAEDMKRECKQFELFPANPKLPPSAACCAVWKRADVPCLCKYVNKEVEKVWCMEKVVYVANYCKRPFQPGYKCGSYTVPLSM

SEQ ID NO: 55155 - protein, 439 aa, Bradyrhizobium sp. BTAi1
MSRVTETVVPRGSLSERTVSAARQVLEGRHSGLRAYLAFAGPAVIASIAYMDPGNFATNIQAGAKYGYALLWVVLAANLIAMLFQALSAKLGIVTGRNLAEMCRDHFPQPVVWAMWAASEIAAMATDLAEFLGGAIGLSLLFHVPLLAGMAVTAVVTYGVLMFERSGFRPIELIIGGMVSVIALCYVVELFIAPVDWAAAAVHLVLPQIPDGGALLLSVGIIGATVMPHAVYLHSGLTQARTPVHNDAERRKLLRFSNQEVIIALAVAGLVNIAMVMMASGAFHAGYTDVEEIETAYHTLTPLLGIGAAAVFLLSLIASGISSSTVGTMAGQMIMQGFLRFRVPIVVRRLVTMLPAFIVVAVGANATSSLVISQVVLSIALPLPMISLLIFTSRRDIMGQFANSRLTFLAALLGTALVLLLNIFFILQIFGLPMPGFAA

SEQ ID NO: 55156 - protein, 511 aa, Oryza sativa (japonica cultivar-group)
MGRTEGRLASVVHLPGRSRVSASPSPRRRRSPSRSPSPRRNRRRDRSPSPYRSRRDRSPSPYRDRRRQWSPYHRDRGRDVEREWARDRDHPAPRRGGGGAGAGAWSASDDDDDEQLKGLTYFEYRRVKREKLRKSMKRCIWNITPSPPRREGEDEDYGYSDEEEEEEEKKESPKKVASSDKSEEEDSKGSSESDSGESDSLSDSSKSDDTRRKKKGRKGSHRSSKRSRHRRRHHSSDTEGDDNSKAEEDSEGSYDSEDSMDRRKKKRSRRHKKSKRRGRSSRRKKRKSNDTASEGSSEEEAVAAASGSSPSPLRDSKKKSRSSRRKRSKQSDSEDQAPSDADLGVKEIDETNEPEIDPEAIKFKEMLEAQKKAALENEMPVGPMPLPRAEGHISYGGALRPGEGDAIAQYVQQGKRIPRRGEVGLSAEEIQKFEDLGYVMSGSRHQRMNAIRIRKENQVYSAEDKRALAMFNYEEKSKREHKVMADLQRLVQRTIGNDVGPSHDPFATADG

SEQ ID NO: 55157 - protein, 157 aa, Daucus carota
QGRLSQEQSYRGVRKRKWGKWVSEIREPGKKARIWLGSYEAPEMAAAAYDVAALHLRGSAAHLNFPEMVGSLPKPVGSSHADVQRAAQEAAMSMRFGRSENRGPVTVQLSSSEIRAINESPLDSQEMWMEMGGSVFVEERRDDEELEEMQCSSLWKF

SEQ ID NO: 55158 - protein, 143 aa, Ipomoea batatas
MGGALSSVLGGDAAAAAASADDSSSSEPSRVTVFHSSQRWQLHFNASKQLNKLMVVDFAAAWCGPCKMMEPMVKQMATKFTDVDFIKIDVDELSDVAQEFSVQAMPTFLLLKQGKEVGRVVGAKKDELERKIVQHKEVPKFAA

SEQ ID NO: 55159 - protein, 272 aa, Nicotiana tabacum
MAESTREENVYMAKLAEQAERYEEMVEFMEKVAKTVDVEELTVEERNLLSVAYKNVIGARRASWRIISSIEQKEESRGNEDHVSSIKEYRGKIEAELSKICDGILNLLESHLIPVASTAESKVFYLKMKGDYHRYLAEFKTGAERKEAAENTLLAYKSAQDIALAELAPTHPIRLGLALNFSVFYYEILNSSDRACNLAKQAFDDAIAELDTLGEESYKDSTLIMQLLRDNLTLWTSDTTVSLSLSQKYTPTNADAPTNNTVHTSKSFLGSA

SEQ ID NO: 55160 - protein, 413 aa, Bradyrhizobium sp. BTAi1
MMNIHVHTPDETETAVLDEAHIGHIHGALGTILHGDVGPRTTWRHRLQTLLAILGPGLIVMVGDNDAGAFGTYTQAGQNYGTALLWTLVLLIPVLYVNQEMVLRLGAVTGVGHARLILERFGRFWGAFSVIDLFLLNALTIVTEFIGISLGLSYLGLPKELGVALSAVVIMGAASTGNFRQFERFALVLVAGSLVLVPIVIMVHPPMTEIVHNLIVPQFPQGAKLSEVMLLIIAIVGTTIAPWQLFFQQSYVIDKRITPRFIRYQRADLWIGIVLVIVGAVAMMAFTAQAFTGTAEFGQFKDAAAVSAGLEKYAGRLPGVLFAIALIDASIIGAAAVSLSTAYAIGDVLSLRHSLHRKTEGRQRVLCGLLRPDRGGGGPRPQPRRPARSPHKRGPDPSRRAAAERHGVSAAAV

SEQ ID NO: 55161 - protein, 406 aa, marine gamma proteobacterium HTCC2143
MMLTEPLVLIVYGATGFTGELVATYLDGHPELRGKPWAIAGRTQSKLAELSAKLGDRPETFCVDLDDSDAVTAMVSRTTVMLNCAGPYSVNNGAALLGACARAGVHYSDLAGEGFWQAEMIDVFDDLARDSGAKVILGGGVDSIPSDLGAFIAAEALPSEPNQSVQLRGVYTRYTGSFSGGTLNSGKATERAKRSGSYTDAMEANPYLLTTGVIGVETDTPGTADGMAPDFKWAFDSTYGAVSKFFMAPINARVVRRSLVLRNEHQKVSYSECAAVGMWLRLTGMWASRGFGYFLGEPINFKPTSGEGPPSWLLRDGGFEIDVTAKARAKTVRTRISGQGDPGYGATSKMLAELGLCLALDDHSESLHRAGVLTPSTGLGHALILRLTQAQGGKFMQFDTAPPSAN

SEQ ID NO: 55162 - protein, 472 aa, Escherichia coli
  misc_feature (450)..(450): Xaa can be any naturally occurring amino acid
  unsure (1)..(472): unsure at all Xaa locations
MVTINTESALTPRSLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFVGITFWLIPETXNVTLEHIERKLMAGEKLRNIGV

SEQ ID NO: 55163 - protein, 544 aa, Providencia stuartii
MTPGEIKRLYFIIRVFLSYGLDELIPKVKLTLPLRIGRFGFFWIKNQHKGKELGERLRLALQELGPVWIKFGQMLSTRRDLFPLAIADQLSLLQDKVASFDGKLARRYIEESLGGPLEQWFDDFDEKALASASIAQVHTAKLKENGKEVVLKVIRPDILPVIKADVKLMYRIANWVPLLPDGRRLRPKEVVREYEKTLIDELNLLRESANAIQLRRNFENSSMLYVPEVYADYCRENVMVMERIYGIPVSDIAALKAQGTNMKILAERGVKVFFTQVFRDSFFHADMHPGNIFVSYEHPEDPLYIGIDCGIVGSLNKEDKRYLAENFIAFFNRDYRKVAELHVDSGWVPADTNVEDFEFAIRTVCEPIFEKPLAEISFGHVLLNLFNTARRFNMEVQPQLVLLQKTLLYIEGLGRQLYPQLDLWKTAKPFLEDWVHSQVGIPAITQALKEKAPYWAEKMPEIPDLIYGALRQHKFLQSNIEQLSEQLKQQRNKQRKSQYLLGIGATLILCGSLFFISASNRMAIAFMSAGALSWIIGWYKSGKS

SEQ ID NO: 55164 - protein, 224 aa, Brassica oleracea
MERGGGRGGGGGETTICDVNPPTPTKSVTPRYSLSFWEVTAASGVVLGFLIGLVCVYLTMPQSDYSFLKLPRNLHDLQILRDNLEIYTSDYTVQVLVGYSLVYVFMQTFMIPGTVFMSLLAGALFGVFKGMALVVSTATAGASSCFLLSKLIGRPLIFSLWPDKLVFFQDQERVSFSPSFVAASLSLEVGSLSPLSRASVISPSSRYWAGLGPGLVNGNPLHDL

SEQ ID NO: 55165 - protein, 359 aa, Mycobacterium tuberculosis CDC1551
MATHQVDAVVLVGGKGTRLRPLTLSAPKPMLPTAGLPFLTHLLSRIAAAGIEHVILGTSYKPAVFEAEFGDGSALGLQIEYVTEEHPLGTGGGIANVAGKLRNDTAMVFNGDVLSGADLAQLLDFHRSNRADVTLQLVRVGDPRAFGCVPTDEEDRVVAFLEKTEDPPTDQINAGCYVFERNVIDRIPQGREVSVEREVFPALLADGDCKIYGYVDASYWRDMGTPEDFVRGSADLVRGIAPSPALRGHRGEQLVHDGAAVSPGALLIGGTVVGRGAEIGPGTRLDGAVIFDGVRVEAGCVIERSIIGFGARIGPRALIRDGVIGDGADIGARCELLSGARVWPGVFLPDGGIRYSSDV

SEQ ID NO: 55166 - protein, 406 aa, Pseudomonas fluorescens Pf-5
MSVEQAPVQRADFDQVMVPNYAPAAFIPVRGAGSRVWDQSGRELIDFAGGIAVNVLGHAHPALVGALTEQAGKLWHVSNVFTNEPALRLAHKLIDATFAERVFFCNSGAEANEAAFKLARRVAHDRFGAEKYEIIAALNSFHGRTLFTVNVGGQSKYSDGFGPKITGITHVPYNDLAALKAAVSDKTCAVVLEPIQGEGGVLPAELAYLQGARELCDQHNALLVFDEVQTGMGRSGELFAYQHYGVTPDILTSAKSLGGGFPIAAMLTTEALAKHLVVGTHGTTYGGNPLACAVAEAVIDVINTPQVLNGVKAKHDRFKTRLLQIGEKYGLFTEVRGLGLLLGCVLSEAWKGKAKDVFNAAEKEGLMILQAGPDVVRFAPSLVVEDADIDQGLDRFERAVAKLTQA

SEQ ID NO: 55167 - protein, 302 aa, Synechococcus sp. CC9605
MTQAATLSPTPFGRVVTAMVTPFDASGAVDLSVAANLARHLVEQGSDGLLVCGTTGESPTLSWDEQLQLLQAVRDAVGSDAKVLAGTGSNSTAEAVEATKEAAAAGADGALVVVPYYNKPPQEGLEAHFRAIAEAAPELPLMLYNIPGRTGCSIAPATVARLMDCPNVVSFKAASGTTEEVTALRLACGPQLAIYSGDDGLTLPMLAVGAVGVVSVGSHVAGPEIRAMIEAYLNGDGASALALHDALIPLFKALFATTNPIPVKAALELNGWSVGAPRPPLCSLSDDMKRSLSNAMAALRQT

SEQ ID NO: 55168 - protein, 643 aa, Triticum aestivum
  misc_feature (144)..(144): Xaa can be any naturally occurring amino acid
  unsure (1)..(643): unsure at all Xaa locations
SREAVLHHCLLRRLRRQIILACLGVEAAKLKEKTDGYFLTVGERGIVRIWCLESAVCVFEQQSSDVTINSENEESRRGFTATNMLPDDQGILCVTADQQFLFYSCTRTDEGTFQLNLYKRLIGYNDEILDLKFVGEDEQYLAVXTNLEQVRVYDVASMSCSYVLAGHTYNDEILDTCVSTSGKTLVVTGSKDNTVRLWDMEKRSCIGTGKGHLGAIGCVAFSKKSKNFFVSGSSDRTIKVWTWDDTLIDAGGEVPLKAKAGVAAHDKDINSLSVSPNDGLVCSGSEDRTASIWKLPNLVSSVVLKGHKRGIWSVEFSPVEQCVITSSGDKTVKIWHVADGSCLKTFEGHTSSVLRASFLSRGTQFVSCGSDGLVKLWTIKTNECIATYDKHDGKVWALAVGKKTEMLATGGTDSDLNLWHDCTMEDKQEDFLKKEEEVLRGQELENAVSDSDYTRAIQLAFELRRPRRLLELFSQLCRKADPEDPIEKALVGLPKEGLRVLLEYIREWNTKPKFCHVAQFVLFRVLRSLPPTDILEIKGISELLEGLIPYSQRHFSRVDRLVRSTFLLDYTLARMSVVDPDVDAGTTKDSSMNNVEMAPAEPAQDTPEKPGRKRKSSKTTSQSSKKSSKKVKASSSAVVSVEA

SEQ ID NO: 55169 - protein, 1495 aa, Candida albicans SC5314
MSSEDIGSSSSSLQEYVGQQQHNKIQPSTDDDYNEDDYESRRLHLVRTVSSINHHNFDEKFDTISREISRQVTNKEGEFQLRLDEFNLAKILANFVYFAKKQGIVLRKSGITFQDLCVYGVDESFAIAPTVTDLLKGPVGAVQAILSQMKTPPRKILKNLNGFAKPGESVLVLGRPGAGCTTFLKALSGTDFDLYKGVTGDIRYDGLPQKEMLKLFKNDLVYNPELDVHFPHLTVDQTLTFAIACKTPEMRINGVTRDEFINAKKEILATVFGLRHTYHTKVGNDFVRGVSGGERKRVSIAEALACNGSIYCWDNATRGLDASTALEFAQAIRTSTKLLKTTAFVTIYQAGEGIYETFDRVTVLYDGHQVYYGPANKAKKYFEDMGWECPPRQSTAEFLTAITDPIGRFPRAGWENKVPRTAQDFEHYWLNSPQYQELMQEIKDYNDEIDEDETRSKYYQSIQQEKMKGSRTKSPFTISYLEQLKLCFIRSYQRILGDSAYTITLMFASVAQAFVAGSLYYNTPDDVSGAFSRGGVIFFAVLFMSLMGLAEISASFSSRPILMKQKNYTMYHPSADSLSNFVMSIPISIFINTFFVIILYFLSNLARDAGKFFICYLFVIMLHLTMKSMFQAIAAINKSIAGANAMGGILMLASLMYSSYMIQRPSMHPWFKWISYINPVLYAFEAVIASEFHGRKMQCTSQYLTPSGPGYENLGAGEQVCTFIGSVPGQSWVLGDDYLRIAYTYRFSHVWRNLGILFGFLAFFLAIATLGTEYVKPITGGGDKLLFLKGKVPEHITLPSEKKEEDIESGGNSDTTATSNGTLSQGKSEEKAAIADDGLKAKGVFVWKDVDYVIPYEGKKRQLLQNVSGYCVPGTLTALMGESGAGKTTLLNVLAQRVDFGVITGDMLVNGRPLDTSFSRRTGYVQQQDIHFSEVTVRESLQFAARLRRSNDVSDAEKLEYVEKIIDVLDMRGYADAVVGRLGNGLNVEQRKKLSIGVELVAKPSLLLFLDEPTSGLDSQSAWAIVKLLRDLANAGQSILCTIHQPSATLFEEFDRLLLLKKGGIVTYFGDIGPRSRTILDYFERNGARHCDDKENPAEYILEAIGAGATASTDFDWGEIWAQSPEKVQTDAKRDELINESAKNATDTSATDSPSEKNLTSKYATPYWYQFRHVTHRTSLIFYRDPDYIAAKVFLMTIAGLFIGFTFFGLKHTKTGAQNGMFCAFLSCVIAAPLINQMLEKAGSRDIYEVREKLSNTYHWSLLILPQIIFEVIYMIIGGTIMFVCLYFPTQVSTVASHSGMFYFSQAIFLQTFAVSFGLMVSYVSPDIESASVIVSFLYTFIVSFSGVVQPVNLMPGFWTFMNKVSPYTYFIQNLVSSFLHDRTIRCNAKELSYFNPPSGQTCKEFASAFISRNGGYLVDEGATSNCGYCNFSNADQYLLTIGAKFSYRWRNIGFFCVYIIFNISVCLVLYYFLRYRKVSFNVTGLVNKFKKSKK

SEQ ID NO: 55170 - protein, 363 aa, Magnaporthe grisea 70-15
MPAMALPKYQHPAETKHELDWAELVTLDLSQFDAPGGKEKLAVQLRDAVHQVGFFYVVNHGLGQDAVDEQYAIGQEVFKLPLEEKMKHIADIASGSYNGYRPAGMRELAPGLRDNVEMYNMFKMNGKLERSHPEVVVRHRAKVEAFQRHLVEDVVRKLLVLLAIVLDLPDENQLLEGHRFDDISDCHLRYMYYHARSPEENAKFGDVYVGGHTDYGTLTLLFRQPVAALQVRMADGGWKWVKPYPESITVNIADALQFWSGGYLKSSIHRVAVPPEDQAHINRLGLLYFVRPGSDLSLKTLESPLLRRLGLKTDEDEAAGIKGADWVKERVRQDLEKAKEDKEKGGTKEIPVLGGLSVKYYRD

SEQ ID NO: 55171 - protein, 204 aa, Brassica napus
MGIRSLHFTRTHKFITMTSIAENQNFKVLFSFFLLVLFFSHTVSVFPKYIDQKKPCKQFSFYYHDIIYDGGDNAANATSAAIVNPPGLGNFKFGKLVIFDDPITMDRNYLSEYVARAQGFYFYDKKLGVNAWICLTLVFNSTEHNGTLNIMGADLMREPTRDIPVVGGTGDFFMARGIATVETDATEGLRYFRLKMDIKLYECY

SEQ ID NO: 55172 - protein, 312 aa, Oryza sativa (indica cultivar-group)
MKQPEGYKWEKYPQMPHVPSEPSNPTIGRSLRLRRISPPYQLIARRAESRKQGDPAAESGRISPAMMPSASDAAAAAAALELQESGWEELRREARKLEGDLDVKLSSYARLAARSSSAADAASASSPSERSSWKSMEFEIQSLLDKLQDVNDAMSRCAASTAPTTSVSQKLARHRDILHEFAQEFRRTRGNLSSIREHADLLSSVRDDITESKATGGMSPRVHLLRERASIHGSINQIDEVIGQAQSTRVALSNQRALFGDVQGKVKQLGEKFPVIRGLLGAIKRKKSKDTIILSAVIAACTIFLIIYWLSK

SEQ ID NO: 55173 - protein, 311 aa, Thiomicrospira crunogena XCL-2
MDTLTIAKRVFDIEAEAVYHLKTLLDENFSQSVDAILATEGRVVICGMGKSGLIGKKIMATLASTGTPCFFMHPGEAFHGDLGMVSPKDVFIALSNSGETEEVIKLIPFLKDNGNTIISMTGRPDSTLAKNSNFHLNIAVPQEACPHQLAPTSSTTATLVMGDALAVALMEKRDFQPQDFARFHPGGSLGRKLLTRVKHEMKSENLPFVEKSASMKDVIHTMTDGRLGLCIVNQGEGIITDGDLRRQMEEDPANFMQKTAGDIMGTHPKMIDSEARLSDAEEMMTQKKITSLLVSDQNQVVGVIQIYDLNN

SEQ ID NO: 55174 - protein, 157 aa, Daucus carota
NQQGRLSQEQSYRGVRKRKWGKWVSEIREPGKKARIWLGSYEAPEMAAAAYDVAALHLRGSAAHLNFPELVGSLPKPVGSSHADVQRAAQEAAMGFGKSENRGPVTVQLSSSEIRAINESPLDSPKMWMEMGGSVFLEERRDEEQLEEMQCSSLWKF

SEQ ID NO: 55175 - protein, 596 aa, Debaryomyces hansenii CBS767
MHALFETDWFLDSKKYGTPCIPKSFNEFMYLVEINAFYTYNKLRDYINTYYINAYCGVWGYLAIIRDAVFIYLMYLYMSQMVVLIRGRGMIASIRIFIHAISKRGFQFLLSIPPIKKKIDQELSETTKKIEEELMQNDESLMQFKSLPEKGLDATIVKKELDRLQDLKHSDWYNGRVSGAVYHGGNELLDLQSDAYHKYSIANQLHPDVFPGIRKMESEIVSMVLRLFNAPEEGCGSTTSGGTESLLLAGLSAREYGKFYKNISNPEIIAPITIHAGIEKACYYFGMKLHKVDLDPVTFKVDVNKVKKLINGNTVLLVGSAPNFPHGIIDDIEALSNLAVKYKIPLHVDACLGSFIVSFLEKSKVHGDKPIPKFDFRLPGVTSISCDTHKYGFAPKGSSIVMYRNSKLRQCQYYILTDWTGGMYGSPTLAGSRPGALMAGCWATLVNFGEDNYAESCRTIVGASMKLKCAIKEHEMLSKYLEVIGDPIGSVVAFGVTKNYRSTLSIYKIGECLSSKGWHFSTLQNPAALHFALTRLTVPVIGELISDLVEVTSAALKDESNSESEIAALYGVAGSVKTTGVAERVVVAFLDTLYKI

SEQ ID NO: 55176 - protein, 521 aa, Solanum lycopersicum
MGICASKGKPNNANNGHHGSGSGGVPIHRNEIQYTKSPGPEAQLHVRPPPSPKPAVRYDTILGKPYEDVKLHYTLGKELGRGQFGVTYLCTEIATGQQYACKSISKKKLVTKADKDDMRREIKIMQHLSGQPNIVEFKGAYEDKGSVYLVMELCGGGELFDRIIAKGHYSERAAATMCRAIVNVVHVCHFMGVLHRDLKPENFLLSDKSENAALKITDFGLSVFIQEGKSYKDIVGSAYYVAPEVLRRCYGKEIDIWSAGVMLYILLSGVPPFWAETEKGIFDAILKGTIDFESKPWPSVSSSAKDLVQKMLTKDPKKRITAAQVLEHPWLKEGGVASDKPLDGAVLSRMKQFRAMNKLKKLALKVIAENLSAEEIHGLKAMFHNIDTDNSGTITYEELKSGLAKLGSKLTEAEVKQLMEAADVDGNGSIDYTEFITATMHKHRLERDENLYTAFQYFDKDSSGFITRDELEAAMEEHGIGDPSCIREIISEVDTDNDGRINYEEFCTMMRSGAKQPGKVF

SEQ ID NO: 55177 - protein, 166 aa, Triticum aestivum
  misc_feature (77)..(77): Xaa can be any naturally occurring amino acid
  unsure (1)..(166): unsure at all Xaa locations
DAWEGIGHAIVEELARFGARVHTCSRNTEELEECRRRWEEKNLQVTVSVCDVSIGADRERLMETVRQTFDSKLDILXESTFHLSQLAHPLLLHASIAGGGTIINMSSIGGSIGFAGYTIYATTKGAIHQLTRSLATEWGPDKIRVNAIAPSFITTDMIKDIDTEFM

SEQ ID NO: 55178 - protein, 109 aa, Glycine max
MDGLQRSEVSFRRQGSSGLVWDDKLLSGELNKVNNNEDQKGGGSGGDLNLKVRTTPPNTTIQRSRSNGGYRTGKVSPAIEPPSPKLSACGFCSAFGKTREKGRAKHRSR

SEQ ID NO: 55179 - protein, 256 aa, Gluconobacter oxydans 621H
MSHPDLFSLSGARALVTGASRGIGLTLAKGLARYGAEVVLNGRNAESLDSAQSGFEAEGLKASTAVFDVTDQDAVIDGVAAIERDMGPIDILINNAGIQRRAPLEEFSRKDWDDLMSTNVNAVFFVGQAVARHMIPRGRGKIVNICSVQSELARPGIAPYTATKGAVKNLTKGMATDWGRHGLQINGLAPGYFATEMTERLVADEEFTDWLCKRTPAGRWGQVEELVGAAVFLSSRASSFVNGQVLMVDGGITVSL

SEQ ID NO: 55180 - protein, 795 aa, Vibrio parahaemolyticus RIMD 2210633
MFLEKDMQKNTLWFNGLSMDDVDKVGGKNASLGEMVSNLANVGVSVPNGFATTSYAFNQFLDHEGLDERIHQLLDELDVDDVEALRKTGATIRQWVLQAPFPADLEQEIRNNYEELIEGNTELSVAVRSSATAEDLPDASFAGQQETFLNVKGIDAVLEATKHVYASLFNDRAISYRVHQGFDHRGISLSAGIQRMVRSDKASSGVMFTLDTESGFDQVVFITSSWGLGEMVVQGAVNPDEFYVHKPMLEAGEHPIVKKTFGSKLIKMIYSNNQEIGKQVDIIDTSEEERNTFSLNEEEIKELAKQAMIIEKHYQRPMDIEWAKDGIDGKLYIVQARPETVCSQTEQNVIERYELNNKADVLVEGRAIGQRIGKGPVRLVDSLDQMSLVQEGDVLVTDMTDPDWEPVMKKASAIVTNRGGRTCHAAIIARELGIPAIVGCGDATSKLTDGATVTVSCSEGETGYVYQGDLDFEVKRSSVDELPLLPTKVMMNVGNPDRAFDFAQIPNEGVGLARLEFIINKMIGIHPKALLNFDAQSDELKAEIKQRIRGYKDPIDFYVSKLTEGIATIASAFWPKRVIVRMSDFKSNEYSNLVGGKAYEPHEENPMLGFRGASRYISPVFEDCFELETQAIKRVRNEMGLKNVEIMIPFVRTPSEAASVIDLLAKFDLRRGDQGLKVIMMCELPSNAVLADEFLKYFDGFSIGSNDMTQLTLGLDRDSGDVAHLFDERNAAVKIMLKMAIDAATKAGKYVGICGQGPSDHEDLAEWLMEQGISSVSLNPDTVIDTWLQLGKVSK

SEQ ID NO: 55181 - protein, 215 aa, Xylella fastidiosa Temecula1
MSEAKRRAAEKAIEYVENDMIIGVGTGSTVAYFIDALGHTPKRIKGAVSSSEQSTAHLKQHGIEVLELNHTGTLPLYVDGADECDPYKRLIKGGGASLTREKIIAEASKQFICIIDPNKQVATLGKFPLPIEVIPMARSLVARQIMARTDGQPVWREGVITDNGNVILDVHHLCITDPVKLEQELNQIPGVVCVGLFARRCADLVIIGSEPPHIL

SEQ ID NO: 55182 - protein, 559 aa, Symbiobacterium thermophilum IAM 14863
MAQRKIVIVGGVAGGATAAARARRTDEHAEIVLFEKGPYISFANCGLPYYVGKEIGDRSALLLQTPESFRARFEVDVRVLHEVVAIDRAAKRVTVRNLETGEVYHESYTALVLAPGSVPIRPPLPGIGLPNVFTVRTVPDAVAIRELVERESPARAVVVGAGFIGLEMVENLAGLGLAVTLVEKADQVLPPLDPEMAAFVQSHLEQMGVEVITGDGIAAFTGNDRATAARLESGREVEGDLFILGLGVRPDTRLAREAGLAIGPTGGIQVNERMQTNDPAIYAAGDAVETIHLVTGRPALIPLAGPANKQGRVAGANAAGDSLTFPGAIGTAIVRVGSLVAAVTGLSEKAARREGLKVYTSYTLSGDHADYYPGMQELMTKLVVESDTGRLLGAQVIGANGVDKRTDVYATAILGRMTVDQLANLDLAYAPPFGAAKDAAVVAGMVAQNIRRAALRVITPEELLGRMEAGEELQVVDVRNPYEYDMGAVPGAVNIPVDELRSRLGELDPSRETVVYDRTGAMAYVAARILAQRGYSVSSLAGGYALFPAAEAVRAQRTL

SEQ ID NO: 55183 - protein, 113 aa, Triticum aestivum
  misc_feature (33)..(33): Xaa can be any naturally occurring amino acid
  unsure (1)..(113): unsure at all Xaa locations
MAANFWASSHSKQLLDPEDVDVVPAADRERGIXTTEEFRLDKIHMSSHIWRLAHQVKVRQRVIATAITDLRWVYTRTTMSEYDPPTGSPRVCLYVPSKVEESPGKGRTSSAST

SEQ ID NO: 55184 - protein, 260 aa, marine gamma proteobacterium HTCC2143
MNIEKTAQHFNLTDKVIVITGGTRGMGLEMAKAFAQAGASLVVSSRKADACAAVAAAIRDEIGTACIGVPCHVADWDACDALVDAAYAEYGRVDVLVNNAGMSPLYDKLSSVSRDLFDKVIGVNLAGPYRLSALIGERMAEGDGGSIINVSSTSSLMPGAKEIPYAAAKAGLNALTTGLAHALGPKVRTNCILPGPFLTDISKAWDMDAMSKVFEKTIPMQRAGHAEEIVGAALYLASDASSFTNGAIIKVDGGMSYAAS

SEQ ID NO: 55185 - protein, 574 aa, Saccharomyces cerevisiae
MAVEENNVPVVSQQPQAGEDVISSLSKDSHLSAQSQKYSNDELKAGESGPEGSQSVPIEIPKKPMSEYVTVSLLCLCVRFGGFMFGWDTSTISGFVVQTDFLRRFGMKHKDGTHYLSNVRTGLIVAIFNIGCAFGGIILSKGGDMYGRKKGLSIVVSVYIVGIIIQIASINKWYQYFIGRIISGLGVGGIAVLCPMLISEIAPKHLRGTLVSCYQLMITAGIFLGYCTNYGTKSYSNSVQWRVPLGLCFAWSLFMIGALTLVPESPRYLCEVNKVEDAKRSIAKSNKVSPEDPAVQAELDLIMAGIEAEKLAGNASWGELFSTKTKVFQRLLMGVFVQMFQQLTGNNYFFYYGTVIFKSVGLDDSFETSIVIGVVNFASTFFSLWTVENLGRRKCLLLGAATMMACMVIYASVGVTRLYPHGKSQPSSKGAGNCMIVFTCFYIFCYATTWAPVAWVITAESFPLRVKSKCMALASASNWVWGFLIAFFTPFITSAINFYYGYVFMGCLVAMFFYVFFFVPETKGLSLEEIQELWEEGVLPWKSEGWIPSSRRGNNYDLEDLQHDDKPWYKAMLE

SEQ ID NO: 55186 - protein, 424 aa, Solanum lycopersicum
MGKDEDEMRGEIEERLINEEYKIWKKNTPFLYDLVITHALEWPSLTVEWLPDREEPSGKDYSVQKMILGTHTSENEPNYLMLAQVQLPLEDAENDARHYDDDRSEFGGFGCANGKVQIIQQINHDGEVNRARYMPQNPFIIATKTVSAEVYVFDYSKHPSKPPLDGACNPDLRLRGHSTEGYGLSWSQFKQGHLLSGSDDSHICLWDINATPKNKALEAMQIFKVHEGVVEDVAWHLRHEYLFGSVGDDQYLHVWDLRTPSVTKPIQSVVAHQSEVNCLAFNPFNEWVVATGSTDKTVKLFDLRKISTALHTLDCHKEEVFQVGWNPKNETILASCCLGRRLMVWDLSRIDEEQTPEDAEDGPPELLFIHGGHTSKISDFSWNPCEDWVVASVAEDNILQIWQMAENIYHDEDDLPGDDAPKGP

SEQ ID NO: 55187 - protein, 116 aa, Streptomyces coelicolor A3(2)
MSHLLDSVDAASLRSDVPAFRPGDTVNVHVRVIEGNRSRVQQFKGVVIRRQGAGVRETFTVRKVSFSVGVERTFPVHTPIVEKIELVTRGDVRRAKLYYLRELRGKAAKIKEKRDS

SEQ ID NO: 55188 - protein, 574 aa, Saccharomyces cerevisiae
MAVEENNVPVVSQQPQAGEDVISSLSKDSHLSAQSQKYSNDELKAGESGPEGSQSVPIEIPKKPMSEYVTVSLLCLCVAFGGFMFGWDTSTISGFVVQTDFLRRFGMKHKDGTHYLSNVRTGLIVAIFNIGCAFGGIILSKGGDMYGRKKGLSIVVSVYIVGIIIQIASINKWYQYFIGRIISGLGVGGIAVLCPMLISEIAPKHLRGTLVSCYQLMITAGIFLGYCTNYGTKSYSNSVQWRVPLGLCFAWSLFMIGALTLVPESPRYLCEVNKVEDAKRSIAKSNKVSPEDPAVQAELDLIMAGIEAEKLAGNASWGELFSTKTKVFQRLLMGVFVQMFQQLTGNNYFFYYGTVIFKSVGLDDSFETSIVIGVVNFASTFFSLWTVENLGRRKCLLLGAATMMACMVIYASVGVTRLYPHGKSQPSSKGAGNCMIVFTCFYIFCYATTWAPVAWVITAESFPLRVKSKCMALASASNWVWGFLIAFFTPFITSAINFYYGYVFMGCLVAMFFYVFFFVPETKGLSLEEIQELWEEGVLPWKSEGWIPSSRRGNNYDLEDLQHDDKPWYKAMLE

SEQ ID NO: 55189 - protein, 256 aa, Oryza sativa (indica cultivar-group)
MSSLPPPLPSTRSLAIPLEWTLYEQVAVAAMDCQRLDVAKDCIGVLSKQFPGSMRVGRLEALLFEAKGEWTDAERAYALILENNPFDQIVHKRKIAIAKAQGDMALAVEYLNKYLELFMADHDAWRELAETYVALQMYKQAAFCYEELILAQPTVPLYHLAYAEVLYTMGGLENLQTARKYYASTIQLTGGKNTRALFGVCLCSSAINQLTKGRNKEEESSELQSLASEALLKDYKQRAPSKEALITSLLKNMKLS

SEQ ID NO: 55190 - protein, 189 aa, Brassica napus
  misc_feature (4)..(4): Xaa can be any naturally occurring amino acid
  unsure (1)..(189): unsure at all Xaa locations
QKQXRSIPSSNLKTNSSISYLKSQEFDKNSWGWSWLERWMAARPWETRLMDATDAATPPTKHMKSPEVVKVRRNNVTTRVSARPPPHMSSSSSGYDFNVSPGSTTPASGTTGLVSDNSSKNKPSYMSMTESTKAKRRTNHVIRQSMDEFQFMNNSGLFTGDLKTSSPVSSDPSYVTNFSKPFGVSTRRG

SEQ ID NO: 55191 - protein, 298 aa, Aspergillus oryzae
MSTQELTGVMVALITPFTDDGSKIDEGRLKSHIDRLLQAGVHGLVPGGSTGEFTVLSLAERKQLTELCVKYAAGRVPVVAGTGATSTQEAVELAKHAGEVGAAAVMVVPPFYDPVNYEQLTEMMSEIHTESKLPIMYYNIPSASGLTLTPQQIADLSKVGVKYLKDTSGNAPAYTELVFALSDKITAFNGWDTLTFYGMAAGAPGCVWGAANVIPELAVQLWEAIAVKGDLKLGRELWAKAFPICKFLESHNYAAAVKTGVELTGQPTGGLRKPFALLADQHKAELASFMQSAGIKTV

SEQ ID NO: 55192 - protein, 463 aa, Streptococcus pyogenes MGAS8232
MTIFRKKKKYSNKTEMQRHFKVIDLIFLGLGSMVGTGIFTVTGIGAAKYAGPALTISIIISAIAIGILALFYAEFASRMPSNGGAYSYVYATLGEFPAWLVGWYIIMEFLTAISSVAVGWGSYLKGLLANYNIVLPNALNGTFNLKNGTYIDILPVLVMFFVTGIVLMNSKLALRFNSFLVILKFSALALFIFVGIFFIDHNNWSHFAPYGVGQITGGKTGIFAGASVMFFAFLGFESISMAVDEVKEPQKTIPKGIILSLIIVTALYIVVTTILTGIVHYTKLNVPDAVAFALRNIRLYWAADYVSIVAILTLITVCISMTYALARTIYSISRDGLLPKSLYTLTKKNKVPQNATLVTGLLAMICAGIFPLSSLAEFVNICTLAYLIILSGAIIKLRRIEGEPKANEFKTPLVPFLPILAIIICLSFMSQYKAFTWIAFAIATIIGTLIYLAYGYTHSIENK

SEQ ID NO: 55193 - protein, 352 aa, Oryza sativa (japonica cultivar-group)
MPKKGTKSRKGTDDEPKQEEKNKLPEHLEVQRTRVVCKGDAPVNTEGFQYAGAFAAMGIDNSVSADKFCKNFKVVVNRLTEDDMEFDMIGIDASMANAFRRILIAEVPTMAIEKVLMADNTSVIADEVLSHRLGLIPLDADPRLFEYISENDVPTERNTIVYKLHVSCKKGSPRLTVKSGDLEWLPEGSQLPLASPAQSGDKQKTYTSFSQSQKDILEKPLGVKFKDITIARLGPGQAIELEVHAVKGIGKVHAKWSPVATAWYRMLPEVVLREEIKDADAEMLVAKCPVNVFDIEDLGNGEKRAVVARPRACTLCRQCVMGPTGEVMGPTFFTVIFCWEGVCAKIYLLTKS

SEQ ID NO: 55194 - protein, 320 aa, Thiomicrospira crunogena XCL-2
MSFILAGDVGATKVLLQAYHQGEQRLLAEKRYLSADFFSLTLLVQHFQNEFDLPYFTAACFGVPGPVVGQQVRLTNLPWVIRADELAQTCQIDQVEILNDFYAAALGIDELTESDLICLQDGEYERLGNRLVIGAGSGLGVAPVKNCQGAFIPQPSEGGHMDFAPLNGHQIQILTWLQQKWPHVSYERLLSGEGLETLYFFYNIQSHGHGKKSVTAAQIYQEAINGEKIACQTLDTFVQIYGAFTGNAALIWEAKAGIFIAGGIAPKIKDWILKPLFMEAFLSKGRMRKVVETFPIYLVMNEKVGLLGAMRRAQAINGDQ

SEQ ID NO: 55195 - protein, 422 aa, Thiomicrospira crunogena XCL-2
MKYYCETKSATDLTRKTLALVLAGGEGSRLKDLTKWRAKPAVPFGGKYRIIDFVLSNCVNSGIRKIGVLTQYKSHSLIRHVQRAWSFMRYEVGEFVELLPAQQRVDKGWYKGTADALYQNLDIMRRHTPDYVLVLGGDHIYSMDYSKMLYEHAESGADVTIGCIEVPRMEATGFGVMSVDECFKITKFTEKPANPDAMPHKPDKALASMGIYVFSTEFLFQKLIEDADNPNSSRDFGKDIIPSIIEDWQVRAFPFEDETGLPVYWRDVGTIESYWKASLDLCSITPDLNLYDEDWPIWTYQAQMPPAKFIFDDEGRRGEAIDSLVAGGCIISGARIKRSVISSGGHVHSFCLVKDSVLLPRVKVERNCRIQNAVIDKGCVIPEGTVIGEDLEADRKRFYVEEASGIVLVTPDMLGQRLHITR

SEQ ID NO: 55196 - protein, 371 aa, Glycine max
MDRLLSSCSSSLNTNLKPFSLLPRFDSVRFNPFSSTRCSFTSISSKHETPPPLSSSPPKTLPPLSPSPLIHFHASVPPSQPLTPNNFQNPKAITARTFAILSSLVLLLIQPAFAPAAFATFQNAAKTGGPAAAAVGGKLIRTELLTSAWTGFFAGCLHTLSGPDHLAALAPLSIGRTRMESAAVGALWGCGHDAGQVIFGLIFLLLKDRLHIEIIRTWGTRVVGLTLLVIGAMGIKEASEVPTPCVALENGECDVSVYESRDSNPVVGKKKIGFATFATGIVHGLQPDALMMVLPALALPSRLAGAAFLIMFLLGTVVAMGSYTVFIGSCSEALKDRVPRITEKLTWASSLIAIALGFAIIISQFFGFSLY

SEQ ID NO: 55197 - protein, 505 aa, Aspergillus oryzae
MPELDLFLDITAPNGRQYKQPTGLFIDNEFVKSTSGQTIASIDPATTREIASVYAAGAEDVDKAVNAAKAALKDDSWKLLPATDRGMLMGRLADLIEQNKELFATIDAWDNGKPYHVALSEDLVEAITTFRYYSGWADKTFGQTINTTPQKFAYTIRQPIGVVGQIIPWNYPLSMAAWKLGPALACGNTVVIKAAEQTPLSILVLGTLIKEAGFPKGVVNIINGYGREAGAALVQHPLVDKVAFTGSTATAREIMKMAAGSLKNITLETGGKSPLIVFNDTDMEQAVKWSHFGIISNQGQICTATSRILVQKDIYDTFVEQFKGAIQTTSKIGDQWDESTFQGPQVTRAQYDRVLEYIQVGISEGATVASGGGPHPANSNGESGYYVQPTVFTNVKDSMRIYREEIFGPVVVIVPFETEEEAIRRANDTTYGLGAAVFTKDLERAHRVAAEIESGMVWINSSQDCDPRVPFGGVKQSGIGRELGEAGLEAYSQVKAVHVNMGNKL

SEQ ID NO: 55198 - protein, 154 aa, Glycine max
PNDIKLSVLFVGTVYRCLICVTLHDDHMELPRQLHDDDSVSCTATDPCLNYKPVIGILTHPGDGASGRLNNAIRVCYIADSYVKFMESGGARVIRRIYNETPENLNKKLDWVNGVLFTAGKADLGPYWDTLGNFCKIALDKSYAGEHLSGIDYL

SEQ ID NO: 55199 - protein, 426 aa, Oryza sativa
MAKYGEGDARWIVQERADGTNVHNWHWAERDCLEWSRSRLTSLLAGLPVLSGEGGLALRTTALDKLDGEAYVNIRKGKVIPGYELSLTLAWEAEATTESGVVKVSGAAEVPYLADENADEDPELRVTVRGDDGPVARRAKDAFLTKGKPLVLEKIREYVAAMAKGGPAKDELDSKKTPTKAAAVEAGGAATAPAPAAEKKEEAPAVKEKKAKAKDKEGFKTIEMTEKFYCRAKDMYEILMDENRWKGFTQSNARISREVGGQFSLFDGSISGVNEELQEGKLIVQKWRFGSWPDGVHSTRLELTSSNSLSDHVIPDLAFGGCCDFAAFQAAACTTSALGTRQWGAVFMVGDSAPGTWHYATVFLGGSIFTCHLSMDGVGAGAAPVGGVCECRLSLRLPLLRAHSGEVSFKLSLHDLSVLPNCLSKE

SEQ ID NO: 55200 - protein, 268 aa, Archaeoglobus fulgidus
  misc_feature (1)..(1): Xaa can be any naturally occurring amino acid
  misc_feature (12)..(12): Xaa can be any naturally occurring amino acid
  misc_feature (58)..(58): Xaa can be any naturally occurring amino acid
  misc_feature (99)..(99): Xaa can be any naturally occurring amino acid
  misc_feature (180)..(180): Xaa can be any naturally occurring amino acid
  misc_feature (196)..(196): Xaa can be any naturally occurring amino acid
  misc_feature (234)..(234): Xaa can be any naturally occurring amino acid
  misc_feature (244)..(244): Xaa can be any naturally occurring amino acid
  unsure (1)..(268): unsure at all Xaa locations
XGHHHHHHGGHXSLLTFVGLGLWDVKDISVKGLEAVREADEVYVEYYTSKLLSSIEEXEEFFGKRVVELERSDLEENSFRLIERAKSKSVVLLVPGDPXVATTHSAIKLEAERKGVKTRIIHGASISTAVCGLTGLHNYRFGKSATVSWHRSQTPVNVIKANRSIDAHTLLFLDLHPEPXTIGHAVENLIAEDAQXKDLYAVGIARAGSGEEVVKCDRLENLKKIDFGKPLHVXVVLAKTLHFXEFECLREFADAPAELERLVAEGGS

SEQ ID NO: 55201 - protein, 251 aa, Neisseria meningitidis Z2491
MWDQKWVIGNWKMNGRLQNNNSLMHRFRILPTAERVLIGLAAPTVYLLQLHNAMQIVLNNRILTCAQDVSRFPDNGAYTGEVSAEMLADTGTDIVLIGHSERSLYFGEKNEIQRRKMENVLNVGLIPLLCVGESLEEREAGKEHEVIAHQLSILQGLDTKNIAVAYEPVWAIGTGKVATVEQIADMHAFIYKEILSLCGSDVKIRVLYGGSVKADNAADIFAVPYVDGALVGGASLSYDSFTAIISAAQNA

SEQ ID NO: 55202 - protein, 300 aa, Arabidopsis thaliana
MSSSEAFPVMQEIMLEFRAGKMSLQGTRVVPDARKGLVRIARGDEGLIHFQWLDRNQNTVEDDQIVFPDEALFEKVNQSSDRVYILKFNSDDRKLFFWMQEPRAEGDAELCSSVNQYLNQPLEFPGEDGLAAAITEELEDMAEDNTSSRAGNLVVPNLSSEVSDVTSSSGPVKLADLQRILNNLSGGPVGIAGDQDEGLALGDILKPELIMPLLEALPVQERLSSHLPEGHSRAEDILELLQSPPFRQQVDAFTYVLRTGQIDLTQFGIDPSKYKFTVDSFLEALEDSVSTQSRDAMDES

SEQ ID NO: 55203 - protein, 198 aa, Glycine max
  misc_feature (151)..(151): Xaa can be any naturally occurring amino acid
  misc_feature (165)..(165): Xaa can be any naturally occurring amino acid
  unsure (1)..(198): unsure at all Xaa locations
DPKFPNLLEPLAGRPRTAKQKSLLAQKTVRHLLKKHSLIDQAQEADHFSIFETSPSALQLNIPLDDSPGTPDNYLKSFSLQKYSASSSARKRPLSRLKTKHAEPSPPVLKPLKNTVLHEKYINQLTRREGAKKPRKKAAGTNATDPERPLXEQRAGSVKAAKNAXISEATDFIGQFKKLQANSLAHVENSEDDEDNSV

SEQ ID NO: 55204 - protein, 396 aa, Agrobacterium tumefaciens str. C58
MTEHNVRNFTINFGPEHPSAHGVLRLVLELDGEIVERVDPHIGLLHRGTEKLIETKTYLQAVPYFDRLDYVAPMNQEHAFALAVEKLLGLEIPMRGQLIRVLYSEIGRILSHIMNVTTQAMDVGAMTPPVWGFEEREKLMVFYERACGARMHSAYVRPGGVHQDLPPELVDDIGKWCDPFLTVLDNIEGLLTDNRIYKQRNVDIGVVSLEDAFAWGFTGVMVRGSGAAWDLRRSQPYECYSDLEFDIPVGKNGDCYDRYLIRMQEMRESVKIMKQCVDRLSGKHRIGPVSSLDGKVVPPKRGEMKRSMEALIHHFKLYTEGYHVPAGEVYAAVEAPKGEFGVYVVADGSNKPYRCKIRAPGYAHLQAMDFLCKGHQLADVTAVLGSLDIVFGEVDR

SEQ ID NO: 55205 - protein, 362 aa, Xylella fastidiosa Temecula1
MSISFDIARSLSTTSDEELSMILQAPGFGVHFTDHMIAIAWDKDNDWHDAQVRAYGPLLLDPAAAVLHYGQEIFEGIKAYRHADGSIWTFRPEANARRLQRSAKRLVLPELPVELFTESLRQLIAVDARWVPSAPETSLYFRPFMIATEAYLGVRAAQHASYYLIASPAGPYFAKGVTPVSIWLSTDCARAALGGTGAVKCGGNYAASLLPQQVAQTQGCSQVLFLDPVEGKYLEELGGMNVFLVYTDGTLVTPALSGSILEGITRESILQLARDRGMCVEERKVAIEEWKEGVVSGAISEVFACGTAAVITPIGELKAEGFSVGNINAPPGEVTLSLRKELTDIQYGRLPDRYGWMTCLKE

SEQ ID NO: 55206 - protein, 457 aa, Desulfotalea psychrophila LSv54
MCRYFVSFRICSRFFKVDTMSFTKKEQLKDPNYLPPLHLAIPLGIQHVLAMFISNITPAIIISLAAGFTFGSPEMVYMIQMVMTFAGIATLLQTVGLGPVGARLPIVQGTSFAFLPIMIPLVKIAGISALYGSIMLSGIFHFFLGTVIGRIRNFLPPLVTGIVVLTIGLSLIPIGIQYAAGGVPLMGTEEFGSMQHWGLSLTVLFVTLILKFFGRGMLSTASVLIGLIVGYLVAISMGMVNFSHIENAAWFAMPTPLHFGFELSLSSVFAMSLMAFVSAIETVGDVSGITQGGAGREATEKEIAGATMADGLGTTLGAFFGALPNTSFSQNVGLVSMTGVMSRHVVTIGALFLIMAGLVPKVGAVISAMPIAVLGGSVIVMFGMVISAGINMLSDVVWNKRNMLILALALSIGLGFQAVPEALQHLPGTTKILLTSGILPAALIAIILNMILPEELG

SEQ ID NO: 55207 - protein, 163 aa, Agrobacterium tumefaciens str. C58
MASLSQAVNSLFLKEFVGAIFLTMRHFFKQKATINYPFEKGPVSPRFRGEHALRRYPNGEERCIACKLCEAICPAQAITIEAGPRRNDGTRRTVRYDIDMVKCIYCGFCQEACPVDAIVEGPNFEFATETREELYFDKQRLLDNGDRWEREIARNLALDAPYR

SEQ ID NO: 55208 - protein, 245 aa, Cryptococcus neoformans var. neoformans JEC21
MTSAQEITDCRIEINDTSLSIRIEPEEPNSAHPLTLNLIFEYPETYPDVIPELIIEAIDEESGDLTEEEREKVLGELNSIAEESLGMAMSFTIASAAREALGVVISERLRKEKEEDDRRTREYEEAEAARTRGTPLTPDAFNVWRKAFTAELAAKREKAEEDRIRALPPKEREDYRKRRERPTGKQLFENSKVLATSDEALYEEGAEEVDFSKYTREEREKERRKEEEEEERRRRGLVEGDSDGE

SEQ ID NO: 55209 - protein, 256 aa, Oryza sativa (japonica cultivar-group)
MAAIRRFRPALLLAAILLLAAGAVEGKKGGKVDVALYYESLCPYSAMFVVGSLAKVFRDGLLDAVDLSLVPYGNARVKDGKISCQHGSEECFLNTVEACAIDAWPDLRVHFRFIYCVEDLVVNHKQREWESCFGKLNLDPKPVTDCYKGERGHQLSLKYGRQTDALQPPHKYVPWVVVDGQPLYEDYENFEAYICKAYKGHPPKVCEGLARPPTPTVLEVAEAVNRVSYYDSGDIRLKPDEDGHAKIKKVVPDDDD

SEQ ID NO: 55210 - protein, 209 aa, Oryza sativa (indica cultivar-group)
MELSPPNHESSPPTAGGGGGGGGDGAGGSSSAGASSSAGGGAATPQTPSRYEAQKRRDWNTFGQYLRNHRPPLGLAQCSGAHVLEFLRYLDQFGKTKVHTAACPFFGHPNPPAPCPCPLRQAWGSLDALVGRLRAAFEENGGRPESNPFAVRAVRLYLREVREHQARARGVSYEKKKRKKPQPADTSGGGGHPHPPPPPPPPPSAGAAC

SEQ ID NO: 55211 - protein, 157 aa, Saccharomyces cerevisiae
DRDEIERLRKRFMKLDRDSSGSIDKNEFMSIPGVSSNPLAGRIMEVFDADNSGDVDFQEFITGLSIFSGRGSKDEKLRFAFKIYDIDKDGFISNGELFIVLKIMVGSNLDDEQLQQIVDRTIVENDSDGDGRLSFEEFKNAIETTEVAKSLTLQYDV

SEQ ID NO: 55212 - protein, 514 aa, Staphylococcus aureus subsp. aureus MSSA476
MVVEFKNEPGYDFSVQENVDMFKKALKDVEKELGQDIPLVINGEKIFKDDKIKSINPADTSQVIANASKATKQDVEDAFKAANEAYKSWKTWSANDRAELMLRVSAIIRRRKAEIAAIMVYEAGKPWDEAVGDAAEGIDFIEYYARSMMDLAQGKPVLDREGEHNKYFYKSIGTGVTIPPWNFPFAIMAGTTLAPVVAGNIVLLKPAEDTPYIAYKLMGILEEAGLPKGVVNFVPGDPKEIGDYLVDHKDTHFVTFTGSRATGTRIYERSAVVQEGQNFLKRVIAEMGGKDAIVVDENIDTDMAAEAIVTSAFGFSGQKCSACSRAIVHKDVYDEVLEKSIKLTKELTLGNTVDNTYMGPVINKKQFDKIKNYIEIGKEEGKLEQGGGTDDSKGYFVEPTIISGLKSKDRIMQEEIFGPVVGFVKVNDFDEAIEVANDTDYGLTGAVITNNREHWIKAVNEFDVGNLYLNRGCTSAVVGYHPFGGFKMSGTDAKTGSPDYLLHFLEQKVVSEMF

SEQ ID NO: 55213 - protein, 233 aa, Spinacia oleracea
MEAMSGLSSPCNCISSLPHSSSTTTRHQNLLFRRNNHHQQKLAAFHSQSHLFSTKCPLISHSLPRKKSFKPHIFLPHLVASMEQVEETYIMIKPDGVQRGLVGEIISRFEKKGFKLIGLKMYPCPKELAEEHYKDLKAKSFYQKLIDYITSGPVVCMAWEGVGVVASSRKLIGATDPLQAEPGTIRGDLAVQTGRNVVHGSDSPDNGKREIGLWFKEGEICQWTPAQAPWLRE

SEQ ID NO: 55214 - protein, 200 aa, Triticum aestivum
  misc_feature (23)..(23): Xaa can be any naturally occurring amino acid
  misc_feature (37)..(37): Xaa can be any naturally occurring amino acid
  misc_feature (71)..(71): Xaa can be any naturally occurring amino acid
  misc_feature (87)..(87): Xaa can be any naturally occurring amino acid
  unsure (1)..(200): unsure at all Xaa locations
GSIASRSLQAVPRRELQLVGIAXAMLIACKYEEIWAXPEVNDFISIADNSYSRHQILSMEKNILNSMAWNXTVPTPYVFLVRFAKAXAGSDKELEHMIFFFAELALMEYGWVTVRPSLVAASAVYAARCTLKRSPIWTETLKHHTGFAEPQLLEPAKMLVMAHAAAPDSKLKAIYKKYSCEQYGRVSLRAPAVAAPQRLA

SEQ ID NO: 55215 - protein, 130 aa, Zea mays
MAAAPVGAQNRCVFVGNIPYDATEEQLVQICEEVGPVVSFRLVIDKETGKPKGYGFCEYKDEETALSARRNLQGYEINGRQLRVDFAENGRNTDRNREKVDDPQIFTVEEPFLPPLEFSVNLRSCIVFVL

SEQ ID NO: 55216 - protein, 550 aa, Schizosaccharomyces pombe 972h-
MSFSLASTLPAWQAVQTHYESVGKHLVLKELFAKDSSRFEKFSFTFNGLKEEDGPILFDFSKNLITEETVELLVKLAKEANVEGLRDALFAGEHINFTEDRAVFHPALRNVSEKPMKVNGQDVMPGVRKVLRHMKEFSDAVRSGAWKGYTGKPIKSIVNVGIGGSDLGPVMVTEALKPYGQENLELHFVSNIDGTHLAEALKKCDPETTLFLIASKTFTTAETCTNAKSAKDWFLASAKDPSHVAKHFVALSTNEKEVTAFGISAQNMFEFSDWVGGRYSVWSAIGLSVALYIGYENFEAFLSGAHAMDEYFCSTPLEKNIPALAALISIWYSDFFGAQTHLVAPYDQYLHRFPAYLQQLSMESNGKAITRSGDMVNYTTGKILWGEPGTNSQHSFFQLIHQGTKLIPADFLIPIESHNPIDNNKHHRMLFSNFAAQTEALMLGKTPAEVKAEGTPDEIVPHKTFVGNRPSNSIIAKKITPASLGALIAFYEWVTFTEGAVWNINSFDQFGVELGKKLAKNVLAQLETKGDVENHDSSTNGLINLFKNGF

SEQ ID NO: 55217 - protein, 175 aa, Triticum aestivum
MVPTVMASLATSVAPFQGLKSIAGLPVSRRSNGASLGSVSNGGRIRCMQVWPIEGIKKFETLSYLPPFSTEALLKHVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 55218 - protein, 333 aa, Prochlorococcus marinus str. MIT 9515
MKSILEQLSSITTVVADTGDLDAIKKFQPRDATTNPSLILAAAKNPDYVKLIDQSLESSRKSLPNGVSESELIKEAIDQVSVFFGKEILNLISGRVSTEVDARLSFDTDATVKKARKLINHYKSFGIDKERILIKIASTWEGIKAAEILEKEGIRCNLTLLFNFCQAVACANAKITLISPFVGRILDWHKVKTGKDNFSGKEDPGVISVTKIYNYFKEKGFKTEVMGASFRNVDEIKELAGCDLLTIAPKFLDELSKEEGELIKKLDENIQSKSSIDYEFDEKDFRLSMLEDQMASEKLSEGITGFSKAIEELEELLLKRFSEINNQKLISAT

SEQ ID NO: 55219 - protein, 352 aa, uncultured bacterium
IGAANNLLAAMVDNHIYQGNELDIDPRRITWHRAVDMNDRQLRNAVDGLGGKAQGYVREDHWDITVASEVMAVFCLSTSIDDLKERLARIVIGYSRAGKPITAGDLNAQGAMAALLKDALKPNLVQTLEGTPAFVHGGPFANIAHGCNSVLATQMAMHFADYVVTEAGFGADLGAEKFMDIKCRMAGLKPDAVIIVATVKALKYNGGVPKADVQKENLEALEAGIPNLLKHVENIKNVFGIPAVVALNKFVTDTDAEIELVTRKCKELGVNVKLSEVWGKGGEGGLELAEEVIRLCDQPSELHYAYELDMPITEKIEAIATKVYGADGVDFAASAKKEIDNLTKMGYDKIPV

SEQ ID NO: 55220 - protein, 339 aa, uncultured bacterium
SAHNTISALLDNYLYQHRKEGFSPREIFWERVLDVNDRSLRNVVTGLRGDGVVSETGFEITPASELMAILCLATSEEDLQRRIENIVLGITADGKPFRVRDLGVAGAITVLLRDALNPNLVQTTEHTPAFIHGGPFANIAHGCSSVLATKMAMTFCDYVVTEAGFGADLGAEKFFDIKCRKAGLKPRLVVIVATTQGLKMHGGVALEHIKEPNAQGLTEGLKNLNRHIRNMQGFGQPVIVTLNRHDTDSEEEIDIVRKNCEDLEVGFAVNEAFLKGGEGATELAQTVVDTIERQHPLPIRFTYKEADCLEDKIEKVCKRIYGASGVEYSKTAKKKLEDL

SEQ ID NO: 55221 - protein, 254 aa, Sinapis alba
MGRGRVELKRIENKINRQVTFAKRRNGLLKKAYELSVLCDAEVALIIFSNRGKLYEFCSSSSMIRTLERYQKCNYGPPEPNVPSREALAVELSSQQEYLKLKERYDALQRTQRNLLGEDLGPLSTKELELLERQLDSSLKQIRALRTQFMLDQLNDLQSKERMLNETNKTLRLRLADGYQMPLQLNPNQEDHHVDYGRHDQQQQQNSHHAFFQPLECEPILQMGYQGQQDHGMEAGPSENNYMLGWLPYDTNSI

SEQ ID NO: 55222 - protein, 816 aa, Desulfotalea psychrophila LSv54
MKFTLNWLQKYVDTTGLTPTEIADKLTMLGLEVDSVAPIFEELAALKTGLVISCEKHPDADKLSLCQVQVGDDTHQIVCGAPNVREGLAVTVALPGAVLPGNFKIKKSKVRGIASAGMLCSERELGIGEDHDGIMELPEGMAHGQRFIDAMELSDTFIEVDLTPNRPDCASVIGTAREIAGKIGRPLQIPVKDRQIEAESRDFSVEVESSELCPRYTAKLIKNVTVGKSPWWLRKLLVSVGMRPINNIVDITNFVMLEYGQPLHAFDFKKVAGNKIVVRLPRENETEITTLDGTKREISAEMLLICDADKPIAVAGVMGGANSEIDAESTDILLESACFNPVSVRKTARNLKLPSEASYRFERGVDPGGVVNALDRAAELIAEIAGGALCSEGIDNYDGKKAVEVQRFSISRTSSLIGVEFSGEELTAMLTSIEMVVEKDPENEDILLVTAPTFRIDIEREADLVEEIARIYGYDNVPTATPLVALSYPEQDDDRLKRYPLALKLTRIGFNEAINYSFVTAQHADMLQLSEQDYRRKVVTLLNPLSEEQAVMRACLLPSLLENVKRNISFQKTAVKLFEIGKIFLAQGEDVQPIERQCITGVLSGNKFGESSSLYFKSANVDIFDAKGTVEFILSEMGLTDLANNEKIEFTVPPEGAREPFSTQDYALTIHLGPNVLGTIGKVEEEVLKSFGIKHEVYYFDLNFDALCALSPQTKAFSSLPVYPAVKRDIALVVPASISAGELLATVRSSRDKLMEYAEIFDVFEGGKIQKGYKSVAVSITYRSQTKTLTEKNVEKSHSKIVSLLTDRFGGSFRDA

SEQ ID NO: 55223 - protein, 353 aa, uncultured bacterium
IGAANNLLAAMLDNHIQQGNALGIDVKKITWKRCVDMNDRQLRFVVDGLGGRMNGTPREDGFGITVASEIIAVFCLASSIADLKERLSRIIVAYTYDDQPVTAGNLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLANEDLAALEKGIPNLLRHVNNIRNVYQLPCVVAINRFPTDTDAEIDFIVRKCRELGVNTILSTVWAEGGKGGEDQAREVVRLCEEEKGNFTFSYELDASIEEKLEAVTKKIYGGSGIALTPAAKKQAERLTALGFDKMPV

SEQ ID NO: 55224 - protein, 250 aa, Solanum commersonii
  misc_feature (231)..(231): Xaa can be any naturally occurring amino acid
  unsure (1)..(250): unsure at all Xaa locations
MGRGRVQLKRIENKINRQVTFSKRRSGLLKKAHEISVLCDAEVGLIVFSTKGKLFEYATDSCMERLLERYERYSFAEKQLVPTDHTSPGSWTLENAKLKARLEVLQRNEKLYVGEDLESLNMKELQNLEHQLASALKHIRSRKNQLMHESISVLQKQDRALQEQNNQLSKKVKEREKEVEQQNQWDQQNHEINSSTFVLPQQLDSPHLGEASQNTNVVDNGEVEGGNSSQXQGAANNTVMPQWMVRHLNG

SEQ ID NO: 55225 - protein, 353 aa, uncultured bacterium
IGAANNLLAAMLDNHIQQGNALGIDIKKITWKRCVDMNDRQLRFVVDGLGGRANGTPREDGFDITVASEIMAVFCLATSMADLKERLSRIIVAYTYDDQPVTAGDLKATGAMAALLRDALKPNLVQTLEGTPAFVHGGPFANIAHGCNSVMATRMAMRMGDYTVTEAGFGADLGAEKFLDIKCRMAGLVPDAVVVVGTVRALKMHGGLDKKQLANEDLAALEKGIPNLLRHVHNITNVYHLPCVVAINRFPTDTDAEIDFIVRKCRELGVNTILSTVWAEGGKGGEDLACEVVRLCEEEKGSFTFSYELDASIEEKLEAVTKKIYGGAGVALTPAARKQAERLTQLGFDKLPV

SEQ ID NO: 55226 - protein, 201 aa, Yersinia pseudotuberculosis IP 32953
MSQNKEWLAASDAWMIYSRELAALKENVDQQVWLQVLDALAECRGKIAVTGVGTSGIAARKVAHMLACVEQPAIYLNATDAAHGDLGFLGAQDIIILISRGGNSDELTRLLPTLQRKQVKIISVTENEQSAIAQVSALVLKTHVKQEIDPLNMLATTSIVLVLALFDAICACLMARTGFSKETLLAVHPGGDVGMALRKQQ

SEQ ID NO: 55227 - protein, 352 aa, uncultured bacterium
ITSANNLCAAMLDNSIKQDNELNIDPEKVVWKRCVDINDRVLRNIIVGRGRDVDGVEREDHFVITVASEIMAILCLANDYADLKDRLGKIIVAYTYDGEPVTAKDIKAVGSMAALLKDAMKPNLIQTLEHTPALVHGGPFANIAHGCNSVRATKTALKMADYVITEAGFGADLGAEKFLDIKCRKAGLKPDAVVLVATVRALKYNGGMPREDLQTEDLDALAKGIVNLEKHIENIQQYDVPVVVTLNQFGTDTDAEIEFVKNFCEEHDCEFAPAKVFKEGGEGGIELAKKIIETIDTKPSNYHPLYTDDMSIKEKIETVATKIYGADGVTYSDEAEEALKKIEELGYSDYPV

SEQ ID NO: 55228 - protein, 494 aa, Mycobacterium tuberculosis CDC1551
MLEACQAIGVTAALGEPGEHSLPASTPITGDVLFSIAPTTPEQADHAIAAAAATFTAWRSTPAPVRGALVARLGELLTAHQQDLATLVTVEVGKITAEARGEVQEMIDVCQFSVGLSRQLYGRTIASERAGHRLLETWHPLGVVGVITAFNFPVAVWAWNTAVALVCGDTVVWKPSELTPLTALACQALLSRAAADVGAPAAVGGLLLGGAERGAQLVDDPRVALLSATGSVRMGQQVGPRVARRFGRVLLELGGNNAAIVAPSADLELAVRGIVFAAAGTAGQRCTSLRRLIVHRSVADDVVARVVGAYRQLAIGDPSAPDTLVGPLIHEAAYRDMVAALERARTDGGEVIGGDRREVGSPGAYYVAPAVVRMPSQTAIVATETFAPILYVLTYDDLDEAIALNNAVPQGLSSSIFTTDLREAEHFLDQSDCGIANVNIGTSGAEIGGAFGGEKQTGGGRESGSDAWKAYMRRATNTVNYSSELPLAQGVKFG

SEQ ID NO: 55229 - protein, 318 aa, Synechococcus sp. CC9605
MALGSVVVCLGEALIDRLGPPGGDPAVDHPLDDRLGGAPANVACGLARLGTPVAFAGRLGQDAIGEAFSSLFAKRGVDTTLLQRDAKCPSRIVLVRRSLDGERQFQGFAGDEGAGFADQALEPVALPEVQWLLIGTLPLASTASAAALFSAARQARSQGTALALDVNWRPTFWDATADAEAGPSSAAKDAIQPLLEQAALIKLAREEALWFFNTDDPGSIQQSLSQRPDVVVTDGASPVLWQLGDESGQQAAFQPPSVVDTTGAGDAFTAGLLHRWAAAPQERVRFAAACGALVCGGAGGIDPQPTQAQVEAFLGGVS

SEQ ID NO: 55230 - protein, 555 aa, Buchnera aphidicola str. Sg (Schizaphis graminum)
MKNINLIETKSWKDLKNHFKEVKNIHLKDLFLSDFNRFKKFSIFFENEILIDFSKNRITEKTLILLLNLAKEMNVKSAIKLMFSGSKINQTENRSVLHIALRNRSNFPILLNNSDIMSEVNDVLKKMKNFSELVIDGTWKGYSGKSISDVVNIGIGGSDLGPYMVTEALRPYKNHLNIHYVSNIDGTHLSEILKKINPETTIFLIASKTFTTDETITNANSAKFWFLKHSKTKETLDKHFFALSANINNAVNFGINIKNIFQFWDWVGGRFSLWSSAGLSIVLSIGFNNFEKFLQGAHVMDNHFYHTEYDKNIPILLALISIWYTNFFNSETEAIFPYDQYMHRFSAYFQQSNMESNGKSIDKNGNKVCYQTGPIIWGEPGTNGQHAFFQLIHQGTKLIPSDFIVPTVSHNNLNDHHLKLISNFLAQTQVLAFGKSKNSFLKESTSFKKEEDEFNRILPFKICEGNKPTNSILLRKITPYTLGMLIALYEHKIFVQGHILNIFSFDQWGVEIGKEVAQSIYKNINEKTKNSKSYDSSTQGLIDFYNFFKNKQNYL

SEQ ID NO: 55231 - protein, 300 aa, Escherichia coli
  misc_feature (1)..(1): Xaa can be any naturally occurring amino acid
  misc_feature (15)..(15): Xaa can be any naturally occurring amino acid
  misc_feature (27)..(27): Xaa can be any naturally occurring amino acid
  misc_feature (42)..(42): Xaa can be any naturally occurring amino acid
  misc_feature (63)..(63): Xaa can be any naturally occurring amino acid
  misc_feature (70)..(70): Xaa can be any naturally occurring amino acid
  misc_feature (129)..(129): Xaa can be any naturally occurring amino acid
  misc_feature (210)..(210): Xaa can be any naturally occurring amino acid
  misc_feature (240)..(240): Xaa can be any naturally occurring amino acid
  misc_feature (260)..(260): Xaa can be any naturally occurring amino acid
  misc_feature (286)..(286): Xaa can be any naturally occurring amino acid
  unsure (1)..(300): unsure at all Xaa locations
XSLDVTAKYELIGLXAYPIRHSLSPEXQNKALEKAGLPFTYXAFEVDNDSFPGAIEGLKALKXRGTGVSXPNKQLACEYVDELTPAAKLVGAINTIVNDDGYLRGYNTDGTGHIRAIKESGFDIKGKTXVLLGAGGASTAIGAQGAIEGLKEIKLFNRRDEFFDKALAFAQRVNENTDCVVTVTDLADQQAFAEALASADILTNGTKVGXKPLENESLVNDISLLHPGLLVTECVYNPHXTKLLQQAQQAGCKTIDGYGXLLWQGAEQFTLWTGKDFPLEYVKQVXGFGAEGGSHHHHHH

SEQ ID NO: 55232 - protein, 502 aa, Yarrowia lipolytica CLIB122
MFRPAYLRRLPTLKASTRLISTSLKSNQPLATNNPPAPLSKADVPQTMQQLGNLPGGSPVTGPGHHNLSTLSPSPFGGDIASAEDRSSDSHEARLLPENHPPMYLSSMKTSDVVALMLTSAATSHPTLIKLCTKLMPYTPNALIKAIVYSLYCGGANHAEVVETGKKLLDRGFGNMMLSYSVEDAEGGDSANALMDSAVDSIIESIDNVLVKYAHESEKKTGKSITGFVALKPTGLMKNATAILRNHDKPEYAEQWKQYLAVCRKICRHAAENGEGKVGIVFDAEKKVLQPGVYAAQRAMMQEFNVNGAVPVIGTIQMYLQDSIIQLQDDISHAAANGYQIGMKLVRGAYIHSEPDRWTTIHRTKEDSDISYNRGVALCLDGIIPDIQSGTHHSAVGKLIVASHNECSMALAAHRLSADLTPEQLESQDKVIFAQLMGMAEDLGEELAHRGYKVLKYVPWGPVNETKDYLVRRMEENGDTLSDGGMTVAFQCATELAKRLVK

SEQ ID NO: 55233 - protein, 503 aa, Pisum sativum
MDIPIPTRQLFINGDWKAPVLNKRIPVINPATQNIIGDIPAATKEDVDVAVAAAKTALTRNKGADWATASGAVRARYLRAIAAKVTEKKPELAKLESIDCGKPLDEAAWDIDDVAGCFEYYADLAEKLDARQKAPVSLPMDTFKSHVLREPIGVVGLITPWNYPMLMATWKVAPALAAGCAAILKPSELASLTCLELGEICKEVGLPRSVLNIVTGLGHEAGAPLASHPDVDKISFTGSSATGSKIMTTAAQLVKPVSLELGGKSPLVVFEDVDLDKAAEWAIFGCFWTNGQICSATSRLILHESIATEFLNRIVKWIKNIKISDPLEEGCRLGPVVSEGQYEKILKFVSNAKSEGATILTGGSRPEHLKKGFFIEPTIITDVTTNMQIWREEVFGPVLCVKTFSTEEEAIDLANDTVYGLGAAVISNDLERCERVTKAFKAGIVWVNCSQPCFTQAPWGGVKRSGFGRELGEWGLDNYLSVKQVTQYISEEPWGWYQPPAKL

SEQ ID NO: 55234 - protein, 572 aa, Yarrowia lipolytica CLIB122
MLRSVSKFRAPLARSCRSFTTIGVPGTPGNGTFSIPEIKNEPVRDFEPGSKDRQGVLNSLKTIKESVHEIPVVIAGRKYWSEKTGSQYNPYDKKEIAKVSQATPEDVTFAIETAMGAKKEWANASFADRAAVFLKAAELIAGKYRYDMLAATMIGQGKNVYQAEIDTTCELADFLRFNVKYAQELYQVQPAENSPGVWNRAEYRALDGFVYAVTPFNFTAIAANLVGAPALMGNTVVWKPSAAAVLSNYYLYQILIEAGLPEGVVSFVPGNAQEVTKTVLGSEDFASLHFTGSTGVFQTLNQEIAAHLPEYNSYPRIVGETGGKNYHLIHPTADLSHAVKSTVRGAFEYQGQKCSACSRAYVPENMWEDFKKEIQAEVKNVTVGDATTPEGFASFAGPVIHQQSFDKLKGVIDAAKKDDSLELVAGGKYDDSKGFYVEPTIYVTRDPDHPNLKTEFFGPILTVCLYDEVKFLETCEVVDKTTKYGLTGAIFASDRYVISQASERLRYSAGNFYINDKCTGAVVGQQWFGGGRQSGTNDKAGSGNILSRFVSIRNIKENFRETDNILYPSNYN

SEQ ID NO: 55235 - protein, 100 aa, Zea mays
AYILFDMKVLYPMGGLENLQTAKKYYASTIQLTGGKNTRALFGVCLCTSAINQLTKGRNKEEEGSELQRLAAEVLLNNYKQQAPSKAPLISSLLKNMKLS

SEQ ID NO: 55236 - protein, 394 aa, Thiomicrospira crunogena XCL-2
MNSQDHLMNTYARLPVTFESGQGALLYDTDGQGYLDAISGIAVCSLGHAHPEISRTICEQSQQLIHTSNLYGIEKQTQLADELIDISHLEKVFFCNSGAEANETAIKMARKFAHQQQIQSPKIIVMENSFHGRTLATLSATGNPKVQQGFEPLVEGFVRVPYNDVEAIQNVSSDSDIVAILVEPVQGEGGVNIPDRGYLKALREICDQNNWLLILDEIQTGIGRTGKWFAHQHEDILPDVMTLAKALGNGVPIGACLAGKKAADLLVPGNHGTTFGGNPLACATGLAVIKTLTFHNFIEHVDAKGALLVARLQEALEQNSAVVNVRGLGYMIGIELDRPCAELVQKALKKHLLINVTQGNTIRLLPTFVMSNDQTDQLINTLVELIEEFTQTST

SEQ ID NO: 55237 - protein, 427 aa, Neisseria meningitidis Z2491
MNRNEILFDRAKAVIPGGVNSPVRAFGSVGGVPRFIKKAEGAYVWDENGTRYTDYVGSWGPAIVGHAHPEVIEAVREAALGGLSFGAPTEGEIAIAEEIAKIMPSVERLRLVSSGTEATMTAIRLARGFTGRDKIIKFEGCYHGHSDSLLVKAGSGLLTFGNPSSAGVPADFTKHTLVLEYNNIAQLEEAFAQSGNDIACVILEPFVGNMNLVRPSEAFVKALRELTEKHGAVLIYDEVMTGFRVALGGAQSLHGITPDLTTMGKVIGGGMPLAAFGGRKDIMECISPLGGVYQAGTLSGNPIAVAAGLKTLEIIRREGFYENLTARTEQLVQGFRTAADAAGIEFTADSVGGMFGLYFAAHAPRNYADMARSNIEGFKQFFHGMLDRGIAFGPSAYEAGFVSAAHTPELIDETVAVAVEVFKAMAA

SEQ ID NO: 55238 - protein, 275 aa, Gluconobacter oxydans 621H
MSIQPVGQSFGRLVVDQKNVWIGTSWKMNKGPSEAIAAARALESFQPPEGIRSFVIPSFTSLRDVCSVLEDSALLVGAQNMHWEDSGAWTGEVSAPMIAECGASIVEIGHSERRQHFGETDWTVNLKVQAALRHGLRPLICIGDTSDEFEFGVSQETLARQVKIALHGVSRKDLGQVMVAYEPVWAIGSAGRPAEASFVSGIHTRLRAVVRELAGDSGVRIPLLYGGSVSQANIRDYVALPDVDGVFVGRAAWEPADFMRLVESVSGVVSRKIAA

SEQ ID NO: 55239 - protein, 266 aa, Zea mays
MRARTACLVPRVRDGRLPSTVLPTWARGPRGGPDQKKRAAERSMLFLRCQPRVPSASAPPFRPRVRVAAPLGVRVTGGRRGQAVVAMASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELPELKGRDKLGDRPVFVLVEADA

SEQ ID NO: 55240 - protein, 667 aa, Streptococcus suis 89/1591
MTKTPFYITTPIYYPSGKLHIGSAYTTIACDVLARYKRLMGHEVFYLTGLDEHGQKIEEKAKEAGLTPQAYVDGMAVGVKELWNLLDISYDKFIRTTDDYHEEVVAAVFEKLLAQDDIYLGEYSGWYSVSDEEFFTESQLEEVFRDENGKVTGGIAPSGHEVAWVSEESYFLRLSKYQDKLVEFFNAHPDFIQPDGRMNEIMKNFIEPGLEDLAVSRTSFTWGVPVPSNPKHVVYVWIDALLNYATALGYGQEETINYDKFWNGTVYHMVGKDILRFHSIYWPIMLMMLDMKLPDLLVAHGWFVMKDGKMSKSKGNVVYPEMLVERFGLDPLRYYLMRSLPVGSDGTFTPEDYVGRINYELANDLGNLLNRTVAMINKYFSGQVPTFVANVTDFDADLAAVVADNLASYHKYMEAVDYPRALEAVWNIISRTNKYIDETAPWVLAKDEADRDKLAAVMAHLTAGLRVVAHLIQPFMMTTSNAIMEQLGLGTAFDLENLDFAGLPAGLTVVAKGTPIFPRLDMEEEIAYIQAQMGGSSAISQEEEKEWNPADVELKNEKAAIKFEDFDKVEIRVAEVKEVAKVEGSDKLLKFRLDAGDGEDRQILSGIAKFYPNEQELVGKKVQIVANLKPRKMMGLLSQGMILSAEHGDNLILLTVDPSVPNGSQIG

SEQ ID NO: 55241 - protein, 244 aa, Schizosaccharomyces pombe 972h-
MSVEITFVEQFQEILQNGKEQIILLNFYAPWAAPCKQMNQVFDQFAKDTKNAVFLKIEAEKFSDIAESFDVNAVPLFVLIHGAKVLARISGANPQKLKAAIDEYIQPLISQISSTNASVETQVNSVQTTNTTSNTSKAPNGLDSELNERLSTLTNAHNVMLFLKGTPSEPACGFSRKLVGLLREQNVQYGFFNILADDSVRQGLKVFSDWPTFPQLYIKGEFVGGLDIVSEMIENGELQEMLPN

SEQ ID NO: 55242 - protein, 352 aa, uncultured bacterium
IGAANNLIAAMLDNHIKQGNALDVDLNNIIWRRCVDMNDRQLRNVVDGLGTAGDGVCREDGFDITVASEVMAVFCLATDLDDLKARLGRMVVAYSRSGKPVTVADIKAEGACTALLKDAIKPNLVQTLENNPAFVHGGPFANIAHGCNSVQATTTAMKMADYVVTEAGFGADLGAEKFLDIKCRYAGIKPSCVVIVATVRALKHNGGVAKADLGNENLEALEAGLPNLLQHVANVQDVFGLPAVVAINAFPTDTQAELELVQAKCKELGMNAVLAEHWAKGGEGATALAEEVVRVCDQPNDFKFSYDVEMGIEEKIEAIAKRIYHADGVDYTPKAKKQLAQLNELGFDKLPI

SEQ ID NO: 55243 - protein, 121 aa, Rhodobacter sphaeroides 2.4.1
MTTTVEEQIRDMVTTNDVVLFMKGTKSMPQCGFSSRVAGVLNYMQVAYKDVNVLEDADVRQGIKDFSDWPTIPQLYVKGEFVGGCDIITEMTLSGELDQLFEAKGVSYDKTAADKIREANA

SEQ ID NO: 55244 - protein, 352 aa, uncultured bacterium
ITSAHMLLSAMLDNSIQQGNPLNIDPRRIIWKRVVDMNDRALRNIVIGLGGKAHGVPREDGFDITVASEVMAILCLASNLHDLKERLKRIVVAYNYDGKPVTAEDLHAAGAMAALLKDAVKPNLVQTLEHVPAIIHGGPFANIAHGCNSVMATRTALRLADFTITEAGFGADLGAEKFFDIKCRQAGLAPDACVLVATVRALKMHGGVAKADLKEPNVEAVKKGLPNLGKHIENIFKFGVPVVVAINIFAQDTKEELQAVYDFCAGMGVNVALSDVFAKGGEGGVELAKEVVALAESGKARFKPIYPLEMSLREKVATVVKEIYGGDRVEFQTKAAQALDQYEKEGYANLPV

SEQ ID NO: 55245 - protein, 352 aa, uncultured bacterium
ITSAHMLLSAMLDNSIQQGNPLNIDPRRIIWKRVVDMNDRALRNIVIGLGGKAHGVPREDGFDITVASEVMAILCLASNLHDLKERLKRIVVAYNYDGKPVTAEDLHAAGAMAALLKDAVKPNLVQTLEHVPAIIHGGPFANIAHGCNSVMATRTALRLADFTITEAGFGADLGAEKFFDIKCRQAGLAPDACVLVATVRALKMHGGVAKADLKEPNVEAVKKGLPNLGKHIENIFKFGVPVVVAINIFAQETKEELQAVYDFCAGMGVNVALSDVFAKGGEGGVELAKEVVALAESGKARFKPIYPLEMSLREKVATVVKEIYGGDRVEFQTKAAQALDQYEKEGYANLPV

SEQ ID NO: 55246 - protein, 672 aa, Rhodobacter sphaeroides 2.4.1
MDIQSLREQHPDHWKKACAIRALTLDAVAAANSGHSGMPMGMADVATVLYEKHMVFDARSPDWPNRDRFVLSAGHGSMLVYALLHLTGDPEFPIEQIRNFRQWGSKTAGHPENFLAKGIETTTGPLGQGLAMSVGLAMAEESLRARWGAKIIDHYTYCIAGDGCLMEGVSQEAIGLAGRHELSHLIVMWDNNGITIDGKVSLSDRTDQKARFAAAGWDVFECDGHDPADIDRALTAAKASKGPAFIACTTHIALGSSAQDTSKGHGALTDAKLIADTKAAYGWTSAAFEIPADVKKAWEAIGARGAEARKAWDERLAALSDGKRALFQQQFSCEPPKKLASAIRAVKKDAVEKMPKVATRRASEMVLEAVNPVMPETIGGSADLTGSNNTKTADLGVFDPINRKGRYVYYGIREHGMAAAMNGMALHGGLRPYGGTFMCFADYCRPAIRLSALMHMPVVYVFTHDSIGLGEDGPTHQPVEHLAMLRATPNMMVFRPADLVETAEAWEIALGAKATPSVLALSRQNLPAVRKNHTNKNLVAQGGYVLEEATGKRQVILIASGSEVEVALKAREALEADGIGTRVVSMPCMELFAQQDEAYRRKVLPAGAVRIAIEAGVRMGWDRWLLGERGREGKDGFVGMTGFGASAPAERLFQEFGITYEATVAKAKALLG

SEQ ID NO: 55247 - protein, 355 aa, uncultured bacterium
IGAANNLLAAMIDAHIQAGNELNIDPRKITWRRAVDMNDRQLRNIVDGLGGKPHGTPREDGFDITVASEVMAIFCLATSISDLKERLGRIVIGYTYDDKPVTAGELKAAGAMAALLKDALKPNLVQTLEGTPAFIHGGPFANIAHGCNSIMATKMALNFGDYAITEAGFGADLGAEKFLDIKCRLAGLKPNAVVIVATVRALKNHGGVPKAQLNEENLEALEAGLPNLLQHVENITNVYKLPCVVAINAFPTDTEAELKLVEDKCKELGVNAVLATHWANGGDGAIELAKEVVRLCEEGTGAEEFEFCYADELSLREKIETIAKRYYRADGVLFAGNAEKQLKQLEDLGFGNMPV

SEQ ID NO: 55248 - protein, 333 aa, Rhodobacter sphaeroides 2.4.1
MTVKVAINGFGRIGRNVLRAIIESGRTDIEVVAINDLGPVETNAHLLRFDSVHGRFPATVTTTEKTIDVGRGPMDVTAIRNPAELPWGHVDIVLECTGIFTDKEKAKVHLESGAKRVLVSAPSTGADKTIVYGVNHETLTKDDLIVSNASCTTNCLSPVAKVLNDTIGITKGFMTTIHSYTGDQPTLDTMHKDLYRARAAALSMIPTSTGAAKAVGLVLPELKGKLDGVAIRVPTPNVSVVDLVFEASRATSVEEVNAAIREAADGKLKGILGYTDQPNVSMDFNHDPHSSIFHLDQTKVMEGNMVRILTWYDNEWGFSNRMADTAVAMGKLI

SEQ ID NO: 55249 - protein, 334 aa, marine gamma proteobacterium HTCC2143
MEENRQVLIDSLPGGKLEITNYKLHQSPVPVAGDGEVLCRTLWVTVAAGARAGLQGSASYAGAPKTGVVMNGAAVATVVASQALGFSEGDLVICNAGWQDYSVHSASVLQKIEGSVDPVHHLGVLGTNGVTAYFGLLDIGKPKAGETVLVSACGGSVGHIVAQLAKLKGCRVVGTAGSDAKAQKLQAQLGIDAVVNYKSPDFRQLLKEATPNGIDVYFDNTGGDILGSALFRMNEHGRIACCGVVSQYDTSSPSPGPKGIPGLLVNKRITMRGFLVFDYKERYDEAKKQLSEWIVSGKLTPLVDEVIGLENAPDAFVDLLAGGNIGTRVIRVSE

SEQ ID NO: 55250 - protein, 338 aa, uncultured bacterium
ANNLLAALLDNHIQQGNELGIDTRQIIWKRAEDMNDRALRNIVVGLGAKADGVPREDHFVITVASEIMAILCLASDMNDLKARLSRIVVAYTRDGEPVTAGDLKAVGSMAALLKDAIKPNLVQTLEHTPVIVHGGPFANIAHGCNSVRATKTALSISDYTVTEAGFGADLGAEKFLDIKCRIAGLHPDAVVLVATIRALKYNGGVAKADLGTENLEALKKGIVNLEKHIENIQKYGVPVVVTLNSFLTDTEAEMEFVRNFCQERGCKFALSEVWAKGGEGGEALAKEVIETINTKPSNYAPIYTDDLSLQDKIVKVSTEIYGADGVTFAPAALKQLKK

SEQ ID NO: 55251 - protein, 144 aa, Rhodobacter sphaeroides 2.4.1
MLVQQILKAKSDDGVVTVPPGSSIAAAAEVLSSRRIGAVVVSRDGKRPEGMLSERDIVRELGRRGAGCLSDKVEAIMTSKIVTCACTDEADRIMQVMTEGRFRHLPVMAEGEMVGLISIGDVVKARLSELSMEKDALEGMIKGF

SEQ ID NO: 55252 - protein, 379 aa, Brassica napus
MSTTGQIIRCKAAVCWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIYHFLGTSTFSEYTVVHSGQVAKINPEAPLDKVCIVSCGLSTGLGATLNVAKPKKGQSVAIFGLGAVGLAAAEGARIAGAGRIIGVDLNPKRFEEAKKFGVTDFVNPKEHDKPVQQVIAEMTNGGVDRSVECTGSIQAMIQAFECVHDGWGVAVLVGVPSKDDAFKTHPMNLLNERTLKGTFFGNYKPKTDIPGVVEKYMNKELELEKFITHTVPFSEINKAFDYMLKGESIRCIITMGA

SEQ ID NO: 55253 - protein, 237 aa, Oryza sativa
  misc_feature (159)..(159): Xaa can be any naturally occurring amino acid
  unsure (1)..(237): unsure at all Xaa locations
MRKKGRGERGIELGGGQEGIADAQQGEGDGPRRGRLAVAMDTTTSTHNVGCLDREKKERGEVAFFIYLFLDWFIRHHAVGQNHSGLGQGDAVVGVADGVGGGGAEVDAGGEGEEEGTLEDEGVTVGGVDEEAENEQMHLMTFMEVAKLRCNDFTIVATXSDSYTEYLKDIEAGKIENVPTPPIAIDYWRLPADATLKDVVVVVCADEAHHRDVNHFASDVHFQGMDLKDTPALLDYH

SEQ ID NO: 55254 - protein, 254 aa, Oryza sativa (japonica cultivar-group)
MSSAVDAISCSKGIAAPPTEEATKERVAVVGKNGGVEHGGDAATMNGKQCGEAPHCRKESNEEEEDDEEKAPKAIDLGPRVSIKDQLEKDKDDESLRRWKEQLLGSVDLNSVGETLEPDVKIMSLAILSPGRPDIFLPLPVEPNAKGVWFTLKEGSLYKLKFTFSVSNNIVSGLRYTNAVWKTGIKVDSHKEMLGTFSPQPEPYTYVTPEETTPSGMFARGSYSARTKFLDDDRKCYLEINYTFDIRREWPALS

SEQ ID NO: 55255 - protein, 492 aa, Candida albicans
MPQVTKTNNENEFRLTRSKVQHQESISTIKNTTISNSQHKQQTQQQISSPPQVSVTSSEGVSHVNTRQYLGDVSNQYITNAKPTNKRKPLGGDNAPLQKQQHRPSRPIPIASDNNNNGSTSSSSNSSNNNNNDANRLASLAVPSRLPQKRQATESSTNLVEKLRVPQPEVGERSQSYHKKSRLIDYEWQDLDEEDNDDQLMVSEYVNEIFSYYYELETRMLPDPQYLFKQTLLKPRMRSILVDWLVEMHLKFKLLPESLFLAVNVMDRFMSVEVVQIDKLQLLATAALFTAAKNEEVFSPLVKNYAYFTDGSYTPEEVVQAEKYMLTILNFDLNYPNPMNFLRRISKADDYDVQSRTLGKYLLEITIVDYKFIGMRPSLCCALAMYLARLILGKLPVWNGNLIHYSGGYRISDMRECIELMFQYLIAPIEHDEFFKKYAMRKFMRASTLCRNWAKKFQASGRDLFDERLSTHRLTLEDDDEEEEIVVAEAEE

SEQ ID NO: 55256 - protein, 468 aa, Thiomicrospira crunogena XCL-2
MSQEIFDLIKDNDVKWVDLRFTDTHGKEQHVTIPADSVDEDFFADGETFDGSSIQGWKGIHNSDMLLMPQTDGFYLDPFTNDPTMIIRCMIVEPSTMEAYEKDPRGIAKNAEAYLASTGIADSAFFGPEPEFFIFDDVRWGADMSGCFVKIDGNEAAWNSEKVFEGGNIGHRPKVKGGYFPVPPVDQLHEVRADICAMAEAMGLKLEAHHHEVASGGQCELAVAGNTLTAKADEVQILKYAVHNTCQALGKTATFMPKPIVGDNGSGMHINQSLSKNGKNIFAGDVYAGLSQEALWYIGGLMKHARALNAFTNPGTNSYKRLVPGFEAPILLAYSGSNRSASIRIPYAPSERSRRVELRFPDPTANPYLAFAASLMAGLDGIINKIDPGEPAEKDLYDLPPEEEATYKTVCASLEEALASLDADRDFLKAGGVFTDEAIDSYINLKMEEVTRMRATTHPIEFDMYYSS

SEQ ID NO: 55257 - protein, 343 aa, Oryza sativa (indica cultivar-group)
MDGEMFGSGHWGGSFPYASIPKESQFVFDAKASPLQLQLFGSAAVPAVGSTGYYNYIANNHLSAMNQERNTNNDVGHEKQLNLQMSLNYFPVENLDRLARIGNPSAVSTGLRLSYENNEHTSITSGSGNMPSLPIMASFVDEVMAELDKENKEFNCYFGLQVEQLVKCMKDVKQRQMVEFLASLERGVGKKLKEKELEVEAMNRKSKELNEQIRQVALEVQSWQSVALHNQSVANSMKSKLMQMVAHSSNLTREGSGDSEVDNTASSQNVNAVPGGFFQSGLLGINSMADGGLGACRLCRMKEAAVLVMPCRHLCLCADCEKNADVCPVCRFPKSCSVEINMS

SEQ ID NO: 55258 - protein, 538 aa, Aspergillus oryzae
MGDAVAPNALADTTRVEAPVTFKTYMMCAFAAFGGIFFGYDSGYINGVMGMSYFIQEFEGLDPATTDSDHFVVSSWKKSLITSILSAGTFFGALIAGDLADWFGRRITIVSGCAIFIVGVVLQTASTTVALLVVGRLIAGFGVGFVSAIIILYMSEIAPRKVRGAIVSGYQFCITIGLMLASCVDYATQNRTDSGSYRIPIGIQIAWALILGGGLLMLPESPRYFVRKGQLDKASHVLARVRGQPEDSEYIKQELAEIVANNEYEMQAMPQGGYFTTWLNCFRGSLFHPNSNLRRTVLGTSLQMMQQWTGVNFVFYFGTTFFTSLGTISNPFLISMITTIVNVCSTPVSFYTMEKVGRRPLLLWGALGMVICQFIVAITGTVVGDKGGNNAAVSAEISFICIYIFFFASTWGPGAWVVIGEIFPLPIRSRGVALSTASNWLWNCIIAVITPYMVDQDKGDLKSKVFFIWGSLCACAFLYTYFLIPETKGLTLEQVDKMMEETTPRTSAKWKPHTTFAADMGLTEKDITDKVHVAHREV

SEQ ID NO: 55259 - protein, 335 aa, Anabaena variabilis ATCC 29413
MADTVNQQIVLKSRPVGEPQESDFALVESPIPQLGEGEVLNRTIYLSLDPYMRGRLSTNASYAASTELNSVIVGETVSQVIQSHHPDFQPGDFVLSNHGWQTYAVAKGKTLRKLDPNQAPLSYYLGVLGMPGLTAYAALLDIGQPKAGETVVISAASGAVGAVAGQIAKIKGARVVGIVGSDQKRDYIVKELGFNVGINRRTQEIASALKEAAPDGIDVYFDNTAGEILEAVLQQINLGARIPLVGLISQYNASSPPPGPNLLPLLIKRALIKGFLVSDYQHRFSDFARDVTEWLQSGQLKYKEDIVVGLENAPRAFIGLLRGENFGKLIVEVSQ

SEQ ID NO: 55260 - protein, 482 aa, Streptomyces avermitilis MA-4680
MSILNDVPKQLFIGGTWADAADGATMPVDDPATGEILCHVADAGPKDARLAADAAVEAQDGWARTAPRERSEILRRAYEIIVSRTGELALLMTSEMGKPLAEARGEVAYAAEFFRWFSEEAVRIDGGYGVLPDGRNRMLLMRRPVGPCLLVTPWNFPLAMGTRKIGPAIAAGCTMVLKPAPQTPLSSLALAGILKEAGLPDGVLNVVTTSRAGEVVEPLLTGGRIRKLSFTGSTRVGRLLLAQCADAVVRTSMELGGNAPFIVLDDADLSAAVDGAMTAKMRNMGEACTAANRFFVHRSVADEFGRRLAERMGALVVGPGTRDGVDVGPLIDEAGRAKVEELVADAVERGARVLVGGVAPDGPGRFYPPTVLADVDPGSRLMETEIFGPVAAILVFDDEDEVVRRANDTPWGLVGYVFTQGLDRALRVSERLEVGMVGVNTGLVSNPAAPFGGVKQSGLGREGGRVGIEEFLEYKYLAVPLR

SEQ ID NO: 55261 - protein, 419 aa, Streptomyces avermitilis MA-4680
MSALSPHLRQATPVVAVRGEGVHLYGEDGRRYLDFTAGIGVTSTGHCHPRVVAAAQEQAGTLVHGQYTTVLHPPLRRLVDRLGEVLPAGLDSLFFTNSGSEAVEAALRLARQATGRPNVLVCHGGFHGRTVAAAAMTTSGTRFRSGFSPLMSGVVVTPFPTAFRYGWDEETATRFALQELDYTLRTISSPDDTAAIIVEPVLGEGGYVPATRAFLEGLRERADRHGFVLILDEVQTGVGRTGRFWGHDHFGVTPDILITAKGLASGFPLSGIAASAELMGKAWPGSQGGTYGANAVACAAACATLDVVRDEKLVDNAEAMGARLRAGLAAVAATTPAIGDVRGLGLMLASEFVTEDGGPDPETAARVQRAAVDEGLLLLLCGAWNQVVRMIPALVIDEAEVDEGLRAWSAAVEVGVPAR

SEQ ID NO: 55262 - protein, 1071 aa, Neisseria meningitidis Z2491
MPKRTDLKSILIIGAGPIVIGQACEFDYSGAQACKALREEGYKVILVNSNPATIMTDPEMADVTYIEPIMWQTVEKIIAKERPDAILPTMGGQTALNCALDLARNGVLAKYNVELIGATEDAIDKAEDRGRFKEAMEKIGLSCPKSFVCHTMNEALAAQEQVGFPTLIRPSFTMGGSGGGIAYNKDEFLAICERGFDASPTHELLIEQSVLGWKEYEMEVVRDKNDNCIIICSIENFDPMGVHTGDSITVAPAQTLTDKEYQIMRNASLAVLREIGVDTGGSNVQFAVNPENGEMIVIEMNPRVSRSSALASKATGFPIAKVAAKLAVGFTLDELRNDITGGRTPASFEPSIDYVVTKIPRFAFEKFPAADDRLTTQMKSVGEVMAMGRTIQESFQKALRGLETGLCGFNPRSSDKAEIRRELANPGPERMLFVADAFRAGFTLEEIHEICAIDPWFLAQIEDLMKEEKAVSDGVLSDLDYAALRRLKRKGFSDKRIAQLLDVKEKEVREHRYVLNLHPVYKRVDTCAAEFATETAYLYSTYEEECEARPSDRKKVMILGGGPNRIGQGIEFDYCCVHAALALRESGFETIMVNCNPETVSTDFDTSDRLYFEPLTLEDVLEIVRTENPWGVIVHYGGQTPLKLANALVENGVNIIGTSADSIDAAEDRERFQKVLNDLGLRQPPNRIAHNEEEALVKAEEIGYPLVVRPSYVLGGRAMQIVHSAEQLQKYMREAVQVSEDSPVLLDFFLNNAIEVDVDCVSDGKDVVIGGIMQHVEQAGIHSGDSGCSLPPYSLSEEIQDEIRRQTKAMAYALGVVGLMNVQFAVQDGVVFVLEVNPRASRTVPFVSKATGVPLAKVGARCMAGISLKEQGVEKEVVPDFYAVKEAVFPFIKFPGVDTILGPEMRSTGEVMGVGASFGEAYYKAQLGAGERLNPTGKIFLSVREEDKERVIKTAKNFQALGYGICATRGTAQYLTEHGLIVQTINKVPEGRPHIGDALKNGEIALVVNTVSSDPQSVSDSHIIRQSALQQRVPQYTTTAGGEAMSEGAKSRDHLGVYSVQELHGRLKNRS

SEQ ID NO: 55263 - protein, 289 aa, Streptococcus suis 89/1591
MNIDGYTRLAAVVAKPIKHSISPFIHNLAFKETGVNGVYVAWEIPEEDLAVTLENIKRYDMFGINLSMPYKQAVIPYLDDLTASARLIGAVNTVIHKDGKLIGHNTDGIGFFKSLERLKGFQVKNKRLTILGGGGASTAIIAQATLDGAKEITIFCRQQSLERTQASLTPIAQATGVPMQVLALDDSQLLQEHITNSDLLVNGTSVGMDGYSQPVPSTIRFPENLLVADVIYQPFETPLLKLAQSQGNPTINGLGMLLFQAAEAFQAWTGKEMPTDLIWDQLVQKYDIK

SEQ ID NO: 55264 - protein, 597 aa, Gluconobacter oxydans 621H
MNASIPAITTGPLPASSKVHVQGTLHDIKVPMRQIEISDECPLNVYDSSGPYTDTAISIDIAKGLADSRGIWLRSRGDVEEYDGRTITAVDNGFAEGERLTPAFPNQRRPLRAVGDRAVTQMAYARAGIITPEMEFVAIRENIGRTQALKEERDGEDFGASIPDFVTPEFVRQEIASGRAIIPANINHRELEPMIIGRNFLVKINANIGNSAVTSSMEEEVEKMVWSIRWGADTVMDLSTGRNIHNIRDWIIRNAPVPIGTVPLYQALEKVGGIAEDLTWEIFRDTLIEQAEQGVDYFTIHAGVRLHMIPLTARRVTGIVSRGGSIMAKWCLHHHRESFLYEHFEEICDICRRYDVSFSLGDGLRPGSIADANDAAQFAELETLGELTKIAWAKDCQVMIEGPGHVPMHKIKTNMDKQLEHCHEAPFYTLGPLTTDIAPGYDHITSAIGAAMIGWFGTAMLCYVTPKEHLGLPDRNDVKTGVITYKLAAHAADLAKGHPGAQMRDDALSRARFEFRWEDQFNLGLDPDTARAMHDETLPKQAHKVSHFCSMCGPKFCSMKISHDIRAAAEKQDGMEQMAEKFREGGQLYVPVTEPAE

SEQ ID NO: 55265 - protein, 478 aa, Arabidopsis thaliana
MICVNCDIYIFFFINTKKIIIKYEAINFFFFFKPHRTKFILPFFYFLFLSTEILSYFHRSSPSDHQNTPVKMKNWIPNDLIYEILSRLPAISVARSRSKARPRLLIGVQQDGEWRFYSTPQSQNPCENKLSPADFHMKFSKGISNYSCSYASGLIYFDGMCIRKEDEDAKHVLCDPLTGKYVILPELRVGDSYSYLGFDPVDKEFKVLFMTTRNNIAWKDLDHYILTLGTGELKWRRIRCAFTHEPVWERICINGVLYYSAMNSDGNYVIYASHDGGSTVKLSMWVLEDVEKPEWSKHVYSLWTESQVVKVNHNLSVSGMTATGDIVLSTKYASQPFYVFYFNPERKTLQVPSVEVEGLGANRACMSYYAFADYVEDLSVNDAVRQLKSSPLQQQGQNIVTKRPKPRQGQDTSHDLSKSAPSVKNKYEFLADRLNHSVILSKWFKSINKDDVVTFTTEDFPWNTLRSKSVYRFSDSFI

SEQ ID NO: 55266 - protein, 452 aa, Mycobacterium sp. MCS
MSATRKTQHREVARLDRVPLPVEAARFGATGWQVTRTGARVVTNLRGRGSLSQKIVKQVPQTFADLGPTYVKFGQIIASSPGAFGEGLSKEFRSLLDRVPPANPEQVAKLLREELGDDPKNLYKSFDDTPFASASIAQVHYATLHTGEEVVVKIQRPGIRRRVAADLQILKRGARLVEFAKLGQRLSAQDVVADFADNLAEELDFRLEAQSMDAWVSHMHASPLGRNIRVPQVYWDLTSEKVLTMERVSGIRIDDAAAIRKKGFDGTELVKALLFSLFEGGLRHGLFHGDLHAGNLYIDDDGKIVFFDFGIMGRIDPRTRWLLRELVYALLVKKDHAAAGKIVVMMGAVGTVKPEAQAAKDLEKFATPLTMTSLGDMSYAEIGRQLSTLADAYDVKLPRELVLIGKQFLYVERYMKLLAPKWQMMSDPQLTGYFANFMVDISREHKEEGLEV

SEQ ID NO: 55267 - protein, 339 aa, uncultured bacterium
AANNLLAALLDAHIHNGNELGIDVRKITWKRVVDMNDRQLRNIVDGLGGKAHGVPREDGFDITVASEIMAIFCLATSISDLKERLGRIVVGYTRDDKPVTAHDLKAEGAMTALLKDALKPNLVQTLEGTPAFVHGGPFANIAHGCNSIMATRMAMALGDYAVTEAGFGADLGAEKFLDIKCRLAGLKPDAVVVVATARALKNHGGVAKADLNAENLEALEAGLPNLLQHVENITKVYQLPCVVAINRFPTDTEAELALIEAKCKELGVNVALSEVWAKGGEGGIALAEEVVRLCEQPNDFQFSYESELGLAEKIEAVATRIYHADGVTFTPAAKKELAQ

SEQ ID NO: 55268 - protein, 352 aa, uncultured bacterium
IGAANNLLAAMLDNHIQQGNTLGIDPRRITWRRAVDMNDRQLRNIVDGLGLRTDGTPRQDGFDITVASEVMAVLCLASDIIDLKERLARIVVGYTYDNQPVTAGDLKAQGAMAALLKDVLKPNLVQTLEHTPAFIHGGPFANIAHGCNSVTATRMALKLGEYAVTEAGFGADLGAEKFLDIKCRMAGLKPNAVVIVATVRALKHNGGVAKADLANENLEALEKGMPNLLQHVDNITNVYHLPCVVAINRFPTDTEAELKLIEDKCHELGVNVALSEVWAKGGAGGRQLAEEVIRLCEQPNDFTYSYDLDTSIMDKLNTIATRIYHADGVDLVGSAVRQLKQLEELGYSHLPI

SEQ ID NO: 55269 - protein, 346 aa, uncultured bacterium
TSAHMLLSAMLDNSIQQGNPLNIDPRRVIWKRVVDMNDRALRNIVIGLGGKAHGVPREDGFDITVASEVMAILCLASNLHDLKERLKRIVVAYNYDGKPVTAEDLHAAGAMAALLKDAVKPNLVQTLEHVPAIIHGGPFANIAHGCNSVMATRTALRLADFTITEAGFGADLGAEKLFDTKCRQAGLAPDACVLVATVRALKMHGGVAKADLKEPNVEAVKKGLPNLGKHIENIFKFGVPVVVAINIFAQDTREELQAVYDYCAGMGVNVALSDVFAKGGEGGVELAKEVVALAESGMARFKPIYPLEMSLKEKVATVVKEVYGGDRVEFQTKAAQALDQYEKEGY

SEQ ID NO: 55270 - protein, 352 aa, uncultured bacterium
IGAANNLLAAMLDNHIQQGNILGIDPKQITWKRAVDMNDRQLRNIVDGLGGRMQGVPREDGFDITVASEVMAVLCLASDIPDLKARLGRIIVGYTYDGKPVTAHDLKAEGAMAALLKDALKPNLVQTLENTPAFIHGGPFANIAHGCNSITATKMALKIGDYVVTEAGFAADLGAEKFLDIKCRMAGLTPSAVVIVATVRALKYHGGVAKADLNEENLDALKKGLPNLLQHVDNIKNVYKLPCVVAINPFPTDTEAELAEVEAQCKELGVNVALSEVWAKGGEGGIALAEEVVRLCDEPNDFQFSYDLDCSIEEKIHAIAHKIYHAKHLMLLPNAKKQAEQLTALGFDKTAD

SEQ ID NO: 55271 - protein, 150 aa, Triticum aestivum
  misc_feature (96)..(96): Xaa can be any naturally occurring amino acid
  misc_feature (125)..(125): Xaa can be any naturally occurring amino acid
  misc_feature (144)..(144): Xaa can be any naturally occurring amino acid
  misc_feature (146)..(146): Xaa can be any naturally occurring amino acid
  unsure (1)..(150): unsure at all Xaa locations
ANAVVYRAIFLPANRTIAVKCLDLDRINSNLDDVRKEAQIMKLIDHPNVIKAYCSFVVDHNLWVIMPFMAEGSCLHLMKVAHPDGLEEPVICSILXKETLKALAYLHGQGHIHRDVKAGNILVDXPCVMKLGDFGVTSCLFDKXNXKVQE

SEQ ID NO: 55272 - protein, 468 aa, Rhodobacter sphaeroides 2.4.1
MEARMPAKSFDMIVIGAGPGGYVCAIRGAQLGLNVAIVERENLGGICLNWGCIPTKAMLRSAEVYHLMHRAKEFGLKAEGIGYDLGAVVKRSRGVAKQLSSGVAHLMKKNRITVVMGDATLAGKGRVSVRTDKGTEELEAKSIVLATGARARELPGLEADGDLVWTYRHALEPKRMPKKLLVIGSGAIGIEFASFFNTLGADTTVVEVMERILPVEDAEVSAFAKKQFVKQGMKILEKATVKKLDRAGGKVTAHVETGGKTETMEFDTVISAVGIVGNVEGLGLEAAGVTVDRSHVVTDEYCRTGVEGLYAIGDIAGAPWLAHKASHEGVMVAELIAGGHPHPIKPGSIAGCTYCQPQVASVGLTEAKAKEKGYEIRVGRFPFIGNGKAIALGEAEGFVKTVFDAKTGELLGAHMVGAEVTELIQGYVVGRALETTEAELMETVFPHPTLSEMMHESVLDAYGRAIHF

SEQ ID NO: 55273 - protein, 454 aa, Saccharomyces cerevisiae
MSEPEFQQAYEEVVSSLEDSTLFEQHPEYRKVLPIVSVPERIIQFRVTWENDKGEQEVAQGYRVQYNSAKGPYKGGLRFHPSGNLSILKFLGFEQIFKNSLTGLDMGGGKGGLCVDLKGRSNNEIRRICYAFMRELSRHIGQDTDVPAGDIGVGGREIGYLFGAYRSYKNSWEGVLTGKGLNWGGSLIRPEATGYGLLYYTQAMIDYATNGKESFEGKRVTISGSGNVAQYAALKVIELGGTVVSLSDSKGCIILETGITSEQVAVISSAKVNFKSLEQIVNEYSTFSENKVQYIAGARPWTHVQKVDIALPCATQNEVSGEEAKALVAQGVKFIAEGSNMGSTPEAIAVFETARSTATGPSEAVWYGPPKAANLGGVAVSGLEMAQNSQRITWTSERVDQELKRIMINCFNECIDYAKKYTKDGKVLPSLVKGANIASFIKVSDAMFDQGDVF

SEQ ID NO: 55274 - protein, 139 aa, Arabidopsis thaliana
MENKRNVCSLGESSIKRHKSDLSFNSKERKDKVGERISALQQIVSPYGKTDTASVLLDAMHYIEFLHEQVKVLSAPYLQTIPDATQEELEQYSLRNRGLCLVPMENTVGVAQSNGADIWAPVKTPLSPAFSVTSQSPFR

SEQ ID NO: 55275 - protein, 356 aa, uncultured bacterium
VTSAHNTISALLDNYIYQHRKEGFSLREIYWKRVLDVNDRALRNVVTGLRGDGVVSETGFDITSASELMAILCLATSEKDLQHRIENILLGITSDGKPFRVRDLGVAGAITVLLRDALSPNLVQTTEHTPAFIHGGPFANIAHGCSSVLATKMAMTYSDYVVTEAGFGADLGAEKFFDIKCRKAGLQPRLVVIVATTQGLKMHGGVDLSLITEPNAKGLKEGLKNLNRHINNMQGFGQPVVVTLNRYDTDTPEEIDIVRKNCEDLGVGFAVNEAFLKGGEGAMELAQKVADTIDQIQPLPIHFAYPENDTIEGKIEKVCKRIYGAAAVEFTKTGKKRLDAIREIFGDDKDIARYPV

SEQ ID NO: 55276 - protein, 453 aa, Saccharomyces cerevisiae
MSEPEFQQAYEEVVSSLEDSTLFEQHPEYRKVLPIVSVPERIIQFRVTWENDKGEQEVAQGYRVQYNSAKGPYKGGLRFHPSVNLSILKFLGFEQIFKNSLTGLDMGGGKGGLCVDLKGRSNNEIRRICYAFMRELSRHIGQDTDVPAGDIGVGGREIGYLFGAYRSYKNSWEGVLTGKGLNWGGSLIRPEATGYGLVYYTQAMIDYATNGKESFEGKRVTISGSGNVAQYAALKVIELGGTVVSLSDSKGCIISETGITSEQVADISSAKVNFKSLEQIVNEYSTFSENKVQYIAGARPWTHVQKVDIALPCATQNEVSGEEAKALVAQGVKFIAEGSNMGSTPEAIAVFETARSTPLDQATVWYGPPKAANLGGVAVSGLEMAQNSQRITWTSERVDQELKRIMINCFNECIDYAKKYTKDGKVLPSLVKGANIASFIKVSDAMFDQGDVF

SEQ ID NO: 55277 - protein, 589 aa, Candida albicans
MTRTTRIDTQEATKHKDLPPVPSPLSLSSNPNPECLMESKSLGRKNFKKLSLDASPVKSTSGSLRSSDMMLIKEPTSLRQKRTRPPPILHLPTASSSATSTPTSNITGSSSASSIQFAQKSPGSGVIVSQTLSRPSSAGGIPSSGYSSLNVNQSNRNVDPDNVVSTDMILNQISNLDLTSMNHHRQHYQNSHHHLPTTNRKRQTVISSISPTKSSAASSPLEPQIQLLPASSQSPIATTSSLKLNNKDLLTLKQLGSGNSGSVLKILHIPTQKTMAKKIIHIDLKSVIQTQIIRELRILHECHSPYIIEFYGACLNNNNTIVICMEYCNCGSLDKILPLCENKQFPTFVLKKLSFAILSGLTYLYTTHKIIHRDIKPNNVLMTHKGEFKLCDFGVSRELTNSLAMADTFVGTSMYMSPERIQGLDYGVKSDVWSTGLMLIELASGVPVWSEDDNNNDDDEDDEDDAYVRQGSIAAERNGQNSPSRSRKNKQKGNGYNSYNGPEGILDLLQRIVNEDAPTLTNKINPVTKLPYDKYLCQFIDLCLIKDDSVRKTPWQLLEDKEHFFKGVEEGVYDKEHKSWAKKIRKCKV

SEQ ID NO: 55278 - protein, 484 aa, Synechococcus sp. CC9605
MIHGQTSTPGLSVAPQIMRASWVESRKGQANVSQMHYARQGVVTEEMAHVAKRENLPESLVMEEVARGRMIIPANINHTNLEPMAIGIASKCKVNANIGASPNASDAAEEVKKLKLAVKYGADTVMDLSTGGVNLDEVRTAIIGASPVPIGTVPVYQALESVHGSIEKLDEDDFLHIIEKHCQQGVDYQTIHAGLLIEHLPKVKGRITGIVSRGGGILAQWMLYHHRQNPLYTRFDDICEIFKRYDCTFSLGDSLRPGCQHDASDAAQLAELHTLGELTRRAWKHDVQVMVEGPGHVPLDQIEFNVKKQMEECSEAPFYVLGPLVTDIAPGYDHITSAIGAAMAGWHGTAMLCYVTPKEHLGLPNADDVREGLIAYKIAAHAADIARHRPGARDRDDELSRARYNFDWNKQFELSLDPERAKEYHDETLPADIYKQAEFCSMCGPKHCPMQTKITDEDLEGLEKVLEANTGAAELTPVKLDKAD

SEQ ID NO: 55279 - protein, 669 aa, Synechococcus sp. CC9605
MVAAPASLDTLCINSIRMLAVDAINKSNSGHPGLPMGCAPMGYALWDKFLNHNPKNPKWFNRDRFVLSAGHGCMLLYALLHLTGYDSVSIEDIKQFRQWGSKTPGHPETFETPGVEVTTGPLGAGISNAVGLAIAESHLAAKFNKADATVVDHYTYVIMGDGCNQEGVSSEAASLAGHLKLGKLIALYDDNSITIDGRTDVSFTEDVLKRYEAYGWHVQHVAEGNTDVDAIANAIEAAKAVTDKPSIIKVTTTIGYGSPNKADTAGVHGAALGEEEAALTRQQLGWDYAPFEIPQDAYDQFRQAIDRGASLEAEWNQTLATYRTKYPTEAAEFERMLRGELPEGWDKELPTYTPEDGGLATRKHSQICLGALGPNLPELIGGSADLTHSNYTDIKGETGSYQASSPEKRYLHFGVREHAMAAILNGIAYHNSGLIPYGGTFLVFADYMRGSMRLSALSELGVIYVLTHDSIGVGEDGPTHQPIETIPSLRAMPNMLVFRPGDGNETSGAYKVAIQNRKRPSSLCLSRQGMANQANSSIDKVALGGYVLEDCAGTPDLILIGTGTELDLCVQAAKQLTAEGKKVRVVSMPCVELFDEQTDAYKEEVLPNAARKRMVVEAAESFGWHRFIGLDGDSVTMNRFGASAPGGTCLKEFGFTVENVVAKAKALLG

SEQ ID NO: 55280 - protein, 307 aa, Zea mays
MAAPLPLSAEDMLRVNGSRRFAAAMAAASPFASLADALLAARRIWLDEVDVNGWLEAFAAHPAIGTTSPSVSKWSKEEQSAALSTATDSTAQELAEWNARYREKFGFVFMICASGRTAAEVLAELKRRYTNRPIVELEAAAQEELKITELRLTKLFSLEPTVPSTTIEGPTVQSDKAAGSSNRSRPPITTHVLDIARGSPASGIEVHLEMWKDCSAPPSFNNKDFSGWETLGYSVTNNDGRSGQLMDIVDNIAPGFYRISFNTGKYAPAGFFPYVSIIFEIKENQAAEHFHVPLLHSPFSFTTYRGS

SEQ ID NO: 55281 - protein, 368 aa, Streptomyces coelicolor A3(2)
MPKPGELTFVAPRGVKKPPRHLADLTPAERKEAVAAIGEKPFRAKQLSQHYFARYAHAPEQWTDIPAGSREGLREALLPELMTVVRHLSTDQGTTRKTLWKLFDGTLVESVLMRYPDRVTMCISSQAGCGMNCPFCATGQAGLDRNLSTAEIVHQIVDGMRALRDGEVPGGPARLSNIVFMGMGEPLANYNRVVGAIRRLTDPEPDGLGLSQRGITVSTVGLVPAIHRFTGEGFKCRLAISLHAPDDELRDTLVPVNTRWKVREVLDAGFEYAAKSGRRLSIEYALIRDINDQAWRGDRLGRLLRGRPVHVNLIPLNPTPGSKWTASRPEDEKAFVEAIAAHGVPVTIRDTRGQEIDGACGQLAASER

SEQ ID NO: 55282 - protein, 236 aa, Zea mays
  misc_feature (160)..(160): Xaa can be any naturally occurring amino acid
  misc_feature (166)..(166): Xaa can be any naturally occurring amino acid
  misc_feature (214)..(214): Xaa can be any naturally occurring amino acid
  unsure (1)..(236): unsure at all Xaa locations
MDSSKSPQPLKKSRTSLSGTDGHQFENDELPSETASDKTPGLKFETVDKVQDEFGEDSSPLQQSAASNVSYRGSPCIGAFTIQCARCFKWRLIPTKEKYEEIREHIIQEPFDCERAREWKPDVTCDDQEDISQDGSRLWAIDKPNIAQPPAGWERQITIXGEGGTXFADADYTSPTTGAPSSLVGAARLLQENPEYGAQGVTLAQFSFQISRPXLRQIYVKMRPKNASPSDESTPK

SEQ ID NO: 55283 - protein, 397 aa, Oryza sativa (japonica cultivar-group)
MAKLQAGYLFPEIARRRAAHLLKFPDAKIISLGIGDTTEPIPDVITNAMAKRAHALSTVDGYSGYGAEQGEKKLRAAIAATYYADLGIEETDIFVSDGAKCDISRLQVLFGSNVKIAVQDPSYPAYVDSSVIMGQTGLYQEDVQKYGNIEYMKCSPENGFFPDLSSVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNISQAGGLGCLSPEGLKAMSDVVGFYKENTKIIVDTFTSLGFNVYGAKNAPYVWVHFPGRNSWDVFAEILEKAHVVTTPGSGFGPGGEGFVRVSAFGHRENIIEAARRLKQLYK

SEQ ID NO: 55284 - protein, 483 aa, Frankia sp. EAN1pec
MQEQDRLFIGGEWVAPSGTRTIEVVSPHSEQVIARVAAPGTEDVDRAVAAARTAFDEGPWPRLDPAERVAVIRRLGALLKPRRKELSELISAEMGAPISFAKLSHVTLPLLMMGAFADIAENLAWEEPRKGFYGQDILLRKEPIGVVAAIVPWNMPLFLTIGKLVPALLAGCSVVLKPSPETPLDAYALAESLAEAGLPQGVVSVLPGDREIGEYLVAHPGVDKVSFTGSTAAGRLVAASCGSNLKRVSLELGGKSAAVVLDDADPAAVAAGVEIAGLMNSGQACVAQTRILVPRARYGEFVDALAAMVEALPVGDPSDPATKVGPLVARRQQERVRGYIEEGQKEGARLVVGGSDLPAGVDQGWYVRPTVFADVESGMRIAQEEIFGPVLTVLPYSDDADAVRIADDTEYGLSGSVWTSDVERGLAVARRVRSGTFGVNQAYSMDPNAPFGGVKASGIGRELGREGIESYLDVKSISVAPAS

SEQ ID NO: 55285 - protein, 1064 aa, Oryza sativa (indica cultivar-group)
MEGTGEMREVGRETLHGGVVQSVSETDEYKEKTIDSEKDGQFRVQPRWRKFLAHVGPGALVAIGFLDPSNLETDMQAGADFKYELLWVILVGMVFALLIQTLAANLGVKTGRHLAELCREEYPHYVNIFLWIIAELAVISDDIPEVLGTAFAFNILLKIPVWAGVILTVFSTLLLLGVQRFGARKLEFIIAAFMFTMAACFFGELSYLRPSAGEVVKGMFVPSLQGKGAAANAIALFGAIITPYNLFLHSALVLSRKTPRSDKSIRAACRYFLIECSLAFIVAFLINVSVVVVAGSICNANNLSPADANTCGDLTLQSTPLLLRNVLGRSSSVVYAVALLASGQSTTISCTFAGQVIMQGFLDMKMKNWVRNLITRVIAIAPSLIVSIVSGPSGAGKLIILSSEFALLLQKQQYPEFLIWIQMILSFELPFALIPLLKFCNSSKKVGPLKESIYTVVIAWILSFALIVVNTYFLVWTYVDWLVHNNLPKYANGLISVVVFALMAAYLVAVVYLTFRKDTVATYVPVPERAQAQVEAGGTPVVDASAADEDQPAPYRKDLADASIICISNWEDEDFIAWHPDLHGRFSVRSAYYLALNLKNQEDTGPSNMAGDRRWDLIWKCEVPQKVRSFAWKVATDSLATMANKTKRKLERIATCGDIHSLIMSLNFTQIEIKTANFLNSWGDGVLVMVSGLVQTKEYSHQRKFIQMFFLAPQEKGYFVLNDYFHFVDEEQVQPAPVIAQDNFETNMASNSVVEPVPEYIHEEENQSAVPITSEESDAVENYTYSEPPQQVVSQSDNWGDEPLPEEPISSFTNGMAMAPEEPVQSPPVPPPHVEEPVGEPVKKTYASILRTAKAPLVFPVAQPAPTRPHQATETNQAAQHSVMTSSVATEKPKTDVYGEFAVQDDEESKSVYVGNVPSSVSEADLENEFKKFGRLIPDGVAIRSRKETGGYYAFVEFEELSGVHNALKASPIEINGRQIYVEERKPNSGIRGGNYTQLHGVVDGGIYLRRGGRGRFGGGGRGYARGGGDNEYAGNRGSGRPSNGYQRVPHHERGILGSHNARN

SEQ ID NO: 55286 - protein, 473 aa, Pseudomonas syringae pv. syringae B728a
MSSSSTSAAAGQQGRQRAASNRLIFISVLVATMGALAFGYDTGIIAGALPFMTLPADQGGLGLDAYSEGMVTASLIVGAAFGSLASGYISDRFGRRLTLRLLSVLFIAGALGTAIAPSIPFMIAARFVLGIAVGGGSATVPVFIAEIAGPSRRARLVSRNELMIVSGQLLAYVLSAVMAALLHTPGIWRYMLAVAMVPGVLLLVGTFFVPASPRWLASKGRFDEAQDVLEQLRPSKQDAQREVDEMKAQDEEARHRPKARELLRQRWVIKLLLIGVGLGFTAQFTGVNAFMYYTPIILKNTGMGTNAALTATIGNGVVSVIATLLGIWAIGRYGRRHLLMTGLVIVILMQAALGCVLQFMPQNMTQSYTALACILVFLLFMQMCISPVYWLLMSELFPMQVRGLLTGTAVSMQWLFNASVAFTFPIAVDTIGNPTFFIFAAINIGSLIFVFLCLPETKGKSLEQIEKHLKKEL

SEQ ID NO: 55287 - protein, 473 aa, Frankia sp. EAN1pec
MALHGRARGRRGDQAVEVRPHLVIPDEDGPVPRYRMPRSSMSAETAYQIVRDELMLDGNARLNLATFVTTWMDEHADRLMTECAAKNMIDKDEYPQTAELEARCVNMLADLWHAPDATDAVGCSTTGSSEACMLAGLAMLRRWRSTREPHRGEQGGGQRGTGARPNIVMGANVQVCWEKFARYWDVEPRLMPLAPGRTHLTAPEAVARCDENTIGVVAVLGSTFDGTYEPVAEIVAALDQLAASGGPDVPVHVDGASGGFIAPFCDPDLVWDFRLERVVSINASGHKYGLVYPGVGWALWRDARHLPAELVFDVDYLGGSMPTFALNFSRPGAQVVAQYYSLLRLGRAGYRHTARTCRDNARWLADEIAKLGPFELISDGSGIPAFAFTTRDAAEFSVFEVSEALRARGWLVPAYRFPPDLAELAVLRIVVRAEFSRDLAHLLVEDLHRVVGRLSGPRWRTAAGGADLASFHH

SEQ ID NO: 55288 - protein, 390 aa, Oryza sativa (japonica cultivar-group)
MLRLQNHLLPLLRASSSSSPVHLRRLIPSTAAASSSSSVHPNRRLHSTAAARSTTTATPFSMEDYLVDTCGLTAAQALKASKNVSHLKSATKPDAVLAILSGVGLSGADLAAVFAAEPRLLCTKAPSVALRVASLRHRVGLSDPQIASLLLLPGGAKGFHTCDMAPRLEFWIPFLGSFEMLDLEEEQRDRQLEPREGYQAQHRAAPGMSQTSARVLTFSPERLKVIVQQAEKLRMPGCSWAFKNAVGAVARSNEGIVNARMEFLSSSLGCSMEKLRSAVCKCPQILGLSESKLHSKIEFLVGKVGLEPDYILQRPVLLTYSLEKRLLPRHYVVEVLLVKGLIKKTVDFYGCVCVSNEDFVARYIDHHENAVPGLADAYAAVCSGKLPALV

SEQ ID NO: 55289 - protein, 523 aa, Oryza sativa (japonica cultivar-group)
MGVLGDGSGWCFWLRAGRSWSGSRTPSSPPKAPPSPPSPSPPEVEEGAEVGVGSSSTAPSCSPRTAPSPPPPPPPPPRFFITSPILDLTIVGLDVVNDELNSHGQQPHFLKTCLNPSLDLGSTVLLLGHTKRKDLTIGEGKVIITTDNLIKFSTDEVAWYPGSAGFDMHGNLAFMVCDPMKLAPSTPTGYASASSAALLSAKKDVPTQFGMPIPAVCGWLKQHWNGNLEDVSKPMMPPARLISTGQRSECSSVGRLNYIKTMEREGGDGMSSSQIPPRLTQHHGSCSSASAKISCGENDSVDSHSIHEQQDLTSQMHESKIEQSASLMDNNFPPGHPRSIRLPLPLKHMMSHENKIKPNPSFSHEAQLANVRINCGTLHNVAYQENCWSEAQSSSSPPDISELGDERGGFSSGEETMYSAETRESRNIPSPKEKNPKMVGRSQSFVNHSKWDSPKSVESSKGAPSKSHTFIPLRKPHLQAAAISQKSQDFFSPTVSSSMKKRNLSQIPMKPRQSAQVTSKWII

SEQ ID NO: 55290 - protein, 114 aa, Brassica napus
ILKWALAFLIGLATGLVGFLNNLAVENIAGFKLLLTGNLMLKEKYFQAFFAFAGCNLILATAAGSLCAFIAPAAAGSGIPEVKAYLNGIDAYSILAPSTLFVKVKIPKPSVQAS

SEQ ID NO: 55291 - protein, 1159 aa, Ustilago maydis 521
MLLTRTASRLQCLPRPAVTPNKALSSSTRALATVTDKKYIAVLGGGISGLTSAYRLAQHLPKDRYNIVLLEHQNRLGGWIRSERIVLPTADGAAQNVTALIEQGPRSIRPAGYSGLMMLELVRSLGLLERMLKVPKTAPSAQNRYLYYPDRLAKLPSSIPSLLSALFKLPFLRAIIPGVLREPRVPSRFLRPRSESKSEKQRLQQREWIQDESVDSFVSRRFGNGLAENLVSAVIHGIYAGDTRKLSIRAVLPFLWEAERVHGSVLRSMLSTKRNKRHRALPEPEAAVKAAKDLRLENIEKELGKDVVESFKSISVYSFQEGVQEIVQALESRLAEYDNVQIKKGDAVQSIHRNEAGKTTLHTESGETMVVDRIISSIPSTRLAQILPSDAELPHLSHNPSANVGVVNLVISPSAVASSSKPLVPVEGFGYLIPRTSPGNQDGILGVVFDSDAIPEQDSVCAASRPVKLTVMMGGSHWADLETLPSEADMRARAINAVSQHLGIDRSLLEDASKVSVRATMQKDCIPWYLVGHPVRMSQLHKALEKDELLGSKLTLVGASYTGVSLNDCVAYATEAVEQIVDAELHGGERIVTGLASFAIPPVPPSQKATSITAQARKGDTRPSVNPQGLMGPITGTPNQFAVAGSIHTRAFSTTRQKSNSSSSSSSSSRSTPVSSADKKTKSLNEILLDSIRASGPMPVSTYMRTCLLDPMQGYYSSANSPSTSREVLGSRGDFITSPEISQVFGELVAIFYLARWQSVGAPSATRIVELGPGKGTLLADMLRTFATFKPFMATLKRIHLVETSEGLMELQLNAIKEALGVVGKRVVSAEEDAGADGVVVEWFPGIDMVPVIPEELTILTAHEFFDALPTHIFEKGVDGKFREVLVGIKPTSSITVLKPGQDLQKQAQNEELGFVLSPTPTPWAQMLVQNNPRFQHLEPGQRVEVSPEAWAVARRVGEIVAGRSASAPSSPKQEAPRSAPEGSAEAKAEAALEAERLQAERRLETQRLSHATEGGIGLIIDYGDDKAYGSSLRAFKNHALVRVFDSPGTVDLTVNVDFLHLKSAIHTTDARYLGPIDQADFLVGMGLQMRTEALVKGRDAHDENRIKDAANRLIDESGMGIQYKALAITARRCAENNAPDQHRDKVADPDIYPFEFQH

SEQ ID NO: 55292 - protein, 355 aa, Blumeria graminis
MSTRAPNATTGSRKISFNVSEQYDIQDVVGEGAYGVVCSALHKPTGQKVAIKKITPFDHSMFCLRTLREMKLLRYFNHENIISILDIQKPRSFDSFTEVYLIQELMETDMHRVIRTQDLSDDHCQYFIYQTLRALKAMHSANVLHRDLKPSNLLINANCDLKVCDFGLARSAASQEDCSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPFKQMFPKTSDLALDLLEKLLAFNPVKRITVDEALQHPYLEPYHDPEDEPTADPIPEEFFDFDKNKDNLSKEQLKELIFQEIMR

SEQ ID NO: 55293 - protein, 657 aa, Escherichia coli K12
MTQLAIGKPAPLGAHYDGQGVNFTLFSAHAERVELCVFDANGQEHRYDLPGHSGDIWHGYLPDARPGLRYGYRVHGPWQPAEGHRFNPAKLLIDPCARQIDGEFKDNPLLHAGHNEPDYRDNAAIAPKCVVVVDHYDWEDDAPPRTPWGSTIIYEAHVKGLTYLHPEIPVEIRGTYKALGHPVMINYLKQLGITALELLPVAQFASEPRLQRMGLSNYWGYNPVAMFALHPAYACSPETALDEFRDAIKALHKAGIEVILDIVLNHSAELDLDGPLFSLRGIDNRSYYWIREDGDYHNWTGCGNTLNLSHPAVVDYASACLRYWVETCHVDGFRFDLAAVMGRTPEFRQDAPLFTAIQNCPVLSQVKLIAEPWDIAPGGYQVGNFPPLFAEWNDHFRDAARRFWLHYDLPLGAFAGRFAASSDVFKRNGRLPSAAINLVTAHDGFTLRDCVCFNHKHNEANGEENRDGTNNNYSNNHGKEGLGGSLDLVERRRDSIHALLTTLLLSQGTPMLLAGDEHGHSQHGNNNAYCQDNQLTWLDWSQASSGLTAFTAALIHLRKRIPALVENRWWEEGDGNVRWLNRYAQPLSTDEWQNGPKQLQILLSDRFLIAINATLEVTEIVLPAGEWHAIPPFAGEDNPVITAVWQGPAHGLCVFQR

SEQ ID NO: 55294 - protein, 115 aa, Lactuca sativa
WKGPWRWFDESMLDCCEPLEKVKAKGISFGKVVCLAHCAGAKVEAFRTNQSNIDEFRKHVIACSTSDDCHVISSYNRATFKQTGSGHFSPIGSYHAGRDMALILDVARFKYPPHW

SEQ ID NO: 55295 - protein, 507 aa, Streptomyces avermitilis MA-4680
MTRFAAPGTDGAIVSYQARYDHFIGGEYVPPARGQYFENPSPVNGQPFTEIARGTAEDVERALDAAHAVAPAWGRTSVAERSDILRRIADRMEANLEKLAVAESWENGKPVRETLAADIPLAIDHFRYFAGAIRAQEGSLGEVDDDTVAYHFHEPLGVVAQIIPWNFPILMATWKLAPALAAGNAVVLKPAEQTPASIHYWLSLVADLLPPGVLNIVNGFGVEAGKPLASSPRVAKVAFTGETTTGRLIMQYASENITPVTLELGGKSPNIFFDDVWSANDDFRDKALEGFTMFALNQGEVCTCPSRALVQRGQYAEFMEAAVARTELIKTGHPLDTDTMIGAQASNDQLEKILSYLDIGRQEGAKILTGGERIEHDGELKGGYYVQPTIFEGDNRMRIFQEEIFGPVVSVTSFNDFDDAIKIANDTLYGLGAGVWTRDINTAYRAGRAIQAGRVWTNCYHAYPAHAAFGGYKGSGIGRETHKMMLDHYQQTKNLLVSYSPKKLGFF

SEQ ID NO: 55296 - protein, 292 aa, Pseudomonas aeruginosa PAO1
MIAGSMVALVTPFDAQGRLDWDSLAKLVDFHLQEGTNAIVAVGTTGESATLDVEEHIQVIRRVVDQVKGRIPVIAGTGANSTREAVALTEAAKSGGADACLLVTPYYNKPTQEGMYQHFRHIAEAVAIPQILYNVPGRTSCDMLPETVERLSKVPNIIGIKEATGDLQRAKEVIERVGKDFLVYSGDDATAVELMLLGGKGNISVTANVAPRAMSDLCAAAMRGDAAAARAINDRLMPLHKALFIESNPIPVKWALHEMGLIPEGIRLPLTWLSPRCHEPLRQAMRQTGVLA

SEQ ID NO: 55297 - protein, 468 aa, Streptococcus suis 89/1591
MSKTLPKDFIFGGATAAYQAEGATKTDGKGPVAWDKYLEDNYWYTAEPASDFYNRYPVDLKLAEEYGVNGIRISIAWSRVFPTGYGEVNRKGVEYYHNLFAECHKRGVEPFVTLHHFDTPEALHSNGDFLNRDNIDHFVAYAAFCFEEFPEVNYWTTFNEIGPIGDGQYLVGKFPPGIQYDLAKVFQSHHNMMVSHARAVKLYKDKGYKGEIGVVHALPTKYPYDPANPDDVRAAELEDIIHNKFILDATYLGRYSEKTMEGVQHILAANGGELDLREEDFSILEAAKDLNDFLGINYYMSDWMQAFDGETEIIHNGKGEKGSSKYQIKGVGRREAPVNVPKTDWDWIIYPQGLYDQIMRVKADYPNYKKIYITENGLGYKDEFVDGTVYDDGRIDYVKKHLEVISDAISDGANVKGYFIWSLMDVFSWSNGYEKRYGLFYVDFETQERYPKKSAHWYKKVAETQVID

SEQ ID NO: 55298 - protein, 115 aa, Lactuca sativa
WKGPWRWFDESMLDCCEPLKKVKEEGITFGKVACLAHCAGANVQAIRTSQGSLEDFRQHIIRCTSSDDCHVITSYNRKAFGQTGTGHFSPIGGYHKGSDMALILDTARFKYPPHW

SEQ ID NO: 55299 - protein, 346 aa, uncultured bacterium
FCNNLLAAMLANHIQQGNSLDIDTRQVIWKRCEDMNDRALRNIVVGLGSKMDGFVREDHFVITVASEIMAILCLADDMEDLKARLSRIVVAYNRAGDPVTAGDLKATGAMAALLKDALKPNLIQTLEHTPAIVYGGPFANIAHGCNSVRATKMALKLADYVITEAGFGADLGAEKFFDIKCRMAGLKPDAVVLVSTVRALKYNGGVPKSDLSEKNMEALAAGIVNLEKHIENLQKYQVPIVVTLNAFVADTEEEIEYVKNFCEERGCEFALSEVWEKGGEGGIALAQKLLYTLENKKSEFKLLYEDDLSLKEKIETVAKEIYGAAGVSYSAAAEKSLKKITEMGLG

SEQ ID NO: 55300 - protein, 179 aa, Triticum aestivum
  misc_feature (9)..(9): Xaa can be any naturally occurring amino acid
  misc_feature (42)..(42): Xaa can be any naturally occurring amino acid
  misc_feature (120)..(120): Xaa can be any naturally occurring amino acid
  misc_feature (141)..(141): Xaa can be any naturally occurring amino acid
  unsure (1)..(179): unsure at all Xaa locations
MAPTVMASXSSPPCAPFQGLNSTVGLPVCRRSKGAGLGSVSXNGGRIRCMQVWPIEGIKKFETLSYLPPLSTEALLKQVDYLIRSKWVPCLEFSKVGFIFREHNASPGYYDGRYWTMWKXLPMFGCTDATQVINEVEEVKXKEYPDAYVRIIGFDNMRQVQCVSFIAFKPPGCEESGQA

SEQ ID NO: 55301 - protein, 352 aa, uncultured bacterium
IGAANNLLAAMLDNHIQQGNELGIDPKAITWKRAVDMNDRQLRHIVSGIGGRLQGVPREDGFDITVASEIMAVLCLASDIPDLKKRLGRIIVGYTYKGEPVTAHDLKAEGAMAALLKDALKPNLVQTLEGTPAFVHGGPFANIAHGCNSVTATKLALKLSDYTITEAGFAADLGAEKFLDIKCRMAKLKPNAVVMVATVRALKYHGGVPKAELGKENLAALEKGLPNLLQHVSNITDVYGLPCVVAINAFPTDTKKELALVEKKCAELGVKAVLAEHWAKGGAGATKLAEAVVEACEQPNKFRFSYADKLSIEEKLEAICKKIYHADGVVLTDNAKKQLKQLTDLGFSNMPI

SEQ ID NO: 55302 - protein, 353 aa, uncultured bacterium
IGAANNLLAAMLDNHIQQGNALGIDIKKITWKRCVDMNDRQLRFVVDGLGGRANGTPREDGFDITVASEIMAVFCLATSMADLKERLSRIIVAYTYDDQPVTAGDLKATGAMAALLRDALKPNLVQTLEGTPAFVHGGPFANIAHGCNSVMATRMAMRMGDYTVTEAGFGADLGAEKFLDIKCRMAGLVPDAVVVVGTVRALKMHGGLDKKQLANEDLAALEKGIPNLLRHVHNITNVYHLPCVVAINRFPTDTDAEIDFIVRKCRELGVNTILSTVWAEGGKGGEDLAREVVRLCEEEKGSFTFSYELDASIEEKLEAVTKKIYGGAGVALTPAARKQAERLTRLGFDKLPV

SEQ ID NO: 55303 - protein, 352 aa, uncultured bacterium
IGAANNLIAAMLDNHIKQGNALDVDLNNIIWRRCVDMNDRQLRNVVDGLGTAGDGVCREDGFDITVASEVMAVFCLATDLDDLKERLGRMVVAYSRSGKPVTVADIKAEGACTALLKDAIKPNLVQTLENNPAFVHGGPFANIAHGCNSVQATMTAMKMTDYVVTEAGFGADLGAEKFIDIKCRYAGFNPSCVVIVATVRALKHHGGVAKADLNNENLEALEAGLPNLLQHVSNVKDVFGISPVVAINAFPTDTEAELKLVQDKCAELGVNAVLAEHWAKGGEGAKALAEEVVRVCDQPNDFKFCYDVEMGIEEKIEAIAKRVYHADGVDYTPKAKKQLAQLNELGFDKLPI

SEQ ID NO: 55304 - protein, 327 aa, uncultured bacterium
LDNHIQQGNALGIDVKKITWKRVVDMNDRQLRNIVDGLGGRMQGVPREDGFDITVASEIMAVLCLASDIDDLKARISRIVVGYTYDDKPVTAADLNAQGAMTALLKDALKPNLVQTLENNPAFVHGGPFANIAHGCNSIMATKMALKMADYVITEAGFGGDLGAEKFLDIKCRMAGLKPSAVVVVATVRALKHHGGVAKADLNNENLEALEKGLPNLLQHVDNMKNVYKLPVVVAINAFPTDTKAELDLVEAKCNELGVNVALSEVWAKGGEGGVALAKEVVRLCEEPNDFQFSYELDGTIEEKIEAIAKKVYRADGIQFTPAAQKE

SEQ ID NO: 55305 - protein, 383 aa, Rhodobacter sphaeroides 2.4.1
MRVSRRGAVDPFIVMDVMEQARRLEATGRAIVHMEVGQPGTPAPAGARAALARAMEEGPLGYTVALGLPELRQGIADLYRRWYGVELDPGRVVVTAGSSSAFLLAFTALFEAGERVALGEPGYPSYRQILRALSLEPVGIPTEARNRLQPVPADLEGVEDLAGLIVASPGNPSGTMLSKEALDALIAHAQARDMAFISDEIYHGLDYGTRSVSALEITDDVYVINSFSKYFSMTGWRLGWLVVPEDHVRRVERLAQNMFICPPHASQIAALAALDCTQELEANRAVYAENRRLMLEGLPKAGFTRFAPPDGAFYVYADVSDLTSDSLAFAAEILEEAGVAVTPGLDFDPLRGGRTLRFSYARATEDIVEGLARLEAFMAARRR

SEQ ID NO: 55306 - protein, 553 aa, Gibberella zeae PH-1
MGVQTVEFKPFQDQKPGTSGLRKKVVVFQQPHYSEAFITSILLSIPEGVEGSNLVIGGDGRYFNPEAIQLIAKIGAAYGVKKLIIGQNGILSTPAASHVIRIRKATGGILLTASHNPGGPKNDFGIKYNLANGGPAPESVTNKIYEFSKTLTSYKIADIPDVDITTVGTQTYGALEVEVIDSTADYVAMLKDIFDFDLIKKFFSSHPDFKVLFDGLHGVTGPYGKAIFEQELGLSNSTQNCIPSPDFNGGHPDPNLTYAHSLVEVVDKHNIPFGAASDGDGDRNMIYGANAFVSPGDSLAIIAHYAHLIPYFKKNGVNGLARSMPTSGAVDLVAKAQGLDCYEVPTGWKFFCALFDAKKLSICGEESFGTGSDHIREKDGLWAVIAWLNIIAGVGIQNPEVTPSIKEIQKEFWTKYGRTFFTRYDYEDVDSEGANKVIGELEKLVADSNFVGSTIEGRKVTKAGNFSYTDLDGSVASKQGLYAGFSSGSRIVVRLSGTGSSGATIRLYIEQHTSDPSKYELDAQDFLKEEVKFATELLKFKEHVGRDEPDVKT

SEQ ID NO: 55307 - protein, 327 aa, Burkholderia vietnamiensis G4
MIAKINDDRALALARDVLDIEADAVRALRDQLDGDFVQAVALLLGCRGRVVVSGIGKSGHIARKIAATLASTGTPAFFVHPAEASHGDLGMVTADDVFIGISYSGESEELVAILPLVKRIGAKLIAITGRAESSLGKLADVHLNAAVSKEACPLNLAPTASTTAALALGDALAVAVLDARGFGSEDFARSHPGGALGRRLLTHVRDVMRSGADVPRVGLDATLSDALFQITEKRLGMTAVVDPDGRVAGIFTDGDLRRVLARDGDFRTLPIVDVMTRAPRTIGPDQLAVEAVELMERHRINQMLVVDTNGMLIGALNMHDLFSKKVI

SEQ ID NO: 55308 - protein, 188 aa, Burkholderia vietnamiensis G4
MPHSSSGAPLDPVAFIHSQIRTVPDWPQPGVMFRDITTLLQSPKALRILVDLFVERYVDAKLDYVAGLDARGFIIAPIVAYELSVGFVPIRKVGKLPYKTCSESYDLEYGSATVEIHEDACRPGDRVIIMDDLIATGGTMMAGRNLLQRLGAVVVEGAAIIDLPDLGGSTLLRNAGLPIYTVTEFAGH

SEQ ID NO: 55309 - protein, 305 aa, Synechococcus sp. RS9916
MHQFLPFAWFEGRCVPFEEAKVSVATHALHYGTGAFGGMRAIPDPNKPGGMLLFRAERHARRLSQSAKLLLADLSEATVMEALTAMLKANQPKTPIYLRPFVYTSDLGIAPRLHNIETDFLIYGLELGDYLSPEGVSCRISSWTRQEDRSLPLRGKISGAYITSSLAKTEAVSSGFDEALLMNSRGKVSEASGMNLFLVRNGQLITPGVDQDILEGITRASVIELAKAMGIEVIERPVDKTELFIADEVFLTGTAAKISPIRQLESTVLSDKRPMMEALRTKLVAITEGRDPDYAHWVTRIELND

SEQ ID NO: 55310 - protein, 396 aa, Aspergillus oryzae
MATSSFTDHQPWYQRIQWFNLSMLVLIPLWAFIQSLWVPLTLKTLVLSVVYYLFSLGSITAGYHRLWAHRSYTASTPLKWLLAAFGAGSLQGSIRFWVREHRLHHRYTDTDLDPYSVNKGLLHAHILWVLLRQPRNERKQRARINLSDIDHDPVVVWQHKYYFLAAFGMGWLLPCLVAGLGWNDWTGGFLYAGVLRAFFVNQATFCVNSLAHYLGHQPYDDRHTPRDHLLTALITLGEGFHNFHHEFPSDYRNGIEWHQVDVTKCFVGLAGDLKRFRHNEIAKARLQQRFKRLNEEKRRLDWGTPLEELPVIDWTEYQRRVGMGQVLVVVEGVVHDLGAFLAEHPGGEATVKGMLGKDATALFNGGVYDHSRAARNLLATMRVAVLRGGGEVECWK

SEQ ID NO: 55311 - protein, 377 aa, Glycine max
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDALMKILTERGYSFTTSAEREIVRDMKEKLAYIALDYEQELETAKTSSAVEKSYELPDGQVITIGAERFRCPEVLFQPSMIGMESPGIHETTYNSIMKCDVDIRKDLYGNIVLSGGSTMFPGIADRMSKEITALAPSSMKIKVVAPPERKYSVWIGGSILASLSTFQQMWIAKAEYDESGPSIVHRKCF

SEQ ID NO: 55312 - protein, 969 aa, Ustilago maydis 521
MRHTHTHRATREKARRKGGTRELRCLSRRDRDECGGKGGGQSESCNSPHKLTEDVRETEPLRSESLSDIPDLLICHLAPAHLPCPHTITHTVQVAYTTTRSFLHDGDGHDDNGTKDKLIIARLQTTLAADRQTMPLLRAIVEDLPLWPAGEMLLAKQPQRESPEGSGSGRSLPIPLLVVSTLSAIFASIFSVYLIWKQLKNYRKPTLQRYVVRLLLMVPIYSIASVISLYSLQLADIIDLFRDLYEAFVIYCFFNLLIEYLGGERSLIVLLHGRRPQEHLFPANLFLHDMDASDPYTFLALKRGVLQYVQVKPVLALATLILKAAGKYEEGKISASNGYTWVSFTYNVSVFLSLYCLGMFWKCLNDDLKPFRVTSKFLCIKGIIFFSFWQGLGISILVAAGLIKKVGPIYDPDYISMAIQDFMICLEMPIFSLGHAWAFSHTDYIDPFAHYAARLPVYYALRDCIGMYDVFSDSLTTVRGTGYVYQTFEPSEGVIHQPLARERRSKAGLRYTQGGKGKYWLPQRGTGDIRDATRGARHQGPLKKLRRYINDKRMQLEGYAPLTPQEADDIIHDDPDVAQEQATSERSPLLRNPKDAARSAVRHAGEGLDFFAERRLDSDEEAEDLRFDDPDEEEEDAYHKSRTLHFGDYAYPNIDINREQARNTRWQQDDEIVHRRRRKGTISKKNESEGAKKKLGEDQVIDGDVSGSVHEPDKSNGEAGRTSKGKAKKEADRANVKTKKRTAQEGNSGNGSTDAERKSKSAWLAWDRETDNYREAWQSNASANGAETQQAEGSASQASAEHSKSSPKLDPYGAVDLVVEDYKAEERERLLERRRGDPALRAGKGTRIFRKQYTPSASGASTPPGERKRSAAIVEREGSPNTPLNPPSSTAAAVTVRSPQTEANPERSKVELQDSTEHGNASNTGDESGDVLISRELDVQNNEAFLKGRVLFPEPRRSMDEDDGQNPWT

SEQ ID NO: 55313 - protein, 570 aa, Aspergillus oryzae
MESATLSNLINKTNMNSTTPPLLSPSDTALLEAFIPGYSFISRFLISYLQIDLSLYLPYILTYIAIAAVLKYSFSKLKGVLETHCIATAEIRLDDEISNYLLYWMAQQPFANRSTRFVAATRISTQSYYYDSEDEDEWGEEDEYDEDGNVINNFDEYWARTRNRDKFKRLRFTPAEGTHYFFFRGQLLAFVRAKGDKKSSSSSRWGARFETEKLYLSCFGRDPAILKELLAEAQRVYVARDGNSTIIYRAQRSPGDYVDWSRCMARSPRPLSTVILDQAQKDAFLDDIKEYLHPRTRRWYSNRGIPYRRGYLLHGPPGTGKTSLCFAVAGLMGLPLYLLNLSSKSFNEDDLMSLFQELPRRCIVLLEDVDCAGITQKRVSDGGEDSTAKPAEGKEGDSPEDADADSSKQGISLSGLLNVIDGVAASEGRILVMTTNHPEKLDPALLRPGRVDMSIQFGYAEPGDIKELFSAIYSTLEGDVRSSRTKRPRGKKDQVTSEVPWHQFSREQIQNLADQFLALVPGGQCTAAEIQGYLLNYKRDPEAAIEGVEEWVRSIRSKREGQTEATVKAD

SEQ ID NO: 55314 - protein, 363 aa, Schizosaccharomyces pombe 972h-
MSMTAGNVVFVGNIPYDVSEQQMTEIFNQVGPVKTFKLVLDPETGSGKGYGFCEFFDSETTAMAVRKLNNSELGPRKIRVEFPSNDPRRNQSYEYTERTDRYMEQQNAHESSYNSRFIPPVLHSTSSLPASQGGGMPSPAIYSSSMATNLNKNINSTSVPAYNFHNSMTSDFDSASQPHTDAYNARTFQYNKSSQNKGDYTSGTSISNPTSIPLAPSVVQVLSTFSAQELLNMLSKLQTVVHIAPEEARRLLIANPALPYAAFQAMLLMNLVDANVLQQVVVAVKNKNMHQPASATSSPPSVPQKIPSSNHKSQQANGSDQGNEGKRMALIQQLLALTPEQINALPPAQRDQILSIRRQHFRQ

SEQ ID NO: 55315 - protein, 429 aa, Bacillus megaterium
MRSYEKSKAAFLEAQQLMPGGVNSPVRAFKSVDMDPIFMERGKGATIYDIDGNKYIDYVLSWGPLIHGHSNDQVVEAVKKVTESGTSFGAPTLIENELAKVVIERVPSIEIVRMVSSGTEATMSALRLARGYTGRNKILKFEGCYHGHGDSLLIKAGSGVATLGLPDSPGVPEGIAKNTITVPYNDLESVQYAFKEFGDDIAGVIVEPVAGNMGVVPPQPGFLQGLRDITSEYGSLLIFDEVMTGFRVAYNCAQGYYNITPDLTCLGKVIGGGLPVGAYGGKAEIMERVAPSGPIYQAGTLSGNPLAMTAGYETLTQLTPQSYDEFIRKADRLEEGLMAAAEKYDVPFTVNRAGSMIGFFFTNEQVINYETAKTSNLDYFAAYYREMANEGVFLPPSQFEGMFLSTSHTDADIEHTIAAAEKAFSKLRG

SEQ ID NO: 55316 - protein, 219 aa, delta proteobacterium MLMS-1
MLKDGEKGAVLQRDKESYAIVPHLPLGLITPEQLRKVAEVAEKYQCAAIKITSAARIAIVGLKEDDIDAAWRDLGMSPGAAVGMCVRSIKTCPGNTLCRLGQQDAMGLARELDSRYHGLELPGKAKLGVSGCPNQCGESSVKDIGYIGKAKGWSIVVGGNAASRPQLAQPLLDGLDDEQALAVTSNIFEFFKTEAKKGERLGRLIDRVGMEAFKEKVCS

SEQ ID NO: 55317 - protein, 378 aa, Streptococcus pyogenes M1 GAS
MNNTEYYDRLGVSKDASQDDIKKAYRKMSKKYHPDINKEAGAEQKYKDVQEAYETLSDSQKRAAYDQYGAAGAQGGFGGGAGGFGGFDGGGFGGFEDIFSSFFGGGGSRNPNAPRQGDDLQYRVNLSFEEAVFGVEKEVSYNREATCGTCLGSGAKPGTAPVTCRKCHGSGVMTIDTQTPLGMMRRQVTCDICHGSGKEIKEPCQTCHGTGHEKQAHKVSVKIPAGVETGQQIRLQGQGEAGFNGGPYGDLFVILNVLPSKQFERNGSTIYYNLDISFTQAALGDTVEIPTVHGDVEMAIPAGTQTGKTFRLKGKGAPKLRGGGQGDQHVTVNIVTPTKLNDAQREALQAFAEASGEKMLHPKKKGFFDKVKDALEDI

SEQ ID NO: 55318 - protein, 130 aa, Prochlorococcus marinus str. MIT 9515
MSSSKVIKTSNAPDPVGPYNQAIKAGNFIYCSGQIAIDPVSNEINCLGNIEKETTQVLKNLLAVLNSGGATAEDVIKTTIYLTDLKNFKTVNEIYSDFFKVKNPPARACVEVSSLPKGVLIEIDCVAYLD

SEQ ID NO: 55319 - protein, 259 aa, delta proteobacterium MLMS-1
MTQPTPPTYRLCVSLAQPGLEELLSAAAQAAPLADVLEIRLDALAAESATMAVKRLTTELAGPLLFTNRPRWEGGAGDVPEERRLEPLLAALEAGAAYVDIELRAGARAHRQLLAAADRCRTAASDAADPGRETTAIPARSGQLIVSWHDFDTTPESTELAEIVRRQQDSGAAIGKLVTMAHTPGQVRRVLNLLEVAEDLNFPLIAFSMGTAGLISRLATCHLGGYMTYAAAGDGQATAPGQLPAVRLRQIEQLLTASK

SEQ ID NO: 55320 - protein, 401 aa, Triticum aestivum
  misc_feature (169)..(169): Xaa can be any naturally occurring amino acid
  unsure (1)..(401): unsure at all Xaa locations
MMNGSTGSLGDHVNGKQVQSVDPPGLSSFNNGPRHRPLNALRRCRGVLCLVIMPVTACMMMVYLAPVTTFVVRLFSVHYSRKWTCFLFGMWLAMFPFLFEKINRTRFVFSGEKVPPKECVLLFANHRTEVDWMYLWDLALRKGRLQSIKYILKKSLMKLPIFNWAFHIXIEFIPVERNWEVDEPLIRRRLSQLKYPKDPLWLAVFPEGTDYTEKKCIKSQEYAAEHGLPILKNVLLPKIKGFNCCLQELRSNLDAVYDITIAYKHRLPTFMDNVYGVDPSEVHVHTKIIQVSDIPTAEDEVSSWLTERFRLKDELLSDFLAQGHFPNEGTEEDLSTLKCVANFVAVIGMTAFFIYLTLFSSVWFRVFAACSASFLTYATLYSVHAPQIVCLPEAGAHAKKA

SEQ ID NO: 55321 - protein, 613 aa, Triticum aestivum
  misc_feature (328)..(328): Xaa can be any naturally occurring amino acid
  misc_feature (390)..(390): Xaa can be any naturally occurring amino acid
  unsure (1)..(613): unsure at all Xaa locations
PGLHPSPLPFLAVTNGTGAVRSFSTTFVFAIFGPYTDLSSHGMAFFISASREVLSTALPGRYLGLLNSSNDGSRTARVFAVELDTILNPEFNDISGNHVGIDVDSLVSLDSTDAGYYDDGTGRFLNLSLISRTAMQVWVDYDSGATKITVTMAPLGVARPKKPLLQITVDLSGVVQSTAYVGFSSATGIMNARHFVLGWSFAMDGLAPALDISMLPALPQVWPNQRFMSVSVKMGLALASVTLVSVGIGIYIFVRWRRLKYSEVHEDWEIPFGPNRFSYKDLFHATGGFSDKNLLGRGGFGSVYKGVLRKPDMKVAVKRLSHNSRQGXREFIAEVVSIGRLRHRNIARLLGYCRRKGELLLVYEYMENGSLDKYLHNRNSSVLDWSHRYXIIRGVASSLLYLHEKWEQVVIHRDIKASNVLLDGKRNGRLGDFGPARIYDHETVAGATHVAGTIGYLAPELGRTGKPTAFTDVYAFGMFLLEVTCGRRPIFTSEQKNQVLLVDWVLEHHQNGSILDTVDPRLQGEFNREEVTIVLKLGLLCTYPLPDVRPIMRKVMHYLDHGQSPPDLSPAYITYMNLVKNEGLNSYNMNRPGLGPKMSVATISSATILQDGR

SEQ ID NO: 55322 - protein, 353 aa, uncultured bacterium
SAHNTISAMLDNYIYQHRKDGFSLREIYWKRVLDVNDRALRNIVTGLRGDGVVSETGFDITSASELMAILCLATSEEDLQYRIENILLGITSDGKPFRVRDLGVAGAITVLLRDALSPNLVQTTENTPAFIHGGPFANIAHGCSSVLATKMAMPYGDYVVTEAGFGADLGAEKFFDIKCRKAGLQPRLVVIVAITQGLKMHGGVDLSLITEPNFKGLREGLKNLNRHINNMQGFGQPVVVTLNRYDTDTDEEIDIVRKNCEDLGVGFAVNEAFLKGGEGAVELAQTVVDTIDRIQPLPIHFTYPENDTIEGKIEKVCKRIYGAAAVEFTKTGKKRLDAVKDIFGDDKAIAHLP

SEQ ID NO: 55323 - protein, 686 aa, Xylella fastidiosa Temecula1
MTKPTRRQLANAIRFLAADAVQAAHSGHPGMPMGMADIAEVLWNDFLRHNPNNPNWFNRDRFILSNGHGSMLQYALLHLSGYDLPLDELKQFRQLHSKTAGHPERSETPGIETTTGPLGQGFANAVGFALAEKLLAQRYNRPEHLIVDHRTWVFMGDGCLMEGISHEAAALAGTWNLGKLICFWDDNNISIDGNTAGWFTEDTPARFEAYGWHVIRDIDGHDAEKIATAIQAAVAQENKPSLLCCRTVIGFGSPNKAGKESSHGAPLGAEELEATRKMLDWPYGPFEIPSEIYDGWRANGTGMLRQAEWEQAFDNYARQYPKEAAELTRRSHAELPTDFLSQLDAYIAKVHAVGPCIASRKASQMAIEAFAPLLPELIGGSADLAHSNLTLWKGSQTVVGDAPNANYAYYGVREFGMSAIANGLALHGGFIPFDATFLVFSDYARNAVRMSALIPAHVIHVYTHDSIGLGEDGPTHQPVEHLAALRYIPNNDVWRPCDAVESAVAWKAAITRNNGPSCLVFSRQNLPHQPRHDAQLEQIARGGYILADAASSIPDIILIATGSEVSLAIEAKKTLDAMQLKTRVVSMPSTNVFERQDPTYRESVLPSKVHKRVAIEAGVTGFWWQYVGLHGAVIGLDTFGASAPADVLYKHFNITAEHVVEVAKALCGRAETTLSLPYYHQMPLSG

SEQ ID NO: 55324 - protein, 343 aa, uncultured bacterium
RTANNLLAAMLDNHIQQGNALGIDVKKITWKRVVDMNDRQLRNIVDGLGGRMQGVPREDGFDITVASEIMAVLCLASDIDDLKARISRIVVGYTYDDKPVTAADLNAQGAMTALLKDALKPNLVQTLENNPAFVHGGPFANIAHGCNSIMATKMALKMADYVITEAGFGGDLGAEKFLDIKCRMAGLKPSAVVVVATVRALKHHGGVAKADLNNENLEALEKGLPNLLQHVDNMKNVYKLPVVVAINAFPTDTKAELDLVEAKCNELGVNVALSEVWAKGGEGGVALAKEVVRLCEEPNDFQFSYELDGTIEEKIEAIAKKVYRADGIQFTPAAQKEVERLTV

SEQ ID NO: 55325 - protein, 150 aa, Thermoplasma acidophilum DSM 1728
MDIIAEEKTKDGRKVIRVAKENLLDLMKELKSQGYNLSLTTAVDYVDHIEVVYHLYNMQKNEYIIVKTETRDNHVPSLTSLWNAANWDEREEYDLVGVIFDGHPNLKRLFLPEGWVGHPLRKNYDLSKAQYVNMDEEGNDYVTFDPEGGW

SEQ ID NO: 55326 - protein, 233 aa, Staphylococcus aureus subsp. aureus COL
MLAARACVFSGSGLITVATHPTNHSALHSRCPEAMVIDINDTKMLTKMIEMTDSILIGPGLGVDFKGNNAITFLLQNIQPHQNLIVDGDAITIFSKLKPQLPTCRVIFTPHLKEWERLSGIPIEEQTYERNREAVDRLGATVVLKKHGTEIFFKDEDFKLTIGSPAMATGGMGDTLAGMITSFVGQFDNLKEAVMSATYTHSFIGENLAKDMYVVPPSRLINEIPYAMKQLES

SEQ ID NO: 55327 - protein, 412 aa, marine gamma proteobacterium HTCC2143
MLPIDAAPVFNWRILQVPFTMGLLGQRWLTRVRCINTTIHNDKKESFMPIDRRTFTLSTVSALSALALSPTVLAGEEKNKRIVLASRPVGKPTLENFRIEDVAIPKIADGQILLKTKYLSLDPYMRGRMNAGKSYASRVELGDVMVGGTVSEVVESRNSTFNRGDLVSSYSGWQSYEVSSGQGIMKLDPRIPKTSYALGVLGMPGLTGYVGLMDIGEPKAGETVVLAASTGAVGSVVGQLAKSKGCRVVGIAGAKEKCEYAVKELGYDACVSHYDSDMAQQLEAECPQGIDVYFENVGGSSWEAVMPLLNNHARIPVCGLIANYNATSLPPGPDRMSMLQSMILTKSIRMQGFIASDYFHRIPELVEEIGPLLASGQMKYKEHVVDGLDNAPEAFFGLFRGANFGKLVVKVS

SEQ ID NO: 55328 - protein, 353 aa, uncultured bacterium
IGAANNLLAAMLDNHIQQGNALGIDVKKITWKRCVDMNDRQLRFVVDGLGGRMNGTPREDGFDITVASEIMAVFCLASSMADLKERLSRIIVAYTYDDQPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLANEDLAALEKGIPNLLRHVNNIRNVYQLPCVVAINRFPTDTDAEIDFIVRKCRELGVNTILSTVWAEGGKGGEDLAREVVRLCEEEKGNFTFSYELDASIEEKLEAVTKKIYGGSGIALTPAAKKQAERLTALGFDKMPV

SEQ ID NO: 55329 - protein, 497 aa, Aspergillus oryzae
MADLFTTIETPSAKYEQPLGLFINNEFVKAKSGRTFETINPTNEKPIVAVQEADENDVEDAVKAARAAFEGEWSKVTPSERGRLLVKLADLFERDSDILAAIEALDNGKAFTMAKGDVAAAAGCLRYYGGWADKIHGQTIDTNPESLTYTRHEPIGVCGQIIPWNFPLLMWSWKIGPAIAAGNVVVLKTAEQTPLSGLYAAKLIKEAGFPAGVVNILSGFGRVAGAAISSHMDIDKIAFTGSTLVGRMILQAAAKSNLKKVTLELGGKSPNIVFDDADIDNAISWSNFGIFFNHGQCCCAGSRILVQEGIHDKFVARFKERAAANKLGNPFTADTFQGPQVSQLQFDRIMEYINHGKQEGATVATGGERHGTEGYFIQPTVFTDVHSDMKIAKEEIFGPVVTIQKFKDEEEAIKIGNSSSYGLAAAVHTKNVNTAIRVSNSLRAGTVWINCYNMINYQAPFGGFKESGLGRELGSYALENYTQVKTVHYRLGDALFA

SEQ ID NO: 55330 - protein, 431 aa, marine gamma proteobacterium HTCC2143
MTSSEQLFDQAKKFIPGGVNSPVRAFKAVGGTPVFIERAQGAYIYDCEDKRYIDYILSWGPMILGHAHPSITEAVIEKMKLGLSFGAPTEVETELASQLCGIMPNMDMVRMVSSGTEATMSAIRLARGYTGRDKIIKFEGCYHGHSDSLLINAGSGALTLGVPSSPGVPASLAEHTITLTYNDIEGVKKAFSEIGDQVAAIIVEPVVGNMNCIPPVEGFLQTLRSECEAYGSVLILDEVMTGFRLGLTGAQGYYNIEADITTLGKIIGGGMPVGAFGGKRKIMEQIAPSGPIYQAGTLSGNPVAMAAGLAQLAGVQKEGFYESLFEKTTTLCMGLERVAKDAGIPFTTNHVGSMFGGFFVDDDFDLDNKITNFQQVMSCNNERFNQFFHGMLDAGIYLAPAAYEAGFMSAAHSDNDIQYTLEAAKKVMSGL

SEQ ID NO: 55331 - protein, 358 aa, uncultured bacterium
AVTSAHNTISALLDNYLYQHRKDGFSLREIFWKRVLDVNDRALRNVVTGLRGDGVVSETGFDITPASELMAILCLATSEEDLQRRIENIVLGITADGKLFKVKDLGVAGAITVLLRDALSPNLVQTTEHTPAFVHGGPFANIAHGCSSVVATKMAMSYCDYVVTEAGFGADLGAEKFFDIRCRKTGLQPRLVVIVATTQGLKMHGGVDLEQINEPNKKGLTEGLKNLNRHIRNMQGFGQPVVVTLNRHDTDLEEEIDIVRKNCEDLDVGFAVNEAFLRGGEGATELAQTVIDTIERQQPLPIHFTYKEADCLEDKIEKVCKRIYGASAVEYSKTAKKKLEALRATFTDEDGAIAHYPV

SEQ ID NO: 55332 - protein, 387 aa, Agrobacterium tumefaciens str. C58
MPLITMSKRSAVEPFHAMDILAEANRRRQAGRPVISMAVGQPSHPAPKASLAAAQEALKHGRIGYTDALGLRELREAIAGHYRLRHQVAIDPARIAVTTGSSAAFNLAFLGLFDAGDHVAIARPGYPAYRNILKALGLNVVEVPVTAETGYTLTPASLERAETKAGCKLKGVLLASPANPTGTVTGREALKRLASYCESRDMAFISDEIYHGLTFVGEETSALEITDSAVVINSFSKYYCMTGWRIGWMVLPENLVRPVECLAQSLYISPPELSQLAATAAFSAAEELDVYRESYRTNRDFLMARLPEIGLPLASPMDGAFYAYVDTSRFSNDSMDFAKRMLAEIDVAATPGMDFDPEEGHRALRISYAGSVSDIAEAVGRIAGWLK

SEQ ID NO: 55333 - protein, 348 aa, uncultured bacterium
NLLAAMLDNHIQQGNALGIDVKKITWKRCVDMNDRQLRFVVDGLGGKANGTPREDGFDITVASEIMAVFCLASSIKDLKERLSRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLANEDLAALEKGIPNLLRHVNNIKNVYQLPCVVAINRFPTDTDAEIDFIIRKCRELGVNTVLSTVWAEGGKGGEELAREVVRLCEEEQGNFTFSYELDASIEEKLEAVTKKIYGGAGVMLTPAAKKQAERLTELGFDKIPV

SEQ ID NO: 55334 - protein, 186 aa, Physcomitrella patens
MSTSRFIKCVTVGDGAVGKTCMLISYTSNTFPTDYVPTVFDNFSANVVVDGNTVNLGLWDTAGQEDYNRLRPLSYRGADVFLLAFSLISKASYENISKKWIPELRHYAPSVPIILVGTKLDLRDDKQFFADHPGAAPITTSQGEELRKSIGAASYIECSSKTQQNVKAVFDAAIKVVLQPPKQKKK

SEQ ID NO: 55335 - protein, 182 aa, Physcomitrella patens
GAVGKTCMLISYTSNTFPTDYVPTVFDNFSANVVVDGNTVNLGLWDTAGQEDYNRLRPLSYRGADVFLLAFSLISKASYENISKKWIPELRHYAPSVPIILVGTKLDLRDDKQFFADHPGAAPITTSQGEELKRSIGAASYIECSSKTQQNVKAVFDAAIKVVLQPPKPKKKKKKQKNCVIL

SEQ ID NO: 55336 - protein, 281 aa, Anabaena variabilis ATCC 29413
MVYHNEGVFKSVDGLELYYQNWYPKGTAKAILVIVHGLGGHSDKYSNIVNHLTAKEYAVYGLDLRGHGRSPGQRGHINAWADFRGDLSAFLKLIQTQQPQYPIFLLGHSLGAVVVCDYILRCPQEVAKLQGAIALAPAIGKVGVSKFRLLVGKLLSQIWPRFSLTTGLDLSAGSRDEKVVAAYAQDTLRHNLGSARLATEYFATVAWIHAHAPDWQIPLLILHGSSDRIASPEGGAIFYKYVGCSDKLRIEYPEAYHDLQADLNYQQVLADLENWLENHLP

SEQ ID NO: 55337 - protein, 447 aa, Staphylococcus aureus subsp. aureus MSSA476
MYMSKAHQLIQEDEHYFAKSGRIKYYPLVIDHGYGATLVDIEGKTYIDLLSSASSQNVGHAPREVTEAIKAQVDKFIHYTPAYMYHEPLVRLAKKLCEITPGDFEKRVTFDLTGSDANDGIIKFARAYTGRPYIISFTNAYHGSTFGSLSMSAISLNMRKHYGPLLNGFYHIPFPDKYRGMYEQPQANSVEEYLAPLKEMFAKYVPADEVACIVIETIQGDGGLLEPVPGYFEALEKICREHGILIAVDDIQQGFGRTGTWSSVSHFNFTPDLITFGKSLAGGMPMSAIVGRKEIMNCLEAPAHLFTTGANPVSCEAALATIQMIEDQSLLQASAEKGEYVRKRMDQWVSKYNSVGDVRGKGLSIGIDIVSDKKLKTRDGSAALKICNYCFEHGVVIIAVAGNVLRFQPPLVITYEQLDTALNTIEDALTALEAGNLDQYDISGQGW

SEQ ID NO: 55338 - protein, 389 aa, Zea mays
MSTRTTAFTITYTATPSPNLPTPAAVPMETAAPARVQALAEAGVSRLPAQYIQPPEHRPTPSPSPIAAALSVPVVDLSTSTADDAVRAACADWGAFHVVGHGVPVDLLDAVRAAGLAFFRAPMEDKLRFACDPARGAASEGYGSRMLANDDSVLDWRDYFDHHTLPESRCDPARWPDFVPGYSMLLLPITREITPCTFYRDTIAKYSNSMKDLAQKLLCIISENLSLPPSYIQEAVGEVFQNITISYYSPCPQPDLALGLQSHSDMGAITLLIQDDVGGLEVLKDGMWIPVPALRDGILVILADQTEIITNGRYKSSVHRAVVNAEHARLSVATFYDPSKSRKICTAPQLVSENEPQKYRDVIYGDYVSSWYSKGPEGKRNIDALLIQH

SEQ ID NO: 55339 - protein, 733 aa, Rhodopirellula baltica SH 1
MPDRFVTCGFSELRRAHDGLEGPRQPNQASDSRSDLYMLMRQPCPDLQFAYSPPFGATLTEKGVQFSVFSRSATEMRLLLYNKVTDREPAQVIDFDRGTDRWGDVWSLHVPGLEAGQLYHFQASGPWEPENGHRFDSTARLIDPYAQALAGTYQKQTDGVVRPPKCVVVDGTFDWEGDRHVRRDVSESIIYEMHVRGFTKSKTAKVKAPGSYLGVIEKIPYLKSLGVTSVELMPVHEFPIRDPQGKKLSRPNYWGYDPMAFFAPHRGYAHDSAPGAQVNEFKQMVKALHSAGIEVILDVVFNHTCEGNEQGPTLSFKGLENQVYYILSEGQHYCNYSGCGNTINGNHPVVREMIFHCLRHWVHNYHIDGFRFDLASILSRDRSGNLIPNPPMVELIAEDPMLADTKIIAEAWDAAGAYQVGSFGNHRWAEWNGRYRDDVRGFWRGDAGTLGPLATRLAGSSDLYQHAGRPPSCSVNLVTTHDGFTMNDLVSYKDKHNEANGEDNNDGDNHNISDNYGVEGPTRKKAISTIRSQQVRNMLATLLTSQGVPMIVSGDEARRTQKGNNNAYCQDTDISWFDWRLVEKNADLVRFVSALIDFRKNQPTIRRREYLTGQPVDGRKVPDVSWYGPSGDPLNWDQGELAMAAYIAAPSRIDDPEGLGRDVILMFNSTGDHREFHFPAIARGTQWNLFVDTAAAPPEDIYPDVDGPMPPNNRIVEVGRHSMRIYVCNAPPK

SEQ ID NO: 55340 - protein, 273 aa, delta proteobacterium MLMS-1
MMKIDGQTEVYGIIGNPVRHSLSPLIHNAAFAACGLNKAYLPFPALDAAAAVAALRALEIAGVSVTIPHKQAVMAALDDIDPVAAAIGAVNTIVRQDGRLHGYNTDWLGANRALEAELALAGASILVLGAGGSARAIGFGLKEAGARLTLASRTPESGRQLAAQLGCPWLPLAEAGDRQADALVNATSVGMSPAADQSPLPAAALGNFPVVMDIVYSPLATKLLQEARAAGCRTIDGLQMLLHQGAAQFELWTGQQAPLEVMRESMLSGLNAT

SEQ ID NO: 55341 - protein, 412 aa, Paracoccus denitrificans
MDGDIRKNSLDDGSMDALTGEQSIRNFNINFGPQHPAAHGLLRMVLELDGEIVERADPHIGLLHRGTEKLMESRTYLQNLPYLDRLDYVAPMNQEHAWCLAIERLTGTVIPRRASLIRVLYSEIGRILNHLMGVTTGAMDVGALTPPLWGFEAREELMIFYERACGARLHAAYFRPGGVHQDLPPDLLDDIEEWCERFPKLVDDLDTLLTENRIFKQRLVDIGIVTEADALDWGYTGVMVRGSGLAWDLRRSQPYECYDEFDFQIPVGRNGDCYDRYLCRMAEMRESCKIMQQAVQKLRAEPAGDVLARGKLTPPRRAEMKRDMESLIHHFKLYTEGFKVPAGEVYAAVEGPKGEFGVYLVADGTNKPWRAKLRAPGFAHLQSIDWMSRGHMLADVPAIIATLDIVFGEVDR

SEQ ID NO: 55342 - protein, 505 aa, Synechococcus sp. WH 7805
MGRRYGGQLLDPMHRRLPMASAPLPLTAAPIRFGTDGWRGILGVDITVERLLQVAAAAARELAYQAPEDHKSRTVVIGYDRRFLAPELAEAIAAAVRGAGLDPLLTSTAVPTPACSWAVVQRQALGALVITASHNPPEWLGLKIKGPFGGSVEGDFTAAVEQRLAAGGITVPIPGDLPRFDARNEHLQGLRNKLDLSAITQGLNSMGLKVIVDPMHGSAAGCVQELLGAEANGIVSEIRSLRDPLFGGCPPEPLAPHLKQLIAAVQASTQSGHPAVGLVFDGDGDRIAAVDETGCFCSTQQLMPLLIDHLAGSRQLPGAVVKTVSGSDLMRLVAEDLGRTVLELPVGFKYIAAEMLSGEVLIGGEESGGVGFGMHLPERDALFAAMLVLEALVAGGQPLGKRLAALRDRCGGASHYDRLDLRLPDMDSRRRLEALLGDQPPQTVAGVAVQEVITTDGVKLRLGPSHWLMLRFSGTEPLLRLYCEAPDAGRVAEVLAWARSFAEAA

SEQ ID NO: 55343 - protein, 207 aa, Paracoccus denitrificans
MSEALSDEALLELAEHIAVRRENDVISTQAVGELTVNATLSGVIGLIEFLRNDPNCRFSTLIDITAVDNPARPARFDVVYHLLSMYQNQRIRVKVQVREDELVPSLIGVFPGANWYEREVFDLFGILFSGHSDLRRILTDYGFRGHPLRKDFPTTGYVEVRWSDIEKRVVYEPVNLVQEYRQFDFLSPWEGAKYVLPGDEKAPEAKK

SEQ ID NO: 55344 - protein, 253 aa, Silicibacter pomeroyi DSS-3
MDLFDLKGRRALVTGSSMGIGYALARGLAQAGASVVLNARDGARLAGAAEQLRGQGIEVETLVFDVTDADAVRKAVDGFEAEIGQIDILVNNAGMQHRTPLEEFPVEAFDRLMRTNVNSAFYVGQAVARHMIGRGAGKIVNIASVQSALARPGIAPYTASKGAVSNLTKGMATDWARHGLNCNAIAPGYFDTPLNAALVADPEFSAWLEKRTPAGRWGEVEELVGACIFLCSDAASFVNGHVLFVDGGITASL

SEQ ID NO: 55345 - protein, 537 aa, delta proteobacterium MLMS-1
MADLQKYFNDFNKLPAFSRLTELALQPVELRAAVDPARIADYRCRGGGVELIYFGQRVNGQVLEALGELAAQAGVLEQYDLMRQGAVLNQIAGYASENRQVLHCSNRDIFAESPRQPEATARTANELAKLREFLEDLEAGRLANPAGEPFETMLQVGIGGSDLGPRALYLALRAYAKPGRQVRFISNVDPDDAAAVLQELDLSRTLVKVVSKSGTTLETLANEELVRRAYQDAGLDPKDFFIAVTGQGSPMDNPEHYLRSFYMFDYIGGRYSATSMVGLVMLGFALGYEQVLEILRGAYEMDEAATQPDPTRNPPLLLALLGIWNRNFLGSQDVAILPYSQALSRFAAHLQQLDMESNGKGVSRAGEPLGWDSGPVVWGEPGTNGQHAFYQLLHQGTAVVPIEFIGFKESQYRRDLTVKGTTAQEKLLANLLAQSLALAVGQEEENPNRRFPGNRPSSILLADRLTPATMGALLALYEAKVVFQGFLWNINSFDQEGVQLGKRLADGLLAQYEARRRGTTPPQDPLGRALLALASSE

SEQ ID NO: 55346 - protein, 163 aa, Paracoccus denitrificans
MAFDFARATKYFLMWDFIKGFGLGMRYFVSPKPTLNYPHEKGPLSPRFRGEHALRRYPNGEERCIACKLCEAVCPAQAITIDAERREDGSRRTTRYDIDMTKCIYCGFCQEACPVDAIVEGPNFEYATETREELFYDKQKLLANGERWEAEIARNLQLDAPYR

SEQ ID NO: 55347 - protein, 529 aa, Pseudomonas aeruginosa PAO1
MKTRNDVANKGRLSLPGKPTKTSGNEQPGEPHMIDGLLRSLGLDPNAFRDGELAVHTPIDGSRLAAVRLEGRAAVAAKVERAEQAFRAWRQVPAPRRGELVRLFGEELRRHKAELGELVSWEAGKITQEGLGEVQEMIDICDFAVGLSRQLYGLTIASERPGHHMRETWHPLGVVGVISAFNFPVAVWSWNTALALVCGNSVVWKPSEKTPLTALACQALFERAARAFGGDAPAHLSQLLIGDREAGEALVDARRVALVSATGSTRMGREVAPRVAARFARCILELGGNNAMILAPSADLDLAVRGILFGAVGTAGQRCTTLRRLIAHESVKDEIVERLKAAYSRVRIGHPLEGNLVGPLIDERSYLAMQDALARAREQGGRVFGGERQLQERYPDAYYVSPAIVEMPGQTEVVRTETFAPILYVVGYRDFDEALRLNNEVPQGLSSCIFTTDLREAELFQGAAGSDCGIANVNIGTSGAEIGGAFGGEKETGGGRESGSDAWKAYMRRQTNTVNYSRELPLAQGITFD

SEQ ID NO: 55348 - protein, 293 aa, Streptomyces avermitilis MA-4680
MPPMPDNPTDQHPRPDFPQQDQEHPGWTGPMDPPPDHGEDSYEGSGLLQDRATLLTGGDSGIGRAVALAFAREGADVMFTHLPEEEKEAAETVRLVEDAGRKAVAVACDIRTEEACRRLVERAVAEFGRIDVLVNNAAYQMSQPDGIGAISTEQFDRVVRTNLYGMFWLCKLALPHIPAGGSVINTTSVQAYKPSPHLLDYAMTKGAIVTFTQGLAQMVAGDGIRVNAVAPGPVWTPLIPATMPDTTEFGKQAPLGRPAQPAEMAPAYVFLASPRASFITAEILNATGGTPLP

SEQ ID NO: 55349 - protein, 454 aa, Prochlorococcus marinus str. MIT 9515
MEFEFDLIVVGAGSGGLAAAKRAASYGAKVAIIEVNKIGGTCVLRGCVPKKLMVYAANNRRNMVSAEGYGLINKEITFNSSVLLKNVREEVSRLSHIHSNSLKKLNVTVFEGLGRFKNQNTVEVVCPKTRNILRKVSANKVLISVGGKPKKLEIPGVDLAWSSDDIFELQDFPKTLLIVGGGYIACEFASIFKNLGTEVIQIIRGQNLLSGFDKDLSECLKKSMTSLGIDLKFNNQLKSIKKIKGKLQSTLVSGSKFLTNNILIATGREPALKELHLDTLNLKMDGIYLDVNEVNQTSNSNIFAIGDIIKRPNLTPVAIEQGRVFADNYFADRRRKVNYQNIPKAVFTIPEISTVGLSEEEATEIYSELNIKIFKCSFTPMSNTFKKNKSKCMLKLVVNKKNDKILGCHMFGEAASEIIQMVSVSLNAGITKKDFDNTMALHPTISEEFVTMYG

SEQ ID NO: 55350 - protein, 474 aa, delta proteobacterium MLMS-1
MTNDNELIIIGAGLSGLAVAHFLGREGANRQITLLEAGLRPGGAIRSFTEAGFRAEWGPHGFLDNNPASRELLAATGLDKEAVKAPLKQNVRYLCLQGRLVALPQSLRALLTTPLLSWRGKLRLAGELFKKPLADGQSIGHWAAHRFGPEVLPLVDAAVTGTYAGDYQRLSIEAVMPGARRLEKEHGSLLRGLLKEGWQKKVQKRRQAKKAASTGAGGDSQGGGLPAMTSFRDGMEHLATRLARDLNIIYDCPVEQIRPTATGWQLTCGERLFNTRQLVLALPVNQALQLLTDWQPPVSAIPEARIITVALGFRARDAQVPAGFGYLAPEREQRFTLGALFSSHMFPDRAPAGHHLLEALVGGRRHPERLELADDELTRQIHADLKELLPISAPPVFSRVLRAAGGIPQLEEHHLDLLKWREQLQDRQPGLQLTGFGWDGIGINDMIKAAQQCAQRLNAGDTPGEQTQVRPVYF

SEQ ID NO: 55351 - protein, 1160 aa, Schizosaccharomyces pombe 972h-
MALWATSMRRAIPGISKAFLGSNRVLETAGVSQLSKHLLPQWSGVPHRKISASATNFNDKVKESNTPDANAYIRSGHIKAAEHEKVKKVVVVGSGGLSIGQAGEFDYSGAQAIKALRESSVHTILINPNIATIQSSHSLADEIYFLPVTAEYLTHLIERENPDGILLTFGGQTALNVGIQLDDMGVFARNHVKVLGTPISTLKTSEDRDLFAKALNEINIPIAESVAVSTVDEALQAAEKVSYPVIIRSAYSLGGLGSGFANNKEELQSMAAKSLSLTPQILVEKSLKGWKEVEYEVVRDAANNCITVCNMENFDPLGIHTGDSIVVAPSQTLSDEEYHMLRTAAIKIIRHLGVVGECNVQYALSPNSLEYRVIEVNARLSRSSALASKATGYPLAYTAAKIALGHTLPELPNAVTKTTTANFEPSLDYVVTKIPRWDLSKFQYVNREIGSSMKSVGEVMAVGRTFEESLQKALRQVDPSFLGFMAMPFKDLDNALSVPTDRRFFAVVEAMLNQGYSIDKIHDLTKIDKWFLSKLANMAKVYKELEEIGSLYGLNKEIMLRAKKTGFSDLQISKLVGASELDVRARRKRLDVHPWVKKIDTLAAEFPAHTNYLYTSYNASSHDIDFNEHGTMVLGSGVYRIGSSVEFDWCGVSCARTLRKLGHSTIMVNYNPETVSTDFDECERLYFEELSYERVMDIYEMETASGIVVSVGGQLPQNIALKLQETGAKVLGTDPLMIDSAEDRHKFSQILDKIGVDQPAWKELTSVAEASKFANAVGYPVLVRPSYVLSGAAMSVIRDESSLKDKLENASAVSPDHPVVITKFIEGARELDVDAVASKGKLLVHAVSEHVENAGVHSGDATIALPPYSLSEDILSRCKEIAEKVCKAFQITGPYNMQIILAQNPDKPDTPDLKVIECNLRASRSFPFVSKTLGVNFIDVATRSIIDQEVPAARDLMAVHRDYVCVKVPQFSWTRLAGADPYLGVEMSSTGEVACFGKDVKEAYWAALQSTQNFKIPLPGQGILLGGDRPELAGIAADLSKLGYKLYVANKDAAKLLQPTSAEVVEFPVKDKRALRAIFEKYNIRSVFNLASARGKNVLDQDYVMRRNAVDFNVTLINDVNCAKLFVESLKEKLPSVLSEKKEMPSEVKRWSEWIGSHDL

SEQ ID NO: 55352 - protein, 344 aa, uncultured bacterium
AANNLLAAMLDNHIQQGNSLGIDPKAITWKRAVDMNDRQLRHIVDGLGGKAQGVPREDGFDITVASEIMAVLCLAADLKDLKARLARIIVGYTYDGKPVTAHDLKAEGAMTALLKDAIKPNLVQTLEGTPAFVHGGPFANIAHGCNSVTATHTALKLADYVVTEAGFAADLGAEKFLDIKCRLSDLHPDAVVIVATVRALKYHGGVPKSELNAENLDALEKGLPNLLQHVGNIKDVFGLPCVVAINAFPTDTEAELKLVEARCRELGVNVALSEVWEKGGKGGIALAEEVVRLCDQPNDFRFAYPLDISIEEKLETICRRIYHADGVLLEAGAKKQARQLTELG

SEQ ID NO: 55353 - protein, 352 aa, uncultured bacterium
IGAANNLLAAMLDNHIYQGNELNIDTRRIVWRRCVDMNDRQLRAVVDGLGGRTQGVPREDGFDITVASEIMAAFCLATSIDDLKERFARIVVAYTRTGEPVTAGQLKAQGAMAALLKDALKPNLVQTLEGTPAFVHGGPFANIAHGCNSVMATRMALHFGDYVVTEAGFGADLGAEKFLDIKCRLTGLRPDAVIIVATIKALKYNGGVPKAEVGKENLEALEKGLPNLLKHVENITQVFGLPAVVALNRFVNDTDAEIELVEKKCAELGVNVKLCEVWAKGGEGGLELAEEVVRLCEQPNNFRFSYDADLPIKEKIETIAKKVYGADGVVYAGNASREIANLEKLGFGNLPI

SEQ ID NO: 55354 - protein, 478 aa, Mycoplasma pulmonis UAB CTIP
MQINAFLLSKKINENLFQERKKMKVVVVGANHAGTSFIRTFKQLNKTDELVVYDRNTNTSFLGCGIALWVGGEFKSPEGLFYSSPEKLAKLGAKVHLEKELINVDYKTKTLTFKDLQTNKEFTDTYDKLVFSLGTSPIVPPFKGIDYKNIIVSKLFQHAEEIFKKAESKEVKNVVVIGAGYIGVELAEAFIKHGKNTTLVDLQERVIPNYFDEEFTSKMEDSMRKHGLKVQLGEKVQEFQSKDGTNVSAVVTDKGTYEADLVILAIGFRPNAQFLNFDKTVNGALKVSPRQNVLLDGQEVKEIYAIGDSAAMIHNVTNQHQHVALATNAVKTGVIAALDMVGQGIDFPGVTGTNAISVFGCHYSSTGMTEKSAKNFGINAVSTEYFEDFDRPEFMNDKSKVGFKVTYEKRTLRLLGAQVGSWSDHIHTEVIYAFSLAIQQGLTLPQLALMDVYFLPHFNKPFNFMLTPILKALGINYE

SEQ ID NO: 55355 - protein, 352 aa, uncultured bacterium
ITSANNLLAALIDNHIQQGNELGIDTRQIIWKRAEDMNDRALRNIVVGLGAKADDVPREDHFVITVASEIMAILCLASDMDDLKARLSRIIVAYTRDGEPVTAKDLNAVGSMAALLKDAIKPNLVQTLEHTPVIVHGGPFANIAHGCNSVRATKTALSISDYTVTEAGFGADLGAEKFLDIKCRIAGLKPDAVVLVATIRALKYNGGVAKKDLGEENLEALKKGIVNLEKHIENIQKYGVPVVVTLNAFLTDTDAEMAYVKQFCEERGCKFALSEVWAKGGEGGEALAKQVIDTIENKPSNYAPIYSDDLSLTDKITKVATEIYGADGVNFLPAATKQLAKIEEMGFGKLPV

SEQ ID NO: 55356 - protein, 433 aa, Arabidopsis thaliana
MRRRRCDLQPKRTRMCDLQPKRTSMCDLPPKLVGEKILTRIPITSLRAVRSTCKLWNALTKDRVLGKAAAQFLGFMTMDSKVCSVRFHLRRSKEEEEDTMDLSIKQVDLLNQVEISRVYHCDGLLLCVAKDNSRVVVWNPYLGQTRWIRPRTESNIGDSYALGYDINRNHKILRMVQTRNVSVYRYEIYDLRSNSWRVLEVTPNGEMDPNHPLYGVSVKGNTYFFAHEDSSSGEIDEDGDIIDLEDFLLCFDFTTETFGLRLPLPFHSTIDATVTLSCVRDQQLAVLYHNEGLHSDDRFTTVEFWVTTSIEPNSVSWSKFLTVDMRPLALTGVRFDNDMGATFFIDEDEKVAVVFDLDGYLSTESARYHTAFISGKDGFFKPVTLGVAPNVGEPCPRTGHIPTTYRPPLVCSSTYLPSLVQVNQQRKRKERHV

SEQ ID NO: 55357 - protein, 353 aa, uncultured bacterium
IGAANNLLAAMLGNHIQQGNTLGIDPKRITWKRAVDMNDRQLRNIVDGLGGRMNGVPREDGFDITVASEIMAVFCLAEDLADLKKRLGSIIVAYTYEGKPVTADDLKASGAMTVLLKDALKPNLVQTLEATPAFVHGGPFANIAHGCNSVIATRMALKCADYVVTEAGFGADLGAEKFLDIKCRMTGLVPDAVVMVATVRALKYHGGVAKADLNRPNLEALEKGLPNLLQHVENITKVYKLPCVVAINAFPTDTKEELQLVEDKCKELGVNVALSEVWAKGGEGGVVLADEVIRLCDESTKTMSYSYDLKDTIEKKLEDICKNVYHADGVQLLPAAVKQLKELTDLGFGDMPI

SEQ ID NO: 55358 - protein, 352 aa, uncultured bacterium
IGAANNLLAAMLDNHIQQGNELGINPKNITWKRAVDMNDRQLRQIVDGLGGEKQGVPREDGFEITVASEIMAIFCLATSISDLKKRLGDIICAYTYDGKPVTARDLKADGAMTALLKDALKPNLVQTLEHTPAFVHGGPFANIAHGCNSVLATKTALKLADYLVTEAGFGADLGAEKFLDIKCRLAGLNPAAVVIVATVRALKMHGGLAKDQLGNEDLDALEKGLPNLLQHVENVTKVFKLPCVVAINAFPTDTEAELKLVEDKCKELGVNVALSEVWAKGGEGGVALAEEVVRLCEQPNEFQFCYDLDMGIMEKLETISTRIYHADGVDLVGNAIEQIKVLESLGFGKLPI

SEQ ID NO: 55359 - protein, 1866 aa, Aspergillus oryzae
MDLTSGAVIPPASSRVRGGSGKLFALELEDGTVYQGYSFGAEKSVAGELVFQTGMVGYPESVTDPSYRGQILVVTFPLVGNYGVPSRETMDELLKTLPKYFESTEIHIAALVVATYAGEDYSHFLAESSLGQWLKEQGVPAMHGVDTRALTKRIRQKGSMLGRMLLQKSDETLEEAPVDKDSWRSYFEQTEWVDPNKKNLVSEVSIREPRLFSPPEDVALKHPSGRPVRVLCLDVGLKFNQLRCLLARGVEVLVVPWDYDFPTLAGKDYDGLFVSNGPGDPATLTTTVNNLSKTLKEARTPVFGICLGHQLIARSVGAQTLKMKFGNRGHNIPCTSMVTGKCHITSQNHGYAVDSTSLPEDWEELFVNANDGSNEGIRHTSRPFFSVQFHPESTPGPRDTEYLFDVFINSIKDTLTSPEAINNPVTFPGGTMEENIKASPRVSVKKVLILGSGGLSIGQAGEFDYSGSQAIKALKEEGIYTVLINPNIATIQTSKGLADKVYFLPVNADFVRKVIKHERPDAIYVTFGGQTALQVGIQLKDEFESLGVKVLGTPIDTIITTEDRELFARSMDSINEKCAKSASASNLEEALRVVEDIKFPVIVRAAYALGGLGSGFANNMEELKDLCTKAFAASPQVLIEKSMKGWKEIEYEVVRDARDNCITVCNMENFDPLGIHTGDSIVVAPSQTLSDEDYNMLRTTAVNVIRHLGVVGECNIQYALNPFSKEYCIIEVNARLSRSSALASKATGYPLAFIAAKLGLGIPLNEIKNSVTKVTCACFEPSLDYCVVKIPRWDLKKFTRVSTQLGSSMKSVGEVMSIGRTFEEAIQKAIRSVDFHNLGFNETSALMSIKGELQTPSDQRLFAIANAMAAGYSVDDIWKLTQIDKWFLSRLKGLSDFSKLMSTHNATTVPRPLIRQAKQLGFSDRQLAKFLSSNELAIRRMRVEAGIIPIVKQIDTVAAEFPSVTNYLYLTYNASEHDVAFDDKGIMVLGSGVYRIGSSVEFDWCSVRTIRTLREQGYKTVMVNYNPETVSTDYDEADRLYFENINLETVLDIYQLESSSGVIMSMGGQTPNNIALPLHRLNVRILGTSPEMIDGAENRYKFSRMLDRIGVDQPAWKELTSIEEATGFCDKVGYPVLVRPSYVLSGAAMNTVYSEHDLASYLNQAAEVSREHPVVITKYIENAKEIEMDAVALNGTMVGHFISEHVENAGVHSGDATLILPPQDLDPETVRRIEEATRKIGNALNVTGPYNIQFIAKDNDIKVIECNVRASRSFPFVSKVMGVDLIEMATKAMLGVPFQEYPPVSVPKDYVGVKVPQFSFSRLSGADPVLGVEMASTGEVASFGRDKYEAYLKALLSTGFRLPKRNVLFSIGSYKEKLEMLPSIRKLHQIGFNLFATSGTADFLKENGVPVKYLEILPGQEDELKSEYSLTQHLSNNLIDLYINLPSSNRFRRPANYMSKGYRTRRMAVDYQTPLVTNVKNAKILIEAIARHYDLAVQTIDYQTSHRTVTLPGLINVAAFVPGLMTPGSKDFEPVGELGPPLYPTVSQTSSPLHEMLSRSTFRQKHVLSVGQFTRADLHLLFTVAQEMRLGVQRQGVLDVLKGRVLCTLFYEPSTRTSASFDAAMQRLGGRTIAISTEHSSTKKGETLQDTLRTLGCYGDAVVLRHPDPASTEVAAKFSPVPVINGGNGSVEHPTQAFLDLFTIREELGTVTGLTITFTGDLRYGRTVHSLIKLLQFYDVRVQLVAPKDLSLPEEVRQQVIASGQLVVESEELTPEIVARSDVLYSTRVQKERFADLEQYERLKNSFVIDNALLKHAKSHMVVMHPLPRNAEIAEEVDFDQRAAYFRQMRYGLYCRMALLALILAP

SEQ ID NO: 55360 - protein, 696 aa, Zea mays
  misc_feature (106)..(106): Xaa can be any naturally occurring amino acid
  unsure (1)..(696): unsure at all Xaa locations
MLRALNPSPSQLRARPACRAAPRRRPRGAWARPRAAAVPQQPPVRRPSGDRLRAPSRGAAAADQLPAPDVGAAAPGARGELEAFLEIVPARMRRGLARHQELRDLXEVIMDLGRRPIARFPSGDWAISDQPVTADDLRQAVAKVGDFSEDNRSGINHSLHRISAIRNRKAQIIGLTCRGGRAISGSAEMIRDLVVSGGSILVIGPPGVGKTTLIREIARILADEGKKRVIIVDTSNEIGGDGDVPHSGIGRARRMQVPKVTMQHNVMIEAVENHMPEVIVIDEIGTELEAMAATTIAQRGVQLVGTAHGVTIESIIKNPCLQMLVGGIESVTLGDEEAKKRKVQKTILERKGPPTFLCAGPSRPAAVCRVHLWLVAAVGAILARLPPKFEARKMHNKSTEFEMPLVIPDREYEIESLPLYQEVMVTRSLSSDGNFSDDFAASRQTKSKSMPSEDNFGDSFVYTRKAKGNKPVHGKSLVQVYTYQISEADILQVATMMGFDDELDVTDDIGAADVILASSSEMKQNPWIHNVAKYHKLPIFVVKTNTMAQIVKAIRMIVGRDNTSSSKQPEVMEGEIEIEDDAPKRKPSLEEIDALEEARLAIEYIVIPGGEPVELLPRCSEIVARQLELVESYQLLAETFGSDSNSRLQILPMKITKRGSSKDNGASKPTKQTGSDLIVSENGGGSSFSRLPFLPK

SEQ ID NO: 55361 - protein, 1085 aa, Helicobacter pylori 26695
MPKRTDISNILLIGSGPIVIGQACEFDYSGTQSCKTLKSLGYRVILINSNPATVMTDPEFSHQTYIQPITPENIATIIEKEKIDAILPTMGGQTALNAVMQMHQKGMLEGVELLGAKIEAIKKGEDRQAFKEAMLKIGMDLPKGRYAYTELEALEAINEIGFPAIIRASFTLAGGGSGVAYNIEEFQELAKNALDASPINEILIEESLLGWKEYEMEVIRDSKDNCIIVCCIENIDPMGVHTGDSITIAPSLTLTDKEYQRMRDASFAILREIGVDTGGSNVQFAIHPETLRMVVIEMNPRVSRSSALASKATGFPIAKVATMLAVGFSLDEIQNDITNTPASFEPSLDYIVVKIPRFAFEKFAGVSSTLGTSMKSIGEVMAIGGNFLEALQKALCSLENNWLGFESLSKDLEAIKKEIRRPNPKRLLYIADAFRLGVCVDEVFELCQIDRWFLSQIQKLVEVEESINSSVLTDAKKLRGLKNLGFSDARIAAKIKENENLEVSPFEVELARSNLQIVPNFEEVDTCAAEFLSLTPYLYSTYAPNPLPPIENKQEKKEKKILIIGSGPNRIGQGIEFDYCCVHASLALKDLNIKSVMFNCNPETVSTDYDTSDTLYFEPIHFECVKSIIQRERVDGIIVHFGGQTPLKLAKDLAKMQAPIIGTPFKVIDIAEDREKFSLFLKELDIKQPKNGMAKSVDEAYSIANVIGFPIIVRPSYVLGGQHMQILENIEELRHYLESVTHALEISPKNPLLIDKFLEKAVELDVDAICDKKEVYIAGILQHIEEAGIHSGDSACFIPSTLSPEILDEIERVSAKIALHLGVVGLLNIQFAVHQNSLYLIEVNPRASRTVPFLSKALGVPLAKVATRVMVLEDLKEALKFYDKKNIVGYSKGVYKPKMPHFVALKEAVFPFNKLYGSDLILGPEMKSTGEVMGIARSLGLAFFKAQTACFNPIKNKGLIFVSIKDKDKEEACVLMKRLVQLGFELCATEGTHKALEKAGVKSLKVLKISEGRPNIMDLMMNGEISMAINTSDHKSQDDAKLIRASVLKNHVSYFTTLSTIEVLLLALEESSKEDELLALQDYLK

SEQ ID NO: 55362 - protein, 315 aa, Arabidopsis thaliana
MSSRDKPKTFAEVREEICKRREEMISRDNQKKTKTVAQVREEKGKRREEMISRYNQKKAKTVAQVKEGKGKRREEMISRDNRTKPKTVAQVRDAKRKRTFDHVPRGTREPHAYLRNDPAPQVASVPKSVPEEKDVILDRILSNVPRRKKTTSYEFVPPKHPQEPQWLLQVMSRMNGAGDPKLIIEKNLDSNDVDPRQNRLSIPINTVIQNDFLTLDESRLIDEDEITNEGNMGVAAFLVDQRTKKWNMGFKQWFMTTDSGSSYWSFVLRGEWSNVVETNGLKEGDKISLWSFRSNDILCFALVPPTSSVVESLDK

SEQ ID NO: 55363 - protein, 514 aa, Synechococcus sp. RS9916
MTYSLTTPLYYVNDKPHLGSTYTTLACDALARFQRLEGNDVVFITGVDEHGQKIQRTAADRGVTPQEHCDAITKRYISLWSDWGISNDRFVRTTEERHLPLVEAFFKRCEANGDIRIGRQTGWYCVGCEEFKDEPPEAKDPYCPIHQKALEWRDEENLFFCLSNFQDKIEQLISQPDFIAPANRRKEIQNFVAGGLRDFSISRVNVSWGLPVPGHPGHTFYVWFDALLGYLTALLDDGGTVDLDRLASVGWPAQMHVIGKDILRFHAVYWPAMLMSAGLPVPARVFGHGFLTREGQKMGKSLGNVLDPELLLERCGTDAVRWYLLRDIQFGDDGDFQQQRFSDLVNNDLANTIGNLLNRTASMARKWFGDAVPQAGTAIATDHPLRQHAEAAIGQVRDAMPDMAFQRASEAVLQLAIQANGYLNERAPWSLMKQPGQEDAVGSDLYAVLECCRIVGLLLNPLVPDLSERILNQLGQHTMPEQWHDALIWGKLPSEQPLPKPNPVMQRLELESPL

SEQ ID NO: 55364 - protein, 398 aa, Photobacterium sp. SKA34
MSNAITEIQKSKCLLIFGYNAADSHPVVARHILKARANGAKIIVCDPRKIESARVADQWLGLKNGSNMALVNALAHVIIEENLYDKSYVENYTEGFTEFRKIVSGYAPEDLEGITGLKAADVRAAARTYANASEAMILWGMGVTQFGQATDVVRGLAGLALLTGNFGREGVGCGPVRGQNNVQGTCDMGMLPHQFPDYQSVEDPEIREKFEKAWGVKLSGTPGYRLTEVGHKADEGICKAFYVFGEDPAQTEADLAAMRETMRKLDLVIVQDIFMTQTAEFADIIFPATSWGEHEGVYSSADRGFQRFYKAVKPTGDVKPDWEIFSLLATKWVIQCRIIILKKFGMNFVNYVLIMLALLTKRWKVLKMFNGHVRQRIIQEHHSYSKAINLLRHQVKDS

SEQ ID NO: 55365 - protein, 395 aa, Synechococcus sp. WH 7805
MSQPPMPVKAEVVIVGGGMAGLSCAAALARRGVRDVVLLEAKTLAHARASSFGETRMFREMYSDPVLCRLAQEANRLWREEEQHAGERLRETHGLLFYGESWDEETIEGSIPGARRVMDEQNIPYEALSAKEIAERFPLKPRPDFTGLFEPTAGAVRSDKVIAHWRRTVEQAGHRLLEGTPVKEIDSDGGGVTLADGHHIAADQVVVACGIWSDLLLAPLGLSPKLEIWPMLWAHYTVDPSLADRYPQWFCFQRERGDDGGLYYGFPVLSRTADGRPRIKAGIDWAPKELRVAEPNAMCSEPPARLVELLDSFLFNELDGVQERVETVMSPYSMASDVNFVLDRLSPKLSLFAGGSGQAFKFAPLVGDSLARLACGESPAVDLSCWGHQREAVRA

SEQ ID NO: 55366 - protein, 349 aa, Silicibacter pomeroyi DSS-3
MHTRVCRIHAARDIRVETDPLPEPGPAQVIVAMAAAGICGSDLHYYHDGGFGPIRVREPMILGHEGAGVVAALGPGVTGLAVGDRVAVNPSRPCGTCSYCVEGLTTHCLNMRFYGSAMRFPHEQGLFRDKLLTDAAQCHKLSDHVTISEGACAEPLAVCLHARHMAGEVRGKRVLVTGSGPIGVLCAAVAAEAGAAEIVVTDLQDAPLEVARRMGATRTVNIAREVEAMAAYAVDKGHFDLVFECSAAAPAIHSAIAALRPQGTYVQVGVTGDVPLPVNLIVGKELCLQGTQRFRAEEFAEAVRLISSRRIDLRAMISGSFPLEQAEEAFRMAADRSRAVKVHLTFADS

SEQ ID NO: 55367 - protein, 275 aa, Silicibacter pomeroyi DSS-3
MTRAELRLGLIGTGIALSRTPAMHMAEGRAQGIATRYDLIDPDRMETPPPLTSLLDRAETEGYAGLNITYPYKQEVLSHLHHLSPAAAAIGAANTVVFRDGQRFGHNSDAWGFAEAMRKTMPDIRLDRVLLIGAGGAGSAVAHALTSLGVGQLLITDRDMPRALALAAATGAGALAGSEITPNMADGVVNATPVGMAKLPGMPMDPALLAPAQWVVDIIYFPLETAFLRAARARGCRVTNGRAMAVYQAVRAFELFTGQVAQAGRMQAVFDAFDR

SEQ ID NO: 55368 - protein, 181 aa, Schizosaccharomyces pombe
MAPIGEKKRFELEKSIEPIYTGGPVAFDSNEKILVTALTDRIIGTRSETGERLFSIKKDEDDYVTALAITSDSKKLIAAFRSRLLTIYEIPSGRRIKSMKAHETPVITMTIDPTNTLLATGGAEGLVKVWDIAGAYVTHSFRGHGGVISALCFGKHQNTWVLASGADDSRVRLWDLNSSRS

SEQ ID NO: 55369 - protein, 275 aa, Oryza sativa
  misc_feature (101)..(101): Xaa can be any naturally occurring amino acid
  misc_feature (180)..(180): Xaa can be any naturally occurring amino acid
  unsure (1)..(275): unsure at all Xaa locations
MSTAAAAAAAQSWCFATVTPRSRATVVASLASPSPSSSSSSSSNSSNLPAPFRPRLIRNTPVFAAPVAPAAMDAAVDRLKDGFAKFKTEFYDKKPELFEPXLKAGQAPKYMVFSCADSRVCPSVTMGLEPGEAFTVRNIANMVPAYCKIKHAGVGSAIEYAVCALKVELIVVIGHSRCGXGIKALLSLKDGAPDSFHFVEDWVRTGFPAKKKVQTEHASLPFDDQCAILEKEAVNQSLENLKTYPFVKEGIANGTLKLVGGHYDFVSGNLDLWEP

SEQ ID NO: 55370 - protein, 206 aa, Zea mays
SRSKSSGSFRIGEVKRVTKETNVHVKINLDGTGVAECSTGIPFLDHMLDQLASHGLFDVYVKATGDTHIDDHHSNEDIALAIGTALLEALGDRKGINRFGHFTAPLDEAAVEVILDLSGRPHLSCGLDIPTQRVGTYDTQLVEHFFQSVVNTSGMTLHIRQLAGKNSHHIIEASFKAFARALRQATEYDLRRQGTVPSSKGVLSRS

SEQ ID NO: 55371 - protein, 492 aa, Triticum aestivum
  misc_feature (18)..(18): Xaa can be any naturally occurring amino acid
  misc_feature (25)..(25): Xaa can be any naturally occurring amino acid
  misc_feature (82)..(83): Xaa can be any naturally occurring amino acid
  misc_feature (90)..(90): Xaa can be any naturally occurring amino acid
  misc_feature (93)..(93): Xaa can be any naturally occurring amino acid
  misc_feature (96)..(96): Xaa can be any naturally occurring amino acid
  misc_feature (118)..(118): Xaa can be any naturally occurring amino acid
  misc_feature (131)..(131): Xaa can be any naturally occurring amino acid
  misc_feature (331)..(331): Xaa can be any naturally occurring amino acid
  misc_feature (337)..(337): Xaa can be any naturally occurring amino acid
  misc_feature (432)..(432): Xaa can be any naturally occurring amino acid
  misc_feature (438)..(438): Xaa can be any naturally occurring amino acid
  unsure (1)..(492): unsure at all Xaa locations
SVYFVAAIDTGVMSGASXYIQKDLXITNVQVEILMGILSIYSIIGTLAAGRTSDWIGRRFTAIFAAFFFFAGALLMGFASGXXMLMLGRXFVXGIXVGYAIVIAPVYTAEIAPASGRXGFLVSFTEVFINXGILLGYISNYAFARLPLHLGWRFMLGIGAVPSVLLAVLVSGMPESPRWLVMKGRLADARVVLEKITDTPEEAEERLADIKTAAGIPDDLDGDVVVVPRKRGGEEKQVWRELILSPTPSMRRILVAALGVFLFQQLTGSDSVVLYSPRVFESAGLTGDHQLLAATCAMGVVKTLVILVAMFLLDRVGRRPLLLCSTGGIIXSLAGLXTGLTVVDQNPDARIPWAVVLCVASVLVYVSFFSIGLGPVLGVYTTEILPLRVRALGFAVGEAGNRLVSGAMSMTFLSLSSAITLGGTFFLYAGIXVLAWVXFFTCLPETRGRTLEEMGSLFGVTDTGAEAEDAAPATQDASCWARLGASPGPRVD

SEQ ID NO: 55372 - protein, 401 aa, Mycobacterium sp. MCS
MYNDHVSTSGGIVIVGGGLAAARTAEQLRRSNYSGPVTIVSDEDHLPYDRPPLSKEVLRSETDDVTLKPAEFYQENDITVLLGAGAASVDTVGKKVTLTDGREIGYEELVIATGLVPKRIPSFPDLTGIHVLRNFDESLKLREEAGSARSAVVIGAGFIGCEVAASLRKLGVDVVLVEPQPAPLASVLGTQIGELVARLHRAEGVDVRCGVGVAEVKGQDVDGQEKVQSVVLSDGAEVDADLVVVGIGSRPSTDWLEDSGITLDNGVVCDAEGRSSAPHVWAIGDVASWLDTIGNQVRVEHWSNVADQARVLVPAMLGQDVPGVVSVPYFWSDQYDVKIQCLGEPEADDTVHIVEDDGRKFLAYYERDGVVAGVVGGGMPGKVMKTRNKIANGAPIADVLG

SEQ ID NO: 55373 - protein, 220 aa, Prochlorococcus marinus str. MIT 9515
MAYSTNFSIEDLHFDNNGLIPAIAQDWLDGSILMFAWMNKESLNKTLQTKNVHYWSRSRSEIWRKGATSGSTQILKEIRFDCDNDALLLSIEQNGSGACHTGEKSCFFNKIDNNFINKKEKRKKPLSNVCSELFNTLNERSINPSEKSYTNLLLTKGSNTILKKIGEETAEFIMACKDNDKNSISNEAADIIYHLQVALLYKGVEWRDVLNILESRRKKR

SEQ ID NO: 55374 - protein, 1469 aa, Coccidioides immitis RS
MPGSGSGDPPPQTREPTDSSDAETLFTSSDYEARRENLRNENPQGLTRPTSGVDVQRAEEEFAQLSKQLTGISERAKRLSRQQSNRLDEKTPEDIETSTEGEPFDLETTLRGSRTAEADAGIRPKRIGVIWDGLTVRGIGGVRNIVRTFPNAVVDFFNVPQTIMHILGLGRKGKEFEILKNFKGVAKPGEMVLVLGKPSAGCTTFLKVIANQRFGYTGVDGEVRYGPFDASAFAKRFRGEAVYNQEDDVHHPTLTVGQTLGFALDTKTPGKRPAGMSKAEFKEKIINLLLKMFNIEHTINTVVGNQFVRGVSGGERKRVSIAEMMVTSATVLAWDNTTRGLDASTALDYAKSLRILTNIYQTTTFVSLYQASENIYDQFNKVMVIDSGRQVYFGPTKEARAYFEDLGFKEKPRQTTPDYLTGCTDPFEREYKEGRNAENTPSTPDALVQAFEKSRFNEALEQEMDTYRAQLDQEKHVYDDFEMAHLEAKRKFTSKSSVYSIPFYLQVWALMQRQFLIKWQDKFSLAVSWITSIGVAIVLGTVWLKLPTTSAGAFTRGGVLFISLLFNALQAFSELASTMLGRPIVNKHRAYTFHRPSALWIAQIAVDLAFASVQIFVFSVIVYFMCGLVLDAGAFFTFVLIIITGYLSMTLFFRTVGCVCPDFDYALKGVSIIITLFVVTSGYLIQWQDQQVWLRWFFYINAVGLGFSGLMMNEFGRLNMTCTPESLIPAGPGYTNLSHQVCTLPGGDPGSSIIPGSNYIKLQFRYDPADLWRNWGIMVVLIVVFLCANAYLGEALTYGAGGKTVTFFAKETHELKKLNSELQEKKRNRQEKKSEESESNLKIESKSVLSWEDLCYDVPVPGGTRRLLNNVFGYVEPGKLTALMGASGAAARKNIGVITGDILVDGRTPGSSFQRGTSYAEQLDVHEPTQTVREALRFSATLRQPYEVPEEEKFAYVEEIISLLELENLADAIIGDPETGLSVEERKRVTIGVELAAKPQLLLFLDEPTSGLDSQSAFNIVRFLRKLAAAGQAILCTIHQPNSALFENFDRLLLLQRGGECVYFGDIGTDARILRDYFHRNGADCPSNANPAEWMLDAIGAGQTPRIGSRDWGDVWETSPEFEQVKQRIVEIKDERVKATEGASASADAEKEYATPLWHQIKVVCRRTNLAFWRSPNYGFTRLFSHVALALITGLCYLQLNDSRSSLQYRIFVLFQITVIPALILAQVEPKYDMSRLIFYRESAAKAYKQFPFALSMVLAEVPYSILCAVCFFLPLYYIPGLQSASSRAGYQFFMILITEFFAVTLGQTISALTPSTFIAMLLNPPVIIIFFLFCGVSIPRPQIPKFWRVWLYELDPFTRLMSGMIVTELHDRPVTCKPEELNRFVPPPGQDCFSYMKEFFANGGPGYLVKNATDICEYCAYKVGDQFYKPFGMEFSNRWRDLGIFLCFIASNLILLFVGSRYLNFNRR

SEQ ID NO: 55375 - protein, 109 aa, Triticum aestivum
  misc_feature (21)..(21): Xaa can be any naturally occurring amino acid
  misc_feature (35)..(35): Xaa can be any naturally occurring amino acid
  misc_feature (49)..(49): Xaa can be any naturally occurring amino acid
  misc_feature (82)..(82): Xaa can be any naturally occurring amino acid
  misc_feature (86)..(86): Xaa can be any naturally occurring amino acid
  misc_feature (96)..(96): Xaa can be any naturally occurring amino acid
  unsure (1)..(109): unsure at all Xaa locations
MNARGYRSTRTALFDGIEEGXSRASSLSSHEIDEXENEPTMGWVASSSXILKEVQGDINEEVGRSITRSWTEWGNDMVPPRXSLPXTMGQFKDMFXTIQEDGEPLPCSI

SEQ ID NO: 55376 - protein, 353 aa, uncultured bacterium
IGAANNLLAAMLDNHIQQGNALGIDVKKITWKRCVDMNDRQLRFVVDGLGGKANGTPREDGFDITVASEIMAVFCLASSMSDLKERLSRIIVAYTYDDQPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLANEDLAALEKGIPNLLRHVNNITNVYQLPCVVAINRFPTDTDAEIDFIVRKCRELGVNTILSTVWAEGGKGGEDLAREVVRLCEEGKGDFTFSYELDASIEEKLEALTKKIYGGAGVALTPVAKKQAEQLTRLGFDKLPV

SEQ ID NO: 55377 - protein, 1047 aa, Bacillus halodurans C-125
MPKRTDIQSVLVIGSGPIVIGQAAEFDYAGAQACLALREEGIQVILVNNNPATVMTDEACADVVYFEPLTVASVKNIIERERPDGLLATLGGQTGLNLAMKLEEAGILEAYNVELLGTPMESIKKGEDREAFRQLMHELHEPVPESEIVHSVAEAVDFANTVGYPIIVRPAYTLGGAGGGIAESEEALIRIVKGGLELSPIQQCLIEKSIAGFKEIEYEVMRDSNDTCITVCNMENIDPVGVHTGDSIVVAPSQTLTDQEYQMLRSASLKIIRTLGIVGGCNIQFALDPDSKQYYLIEVNPRVSRSSALASKATGYPIARMAAKLSLGYGLHELKNPVTEDTYASFEPSLDYVVVKFPRWPFDKLVHVNRELGTQMKATGEVMAIERNLEAGLQKAVRSLEIKTHGLSLPSLSQWEDSELWVIVKKADDRRFFAILELLRRGVTIEAIHEQTKIDRFFLTSFAKLMTLEKEIAGQSLDDITSDELSTYKKYGFSDEWLASSWGVGLADVRHTRKALGVVPSYKMVDTCAAEFEAKTPYYYSSWTGENDLLLPEKAKERVLIIGSGPIRIGQGIEFDYCSVHGAKSLRARNFEAIIINNNPETVSTDYETADRLYFEPLAVEDVLNVIEVENVDHVIVQLGGQTAIGLTKGLEEAGVSILGTTQDVIDQLEDRERFYEFMRSVEVPHIPGKTAETKEELLKAAQSIGYPILLRPSYVIGGQGMFIASNQEELAAFCEDKNHSVTFPILVDAYYPGVEFEVDVLTDGSDIFIPGMFEHVEKAGVHSGDSMAVTPPPTLEAKWKQQAINYTRQIAKGMAYKGLFNIQFVLYDEELYVIEVNPRASRTVPIFSKATSLPLITYTIDVLFGKTIAELGLSAGYRKESPYYTVKAPVFSYQKLAGLDPLLEAEMKSTGELIAISKDLPSAFRKAFAWGEEQTPALFRKKGSVFCQVDRAYDTEWQPLLRQLKEKGYSVVTEEAMSFSEWLASEDAICLVSVPAPGQKTGKQNREEALKQRVTVVSDLATFEKMIECLEVKDGEPFLLPDVVMN

SEQ ID NO: 55378 - protein, 356 aa, uncultured bacterium
IGAANNLLAAMIDNHIYQGNELNIDPRKITWRRCVDMNDRQLRFVVDGLGGRVNGTPREDGYDITVASEIMAILCLSNDISDLKNRLAKIIVGYTYGKPTEQKPVTAGELHAEGAMAALLKDALKPNLVQTLEHTPAIVHGGPFANIAHGCNSVTATKMCMNLADYTITEAGFGADLGAEKFLDIKCRMAGLKPNAVVIVCTVRALKYNGGVPKAELGSENLEALKAGLPNLLKHVDNITNVFGLPCVVAVNAFPTDTKAELDLVEAECKKLGVNVKLSEVWAKGGEGGRALAEEVVRLCEQPNNFKYSYELEGSIEDKIRTIATRIYGAKDIVLTSNAVKQAAELEALGFSNLPI

SEQ ID NO: 55379 - protein, 556 aa, Aspergillus oryzae
MRIPFLSDRHCENISPFTSMKSYLSSHLHPKQCRRSGNQTSCLPHAIELEHVDEGNRRSYVAHRVPAFYTPVYSPRFVYGCVLSASIGGILFGYDTGIISSALVVFYRDLGHDLSREEKQLLTSLTSGGAFIGALIAALTTDAIGRKMVIGLGCIWFTVGSVLASSAYSVALMSIARFIIGVGMGLETMVTPIYISELSPSSRRGRMITVYSLAVTGGQALAYAIGSIFNLVSQGWRYMFAFGAIPALIQVALFPIYPETPRHLIYRNQTADAIMVLQQIYPQAPPSDIQTLVQTIQDDVNRSVSFDQGIRRACWSWKQLHTVPSHLRSLITACGLMALQQLSGFNSLMYYSATLFNIMGFSKPIEAGLIVSGTNFIFTALSLKFVDLGRRRLLIGTVWGLPVALAMAAGAFSKINIDTNLELVATPPLWAKVLAIISFAVFVAFYAIALGNVPWLANEFLALEVRAVGTAMLTMVCWSSNILVSATFLSLVSAISASGAFGLYAGVCFVGWVFIIFTYPETAGLGLESVRQVFEHGFGVRYANQLQGLRWIDAAL

SEQ ID NO: 55380 - protein, 352 aa, uncultured bacterium
IGAANNLLAAMLDNHIQQGNTLGIDPKQITWKRAVDMNDRQLRHIVDGLGGKAQGVPREDGFDITVASEIMAVLCLAADLTDLKARLARIIVAYTYDGKPVTAHDLKAEGAMTALLKDAIKPNLVQTLEGTPAFIHGGPFANIAHGCNSVTATRTALKLADYVVTEAGFAADLGAEKFLDIKCHLTGFRPSAVVIVATVRALKYHGGVPKTELNNENLDALEKGLPNLLQHVSNIKDVFGLPCVVAVNAFPTDTKAELDMVEAKCRELGVNVALSEVWAKGGEGGRALASEVVRLCEEPNDFRFSYPLEMSIEDKLETICKRIYHADGVALTPNAKKQAQQLTELGFANLPI

SEQ ID NO: 55381 - protein, 547 aa, Aspergillus oryzae
MSSIDLDKRKDGPTVEHDEDAIPGLHYQTVDPHVNPDAISYGPSGVKGLFTSNYVFGAATLASLGGFSMGYDMGVISIINVMEPFHQAFPKAETSFGKGLMTGMLLLGAFIGCIFMSYLSDRISRKWAITAMVVAFDIGAILQTAAVNYDMLVAGRFIGGIGVGTLAMGAPLYISEISPPNMRGTLLVLESISISAGVVIAYWITFGTRHMTGEACFRLPFGLQMVSATALGLGIHFFPYSPRWLALVNRDAECLTSLTKLRNLPATDERVQIEYHSILSEVRFQKIVQERKHPGAKGLKLEILSWFDLFSKETWKRTAVGCGIAFFQQFSGINAFIYYAPTLFESLGQTSEMSLILSGVFNVLQFVAAIICFLLIEKIGRRPLAIGGAFGMTGAYVVIAVLSGVYSKDWQANMAAGWACVAMAFVFILLYGVSYSPLGWALPSEVFSTTSRSKGVALSTCVIWLSDFIIGLITPSMLANIEYRTYIFFAVMCFVAGVWAILLVPETSGKSLEEIDELFGDDSAKKEREIAAAALGSPSAERGVMTV

SEQ ID NO: 55382 - protein, 352 aa, uncultured bacterium
IGAANNLLAAMIDNHIHQGNELRIDARRITWKRAVDMNDRALRSIVVGLGGKPNGFPREDGFDITVASEIMAILCLSSGIADLKARLARIIIGYNLDGEPVTAGELKAQGAMAALLKDALKPNLVQTLEHTPAFVHGGPFANIAHGCNSVMATRMALKTGDYVVTEAGFGADLGAEKFLDIKCRMAGLHPAAVVIVATVRALKLHGGKALKDLKQEDLTALEAGLPNLLQHVENITKVYGLPAVVAINRFPDDTEAELALVEQKCRALGVNVVLSEVWAKGGEGGKALAEEIVRLCEMPNEFRFSYESGLSLKEKIEAVSTKIYRADGVDFLPAAAAELARLEELGYGGVPV

SEQ ID NO: 55383 - protein, 252 aa, Arabidopsis thaliana
MLPKAMSFGHRVPPFSPGRDLHHNNHHNYTAANKMFFSGPMVPLVPNAARVRRNKSDAVWDEPTSPKVSCIGQIKLGKSKCPTGKKNKAPSSLIPKISKTSTSSLTKEDEKGRLSKIKSIFSFSPASGRNTSRKSHPTAVSAADEHPVTVVSTAAVPSLGQMKKFASSRDALGDFDWAVEMKHEEESPADHHRGYYSDDDTRGAYLRYDDDEDEDDIIIPFSAPLGLKPKKEVNLWKRRTMDPPKPLHLQTI

SEQ ID NO: 55384 - protein, 203 aa, Synechococcus sp. WH 7805
MSMRSGEIHRVTGETDVQVRLNLDGSGQCQASTGVPFLDHMLHQISSHGLIDLVISAQGDTHIDDHHTNEDVGIAVGQALAQALGDRRGIHRFGHFLAPLDEALVQVALDCSGRPHLSYSLSIPSQKIGTYDTELVKEFFVAVVNNSGLTLHIRQLDGANSHHIVEACFKAFARALRQATEIDPRRANAVPSSKGVLEQAGLN

SEQ ID NO: 55385 - protein, 311 aa, Synechococcus sp. RS9916
MAPDQSVLFDPSALPGLDGWLLGMGWSPRDWVAQWESRGGLHLATHAWPFAVDPRWIWGVGFPLLTALEKAARSNQRLLFGLNGLPGCGKSSLAHWIEEAGAQLEIPVSVVSIDDFYWPAAEMEAAMAGNPWSVPRALPGSHDLKLMEEALDHWLESGTLHAPQFNKSLRQGRGDRAGWREHTAAVVLLEGWFLGVEANNDASLDPPLTPAERQYRSRMLQQLDRYQPVWDKLSSLWQLQAPAVEASRLWKQQQEDAMHQRTGARLSDDSLRGFVRMIETAIPQKALQTIDRADVVVELTLDRVVRELRWR

SEQ ID NO: 55386 - protein, 552 aa, Anabaena variabilis ATCC 29413
MAKPIEFTLFAPYNKGAALIASFSDWQEIPMQKGDDGYFRATIELEDGTYQYKFRVQTRSWFFEEDQWVDVTDPYATDIDESSGKDNGIIKIKDGEKIVDTYVWQHDDKPLPADHELVIYELHVGDFSGGEDDLYARGKYKHVIEKLDYLCELGINAIELLPVKEYPGDYSWGYNPRYFFATESSYGSTADLKKLVDECHQRGIRIIMDGIYNHSEASSPLTQIDHDYWYHHEPRDPDNNWGPEFNYEHYDENLETYPARKFIGDTVRYWVGEYHLDGIRYDAARQIANYDFMHWIAQEAKKTAGAKPFYNVAEHIPETTSITNLDGPMDGCWHDSFYHTIKAHICGDTFDLESLKDVIDPKRQGFLGATNVVNYLTNHDHDHIMVELGNREIFHDEAFRRAKLGTAILMTAVGVPLIWMGEEFGEYKPKQQDQSKIDWTLLGNDLNRSLFDYYRGLIGLRKNNHALYTENIDFIHENPEAKVLAYSRWNDEGSRVVVVTNFSEDFLAGYHVPNFPSGGTWHEWTGDYDVEAGDDGIITDIGPYEAKVFVWQ

SEQ ID NO: 55387 - protein, 486 aa, Oryza sativa (japonica cultivar-group)
MGRRSGGRKLPFFASNASTSSSTKRTRSARRLPSLTRPRASSSPSPASPSPPPPSASHPAPPSPPLAVSPAGAGKVGKKKAGARLWMRLDRWGVSETLHLDKGSIIRRAGLPPRDLRILGPVFSDSSSILAREKAMVINLEFIRAIVTADEILLLDPLTIDVIPFVEQLTHHLPLKNLVCGNGQPGGDDHGEKHDDSHGDQVPRLNEATGAEHELPFEFQVLELALETVCSSFDVNVSGLERRATPVLEELTKNVSTRNLDRVRTLKSDLTRLLAHVQKVRDEIEHLLDDNEDMAHLYLTRKQLQNQQVEALISSAASNSIVPGGTSLSRLNNSFRRSVSIATSMHLDNDVEDLEMLLEAYFMQLDGIRNRILSVREYIDDTEDYVNIQLDNQRNELIQLQLTLTIASFGIAVNTFIAGAFAMNIQSKLYSIDDGSFFWPFVGGTSSGCFMICIVLLWGSNHPEAAVCLLCREIADESLNFMDNTE

SEQ ID NO: 55388 - protein, 1568 aa, Ustilago maydis 521
MSAATPTSPGFPLTMGTGVMAAHFAAPSSNAGSPRSRPTTPLSAGLTPSGPTYDDLGRWDDADVASWLNAARLGHYASIFAEHDIRGSVILDVDQAALKEMGITMVKDRVRISAAIKLLNKRCADSAVARRPSVVSISPLLPLASHPLYAHEGEIEYLQHDHTADPSADGSGSNFGLNSMGMRRGQMRPPPLTLKQSTSRGMPGYASPAGSINQSQGFGLSAARGLTPGAARGSVWNTASSSSATSKPGTPDGALHRKVNSIGGVAAPLAVGASSSLSSSRHPYGHAVHSNRPSTATGASGYSTVPASQSLRSNHTSSSPTATSFGSNINAASARPSTATGAQSYTTNVPGTSSARDGYSPLTPISESNSLGNTPTTPSGIQQQQQSAGYAVGRGPFASSQRYAASSVPSQQQPSSGHTLRHVDSGEGYNLAGYQNPNPPTLEDLKRRTIKFISEEDNTTRIVNVSDCRDAYDVMARVLKKFGKPPSGNSYTPTADQGPTGDELGATETWGIFATSADGQNTKALSDNELLAICHAPQPHDPLRERGLTLRRIPNHLPGEDARKVPVRSGRNKLEAFFGERMPVAQMQPAGPGSGVNADEEDAGSVTISGKKMKRASTVSIMSGLGDGPFSSSSHNTGAGHTHGSTRAEGKLLSKKESKHMSPPPVTSKPSKIRNFFGQRPPSELINTNLADFFPSTDSKALQRTARRSIYGRASASTRSKRNSTWSFVADPDAPPLPNKGSMDGHPTPLERSSISIRERGTTPVIQIGYDSRSEDDHQSNARRTSSGTHSHLHPSLTGPPTLPPVVSRDSLDEWSRDLKAVGSPVTEENAMFQSSRHGHASGSQQHHAAMKHYPSHASGYADRPSISRRASGESARSRRSLASQVRHGLSAARERNADTASLLTVDEITQEVENRRESISLAGAGGGWVVDEDGVPIPIPGSSSPFSSSAAASTRPSSGISSSYVHNGHLEHDDSEGHSDEEANQSSDLEEATRTRKARGVPSKAASIRTVASKRASSVLQAPGDESDRHLGDPMAVARSTTSRASSVSELRRSVHDHGDPSDGESGSDFTDSDLDSDGSETDEDEQANDVYLPSAKPAPIKWHKGALIGAGSFGNVFLGMNAKTGLLMAVKQVELPSGDSHLDQRKKGMLEALEREIKLLKSLEHENIVQYLDSFADDSHLNIFLEYVPGGSIVALLRNYGAFEEPLVRNFVRQILNGLSFLHNRGIMHRDIKGANILVDNKGGIKISDFGISKKVESDLVLATNKSGAGGGGAGGAAHRPSLQGSVFWMAPEVVKQTSYTIKADIWSLGCLVVEMISGTHPWAELNQMQALFQIGMGRKPSLPDEISNECRDFLEKTFELDYNNRPSADELLNHAFMGTEMTFPPSSGADGSGGGDDDAGGSGDAGDGDASTMGMTNDAETGTTRETRETKDGKRPTRSKSTRRLEREKRHKEAAAAAAAATALDTGTPNTPTSHTAAAAAAAAAAAASASASASASPAVASTSPAPGDAETGSPTNGKSAVPPAGSTGGTPESILTVSIATARGNSTSTALSAADAAFSEEADS

SEQ ID NO: 55389 - protein, 634 aa, Erwinia carotovora subsp. atroseptica SCRI1043
MSKEKTFDVICMGRVAVDLYGQQIGARLEDMGSFSKYLGGSSGNVAYGTARQGLRSSMLARVGDEHMGRFLREELNQVGCDTSHLITDKERLTALVLLGIKDRDTFPLIFYRDNCADMAISPEDFTEDYIASSRCLAITGTHLSHPNTRAAVLTALQYARRNGVKTALDIDYRPVLWGLTSLGDGETRFVEAQAVTAQLQQVLSLFDVIVGTEEEFYIAGGSTDTLQALRTVRQHTQAELVCKRGALGCSVFSDAIPDHLDKGITIKGVRVDVLKVLGAGDAFMSGLLRGYLNGEGWEKACAYANACGALVVSRHGCAPAMPSKIELDNYLARAASVPRPDLDEELNHLHRVTTRRKQWDELCVIAFDHRSQLEDMALNCGTEISRIPALKKLILRASYDAAQQAGLEGKAGLLCDGTFGQDALNDITGKGWWIGRPIELPGSRPLIMERGNIGSQLVSWPLEHVVKCLVFFHPEDAHALRREQEMKVMEVYQACRQSGHELLLEVILPAGMPHSDALYLRAIQRFYNLGVRPDWWKLPPLSSDGWEQLTPLLAERDPYCRGVVILGLDAPLETLQQGFSAAVNFPIVKGFAVGRTLFAQPAQKWLRNEIDDAELIEQVKHNYLQLIAVWRQRG

SEQ ID NO: 55390 - protein, 351 aa, uncultured bacterium
STSSINLISAVVENSLYQGNPLRIDPNRIVWKRALDMNDRSLRAITVAENDPKGIPHASEFVITVASEMMAIYCLAASPEDFLERLKKIIVAYDVDGKALTVADFKVSHAVMRLMRDAFYPNLVQTLEHNPCFVQGGPFANIAHGCNSLIATKTALRLAPIVITEAGFGADLGAEKFLDIKCQVGGLRPDACVMVATVRALKTHGGVAFEDLAEENIEALLRGVPNLERHVENIKKFGLPVVVAINQFPTDTEKELDALFAWCASKGYRCAINSSFLNGGEGAAELAKIVKDMLENEPSNYHPIYDRKEPVYEKIERICEEIYGASGVEYSDKARAQIAEYEALGFGDAFV

SEQ ID NO: 55391 - protein, 294 aa, Prochlorococcus marinus subsp. marinus str. CCMP1375
MPAEGLKTTSNSAGARLAIRLLQDAAENGDIDPWDIDVIPVIDGFLDQLRQRIDLPKRCLSNSGGTFENDLADSSEAFLAASVLVSLKAEVLETDTFPPEAEDEDTFDLDFSEQGWLDPRLNIPRNPERHLYRRPVAPPPLRRAVSLGELIEQLESIAETIEADELLSRRRRRDKRFSEKQIIEQVTSLAHREKLPETTAALGVFLNNWEQALNWVDFDALVINWEDVASSDLDRDRVGVFWALLFLSSQGKIELKQEGFLYAPLRLRRILEPGMIAQLPLNTSDVTASSPAAA

SEQ ID NO: 55392 - protein, 389 aa, Zea mays
MEVGDARNGSAAAALTKGGADDAARKPLPPCCVKAKARVPETEANCHDTVVSGWFTEPRSRFGKTSKVQYFNNPMWPGEAHSLKVEKILFQGKSPYQEILVFESSTYGNVLVLDGIVQLTDKDECAYQEMVTHLPLCSIPAPKNVLVVGGGDGGVLREIARHDSVETIDICEIDQLVIDVSKEFFPNLSIGFKDPRVRLHVGDAVDFLRNSPEGKYDAIIVDSSDPIGPAQALVEKPFIQTIARALKPGGVLCNLAESMWLHTHLIQDMLAICRQTFKGAVHYAWTSVPTYPSGVIGFLLCAKEGRAVNFLTPANPIEKIEGAAKAGRELRFYNSEIHRAAFVLPTFVRRELEAYTTPISSAENEKPKESVSEPQKIKILSNNAILTAS

SEQ ID NO: 55393 - protein, 518 aa, Rhodobacter sphaeroides 2.4.1
MTQHDRLLIIDFGSQVTQLIARRLRELNVYCEIHPYQNVTEAFLKGFAPKAVIFSGGPSSVFAEGAPMPPAGVFDLGVPILGICYGQQVMMHCLGGKVERGHGTAEFGRAFVTPTAERLAILDGWFEEGREQVWMSHGDHVSQIAPGFQVFGTSPNAPFAITGDPARHFYAVQFHPEVHHTPKGAKLYENFVRLAGFKGDWTMGAYREEAIARIRAQVGDQKVICGLSGGVDSSVAAVLIHEAIGDQLTCVFVDHGLLRLGEAEQVVKMFRDHYNMPLIHADESDLFLGALEGVSDPEVKRKTIGRLFIDVFQKHAADVGGATFLAQGTLYPDVIESVSFSGGPSVTIKSHHNVGGLPEKMGLKLVEPLRELFKDEVRALGRELGLPESFIGRHPFPGPGLAIRCPGEITREKLEILRRADAVYIDQIRRHGLYDEIWQAFVALLPVRTVGVMGDGRTYDYACALRAVTSVDGMTADYYPFTHDFLGETATRIINEVQGINRVTYDITSKPPGTIEWE

SEQ ID NO: 55394 - protein, 352 aa, uncultured bacterium
IGAGNNLLAAMIDNHIFQGNELGLDPKTIVWRRCVDMNDRQLRFVVDGLGGAKNGCPREDGYDITVASEVMAILCLSSSIADLKARLGRIIVGYRYDGTAVTASQLKANGAMAAILKDALKPNLVQSLEGTPAFIHGGPFANIAHGCNSVLATRMALKCGDYVTTEAGFGADLGAEKFMDIKCRITGLRPNAVVVVATVRALKMHGGLKKDSLGSEDLDALEKGLPNLLRHVSVMTDVYKVPCVVAINRFPTDTEAELDLVQRRCRELGVNAVLSEVWAKGGEGAIELANEVIRLCRLKSHVELTYEDDDDLETKISKVVKRIYGGSAVSYAPGVRTKIKKLEASGFRNVPV

SEQ ID NO: 55395 - protein, 352 aa, uncultured bacterium
IGAANNLLAAMLDNHIQQGNSLGIDVKQITWKRAVDMNDRQLRRIVDGLGGRAQGVPREDGFEITVASEIMAVLCLASDLKDLKARLARIIVGYTYDGKPVTAHDLKAEGAMTALLKDAIKPNLVQTLEGTPAFVHGGPFANIAHGCNSVIATHTALKLADYVITEAGFAADLGAEKFLDIKCRVSDLHPSAVVIVATVRALKYHGGIPKAELNAENLEALEKGLPNLLQHVSNIKNVFGLPCVVAINAFPTDTEAELKLVEKKCRELGVNVALSEVWAKGGEGGIALAEEVVRLCEQPNSFTFSYPLEMSIEEKLETICKKIYHADGVTLDANARKQAEQLTALGFDKLPI

SEQ ID NO: 55396 - protein, 352 aa, uncultured bacterium
ITSANNLCAAMLDNSIKQDNELNIDPEKVVWKRCVDINDRVLRNIIVGRGRDVDGVEREDHFVITVASEIMAILCLANDYADLKDRLGKIIVAYTYDGKPVTAKDIKAVGSMAALLKDAMKPNLIQTLEHTPALVHGGPFANIAHGCNSVRATKTALKMADYVITEAGFGADLGAEKFLDIKCRKADLKPDAVVLVATVRALKYNGGMPREDLQTEDLDALSKGIVNLEKHIENIQQYDVPVVVTLNQFGTDTDAEIEFVKNFCEEHDCDFAPAKVFKEGGEGGIELAKKIIETIETKPSNYHPLYTDDMSIKEKIETVATKIYGADGVTYSDEANEAIAKIEELGFDDCPV

SEQ ID NO: 55397 - protein, 119 aa, Mesostigma viride
MNRNQILQNIEANQIKANLPNIYVGDYVKVGLLIQEGNKERVQPYEGVVIAKHNSASNSTITVRKMFQGIGVERIFLIHSPRITSIEVISNSKVRRAKLYYLRERIGKATRLKQKFSKV

SEQ ID NO: 55398 - protein, 560 aa, Chlorobium tepidum TLS
MTNAPSNAPWLSHYDEGIPSSLAPYPRVTLPDILREAARKHPEDPALLFLGNTISYGELERESNAFAAALHASEVRKGNRVAVLLPNSPQMIIAEFGIWKAGGIAVMLNPLWTEHELERAIDECEAEIAVVLAPFYEKINHLRSRTSLKTVVITDLHDYFPAAMRNASPANGAVATMLQSSDLRMPAMIESYSGSQTPAVEVSPKDPALFIFSGGTTGKPKCAIGRHEASVMNGMQVDAWFRPVLGSDRVPVMLNLPLHHVYPQVAIIGYGFVTRSPLVLIPDPRDFELLIKTIKQYKVGLLPGIPTLFNALAAHPLLKEAPGSLDSLKLIISAAAPLHNKTRRRFKELTGATIIDAYGLTEAMVSPVCQPLNGIRKNGSVGLPVPDVEMRIVDADTGIEVLPSMEIGEIVIRSPQLMTGYWKNPEETAEVLRDGWLYTGDLGYIDDDGYLYIVDRKKDVIKPSGFQVWPSEVEEVIAMHPAVLETGVAGVPDDYQSEAVKAWVVLHKGHSLDAEQLKNWCRQTLAPYKVPKHIEFCEQLPKSALGKVLRQALVEQHLTS

SEQ ID NO: 55399 - protein, 426 aa, Chlorobium tepidum TLS
MTIDLDFDRCHLWHPYTSMADPLPVWPVKRASGVMIELEDGRKLIDGMSSWWAAIHGYNHPVLNRAVTEQLGRMSHVMFGGLTHEPAIELGKILTSLLPDPLDRIFFCDSGSVAVEVAIKMALQYWLAAGKPGKKRLLTVRSGYHGDTFMAMSVCDPVTGMHSLFSGAVPEQLFVEAPACGFNEPWREEAIDKMRQALEDHANTIAAVIIEPIVQGAGGMRFYSPHYLRRLRELCTEHGVLLIFDEIATGFGRTGKLFAMEYASVTPDIVCLGKALTGGYMTLAATVTTGHVADTISGGNPGLFMHGPTFMANPLACAVAVASLKLLLSGDWQSTVWRIERQLAEELAPCTGMTGVRDVRVLGAIGVVELDRPVDMAKIQQAFVERGIWVRPFGRLVYLMPPFIIRDNELTRLTSVICEVIGAEYR

SEQ ID NO: 55400 - protein, 243 aa, Medicago truncatula
MGKSLFQESLKALEADIQYANTLALGHPRDKEGGCFQMRLSYSPVAPLFLSLVQWTDYRLAGALGLLRILIYVTYGNGKTTISIYERKASIRQFYSIIFPALLQLQKGVTDLEERKQKEVYANRYQKKTDFKDRRESKIDIEREKECGVCLEVKAKVVLPNCCHQMCFKCYREWCLRSQSCPFCRDSLKRVNSGDLWIYTDTSDIVDVGTIFKENCKILFLYIEKLPLIIPDPRHVSYDPFFR

SEQ ID NO: 55401 - protein, 478 aa, Rhizobium leguminosarum bv. viciae 3841
MSPKKTTLKPARNVPASKKTPPEPGSLRGVANWKEAARWLRHRGIEDIECITPDLAGVARGKMMPSSKFTSNTSLALPSAIYRHTISGEYPDETESFRYEPRDSDLKLMPDLSTLSVVPWETDPTAQVICDIVDSDGGEVPYTPRNVLKRIMSLYHERGWKPIVAPEIEFYLVAKNDDPDYPLHPPKGRSGRSILGGQGYSIAGINEFDELIDDVYHFSEKQGLEIDTLIHEEGPAQLEINLRHGNPIELADQVFLFKRTIREAALKHDIYATFMAKPMQGQPGSAMHIHQSVVDIETGKNIFSNADGSASKEFFHFIGGMQKFVPSAMAMLAPYVNSYRRLQPDMSCPVNNAWGYDNRTTAFRVPVSDPQARRVENRLPSSDANPYLALAASLASGLLGIIKQIEPTAPTEDSANEGSIDLPRGLLEAVALLEDEPAFEEIFGKQFIGLYAGVKRGEFETFMQVISPWEREFLLLNV

SEQ ID NO: 55402 - protein, 140 aa, Silicibacter pomeroyi DSS-3
MALERTFSIIKPDATRRNLTGKINAKFEEAGLRIVAQKRIHMTKEQAGVFYGVHAERPFYDELCEFMSSAPVVVQVLEGENAIAKNREVMGATNPADAAPGTIRAEFAESVGENSVHGSDAPETAAVEIAYFFSGIELVG

SEQ ID NO: 55403 - protein, 151 aa, uncultured Frankia sp.
SRDPRNTAKKAESYLRGTGFADTAYFGPEAEFYIFDDVRYDYNPYGSLHAVDSIEAAWNTARKEEGGNLGYKPRFKGGYFPVPPTDHFTDLRSEMSRALIRAGITVEMQHHEVGTAGQAEIDIRYDTLLRTANNLMLYKYIIRNVALSRGK

SEQ ID NO: 55404 - protein, 236 aa, Anabaena variabilis ATCC 29413
MTVTADPVTLMKQEVGKAAAALVKSGSIVGLGTGSTTAYTIQYLGDRLKSGELTDIVGIPTSFQSEVLSKQYGVPLTTLDAVDHIDIAIDGADEVDPQKNLIKGGGAAHTREKVVDYLANQFIVVVDSGKLVDRLGSVFAVPVEVIPMAITPVTNAIKQLGGKPELRMGVKKAGPVITDQGNFVLDVRFDSIDDPVNLEKILNNIPGVLENGIFVNCADIVLVGEVKDGQPLVRQL

SEQ ID NO: 55405 - protein, 151 aa, uncultured Frankia sp.
SRDPRNTAKKAEAYLRGTGFADTAYFGPEAEFYIFDDVRYDYNPYGSLHAVDSIEAAWNTARKEEGGNLGYKPRFKGGYFPVPPTDHFTDLRSEMSRALIRAGITVEMQHHEVGTAGQAEIDIRYDTLLRTANNLMLYKYIIRNVALSRGK

SEQ ID NO: 55406 - protein, 107 aa, Zea mays
  misc_feature (52)..(52): Xaa can be any naturally occurring amino acid
  unsure (1)..(107): unsure at all Xaa locations
MRRPKVACGPGGEGLGKGGAKRHRKVLRDNIQGITKPAIRRLARRGGVERIXGLIYEETRGVLKIFLENVIRDDCNYTEHARRKTVTGMDVVYPLKRQGRSVYGFGS

SEQ ID NO: 55407 - protein, 345 aa, Prochlorococcus marinus str. MIT 9515
MNFLACDLGGTKVLVGIYEKDLESDTPKLIFKKKYLSTEWDSFDSIIENFLEKECKNITWPLHACFAIAGPVRNNAAKIINLSWNISGNDLKMKFKFESVELINDFGVLIYGIPFLQKNQFATIQNGEFHVSSSKNFHAIVGAGTGLGIARGFINGNNIEVLASEGGHVEFSPRSKEEWELKIWLKNHLKVERISCERIVSGEGLSRIAEWRLSKPDAKNHPFQKTIKELEISEESRKKIPSQICKLSNEGDILMMEIERIWLEAYASLLGDIAVHELCFGGLWIAGGTATKHFKNFKSDSFLKQISNKGRLIDIVKSIPIKIILDEEFGLYSAACRAKMLLKTT

SEQ ID NO: 55408 - protein, 133 aa, Glycine max
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRG

SEQ ID NO: 55409 - protein, 3475 aa, Nodularia spumigena
MAQNIDNKKLIAATLSKMEAMQARITELETRQSAPIAVIGMGCRFPGGISSPEIYWNYCQAGGDAIVEVPANRWDISKYYAPEPTPGKMNSRYGGFLQEDITEFDARFFSISAREATSMDPQQRLLLEVTWEALENANIPPTNLAGDRVGVFVGITSVDHAMTVYKSNYEQIDSFFGTGNSLSAAAGRLSYFLNLRGPAMSIDAACASSLVAIHQAIRSLRNHECELALVAGVNLILNPAITINLSQSGMMSPDGRCKTFDAAANGYVRGEGCGVLVLQRLSAAQKKGDRILAVLRGSAVNHNGAAAGLTVPSGPAQQDLLRQALTDARVSPQQVGYIEAHGTGTSLGDPIEMNAIAAVYGKRSQPLYVGSVKTNIGHLEAAAGIAGMIKTILSLQHGEIPPHLHFQKPNPLINWQGYPIKIPSQIIPWSNHGEIRIAGVSSFGFSGTNAHVIVEQAPAAKTTEIKLQRPSHLLTISAHNETALKELAQRFHTRLESDPEIGDICHSAAIGRSPLPERLAIVADTLPELQQKLSAFANEKTIDHLTFSQRFSGEKQPKIAFLFTGQGACYAGMGEQLYQTQPTFRKYIDQCADILANHLEYSLQNILFGNQTDLLNQTAYAQPAIFALEYSLTMLWKSWGIEPNLLIGHSVGEYVAACVAGVFSLEAGLQLVVKRGQLMQTAPTGKMAVVFADQATVLSLLENYTDTVSIAAINHPQQIVISGESHSIDQIIANCKTQNIPVQFLSLSGAYHSPLMEAILDEFETAAQSIDYDEPKTLLLSGIDGQPLETAPNASYWRKQCRQTVQFLQSIITALNKGYNLFLEIGYRPILAEQGRRYHDEAIWLSSLNRGLDSWQTMLATLAQLYIHGVSFNAEKFNQDYGYRNVQLPTYPFQRKRFQFQPPSQINEEHIEREQTKMTVAKVSHTQKHQQEIGKQLKSILAVLLKEDENEIRDDETLLNLGADSIILTDFTRKIEEKFSVKVRIDQLFTDLQRIVDIANYLSNYIAQEALETSEPISVGNIILSQNSELNNYLWVISQLQPIVVAYILKALGALGQSLNQAETWTTENLLQTLPIAPKYYLLITRYLKTLEQAGIIQNQGNVWTVKNLPTPFSLPETIENLQTHCPAAKPELEMLQRCGENLAEVIKGNIDPLELIFPAGSLIHAESIYGNSPVSRLMNQRVAQEINRILENFSSGDRPYQIIEVGGGTGATSEAILNNLNLTNVTYSFTELSPVLLNKARQKFQHRDHLNFHQLNIEKSPISQGIPAHSYHIVVAANVLHSTRNITETLNHIRELLLPGGFLVLLETVENNSWLDLTFGLTPGWWRFQDKELRLDTPLLSGETWCSVLKRCGFTTTDIFSQQNNVSIYNGQELIIASAPAESAIVSQPKTVAVSIPTSGKEALMMAQLQSLKDLKDIHEKTIIKQLEILQSASVAPSPTSEVLIRQTEPAPPQKATIEIAPLPQKIKTDSPKKPSSPSLNPLALKLAENKSLTEKQQAFISNLQIIYNQKTAKSKAYSQNSRKTMVDVKPTIDFRMALKEFQYPIVSESAQGAYFRDIDGNDYIDLAMGFGVNFFGHSPDFVIAAVQQQMQHGIGLGMQSNIAAETAALVSEITGVERVAFSNTGTEAIMAAVRIARSRTKRLKIVLFSGSYHGTFDGILARVGEEPGTAQPLSLGTPSGMVEDVIVLTYGAEESLEIIAAQADNLAAVLVEPVQSRKPDLQPQEFLQKLRKLTHEKEIALIFDEIITGFRMALGGAQEWFDVEADIVVYGKAIGGGLPISMICGKADFLDTIDGGFWSYGDNSHPHTELTGYGGTFCRHPLALAACRAVLLHLRAQGGTLQKRVNQLTNRLATEVNEFFQETGIPIRIVNFGSLFRFEPFGAYSLFLQPIELPLFYYLLNLKGIYTWEKRVCFLSTDHTNQDIDKVVIAVKEAIRELRQAGFFENAKPPQAKKREESDRSDDEDGRSSINQRFPTSEAQRQLWLLAELDTTASASYNVTTSLELRGNIEILYLQQAINEVVNRHEALRTQILEQGELQEVFNTVKIDLPLINLIDAENPEAAALTLRTQLSQKPFDLGSAPLFAAVLMRLAPEHYLLSLKTHHIVADGWSLGLILNEIGKLYSAKIGVSTDNLAPPMQFRQYLALRQQEAQSSQMQEHRDFWLKTYEGEIPVFELPTDFPRPAVKTYTGGRESKIIAPQLWRNLQTVGRQNQATLFMTMFAAYTAFLRRISGDDDLVIGIPISGRQFEGSEGLVGFCSQFLPVRIQTNITASFVDHLRHTKETLIAAFKHQSHALEELLAALQLQRDFSRSPLISVSFNMDPSLTLPEFEGLEVLLPPEPIGYTPFDLGFNFIEINDALIIYCNYNTELFKPETIKQFLESFEFLMEGVINNGNRLLSQLPLLTQSQEAKLLAELQGQTIDFPQTATIIDDFIAKVNSTPNAPALIVGDNTLSYGELNQKVNQLTNYLHQKYQLSSGKAIALIIGRNQNLIIAILATFKTGATYVPIDPEYPQSRIDFILKDSGCDVCLTESNFVSQLPQDIEAICLDKIDHTLAKFDTSEPHIKRDSSQIAYILYTSGSTGTPKGVMGCHISILNVIRSLRLTFDLDQHPDWHYIFTAPITHDPSLRNIFLPLTIGAALYMYEVKHIGHLVSFLQENQINALHTTPSIYREILAVLDTGETIPSLKYISAGGEKLDRETAIALRKRFPADIVSNVYGSTETCVGVAQYRIDENLNTDVPLGEVFHNNRLFVLDEFNNTVPLHVVGEICVEGVALASGYHNLPQITAEKFQPSFMTEGKTIFRTGDLGKQIAPGVIEFLGRKDNQVKVNGYRIDPGEIEYQLSRHSQIERAIVLPTNVDNQTQLSAYCKTESDIEISEIREFLSNFLPVYMIPTFFIFLKQFPLTRHGKIDLRSLAEFKGIGNLTQLAYTAPRNNLESKLVHIWEKILTKQPIGIFDNFFEIGGHSLLLSRVVTHVHKELNVLVKLAEFFKVPTIAGLAALVSKTQYDYQEPIPAITQQTSYPMSHGQRRLWALEFLDRNHTAYGMPSAYLFKGNLNIAAFENAFQHLLQRHEILRTTFTLIDNEPRQVVHESMNFQVKQIDLTEDEEQAEIIAEAIHNNAKNTFNLETGSLLKVNLLKVTQQSYIVLFNMHHIISDGWSAGVLIKDFLVLYHAYGQQNLELPPPLRIHYKDYSSWQEKRLNTSELQAQRDYWLNKLTPAPTRLNLPLDYARPGVQSFQGSAVIWQPDPELIKGFRVLLQNQESSLFMGLLTLVKSFLFCYTEQNEITVGSPIAGRNHPDLEEQIGFYVNMLVLRDQIAVDDSFATLLAKVKTTTLEAYDNQEYPFDKLVSDLNFPRDPSRNPLFDTAIVLQNNQNVELLLDGITVHPLDQEIVSAKFDLEFTFVEESQLYLKLIYNTDIFVHERISLMLKLLEGLLEEIVKLPEIPFLKLSFNTENSDEGDSKLFATNFNF

SEQ ID NO: 55410 - protein, 553 aa, Kluyveromyces lactis NRRL Y-1140
MSEEQNLRPVYDDDQPGEDTYKRGAIYKQTRSRKADYEDGENSEKRQKPNDTDNGPTAVVTDLSNEKKETRSKDKDESVALAVDADGNPIPQEVRLPKRKVAVMIGYCGTGYHGMQYNPPNDTIEKELFEAFVRAGAISKANSTDLKKNGFQRAARTDKGVHAGGNVISLKLIIEDPEVKEKINNELPDQIRVWDISRVNKAFDCRKMCSSRWYEYLLPTYSLIGPKPSTYLYNEIEASKKEIPNVIQDDVESAQFWEAFSTEAESKFTKEELEEIAAFVMPKDSFDENNETYQKSKAFKKLEAEHKRAYRISKERLDRFRSALKQYEGTFNFHNFTLGKDFNDPSAKRFMKQITVSEPFVIGEAKTEWVSIKIHGQSFMLHQIRKMISMATLITRCFSPLERIRQAYGQEKINIPKAPALGLLLEAPVYDGYNTRLQEFGYDPIDFSKYQSEMDTFKMKHIYDKIYLEEVNENVFNAFFSYIDTFNPSYNISQEQQQLKGQELQQPSQAVELVTEDLEQKAPSDPTPSDEKGKKPQRPIFDFLTARGIQLQD

SEQ ID NO: 55411 - protein, 219 aa, Prochlorococcus marinus subsp. marinus str. CCMP1375
MGTFFQKIADYSKDAVSAGKYLLQGLAVTFDHMRRRPITVQYPYEKLIPSERYRGRIHYEFDKCIACEVCVRVCPINLPVVDWVMNKETKKKELRNYSIDFGVCIFCGNCVEYCPTNCLSMTEEYELAAFDRHSLNFDNVALGRLPTSVTSDPSVMPLRELGYLPEGVMDPHELPKDSSRAGKLPIEIMDWMKNKESNKSEDNNLDININSLKVEKDSK

SEQ ID NO: 55412 - protein, 290 aa, Oryza sativa (japonica cultivar-group)
MKLEVLWRVLERCAHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 55413 - protein, 230 aa, Magnaporthe grisea 70-15
MADQKKEIATYLQQTHDRVFEHNRVWAAEQTKKDPDFFLKLTAGQKPEYLWIGCSDSRIPAEQITGLGPGEAFIHRNIANLVCSIDLNVMSVINYAVQHLQVKHIVVCGHYGCGGVKAAMTPRDLGILNPWLRNIRDVYRLHEAELDAIPEEEARYDRLVELNIIEQCRNVIKTAAVQQSYEANSFPIVHGWVFGFQDGRLKDLKVDHEAILKDVQKIYNLTGTPRMGGP

SEQ ID NO: 55414 - protein, 352 aa, uncultured bacterium
ITSAHMLLSAMLDNSIQQGNPLNIDPRRVIWKRVVDMNDRALRNIVIGLGGKAHGVPREDGFDITVASEVMAILCLASNLHDLKERLKRIVVAYNYDGKPVTAEDLHAAGAMAALLKDAVKPNLVQTLEHVPAIIHGGPFANIAHGCNSVMATRTALRLADFTITEAGFGADLGAEKFFDIKCRQAGLAPDACVLVATVRALKMHGGVAKADLKEPNVEAVKKGLPNLGKHIENIFKFGVPVVVAINIFAQDTREELQAVYDYCAGMGVNVALSDVFAKGGEGGVELAKEVVALAESGMARFKPIYPLEMSLKEKVATVVKEVYGGDRVEFQTKAAQALDQYEKEGYGNLPV

SEQ ID NO: 55415 - protein, 392 aa, Prochlorococcus marinus subsp. marinus str. CCMP1375
MEQKAIDNQNDPCNMVLKPGLEGVPVTQSAICDINGLKGELKYRGYSIAELAAKSSFLETTYLLIWGDLPSSKQLREFEDAIQMHRRLSFRVRDMMKCFPATGHPMDALQSSAASLGLFYSRRAIDNPQYIYDAVVRLIAKIPTMVAAFQLIRKGQDPIQPRDDLPYSANFLYMLTEREPDPLAARVFDRCLILHAEHSLNASTFSARVTASTLTDPYAVVASAVGTLAGPLHGGANEDVIAMLEEIGAPENARNYLKQAIDQKSKIMGFGHREYKVKDPRATLLQGFAEDLFARFGKDEMYDVARSVEEEASPLLGPRGIYPNVDFYSGLVYRKLGIPRDLFTPIFAISRVAGWLAHWREQLSANRIFRPTQIYTGKKTRAWCALEERNKN

SEQ ID NO: 55416 - protein, 268 aa, Oryza sativa (japonica cultivar-group)
MCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 55417 - protein, 280 aa, Glycine max
CSRLWPRKSWWRVSSPATLTLLLLTCSFLTLILLALHILSTPHANANSSVSRNTHIEAEEDDQVALRMEVISWQPRAFLYHNFLTKEECEYLINIATPHMQKSTVADNQSGQSVVHDVRKSTGAFLDRGQDEIVRNIEKRIADVTFIPIENGEPIYVIHYEVGQYYDPHYDYFIDDFNIENGGQRIATMLMYLSNVEEGGETMFPRAKANFSSVPWWNELSNCGKMGLSIKPKMGDALLFWSMKPNATLDALTLHSACPVIKGNKWSCTKWMHPTEFKMV

SEQ ID NO: 55418 - protein, 353 aa, uncultured bacterium
IGAANNLLAAMLDNHIQQGNALGIDVKKITWKRCVDMNDRQLRFVVDGLGGKASGTPREDGFDITVASEIMAVFCLASSMADLKERLSRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLANEDLAALEKGIPNLLRHVNNIKNVYQLPCVVAINRFPTDTDAEIDFIIRKCRELGVNTVLSTVWAEGGKGGEDLAREVVRLCEEEQGNFTFSYELDATIEEKLEAVTKKIYGGAGVALTPAAKKQAERLTALGFDKMPV

SEQ ID NO: 55419 - protein, 303 aa, Oryza sativa (japonica cultivar-group)
MATAGKVIKCKAAVAWEAGKPLSIEEVEVAPPQAMEVRLKILYTALCHTDVYFWEAKGQTPVFPRIFGHEAGGIVESVGEGVTELSPGDHVLPVFTGECGDCRHCLSEESNLCDLLRINTDRGAMIGDGQTRFTARGGQPVYHFLGTSTFSEYTVVHVGCVAKIHPAAPLDKVCVLSCGISTGFGATVNVAKPPKGCTVAIFGLGAVGLAAMEGARISGASRIIGVDLNPAKFELAKKFGCTDFVNPKDYDKPVQQVIIEMTNGGVDRSVECTGNAAAMISAFECVHDVRTPSHPLIHHIYFQ

SEQ ID NO: 55420 - protein, 352 aa, uncultured bacterium
ITSANNLLAGLLDNHIQQGNVLGIDPRQIVWKRCEDMNDRVLRNVVVGLGAKGDGMVREDHFVITVASEIMAIFCLASDYDDLRERLSKIIVAYNFKGEPVTAGDLQAVGAMMALLKDAFAPNLIQTLEHTPAIVHGGPFANIAHGCNSVRATKTALKLADIVVTEAGFGADLGAEKFFDIKCRMAGLKPDAVVLVATIRALKYNGGVKKEDLSAENVDALKKGIVNLEKHIENLQKYGVPIVVTLNSFVTDSKAETEFVRNFCEERGCEFALSEVWEKGGEGGIELANKVLDVLENKTSDFKPLYPDDMSLKDKIETVAKEIYGADGVDYAPAALKSLEKLEELGMGKCPV

SEQ ID NO: 55421 - protein, 353 aa, uncultured bacterium
IGAANNLLAAMLDNHIQQGNALGIDVKKITWKRCVDMNDRQLRFVVDGLGGKANGTPREDGFDITVASEIMAVFCLASSIKDLKERLSRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLANEDLAALEKGIPNLLRHVNNIKNVYQLPCVVAINRFPTDTDAEIDFIIRKCRELGVNTVLSTVWAEGGKGGEELAREVVRLCEEEQGNFTFSYELDASIEEKLEAVTKKIYGGAGVMLTPAAKKQAERLTELGFDKIPV

SEQ ID NO: 55422 - protein, 125 aa, Helicobacter pylori 26695
MKEVIHSTLAPKAIGPYSQAIATNDLVFVSGQLGIDVSTGEFKGADIHSQTTQSMENIKAILKEAGLGMDSVVKTTILLKSLDDFAVVNGIYGSYFTEPYPARATFQVAKLPKDALVEIEAIAIK

SEQ ID NO: 55423 - protein, 128 aa, Chlorobium tepidum TLS
MTRYDPDCIFCKIATGHIPANLVYKNDHVAAFHDINPVAPIHVLIIPLEHIRSLSDLKDGDSEIAAQILLAARIVAEKTGVLESGYRLVFNNGEDALQSVGHIHAHLIGGKTMGWPPFAGREVAHGQD

SEQ ID NO: 55424 - protein, 73 aa, Glycine max
AFSMIFSPAVITVNLAGADMVAPFTVLMSMAGFPTRKTNNDITSIASNGGRVQCMQVRPPICKNKSETLSYLA

SEQ ID NO: 55425 - protein, 391 aa, Streptomyces avermitilis MA-4680
MKAAVYEGPRTVAVKDVPDAKIEHPCDIIVKITTTNICGSDLHMYEGRTSFESGRTLGHENMGQVVEVGSAVRKVQVGEYVVLPFNIACGFCKQCERGLTNYCLTMQPEPALAGAAYGFADMGPYQGGQAELLRVPYGDFNALRLGEDAAEWQTDYVMLADIFPTGYHATEMAHVKPGDQTIVFGAGPVGLMAAYSALLKGAGRVWVADHQPDRLRKAEEIGAIPINTAEQKPGEVVKEATLGLGADNGCECVGYQAHDPEGHEDASLTLNGLIDSVRFTGDIGVVGVFLPQDPGGAEAQGELEAQGKVPLDFGLMWFKGQHMGTGQAPVKRYNRALRDLIAGGKAKPSFVVSHELSLDEAPTAYEHFDARDEGWTKVVLHPNGHGNGHKR

SEQ ID NO: 55426 - protein, 389 aa, Anabaena variabilis ATCC 29413
MKAVCWYGANEVRVENVPDPKILNPRDAIIKITSTAICGSDLHIYGGYIPTVQQGDIIGHEFMGEVVEVGSGVDNLKIGDRVVVPSTIGCGRCHYCEHDMWSLCDNSNTKGWLEEKLYGNITSAIYGYSHLLGGYAGAQAEYIRVPFADVGVVKVPPDLPDEMLLFISDAIPTGYMGAEMCDIQPGDTVAVWGCGAVGQFAMISAYMMGAEKVIAIDRFPERLEMARKYAKAEVINYEEVNAGEALKEMTGGRGPDACIDAVGLEAHGVGLEDFYDQTKQKLKLESDRPHVLREMMVACRKGGTLSIMGVYGGFVDKIPFGAAFNKGLTFRMGQMHGQKYMNLLLQLILDGKLDPSFVVSHQLPLEQAPFGYHIFQQKKDNCTKVVLKP

SEQ ID NO: 55427 - protein, 147 aa, uncultured Frankia sp.
RNTAKKAESYLRGTGFADTAYFGPEAEFYIFDDVRYDYNPYGSLHAVDSIEAAWNTARKEEGGNLGYKPRFKGGYFPVPPTDHFTDLRSEMSRALIRAGITVEMQHHEVGTAGQAEIDIRYDTLLRTANNLMLYKYIIRNVALSRGK

SEQ ID NO: 55428 - protein, 392 aa, Anabaena variabilis ATCC 29413
MKAVCWHGTNDVRVETVPDPKILNPRDAIIKITSTAICGSDLHIYNGYIPTMQSGDILGHEFMGEVVELGSAVKNVKVGDRVVVPFTISCGSCFFCQRDLWSLCDNSNPNAWMVELQMGHSPAGLFGYSHLFGGYAGGQAEYARVPFADVGLLKIPDNLPDEQVLFLTDIFPTGYMAAENCNIKPGDIVAVWGCGPVGQFAIKSAYMLGAERVIAFDRIPERLQMAKEQCNAEVLNYEEVNIGEALKEMTGGRGPDACIDAVGMEAHGTDLMAFYDQVKQAVRLETDRPTALRQVIVSAAKGGHVSLAGVYGGFLDKIPMGSAMNKGLTFKMGQTHVHKYLRPLLERIQNGEIDTSFVITHTLPLEQAPHGYEIFKHKKDNCIKVVLKPSGN

SEQ ID NO: 55429 - protein, 147 aa, uncultured Frankia sp.
RNTAKKAESYLRGTGFADTAYFGPEAEFYIFDDVRYDYNPYGSLHAVDSIEAAWNTARKEEGGNLGYKPRFKGGYFPVPPTDHFTDLRSEMSRALIRAGITVEMQHHEVGTAGQAEIDIRYDTLLRTADNLMLYKYIIRNVALSRGK

SEQ ID NO: 55430 - protein, 143 aa, uncultured Frankia sp.
SRDPRNTAKKAESYLRGTGFADTAYFGPEAEFYIFDDVRYDYNPYGSLHAVDSIEAAWNTARKEEGGNLGYKPRFKGGYFPVPPTDHFTDLRSEMSRALIRAGITVEMQHHEVGTAGQAEIDIRYDTLLRTADNLMLYKYIIR

SEQ ID NO: 55431 - protein, 235 aa, Triticum aestivum
IFRAGEGTTATIVVKTATGEEFHGGKCIITVGAWTSKLVKSVTGADLPVQPLHTLICYWKVKPGHERELTTEAGFPTFASYGVPYIYSTPSMEYPGLIKIAMHGGPPCDPDGRDWAIGPGEDGLVEPVARWIDEVMPGHVETAGGPVVRQACMYSMTPDEDFVIDFLGGEEFGRDVVVGAGFSGHGFKMGPAVGRILAEMALDGESGTAAEAGVELRHFGIRRFDGNPTGNARSY

SEQ ID NO: 55432 - protein, 779 aa, Ustilago maydis 521
MLPASIRTFLSSNFLLLLALAYSVTAFTVTISDKDELRQTCSGMIAGDDSHIQAYFDKGSKGTVATMFYEFIDFDKLGKWSDDKDALGYQLKSYICTPKAVQKTLCMQEQLGNFIVDESGGKASTVQLQRMDFGAAGLSEVKTLLPDAQLTRQRYNVTKTGYYCFGATEVPLVSLEAAPSGSGDLSVHAEFSGRVEFFNKFKGNLPAAEYPKLNFYFAMTIAYIALGIYWISLCIKHRDEMLTVQYFISGTIAFLVVEMAAQWMYYYYLNGHLIDFFRIREVNNHTGVTAMARFLLVLTSILDAGRNSVSFFLLLIVAMGYGVIRPSIGPVMTRVRLLTAAHFIFGVLYSIGIVLIQLEQGGAWIFAFIFPLAMTLTAFLTWIMNSLNRSIEHLTQRKQTFKKSMFVKLHRILLGAVVVIFAFFIISSIAFSQSGGEGFAPNTWQYRWFLLDGWLALLYLAVFSAIAWVWRPTGNNMRLAMSDELATDDDPNAEGYEVDTFAARGPDGPDSDDEDDVEAKRTSQGPNGGRSAGAQPNSDVVFEIGDEDDEADHSKAAAADRREGRRGERQGLMSTSTNVSEETLVPVLLTITCRNHVYPRAFANAVTPLARLCTFALALTRFTMWTAASRSAAAQLQLTITLGRSTVFRVQVPSLFSTPSSLCSTFHPLTPALSTSQSAVSSSTASPSTWASDVGTLLWDGILRAVPKKKVSHSRKSMRAANKGLKDRTDLVHCSSCGKPKLHHHICASCYFELNRARKVALKQQHGGAPTNGGAQQHP

SEQ ID NO: 55433 - protein, 483 aa, Sulfitobacter sp. EE-36
MQTQPIASHFINGEYVEDTNGTPIEVIYPATGEVIATVYAATPEIVEKAITAARDAQAAWAAMTGTERGRILRRAADIMRERNHDLSILETYDTGKPYQETSVADATSGADALEYFGGLAASLTGEHIQLGEDWVYTRREPLGVCVGIGAWNYPTQIACWKGAPALACGNSIIFKPSETTPLCALKVAEILVEAGLPAGLYNVVQGMGEVGASLVTDPRVDKVSLTGSVPTGRKVYAAAAEGIKHVTMELGGKSPMIVFEDADIENAISGAILGNFYSSGQICSNGTRVFVHRDIKEAFLKRLAERLDTAVIGDPMDPDTSFGPMVSKRQMEIALGYVEKGKAEGARLVYGGAAIDRDGFYMQPTVFADVTDDMSIAREEIFGPVMSVLDFETEAEVMARANATEFGLAAGVFTKDLSRAHRVAAGFEAGTCYINTYNDAPVEAPFGGMKNSGVGRENSKAAIDHYSQLKTVYVRMGDMEAPF

SEQ ID NO: 55434 - protein, 828 aa, Oryza sativa (indica cultivar-group)
MAEHKPLPGRPKREGEGASKRKAKSGGFESMGLCEEVYRGVRHKGYRVPTPIQRKAMPLILAGHDIAAMARTGSGKTAAFLVPMIQRLRRHDAGAGIRALILSPTRDLATQTLKFAQQLGKFTDLKISLIVGGDSMESQFEELAENPDIIIATPGRLVHHLAEVEDLNLRTVEYVVFDEADSLFSLGLIQQLHDILHKLSDTRQTLLFSATLPQALADFAKAGLRDPQIVRLDLDKKISPDLKLAFFTLRQEEKLAALLYLVRERISSEEQTIIFVSTKHHVEFLNILFREEGLEPSLSYGAMDQEARNIHISKFRARETMILIVTDVAARGLDIPLLDNVVNWDFPAKPKLFVHRVGRVARQGRSGTAYTFVTSEDMAYLLDLHLFLSKPLRPAPTEEELLKDMEGMNLKIDRALANGETVYGRFPQTIIDLVSDGIKEVINGCTDLIALEKPCTNAFHLYLKTRPMPSTESIRRVKDLPREGLHPIFRDVLGSDELSALAFSERLKSFRPKQTILEAEGEAARGSNQWLDVMKKKREVHEGIINLVHQKNNVDHEPKEELVENISNWERKDVCGNKRKLQSFRDEEYYISSVPQNQHLEAGLSVRANEGFVENRLDAAVLDLVDDETSGMQAQKTRYHWKKNKFVKLNSGDRVTATGKIKTESGAKLKPTKTGIYKKWQQKTHRSIDTGRKYGGFAEEGASTTGSHQRGNRKHTAAGRGRRYIPNADVPSEIRNPEQIQKSRQQKAMDIARMKNRSTKESKFQKFQKNNRRHDGPSKDGKFQKNRRPDGNGKNRRPDGNGKGRGKGKGNANGFGKGKGKMKGKGTR

SEQ ID NO: 55435 - protein, 61 aa, Brassica napus
FVVHFLVRGRTEISPDQREKFLQRYQQVRQGHGNLLGMASLSERNEKQFSSQQQNPLLQQM

SEQ ID NO: 55436 - protein, 294 aa, Carboxydothermus hydrogenoformans Z-2901
MGEKGTWVVKKGLAEMLKGGVIMDVTTPEQAKIAEEAGACAVMALERVPADIRAAGGVARMADPNVILRIMDAVTIPVMAKVRIGHFVEAQILEALGVDYIDESEVLTPADELFHIDKHAFKVPFVCGARNLGEALRRIGEGAAMIRTKGEPGTGNVVEAVRHMRQVMGEIRRIQNMPREELMTAAKEMGAPYDLVLYVHEHGRLPVVNFAAGGIATPADAALMMQLGADGIFVGSGIFKSKDPVGRAKAIVAATTYYDDPKVLAEVSKGLGEAMPGIDIKTISQTERMSERGW

SEQ ID NO: 55437 - protein, 352 aa, uncultured bacterium
IGAANNLIAAMLDNHIKQGNELDVDLNNIIWRRCVDMNDRQLRNVVDGLGTAGDGVAREDGFDITVASEVMAVFCLATDLDDLKARLGRMVVAYSRSGKPVTVADIKAEGACTALLKDAIKPNLVQTLENNPAFVHGGPFANIAHGCNSVQATTTAMKMTDYVVTEAGFGADLGAEKFIDIKCRAAGIQPSCVVIVATVRALKHNGGVAKADLGNENLAALEAGLPNLLQHVSNIQDVFGLPAVVAINAFPTDTQAELDLVQAKCKELGVNAVLAKHWAEGGAGAVPLAEEVVRLCEESNNFQFSYDVDKGIEEKIETIAKRIYHADGVEYTPKAKKQLAQLNDLGFDKLPI

SEQ ID NO: 55438 - protein, 672 aa, Methanococcus maripaludis S2
MDDKQIQNIRPRLTECLKTLNFQDIISEKKKVAVDIDNIYKHGVIDFIEFLEEFPKEGIELLEECYRDAYYSIKTEKPDIVITVKNIPEEFNKSEKKQNYTIEDIKSGTLGKLIEFEGIIVIATKIKSALKKATYVCTQCGEKKIQEVENPFEAYFEPPCPKCAQNMTLIEDESEYIDFQEIKVQQPLDSMGDPEEPPKYITVFLEHSPGIYCGRVKVTGIPIKNQKNKNIPIYDIYVKGINCEVLEDKIEANLNEEDIKNIEKVGKNPKVIDILSERMIPEIKGYEIIKKAIFLQQVKGVKKGNKRADSHLLLITDPGIGKSVMLRKIAEIPGNLYGSATTASGVGLTAAVIREKTEIGDDTWVIKPGLLVKANKGTACIDELTVNRDLQTFVLEAMESQTIHVSKGGINAKLPSECAIIAACNPRWGRFDPNVSIPEQINIPAPMLSRFDLIFPIKDEADRSKDKDIAQHIINVHRAYLSKEVSKNMKLDHIIVDDVLIDRDFVIKYIEYAKTKSPIISESAEKLLTEFYLNMRKGSVQITARQLEAAIRIAEAHAKAKLKDVVDEEDANEAISIITESLKETAYDPETGQFDVDKISGVGKKDRSKMMGVYDLIKALAEKSDNDLVIIDEIVEAGKSKGIDEEHILLSIKKLKSNGDIDEPKTGKFRII

SEQ ID NO: 55439 - protein, 348 aa, uncultured bacterium
IGAANNLLAAMLDNHIQQGNALGIDVKKITWKRCVDMNDRQLRFVVDGLGGRMNGTPREDGFDITVASEIMAVFCLASSMADLKERLSRIIVAYTYDDQPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLANEDLAALEKGIPNLLRHVNNIRNVYQLPCVVAINRFPTDTDAEIDFIVRKCRELGVNTILSTVWAEGGKGGEDLACEVVRLCEEEKGNFTFSYELDASIEEKLEAVTKKIYGGSGIALTPAAKKQAERLTALGF

SEQ ID NO: 55440 - protein, 394 aa, Prochlorococcus marinus subsp. marinus str. CCMP1375
MSQLETRTEPMVVNFGPHHPSMHGVLRLVVTLDGEDVIDCEPVIGYLHRGMEKIAENRTNVMFVPYVSRMDYAAGMFYEAIVVNAPERLANISIPKRASYIRVLMLELNRIANHLLWLGPFLADVGAQTPFFYIFREREMIYDLWEAATGQRLINNNFFRIGGVACDLPWGWLEKCKDFCDWFGPKIDEYEKLITNNPIFRRRIEGLGSISKEKAINWSLSGPMLRASGVPWDLRKVDHYECYDDFDWNIAIAEEGDCYARYRVRIEEMRQSLRILRQACEMIPGGPTENLEASRIAEGKNSPFAGFDFQYVAKKVAPTFKIPNGELYTRLESGKGEIGVFIQGNNDVTPWRFKIRAADLNNLQILPHILKGAKVADIMAILGSIDVIMGSVDR

SEQ ID NO: 55441 - protein, 353 aa, uncultured bacterium
IGAANNLLAAMLDNHIQQGNALGIDVKKITWKRCVDMNDRQLRFVVDGLGGRANGTPREDGFDITVASEIMAVFCLASSMSDLKERLSRIIVAYTYDNQPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLANEDLAALERGIPNLLRHVNNITNVYQLPCVVAINRFPTDTDVEIDFIVRKCREMGVNTILSTVWAEGGKGGEDLAREVVRLCEEGKGNFTFSYELDATIEEKLEALTKKIYGGAGVALTPAAKKQAEQLTRLGFDKLPV

SEQ ID NO: 55442 - protein, 785 aa, Chromobacterium violaceum ATCC 12472
MQFSEQWLRSWVNPALNTEQLSDLLTMAGLEVEETVAAAPAFSGVVIAEVKECVKHENADRLRVTKVDAGTGELIQIVCGAPNVAVGVRVPCALPGAVLPGEFKIKPTKMRGVESNGMLCSGKELGVPEDVDGLMLLPADAPVGQSIRDYLGLDDQLFTLKITPNRADSLSIRGIAREVAALTGAELKPVAIEPVAPSIDDVRPVKIESRQACGRYLGRVVKGVNAAAPTPAWMRRRLERSGLRSISAIVDITNYILLEQGQPMHAFDLAKIDGGITVRQARAGESLLCLNEKTVELQPKHLVIADDAKPLAMGGIMGGEHSGVTVASHDIFLESAFFAPEAIAGKARELGFGSDSSYRYERGVDFALQRDAIERATRLVLEICGGQAGPVVEEVAELPKRQAVQLRAARVAKVLGVAMSAERIGDILSRLSLSYTLADEVFTVQAPSFRFDIEIEEDLIEEVARVYGYNNIPADAPRSGMRMLAQPEDKRPVDQLRHLLAGRDYQEVVSYAFVDERWERDFAGNDNPIRLQNPIASQMSVMRSTLIGGLVDVLAGNINRKQPRVRLFEVARVFLRGGNGFDQPEKVAGLVWGPRLAEQWAAKSERVDFFDVKADVEALLHPIKAEYRKAAHPAFHPGRCAEVRVDGKAVGVIGELHPQWVQAYGLINAPVLFELDLAAAIARGRIKAQPVSKFQPVRRDLALLVDEAVTVAQLLSAFAAKRAEIVADIALFDVYRGKGVAEGKKSLAFSVLMQDNSRTLTDEDVEPAMQALLEAASELGAQLRV

SEQ ID NO: 55443 - protein, 352 aa, uncultured bacterium
IGAANNLLAAMLDNHIQQGNALGIDVKKITWKRVVDMNDRQLRNIVDGLGGRMQGVPREDGFDITVASEIMAVLCLASDIDDLKARISRIVVGYTYDDKPVTAADLNAQGAMTALLKDALKPNLVQTLENNPAFVHGGPFANIAHGCNSIMATKMALKMADYVITEAGFGGDLGAEKFLDIKCRMAGLKPSAVVVVATVRALKHHGGVAKADLNNENLEALEKGLPNLLQHVDNMKNVYKLPVVVAINAFPTDTKAELDLVEAKCNELGVNVALSEVWAKDGEGGVALAKEVVRLCEEPNDFQFSYELDGTIEEKIEAIAKKVYRADGIQFTPAAQKEVERLTALGFDKMPI

SEQ ID NO: 55444 - protein, 261 aa, Solanum tuberosum
MAAGRWNLEGCTALVTGGSRGIGYGIVEELASLGASVYTCSRNQKELNECLTQWRSKGFKVEASVCDLSSRSEREEFIKTVANHFDGKLNILVNNAGIVIYKEAKDYTMEDYSLIMSINFEAAYHLSVLAHPFLKASQRGNVVFISSISGASALPYEAVYGATKGAMDQLTRCLAFEWAKDNIRVNGVAPGVIASSMVEMTIQDQEQKENLDKLIDRCALHRMGEPKELAAVVAFLCFPAASYVTGQIIYVDGGFMANGGF

SEQ ID NO: 55445 - protein, 557 aa, Arabidopsis thaliana
MSGSVSRDAEALKSADSSTRRSGGRITFPFMIVTLFGLTLATLGWLQNLIVYLIEEYNMKSIAAAKILNIFSGFTFMFPAIGAIAADSFFGTIPVILVSSFISLVGVVLLALTTLFDSLRPQACETASKLCQAPTNIQLGVLYTAITLGCVGAGGLRFTLATAGANQYEKTKDQGSFFNWFFFTWYLAASISATAIVYAEENISWSFGFGLCVAANLLGLIVFISGKKFYKHDKPLGSPFTSLLRVIFAAIRKRKAVVSTNEKDYHSESKKTPTKSFRFFNRAALKQDDEVNSDGTIHNQWRLCSVQQVEDFKAVIRIIPLVLAILFLSTPIAMQLGLTVLQGLVMDRRLGPHFKIPAGSLQVITLLSTCLFIIVNDRFLYPFYQKLTGKFPTPIQRVGIGHVFNILSMAVTAIVEAKRLKIVQKGHFLGSSSVADMSVLWLFPPLVIVGIGEAFHFPGNVALCYQEFPESMRSTATSITSVLIGICFYTSTALIDLIQKTTAWLPDDINHGRVDNVYWILVIGGVLNLGYFLVCSWFYKYRNLENADHEQDANVSH

SEQ ID NO: 55446 - protein, 202 aa, Solenostemon scutellarioides
MQGGIQAIFSRGKNAVLQHVRVVPPAMRALMFPRHESTSAARMEEHGFESTTISDVLTAKGKGADGSWLWCTTDDSVYDAVKSMTQHNVGALVVVKPGEQKSIAGIITERDYLRKIIVQGRSSKSTKVGDIMTEENKLITVTPDTKVLKAMQLMTDNRIRHIPVVNEGGMIGMVSIGDVVRAVVREHREELNRLNAYIQGGY

SEQ ID NO: 55447 - protein, 210 aa, Emiliania huxleyi
  misc_feature (16)..(16): Xaa can be any naturally occurring amino acid
  misc_feature (151)..(151): Xaa can be any naturally occurring amino acid
  unsure (1)..(210): unsure at all Xaa locations
DNGSGMCKAGFAGDDXPRAVFPSIIGRPRQPGVMVGMGQKDSYVGDEAQSKRGILTLKYPIERGIVTNWDDMEKIWHHTFYNELRVAPEEHPVLLTEAPLNPKANREKMTQIMFETFNVPAMYVAIQAVLSLYASGRTTGIVMDSGDGVSXTVPIYEGYAVPHAILRLDLAGRDLTDWMVKLLTERGYSFTTTAEREIVRDIKEKLAYVA

SEQ ID NO: 55448 - protein, 515 aa, Salmonella enterica subsp. enterica serovar Typhi str. CT18
MMDHNMKKNPVSIPHSIWPADDIKRLERDAADAFGLTLYELMLRAGDAAFRVARDSYPDARHWLVLCGHGNNGGDGYVVARLAQAAGISVTLLAQESDKPLPEEAAQARDAWLNAGGIIHAADIIWPEATDLIIDALLGTGIAQEPRDPVAGLIEQANAHPAPVVAVDIPSGLLAQTGTTPGAVISAAHTVTFIALKPGLLTGKARDVTGILHYDALGLEGWLASQTPPLRRFDATQLGQWLTPRRPTSYKGDHGRLAIIGGDQGTAGAIRMAGEAALRTGAGLVRVLTRGENIASLLTARPELMVHELTPQSLEESLTWADVVVIGPGLGQQEWGKKALQKVENVRKPMLWDADALNLLAINPDKRHNRVITPHPGEAARLLGCSVAEIESDRLLSAQRLVKRYGGVVVLKGAGTIIAAEHHPLAIIDAGNAGMASGGMGDVLSGIIGALLGQKFTPYDAACVGCVAHGAAADLLAARYGARGMLATDLFTTLRRIVNPDVIDVNHDESSNSAT

SEQ ID NO: 55449 - protein, 210 aa, Emiliania huxleyi
  misc_feature (16)..(16): Xaa can be any naturally occurring amino acid
  misc_feature (151)..(151): Xaa can be any naturally occurring amino acid
  unsure (1)..(210): unsure at all Xaa locations
DNGSGMCKAGFAGDDXPRAVFPSIIGRPRQPGVMVGMGQKDSYVGDEAQSKRGILTLKYPIERGIVTNWDDMEKIWHHTFYNELRVAPEEHPVLLTEAPLNPKANREKMTQIMFETFNVPAMYVAIQAVLSLYASGRTTGIVMDSGDGVSXTVPIYEGYAVPHAILRLDLAGRDLTDWMVKLLTERGYFFTTTAEREIVRDIKEKLAYVA

SEQ ID NO: 55450 - protein, 249 aa, Hordeum vulgare
MVKLAFGSFGDSFSATSIRSYVAEFIATLLFVFAGVGSAISYGQLTQGGALDPAGLVAIAIAHAFALFVGVAMAANISGGHLNPAVTFGLAVGGHVTILTGLFYWVAQLLGASVACLLLQFVTHAQAMPTHAVSGISEVEGVVMEIVITFALVYTVYATAADPKKGSLGTIAPMAIGFIVGANILAAGPFSGGSMNPARSFGPAVAAGNFSGHWVYWVGPLIGGGLAGLVYGDVFIASYQPVGHQQEYP

SEQ ID NO: 55451 - protein, 149 aa, uncultured Frankia sp.
RPRNTAKKAESYLRGTGFADTAYFGPEAEFYIFDDVRYDYNPYGSLHAVDSIEAAWNTARKEEGGNLGYKPRFKGGYFPVPPTDHFTDLRSEMSRALIRAGITVEMQHHEVGTAGQAEIDIRYDTLLRTADNLMLYKYIIRNVALSRGK

SEQ ID NO: 55452 - protein, 347 aa, Synechococcus sp. WH 7805
MNHSIPVVAENADQLDHSIVSALTRCLQEEAAAIAAAASQLSADEVEGALALLERCADRKAKLVITGVGKSGIVARKIAATFSSIGLMALYLNPLDALHGDLGVVAPDDVCLLLSNSGETAELLEVLPHLKRRGTARIALVGRADSSLARGSDVVLDASVDREVCPLNLAPTASTAVAMAIGDALAAVWMERRGISSADFALNHPAGALGKQLTMTVADLMIPVAQLPSITPTTPLPDVIGRLTQGAIGSGWVEDPAQPGRLLGLITDGDLRRALRDHGPERWPALTAGELMTADPITVSADILAVEAIQRMEHNRRKPISVLPVVDEHDGLHGLLRLHDLVQAGLA

SEQ ID NO: 55453 - protein, 450 aa, Escherichia coli K12
MTKHYDYIAIGGGSGGIASINRAAMYGQKCALIEAKELGGTCVNVGCVPKKVMWHAAQIREAIHMYGPDYGFDTTINKFNWETLIASRTAYIDRIHTSYENVLGKNNVDVIKGFARFVDAKTLEVNGETITADHILIATGGRPSHPDIPGVEYGIDSDGFFALPALPERVAVVGAGYIAVELAGVINGLGAKTHLFVRKHAPLRSFDPMISETLVEVMNAEGPQLHTNAIPKAVVKNTDGSLTLELEDGRSETVDCLIWAIGREPANDNINLEAAGVKTNEKGYIVVDKYQNTNIEGIYAVGDNTGAVELTPVAVAAGRRLSERLFNNKPDEHLDYSNIPTVVFSHPPIGTVGLTEPQAREQYGDDQVKVYKSSFTAMYTAVTTHRQPCRMKLVCVGSEEKIVGIHGIGFGMDEMLQGFAVALKMGATKKDFDNTVAIHPTAAEEFVTMR

SEQ ID NO: 55454 - protein, 603 aa, Carboxydothermus hydrogenoformans Z-2901
MPKRQELIRNFCIIAHIDHGKSTLADRLIEFTGALSERELKEQVLDQMELERERGITIKAQAVKLTYKAKDGNTYYLNLIDTPGHVDFTYEVSRSLAACEGALLVVDASQGIEAQTLANVYLAMEHDLELIPVVNKIDLPNAEPERVLKEIEDVIGLDTSEAILASAKTGQGIEEVLEAIVKRIPPPRGDEEKPLKALIFDSHYDPYKGVIAYIRLVDGFIKPGMKIKMMSNDKEFEVTEVGIFKPYLTPVEGLWAGEVGFIAAGIKNVRDCRVGDTITSAENPAKEPLPGYKQVKPMVFCGLYPVESNQYEDLRDALEKLKLNDASLTFEPETSVALGFGFRCGFLGLLHMEIIQERLEREYGLNLITTAPNVVYRVVQTNGEVLEIDNPAKLPPAGKIDHIEEPYVKATIMVPKEFVGNIMDLCIERRGVFINMEYLSENRVMLTYDLPLAEIIYDFFDQLKSRSKGYASLDYEFIGYRPGDLVKMDILIAGEPVDALSIIVHEDKAYYRGRQLVEKLRELIPRHLFEIPIQAAIGSRVIARETVKALRKDVLAKCYGGDVTRKKKLLEKQKEGKKRMKQIGRVEIPQEAFMAVLKIDNNK

SEQ ID NO: 55455 - protein, 159 aa, Medicago sativa subsp. falcata
MVLLISSEVSARDLTETTSDAKKEVVEKTNEVNDAKYGGGYNHGGGGYNGGGYNHGGGGYNNGGGYNHGGGGYNNGGGGYNHGGGGYNNGGGGYNHGGGGYNNGGGGYNHGGGGYNGGGYNHGGGGYNHGGGGCQYHCHGRCCSHAEFVAMQAKDNTQN

SEQ ID NO: 55456 - protein, 192 aa, Triticum aestivum
  misc_feature (114)..(114): Xaa can be any naturally occurring amino acid
  misc_feature (141)..(141): Xaa can be any naturally occurring amino acid
  misc_feature (147)..(147): Xaa can be any naturally occurring amino acid
  unsure (1)..(192): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWXTMWKLPMFGCTDATQVINEVEEARRSXPDAYAXIIGFTTSQVQCVTHRKQRAARSKAKHSSHGHIKMRFGTEAWVSFN

SEQ ID NO: 55457 - protein, 258 aa, Oryza sativa
  misc_feature (168)..(168): Xaa can be any naturally occurring amino acid
  unsure (1)..(258): unsure at all Xaa locations
MAATRVWLSALLLAFLLAAAPVVQVARAQSMEEAATAEVVDGADLGIVSDDTQVSSDGPLSPAPGVETVCVFPKNAGKIVLAGEETELLVGLQNEGESTLNVVAIHSTLHLPFDHKMYGQNLTVQNFFNASVPVSVQATFPYTFAVSKFLQPGAYDLVGYIVYEIDQXPPYQNVFYNGTVEVVEAGGLLSVESVFLITLGVALLGLFGLWAYGQVQQLSKKTKKAPKVELGTGTTDANMDEWLEGTAFAQGSKSKKKK

SEQ ID NO: 55458 - protein, 495 aa, Staphylococcus aureus subsp. aureus COL
MAVNVRDYIAENYGLFINGEFVKGSSDETIEVTNPATGETLSHITRAKDKDVDHAVKVAQEAFESWSLTSKSERAQMLRDIGDKLMAQKDKIAMIETLNNGKPIRETTAIDIPFAARHFHYFASVIETEEGTVNDIDKDTMSIVRHEPIGVVGAVVAWNFPMLLAAWKIAPAIAAGNTIVIQPSSSTPLSLLEVAKIFQEVLPKGVVNILTGKGSESGNAIFNHDGVDKLSFTGSTDVGYQVAEAAAKHLVPATLELGGKSANIILDDANLDLAVEGIQLGILFNQGEVCSAGSRLLVHEKIYDQLVPRLQEAFSNIKVGNPQDEATQMGSQTGKDQLDKIQSYIDAAKESDAQILAGGHRLTENGLDKGFFFEPTLIAVPDNHHKLAQEEIFGPVLTVIKVKDDQEAIDIANDSEYGLAGGVFSQNITRALNIAKAVRTGRIWINTYNQVPEGAPFGGYKKSGIGRETYKGALSNYQQVKNIYIDTSNALKGLY

SEQ ID NO: 55459 - protein, 441 aa, Erwinia carotovora subsp. atroseptica SCRI1043
MQAPMFPKGQLSPTQISQRYRYWRPRLLISMVIGYATFYLTRKSINFVMPVMQLELGLSKGDIGLLGTLFYLCYGASKFISGIVCDRTQVRWFMGVGLMITGVLNILFMYCQSLTGLLIVWALNGFFQGWGWPPCARLLSSWYSRNERGLWWGCWNTSINIGGAAVPLLAGYLASEWGWQAALLVPGIIGIVIGLWLCWQLCDKPQQQGLPSVGQWRRDALELRQEQQSPPMPMRQILRDAILRNRTIWLLGFSYILVYLIRIALNDWGNIWLSESHGFNLLSANATLSLFELGGLLGALFAGWGSDLLFRGQRAPMILLFALGLFLTMTALWLAPIHHYSLLAACFFSIGFFVFGPQMLIGLAATEYSHKDAAGTVTGFLALFAYLGAALAGWPLAQVLQHYGWSGFFTLLALASACIGLLLMPLLMAGVSRRERLMTSK

SEQ ID NO: 55460 - protein, 186 aa, Wolbachia endosymbiont strain TRS of Brugia malayi
MFGASDIKSLPNESAPEIAFAGRSNVGKSSLINLLINSKKAARVSSKPGCTRQINFYSMYNDKFRLVDLPGYGCSHASKDETIQYLGLVEYYLIHRRNLRRVFVLIDSKVRLKEIDKDFIYWLTYNNINFDVVLTKIDKVDRENLDAIIESTRKWINNESVSIRQISVRVKYEMTKVRDEFFKFTR

SEQ ID NO: 55461 - protein, 469 aa, Hordeum vulgare
MAGAAAAVASGISIRPVAAPKISRAPRSRSVVRAAVSIDEKAYTVQKSEEIFNAAKELMPGGVNSPVRAFKSVGGQPIVFDSVKGSHMWDVDGNEYIDYVGSWGPAIIGHADDKVNAALIETLKKGTSFGAPCALENVLAQMVISAVPSIEMVRFVNSGTEACMGALRLVRAFTGREKILKFEGCYHGHADSFLVKAGSGVATLGLPDSPGVPKGATVGTLTAPYNDADAVKKLFEDNKGEIAAVFLEPVVGNAGFIPPQPAFLNALREVTKQDGALLVFDEVMTGFRLAYGGAQEYFGITPDVTTLGKIIGGGLPVGAYGGRKDIMEMVAPAGPMYQAGTLSGNPLAMTAGIHTLKRLMEPGTYEYLDKVTGELVRGILDVGAKTGHEMCGGHIRGMFGFFFAGGPVHNFDDAKKSDTAKFGRFHRGMLGEGVYLAPSQFEAGFTSLAHTTQDIEKTVEAAEKVLRWI

SEQ ID NO: 55462 - protein, 150 aa, Zea mays
  misc_feature (48)..(49): Xaa can be any naturally occurring amino acid
  misc_feature (95)..(95): Xaa can be any naturally occurring amino acid
  misc_feature (114)..(114): Xaa can be any naturally occurring amino acid
  misc_feature (124)..(124): Xaa can be any naturally occurring amino acid
  misc_feature (133)..(136): Xaa can be any naturally occurring amino acid
  unsure (1)..(150): unsure at all Xaa locations
GEKRERATIPPPPPPAAPGVCLLRFAWESAAGSLVGAVGGYGKGLVMXXGFKGSFPDAASSAKIFAVLAGVQSLVACSLRKLRGKDDGINAGVAXGCCTGLALSLSCAPQTLIXSCLTFGTFSXIIETLNKQXXXXALPATIQKGWKFHA

SEQ ID NO: 55463 - protein, 238 aa, Arabidopsis thaliana
MPIRSNPFFNMDSSALLSLLRHTGTSMDSKSSKKSSGSIGGGVLKMFKLIPMLSSGCKMVNLLSRGHRRPLLKDYATTGTIFGFRKGRVFLAIQEDPHCLPIFIIELPMLTSALQKEMASETVRIALESETKTSRKKVLEEYVWGIYCNGRKIGYSIRRKNMSEEEMYVIDALRGVSMGAGVLPCKNQYDQETEGEMTYMRARFDRVIGSKDSEALYMINPEGSGQGTELSIYFLRSH

SEQ ID NO: 55464 - protein, 477 aa, Magnaporthe grisea 70-15
MSLRTTSRALGAFRPLATRSACTSNVRSTRNYSASSEPDLKTTLKSVIPAKRELLKKVKAHGSKVIGEVKVENTIGGMRGLKAMVWEGSVLDADEGIRFHGRTIKDCQRELPKGKTGTEMLPEAMFWLLLTGQVPSTNQVRVLSRQLAEQAQLPAFVNKMLDDFPRDLHPMTQFAIAVSALNHTSKFAKAYADGLNKADYWEPTFDDSISLLAKLPTIAAKIYHNSYKGGGALPAEVDLEQDWSYNFAAMLGKGGKGNENFQDLLRLYLALHGDHEGGNVSAHATHLVGSALSDPFLSYSAGLQGLAGPLHGLAAQEVLRWIIQMKEAIPATYSEKDVTDYLWSTLNSGRVVPGYGHAVLRKPDPRFQALMDYAASRPEIAKDPVFQLVQLNSQVAPEVLKKHGKTKNPYPNVDSSSGVLFHHYGFHETLYYTATFGVSRGLGPLAQLIWDRALGLPIERPKSINLEGILKIVGDKS

SEQ ID NO: 55465 - protein, 503 aa, Glycine max
MAISIPSRQLFIDGEWKVPLLNNRFPIINPATEDIIGHIPAATKEDVDLAVDAAKRAFSHNKGKDWSSAPGSVRARYLRAIASKITEKKDELGKLEAIDCGKPLDEALADLDDVIGCFNYYAELAEGLDAKQNAPVSLPMETFKSYVLKEPIGVVALITPWNYPLLMATWKVAPALAAGCTAILKPSELASVTCLELAEICREVGLPPGVLNIVTGLGNEAGAPLSSHPDVDKISFTGSSATGSRIMTAAAQLTKPVSLELGGKSPIIVFEDVDLDKTAEWTIFGCFFTNGQICSATSRLIVHESIATEFVNRLVQWAKNIKISDPFEEGCRLGPIVSEGQYKKVLNCISTAKSEGATILIGGSRPEHLKKGYFVEPTIITDVTTSMQIWREEVFGPVLCVKTFSTEEEAIELANDTHYGLGSAVMSKDLERCERISKAIQAGIVWINCAQPSFIQAPWGGVKRSGFGRELGEWGLENYLSVKQVTKYIFDEPWGWYQSPSKL

SEQ ID NO: 55466 - protein, 176 aa, Mesostigma viride
MFNFIDNVQTYSKEALQAAKYIGQGFMVTFDHMNRRAITIQYPYEKLIPSERFRGRIHFEFDKCIACEVCVRVCPINLPVVNWEFQKEKKKKQLQTYSIDFGVCIFCGNCVEYCPTNCLSMTEEYELSVYDRHELNYDNFALGRLPTMVNNDSMVKGIKGLGYLPKGIIEGHIDNQ

SEQ ID NO: 55467 - protein, 291 aa, Zea mays
  misc_feature (103)..(103): Xaa can be any naturally occurring amino acid
  misc_feature (175)..(175): Xaa can be any naturally occurring amino acid
  unsure (1)..(291): unsure at all Xaa locations
MEAMPRPSVAPSLQLQARPCPRWPRRKHCPPSSVASRRVACSASAADADVVDLFDAAKLTVDKFVTSGMVVGLGSGPASALAIQYLGTRLRRGSLAGITAVTXPRSVLSASEADKAGIRANSYQEGTQIDFAFTDAEAIEEGTLAAVIGRRKTESGEPSFMAEKGNDKYVTTGGXMAKSAHKLAFITGNDKYVTTGVEGSIPVLIKSVWRRPSFGTAGPLGGDHPLVTKEGHHVLDVIFTTPIQDLGQVAEKLDKVDGVVDHGIICSNQPYAVIASKGEVQVLDEKSSVIQ

SEQ ID NO: 55468 - protein, 178 aa, Rhizobium leguminosarum bv. viciae 3841
MSEQMNRPHAIIVMGVSGCGKSSVGEKLAEALHLAFVEGDALHPAANVEKMSKGIPLTDEDRMPWLDRIGEDIKASLEKSKGIIVSCSALKRLYRDRLRAAAGGKLFFVYLEGSRALLMKRMGERKGHFMPVSLLDSQLATLEVPTGEPGVVTVDIDDTVDGITATALEGLASLGVTG

SEQ ID NO: 55469 - protein, 446 aa, Zea mays
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSKKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 55470 - protein, 463 aa, Legionella pneumophila str. Paris
MDLFRKKDIKGSLDNESHLAKCLSVFDLTFLGVGAIIGAGIFVLTGIVAATISGPAVIFSYVVAGFACAFAALSYAELAASIGGCGSAYGYAYAGFGELIAWIVGWDLLLEYSIAVSAVSIGWSGYANDFLMALKIFIPTHLLHGPADGGDLNILAILIIAVLTTLLIVGVKSSSRFNNIMVFVKLLVIFIFIAIAFGEVKVENWSSFMPYGWAGVMKGASIIFFAYVGFDAVSTAAEEAINPQRDLPIGIIASLAICTVIYILVSGLLTGIAHYTTLNVSSPISHVLLVLGYKTAAGLVGVGAIAGLTTVMLVLFYGLTRVFLAMSRDGLLPRFLSKTNEHTKTPIRIILLCGILMASLASVTPIGTLAELVNIGTLFAFIVVCGGVLYLRRTHPDMERPFKTPFMPYVPILGIISCFYLILNLPWVTILRFIIWMLVGIAVYFAFSRTNSALSVEGDCAAE

SEQ ID NO: 55471 - protein, 491 aa, Helicobacter pylori 26695
MAQKTLLIITDGIGYRKDSDHNAFFHAKKPTYDLMFKTLPYSLIDTHGLSVGLPKGQMGNSEVGHMCIGAGRVLYQDLVKISLSLQNDELKNNPAFLNTIQKSPVVHLMGLMSDGGVHSHIEHFIALALECEKSHKKVCLHLITDGRDVAPKSALTYLKQMQNICNESIQIATISGRFYAMDRDKRFERIELAYHSLMGLNHTPLSPSEYIQSQYDKNITDEFIMPACFKNYCGMQDDESFIFINFRNDRAREIVSALGQKQFSGFKRQVFKKLHIATMTPYDNTFPYPVLFPKESVQNTLAEVVSQHNLTQSHIAETEKYAHVTFFINGGVETPFKNENRVLIQSPKVTTYDLKPEMSAKEVTLAVLEQMKLGTDLIIVNFANGDMVGHTGNFEASVKAVEAVDACLGEILSLAKKLDYAMLLTSDHGNCERMKDENQNPLTNHTAGSVYCFVLGDGVKSIKNGALNNIASSVLKLMGLKAPATMDEPLF

SEQ ID NO: 55472 - protein, 421 aa, Arabidopsis thaliana
MVIKGMRVGKYELGRTLGEGNSAKVKFAIDTLTGESFAIKIIEKSCITRLNVSFQIKREIRTLKVLKHPNIVRLHEVLASKTKIYMVLECVTGGDLFDRIVSKGKLSETQGRKMFQQLIDGVSYCHNKGVFHRDLKLENVLLDAKGHIKITDFGLSALSQHYREDGLLHTTCGSPNYVAPEVLANEGYDGAASDIWSCGVILYVILTGCLPFDDANLAVICRKIFKGDPPIPRWISLGAKTMIKRMLDPNPVTRVTIAGIKAHDWFKHDYTPSNYDDDDDVYLIQEDVFMMKEYEEEKSPDSPTIINAFQLIGMSSFLDLSGFFETEKLSERQIRFTSNSLAKDLLENIETIFTEMGFCLQKKHAKLKAIKEESTQKRQCGLSVTAEVFEISPSLNVVELRKSHGDSSLYKQVMMHSCNIS

SEQ ID NO: 55473 - protein, 144 aa, uncultured Frankia sp.
SRDPRNIAKKAETYLRGTGIADTAYFGPEAEFYIFDDVRYDYNPYGSMHQVDSVEAAWNTSRKEEGGNLGYKPRFKGGYFPVPPTDHFTDLRSEMTRVLYETGITVEMQHHEVGTAGQAEIDIRYDTLLKTADNLMLYKYVIRN

SEQ ID NO: 55474 - protein, 143 aa, uncultured Frankia sp.
SRDPRNIAKKAETYLRGTGIADTAYFGPEAEFYIFDDVRYDYNPYGSMHQVDSVEAAWNTARKEEGGNLGYKPRFKGGYFPVPPTDHFTDLRSEMTRVLYETGITVEMQHHEVGTAGQAEIDIRYDTLLKTADNLMLYKYVIR

SEQ ID NO: 55475 - protein, 406 aa, Streptomyces avermitilis MA-4680
MRRGGPSVLGIVLAGGEGKRLMPLTADRAKPAVTFGGTYRLVDFVLSNLVNADILRICVLTQYKSHSLDRHITTTWRMSSLLGNYITPVPAQQRLGPRWYLGSADAILQSLNLVYDERPEYIAVFGADHVYRMDPRQMLGEHIESGAGVTVAGIRVPRAESSSFGVIAPGSDGQTVENFLEKPADPPGLPGDPECVFASMGNYVFTTKVLIEALQRDAEDGDSVHDMGGSILPALTDRGEARLYDFSANHVPGETTRDQGYWRDVGTLDAYYDAHMDLIAERPAFNLFNRSWPIYTHSGQLSPARFNAGGIASESIISAGCLIRGQVTRSVLSPGVVVDPGAVVQGSVLHDNVHVGRGAVVRGAVLDKNVEVPPGATIGVNPGRDADLYTVSKGGVIGLGKGQRVS

SEQ ID NO: 55476 - protein, 144 aa, uncultured Frankia sp.
SRDPRNIAKKAETYLRGTGIADTAYFGPEAEFYIFDDVRYDYNPYGSMHQVDSVEAAWNTARKEEGGNLGYKPRFKGGYFPVPPTDHFTDLRSEMTRVLYETGITVEMQHHEVGTAGQAEIDIRYDTLLKTADNLMLYKYVIRN

SEQ ID NO: 55477 - protein, 1064 aa, Carboxydothermus hydrogenoformans Z-2901
MPKRTDIQKVMVIGSGPIVIGQAAEFDYAGTQACRALKEEGYEVVLVNSNPATIMTDANIADRVYIEPLTVEFLEKVIIQEKPQGIVATLGGQAGLNLTVELFERGILQRESVQVLGTPLEAIKKAEDRELFKETMLAIGEPVPESTIVTNVEDGLSFARSIGYPVIIRPAYTLGGSGGGIAHNDEEFKEICQRGLKQSLIQQVLVEKSVAGWKEIEYEVLRDAMDNAIIVCNMENIDPVGVHTGDSIVVAPSQTLSDKEYQLLRNASLKIIRALKIEGGCNVQFALDPKSFKYYVIEVNPRVSRSSALASKATGYPIAKVAAKIAVGLTLPEITNAVTGKTTAAFEPALDYVVVKIPRWPFDKFRTMDKRIGTQMKATGEVMAIDRTFEGALNKALRSLEIGVYGLSKKGLDLTKLEEKLKYPDDERLFYLREAIIQGYSLEKLSELTGIDQFFLKKIENIVRFEQKIARDDLTAELLLEAKKLNFSDREIAALKGLTEGEVRNLREKYGIKPVYKMVDTCAGEFEAKTPYFYSTYEKENEAKETSGKKAIVLGSGPIRIGQGIEFDYCSVHAVWTLREEGYKAVIINNNPETVSTDFDTSDRLYFDPLTFEDVKNIIDHEKPEGVVVQFGGQTAINLAKPLAQAGIKLFGSSVEAIDTAEDRQKFDAFLNSLGLKRPAGKGVFAISEAVQTAKEIGYPVVVRPSYVLGGRAMEIVYNEEELKNYMKWATQISPEHPVLIDRYLEGLEIEVDALADGKEVFIPGIMEHIERAGVHSGDSIAVYPTLHLDAEMIDKIYEYTCKIALGLGIKGLLNIQYVVYENELYVLEVNPRASRTIPFLSKITGVPMVKIATLLSLGKTLREVGYQGGILPTRNLWGVKAPVFSFAKLTNLDVSLGPEMKSTGEVMGVAQTFPEALYKALIASGIKVPLKGTVLATIADRDKEEAYAIIKKFADLGFRIFATEGTANFLTSKGLDVVKVKKLSEGTYNILDLLRDDQIQLVINTLTSGSQPEKEGFRIRRTAVELGVPCLTSLDTARAMANMLEYLIDKEEEIKVYALQDYH

SEQ ID NO: 55478 - protein, 466 aa, Escherichia coli K12
MDQKLLTDFRSELLDSRFGAKAISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 55479 - protein, 990 aa, Pichia pastoris
MPEPSISALSFTSFVTNDDKLFEETFNFYTKLGFHATRSYVKDNRSDFELTGISTDSIKEIWLESFPLSEVVETSAGRELRKPLQESVGYQSEALLGYSPYQSDGVVIKLRLSNHDLQKNKDLPGEVTFFTASIDKLRAKLIEIGAEIIPSEIDLVEFSTKDPMGDVISFSSYPSLSSKKKITSPDFFLHPKKEVRSQESIVEQVKSEEGKKKIAIITSGGDAPGMNAAVRAVTRAGIFYGCKVYACYEGYTGLVKGGDMLKELQWQDVRGLLSIGGTIIGTARSKEFRERWGRLQACYNMVSNGIDALVVCGGDGSLTGADLFRNEWPELIKELLGEGKITKEQYETHRNLTIVGLVGSIDNDMCGTDSTIGAYSSLERIIELVDYIDATAASHSRAFVVEVMGRHCGWLGLMSGIATGADYIFIPERPPSETNWKDDLKKVCLRHREKGRRKTTVIVAEGAIDDQLNPITSEEVKDVLVEIGLDTRITRLGHVQRGGAPCAFDRFLATVQGVDAVRAVLESTPAIPSPVISILENKIVRQPLVESVAQTKTVSDAIEAKDFDKALKLREQEFATSYESFLSVSKYDDGSYLVPESSRLNIAIIHVGAPTSALNPATRVATLNSLAKGHRVFAIRNGFAGLIRHGAVRELNWIDVEDWHNTGGSEIGTNRSLPSDDMGTVAYYFQQYKFDGLIIIGGFEAFTALYQLDAARAQYPIFNIPMCCLPATVSNNVPGTEYSLGSDTCLNTLSGYCDAVKQSASASRRRTFVVEVQGGYSGYLASYAGLITGALAVYTPENPINLQTVQEDIELLTRTYEEDDGKNRSGKIFIHNEKASKVYTTDLIAAIIGEAGKGRFESRTAVPGHVQQGKSPSSIDRVNACRLAIKCCNFIEDANFQVKHNANLSADERHLRFFCDDGVKTSAVSGKSSVIDDNTSVVIGIQGSEVTFTPVKQLWEKETHHKWRKGKNVHWEQLNIVSDLLSGRLSIRTT

SEQ ID NO: 55480 - protein, 698 aa, Erwinia carotovora subsp. atroseptica SCRI1043
MQKVLTVCPYCGSGCKINLLVENGKVVGAEGANGVTNEGELCLKGYYGWDFLNDTKLLTPRLKQPLIRRQKGAPFEAVSWDEAIGFASSRLKGIKEKYGAESIMHTGSSRGPGNETNYVMQKFARAVTGNNNVDCCARLCHGPSVAGLQVTLGNGAMSNSICEIEKTDCILIFGYNAADSHPIVARRILKAKARGAKIIVCDPRRIETARIADLWLPLKNGSNMALVNAFANVLINEGRYDKAYVARHTEGFEEFSQTVAKYTPEYVADITGLSPKLIRDAMRMYAAAPSATILWGMGVTQWGQGVDVVKGLSGLALLTGNLGRPNVGVGPVRGQNNVQGACDMGALPNMFPGYQNVTDKAVLAKFADAWGVPELSDKIGYSLTDLPHKIKEGKIRANYVMGEDPLQTEPDLSMLRDAFNELDLLIVQDIFMTKTAAIADVILPATSWGEHEGVYTAADRGFQRFYKAVEPQGDVKPDWEIISLMATALGYPMHYNNTQEIWDELRQLCPLYYGATYEKMAGLGYVPWPCPTEDSPGTPWLYANNHFDRPGGKGLLLTAEWRPPMELVDEDYPLVLCTVREVGHYSCRSMTGNCTALQTLADEPGYVQVNPHDAERLGICDQQLVWISSRRGKVISRVAVSERINKGAVYMTYQWWIGACNELTLDHLDPVSKTPEYKHCAVKLEAIDDQQAAENYVQ

SEQ ID NO: 55481 - protein, 552 aa, Ricinus communis
MATPNSGRAASVYSEVQSSRIEHVLPLPSVLNHPFKIVQGPPSSAAGNPDEIAKLFPNLFGQPSAMLVPDVADSLDSNQQLKIGLVLSGGQAPGGHNVISGIFDYLQDRAKGSILYGFRGGPAGIMKCNYVQLTADYIHPYRNQGGFDMICSGRDKIETPEQFKQAEETAGKLDLNGLVVIGGDDSNTNACLLAENFRSKNLKTRVIGCPKTIDGDLKCKEVPTSFGFDTACKIYSEMIGNVMIDARSTGKYYHFVRLMGRAASHITLECALQTHPNITIIGEEVAAKKLALKDVTDYIVDVICKRADLGYNYGVILIPEGLIDFIPEVQNLIAELNEILAHDVVDEGGLWKKKLTSQSLQLFEFLPVAIQEQLMLERDPHGNVQVAKIETEKMLIQMVETELEKRKQQGTYKAHFKGQSHFFGYEGRCGLPTNFDSTYCYALGYAAGALLHSGKTGLISSVGNLGAPVAEWTVGGTALTSLMDVERRHGKFKPVIKKAMVELEGAPFKKFASLREEWALKNRYVSPGPIQFMGPGSDAASHTLLLELGSVA

SEQ ID NO: 55482 - protein, 398 aa, Solanum lycopersicum
MMSVTCHNLEIGRTPLESLACGCSFSKGVLRNVSRRFSGKKLLSCRQEFGRISTKASLTGLAPVLDLNKSEKPISLTNVFEVVADDLLTLNKNLHNIVGAENPVLMSAAEQIFGAGGKRVRPALVFLVSRATAEMSGLKELTTNHRRLAEIIEMIHTASLIHDDVLDESDTRRGKETIHQLYGTRVAVLAGDFMFAQSSWYLANLENLEVIKLISQVIKDFASGEIKQASNLFDCDVGLDEYLLKSYYKTASLIAASTKGAAIFSEVGSDISEQMFQYGRNLGLSFQIVDDILDFTQSAAQLGKPAGSDLAKGNLTAPVLFALEKEPNLRNIIESEFHDAGSLEEAINLVKSCGGIQRAQDLAKEKADLAMQNLKCLPSSPFQAALEEIVKYNLERIE

SEQ ID NO: 55483 - protein, 481 aa, Glycine max
  misc_feature (341)..(341): Xaa can be any naturally occurring amino acid
  unsure (1)..(481): unsure at all Xaa locations
MSLGYAEKLSYIEDVGNVGMVEYFDPSHVLREKIDQLAIMIKKSKHLVVFTGAGISTSCGIPDFRGPKGIWTLQREGKALPEASLPFHRAAPSMTHMALVELEKAGILKFVISQNVDGLHLRSGIPREKLAELHGNSFMETCPSCALRYFRDFEVETIGLKETSRRCSVAKCGTRLKDTVLDWEDALPSKEMNPAEKHCKQADIVLCLGTSLQITPACNLPLKALRGGGKVVIVNLQKTPKDKKASLVIHGFVDKVIAGVMDQLNMQIHPFVRIDLFQIILVQALSNDERYVNWTLQVASVHGQKAALPFIESVEISFLDREDYKAAILDKQPFRLKRFSXRSYNKAFEMVLKLNFSDGCGCSSLEIDVPVDFKVSTDCFDFDKDYIFQKLRDKAVLESRCGQNAVIERKTILTPRSDVTTYAIVTNVVQYSKACKAALDSLSNGDFKKRKASVTGTGSSRKRSKGSSKCKSRSDNIRGHT

SEQ ID NO: 55484 - protein, 417 aa, Arabidopsis thaliana
MDLFSSLPDEVLCHILSFLTTKEAALASVVSKRWRNQFALVPNLDIDEEGKREREEILLSFMDFVDNVLALQADSPIKKFSLKCKTGVHPRRLDAWARLGPVLPMLKTLIIDSAWIRCDTIETFLPTFPVLEELSMSINEWPDWDETVTSASLRKLSIFTIGCENFSNPKSISFDIPSLVYFEYYDMVAEDYPKVNLTSVVEARISLLLDQDQIKRGRAPNNDEDDVLLRLRNGWKLMSGIRNVQKLYISLDTLQVLSLCCKSMPVFNNLKLLSVKTAENEGWEGMPVLLRNCPHLETLVFEGLRHFVTNKCGDACDYVSREDKGRSLVSCPVKKLQIKGFRGTIRELEMIKHFLYSFRCLEKVEIYAEEKGRTRTDLEVPGMFELIARMLRLYNEFYSCDVQFLVRSSLDKKWTAQ

SEQ ID NO: 55485 - protein, 952 aa, Photobacterium sp. SKA34
MKLTKRSDKVSKVENQLGISRRSFIRNTSLAAAGGVAGVSMFAPGMMKKAQAASEDVYDAPKVVKRTICSHCSVGCGIYAETQDGVWTHQEPAFDHPFNAGGHCAKGAALREHGHGARRVKYPMKLVNGKWKKLSWEQALDEVSQQVLKIREESGPDSVYFLGSAKHNNEQAYMFRKMVSMWGSNNVDHQARICHSTTVAGVANTWGYGAMTNSLNDMHNCKSMLFIGSNPAEAHPVAMQHILIAKETNSCKIVVVDPRRTRTAAKADHYVSLRPGTDVAFVWGVLYHIFNNGWEDKEFIRQRVYGMDEVRAEVAKWNPKEVERVTGVPEEQVYQTAKMLSENRPGCVVWCMGGTQHTTGNNNTRAYCILELALGNMGKSGGGANIFRGHDNVQGATDFGVLSDNLPGYYGLSEGAWKHWAQVWDVDYSWLQGRFDQNTYNGKKPMNSAGIPVSRWIDGVLENKDKIEQRDNIRAMFYWGHAVNSQTRGPEMKTAMEKLDMMVIVDPYPGVAAVMNGRTDNVYLFPATTQFETYGSVTATNRSIQWRDQVIEPLFEAKPDHEIMYLLSKRLGFADQLFKNIKVENNRPHIEDITREFNKGMWTIGYTGQSRERLKEHQQNWHTFNRTSLEAIGGPANGETYGLPWPCWGTPEMKHPGTHILYDTSKTVAQGGGNFRARFGVEHNGVSLLADDSYSLGCELEDGYPEFTAKMLKQLGWWDDLTAEEKVAAEGKNWKTDLSGGIQRVAIKHGCIPYGNAKARTVVWTFPDAVPIHREPLYTPRRDLLPEYQTWDDKAHLFRLPTLYKSIQDKDMSKEYPIILTSGRLVEYEGGGEETRSNPWLAELQQEMFVELNLKDANDRGIKDGEMVWVEGAEKGRIKVKAMVTPRVREGLAFLPFHFGGEFEGESLRSHYPEGCSPYVSGEAANTATTYGYDPVTQMQETKVTLCKITKA

SEQ ID NO: 55486 - protein, 190 aa, Zea mays
MAGKKRKSTEKQPKGSRLPLGADADAVADAGKRRRSGAAKRHQAEEEESVPSSISAKILREALRQQQEEGLADSRHAAAAATPAAPAVSAAPSTSFPVPAADGGDDDDEDVDEFDGFDALSEYDGGVPEIDEEDEKALAAFMSKDTSSKQSLGDIILQKIREKDAPVSTEARPAVKLDSRIIELYKEVGQ

SEQ ID NO: 55487 - protein, 426 aa, Triticum aestivum
MDDDAGDASPPPGPVPPAATGASSSRDMAASPTSSRSVTETVNGSHRFVIQGYSLAKGMGVGKHIASETFTVGGYQWAIYFYPDGKNPEDNSAYVSVFIALASEGTDVRALFELTLQDQSGKGKHKVHSHFDRSLESGPYTLKYRGSMWGYKRFFRRTALETSDFLKDDCLRINCTVGVVVSTIDYSRPHSIQVPDSDIGYHFGSLLDSNEGVDVILNVSGERFHAHKLVLAARSTVFRSKLFGDESEGDKNEVNESEDLKEIVIDDLEPKVFKAMLHFIYRDTLVDDYELDASSSMGSIFDTLAAKLLAAADKYDLGRLRFLCESYLCKGISVASVANTLALADSHHAMELKAVCLKFAAENLSAVIRTDGFDYLKDNCPSLQSEILRTVAGCEEPCSSGGKSQSVWGQLSDGGDTSGRRVRPRI

SEQ ID NO: 55488 - protein, 349 aa, Psychrobacter arcticus 273-4
MTCTSLSNVAAPLSTAPSVNLSTTPTYANIQSIVADDFEIMDKQVFGSLNSKVQLVMNVSQHVINAGGKRMRPLITLLCARMFNDEPSQQAMHLAAITEMLHTATLVHDDVIDESGQRRGKATANATWDNATAVLVGDYLIARAFNLLVGFQSLPLLQVFSDGTCDIAEGEVLQLQHQHNPEATEQDYLNIIDGKTSRLFMMATQGAAILQGQIQHLQALADFGQHFGNAFQIIDDVLDYSGDSELMGKNLGDDLAEGKPTLPTIKALELLKDSNKEDYEQLRIAVQTGKTPNAEQLIALVRHSGSLEYCKQRALEETKLAQQALSSLPDNRYRQGLYQLTELASARLL

SEQ ID NO: 55489 - protein, 144 aa, Glycine max
  misc_feature (126)..(126): Xaa can be any naturally occurring amino acid
  unsure (1)..(144): unsure at all Xaa locations
PLIRPRVRPHVGVLTKQHGGLTNKHFLNKFSPNTLWQPYLNAYKYVGETDTLDCTLHGYTSAAITSTLFHQMIKGAATIVTHTFIYPVTINYPFEKGPLSTPFLSEHSLLRYPYGQEPCIACKLCXAICSAHAITIETETLPDS

SEQ ID NO: 55490 - protein, 486 aa, Zea mays
PTRPGRGTFGHVYAGFNSDKGEMCAMKEVTLFSDDPKSKESAKQLCQEISLLSRLQHPNIVRYYGSETVDDKLYIYLEYVSGGSIHKLLQEYGQFGEQAIRSYTKQILLGLAFLHAKNTVHRDIKGANILVDPNGRVKLADFGMAKHINGQQCPFSFKGSPYWMAPEVIKNASGCNLAVDIWSLGCTVLEMATSKPPWSQYEGIAAMFKIGNSKELPPIPDHLSEEGKDFIRQCLQRDPSSRPTAVDLLQHPFVGNAPPLEKSSASHPLEQLTTISCRTNWKVVEHARNMSSLGLEGRYQSILQRRAAKFSLPNSDIRIQSNISCPVSPCGSPLLRSRSPQHQNGRMSPSPISSPRTTSGASTPLTGGSGAVPLNHLRQPAYRNEGFTVTSRGFDDHIPSRLVDPVHGRFIRVQQLSAGRQERVVSEADILSSQFGKMRHANVWDPHDRPLPSERSSQQCFGDHAKLKPSLDLRSGPLHPGRNHGH

SEQ ID NO: 55491 - protein, 379 aa, Nicotiana tabacum
MAIDCMITNVNSPMLRILEDDKKPLIFDASQMKREYNIPTQFIWPDDEKPRAVARELPVPLIDLGGFLSGDPVAAQQASRLVGEACRNHGFFLVVNHGVNANLISNAHRYMDMFFDLPLSEKQKAQRKLEEHCGYASSFTGRFSSKLPWKETLSFRYSAEEDSSHIVEEYFQNTMGESFSHLGNVYQEYCNSMSTLSLGIMELLGMSLGVGREHFKEFFEENESIMRLNYYPPCQKPDLTLGTGPHCDPTSLTILHQDSVGGLQVFVDNEWRSVSPNFNAFVVNIGDTFMALSNGRYKSCLHRAVVNNKTPRKSLAFFLCPKKDKVVSPPNELVDTNNPRIYPDFTWPTLLEFTQKHYRADMNTLQTFSNWLKQKTAQV

SEQ ID NO: 55492 - protein, 717 aa, Zea mays
MSRVASLSPSLSGDEVEVEEEEEGEGVDGYRKGGYHAVRPGDQFAAGRYVAQRKLGWGNFSTVWLAFDVQSQRYVALKIQKSAPEFAQAALHEIEFLSEITKKDPSNCKCIIQLIDHFKHTGPNGQHICLVFELLGDSLLKLVQYNRYKGIGLDRVRQICKSILVGLDYLHNELGIIHSDLKLENLLLLSTIDPSKDPIRSGLKPCLERPEGNPNGEGGINAIEKKLKMRARRVLAKLAEKRKSAVESSRSERSLDGIDMTCKIVDFGNACWADKQFTDFIQTRQYRAPEIILGAGYSFSVDMWSFACIAFELATGEILFTPKEGHGYSEDEDHLALMMELLGKMPKKIATMGTRSKEYFDRHGDLKRIRRLKLSSIERVLVDKYKISESDAREFANFLCPLLDFAPEKRPTALGCLKHPWLHYNEDKTCQSLNNNDAKNIDLAQSPGSITSGNCTNIDLTSKKGSSTGTCDKTVDAKYNTRSITSNATMNTYVQPTSGSFANRLAKNVDVNPNIGSISNRDAKSSDMKAHMGSNTISDAKSSIVKLDTGNITDRNAKPVDIKPNSDNISSRDDKSSNVDTTTSSVVNKDAKRSIRSVVNSYIKNFDAKCNTGSTANSDARDPSDTKSSTKIVSSADNAKCVDIKPINGSDKSNDTSDKSNDTVDANVKSNSGIVANSDASNTDVQTNTGSVNNSDDYSIDSKPNSMPRCCQLTEPN

SEQ ID NO: 55493 - protein, 402 aa, Prochlorococcus marinus subsp. marinus str. CCMP1375
MAKRSLSNLSVEDLCGKRVLVRVDFNVPLNEEGSITDDTRIRAALPTIQHLIEKEARVILSAHFGRPKGKVNEDMRLTPVSQRLSELLGKTVVKTESCIGPDAEKKVHEMSNGDVVLLENVRFIGEEEKNDSEFAKKLASLAEVYVNDAFGAAHRAHASTEGVTNYLSPSVAGYLMEKELKYLQGAIDSPQRPLAAIVGGSKVSSKIGVLESLIDKCDKVLIGGGMIFTFYKARGLSVGKSLVEDDKLDLARALEKKAKEKGVQLLLPSDVVLADNFSPDASSQMVQIDSIPEGWMGLDIGKESVKLFQDALADCKTVIWNGPMGVFEFDKFANGTNSISTTLAELSAKGCCTIIGGGDSVAAVEKAGLASKMSHISTGGGASLELLEGKVLPGVAALDDEI

SEQ ID NO: 55494 - protein, 481 aa, Nicotiana tabacum
MASATASHTLCGIPATSSSTTNKAIAPSSARFLAKTPLRRLGFAGAAADSLFTNHVATKLRSLKSSSKPIRGVASMAKKSVGDLTAAELKGKKVFVRADLNVPLDDNQNITDDTRIRAAVPTIKHLMANGAKVILSSHLGRPKGVTPKYSLAPLVPRLSELLGIQVVKVEDCIGPEVEKLVASLPEGGVLLLENVRFYKEEEKNEPEFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATSLLEKAKAKGVSLLLPSDVVIADKFAPDANSKIVPASAIPDGWMGLDIGPDSVKTFNDALDTTKTVIWNGPMGVFEFDKFAVGTEAIAKKLADLSGKGVTTIIGGGDSVAAVEKVGVASVMSHISTGGGASLELLEGKVLPGVIALDEADAPVAV

SEQ ID NO: 55495 - protein, 401 aa, Nicotiana tabacum
MAVKKSVGSLKEADLKGKRVFVRVDLNVPLDENFNITDDTRIRAAVPTIKYLMQHGSHVILASHLGRPKGVTPKYSLKPLVPRLSELLGVEVKIANDSIGPEVEKLVAEIPEGGVLLLENVRFYKEEEKNEPEFAKKLASLADLYVNDAFGTAHRAHASTEGVAKYLKPAVAGFLMQKELDYLVGAVANPQKPFAAIVGGSKVSSKIGVIESLLEKVDVLLLGGGMIFTFYKAQGYAVGSSLVEEDKLDLATSLMEKAKAKGVSLLLPTDVVIADKFAADANSKVVPASEIPDGWMGLDIGPDAIKSFGSALDTTKTVIWNGPMGVFEFDKFAAGTEAIAKKLAELSGKGVTTIIGGGDSVAAVEKVGLAEKMSHISTGGGASLELLEGKPLPGVLALDDA

SEQ ID NO: 55496 - protein, 305 aa, Zea mays
MGGSEDDEPPSKRARTSSVESASLPDCFSFSKFSNPLGSTMARPLPSQGKEVMVGSKGVIKKEEFVRIITKTLYSLGYEKSGAVLEEESGIILHNPMVKLFREQVIDGNWDNAVVTMNTIGLQDENILKSAAFLILEQKFFELLKNDNVMGAMKTLRCEITPLGVNRKRVHELSTCMISCSSQQLFLGFSKLGIDSSSSRLKLLEELQKVLPPTVMVPERRLENLVEQALTVQRDACYFHNSVDGLSLYIDHHCGKDQLPSRTLQTDSDYWLLTEGDVSMTDMWKTERILDNHSLSWFKIICSVM

SEQ ID NO: 55497 - protein, 462 aa, Lactobacillus johnsonii NCC 533
MKLNPFRKESLKRYLGTDKHFVKTLGAFDLLTIGIGAVIGTGIFILPGTVAAKEAGPGVTLSFLIAALVCTLASMCYAELSSSIPVAGSAYSYGNILYGEVIGWILGWALILEYMLSVAAVSAGWASYFNSLLHSFGLHIPHHFEGPFDPLNGTYLNLWAVISVLLIGILLSRGMKASMKFNNAAVLIKIAIIFIFIGVGLFFIKPKNYQPFTPYGTTGVLRGATTVFFAFLGFDVVSSSAAEVKNPKKNMPIGIIGTLIVAALLYMGVSVVLTGMVNYKQLDVANPVAYALKVVNQGWVADLLSIGAIVGMSTMMLTMIYSSSRLIYSIGRDGLLPSFLGKIDKHGLPENALWIVTIVIAIMGGLFSLEELTSLVSIGTLLAFTFVSFGVILLRRRKDIPEGDFKVPFYPVIPILSGLACIGMMCFLSVKTYIFASVWFLFGLFIYCVYGYKHSKISKRNN

SEQ ID NO: 55498 - protein, 394 aa, Carboxydothermus hydrogenoformans Z-2901
MNKKSIRDVEVKGKKVFVRVDFNVPLNENREITDDTRIRAALPTLQYLREQGAKLIVASHLGRPKGQFNEKYSLKPVAKRLAELLGIEVKMAPDVVGPEVEKMAGELRPGEVLLLENVRFYPEEEKNDPEFARKLARLAEIFVSDAFGAAHRAHASTAGIASYLPAVAGFLMEKEINFLSRALNNPERPFVAIIGGAKVSDKIGVIENLLGKVDVLLIGGGMANTFLKAMGYETGKSLVEEDKVNLAGELMNKAKEVGVKLLLPSDVVVAPRIEAGVPSKIVAVDSIPAEEMALDIGEKTAKHFREEILKAKTVVWNGPMGVFEVEPFDRGTVAVAEAVAESGALSVVGGGDSVAAVEKAGVADKITHISTGGGASLEFLEGKKLPGVEVLNDK

SEQ ID NO: 55499 - protein, 865 aa, Anaerobranca horikoshii
MFKLRKLTPFVLLLFIMAFLAGCGGKDVTQPPPQEEEEDLSKYYPGPPPLPDFEVKTTLIINYHRYEGDYRPWDLWVWADGKEGKAYQFTELTDYGVRATIYFPEEYNRLGFIVRRGNWSAKDVDRDRFVDVVDGKAEIWLLQSDPNIYFSQDEVNKNPRIVSAYMDGKDEIIVSLTHQHKLTDGDNGFVIKGENKEYNVKKVEIVGSGSSGNVLKLTLEKELDITANYTIESPDYTGNYVIKRRVLDLPEFYYAGDDLGNTYTKNSTKFRVWAPTALNVKVRIYNTADAKEGKDYDMKKDVNGTWFLEIKGDLKNKYYTYIVDHGYIVNEAVDPYVRAVSLNSTKGMIVDLKETNPKGWDSFKKPEFKNYTDAIIYEMHVRDFSIYPQSGNKYKGKYLGLIEKGTTGPGGVKTGLDHLVELGITHIHLLPTYDFASIDDSRDDQYNWGYDPRLYNVPQGTYSTNAADGLTRIREYKEMVMGLNRAGIRVIKDVVYNHTYTVGDSPFDLIVPKYFYRTDDKGNYTNGSGCGNEIASERPMVRKFIVDSVKYWATEYKIDGFRFDLMALHDVDTMLEVQQALHQIDPSIIIYGEPWQAGGSPLPANLQFTKGKQRGTKIAVFNDHIRNAIKGDTDGATKGYAQGMVNQRNNVIKGIMGAIDDFAQEPTESIVYVTCHDNLTLWDKIEKSNPNDSEEDRIRMNLLSNAIVLTSQGVPFLHGGVEMMRTKYGDHNSYKSPDHINQIEWSRKHTYYEEFLYHQGLIRLRREHPAFRMPTAEMVRKHMEILDSPDGSIMFHLKDNANGDPWKDIVVIYNPNGHDITVNLPKGGTWNIVVKDKKAGVDTLETVNGSSVKVPRISMMVLYQN

SEQ ID NO: 55500 - protein, 398 aa, Saccharomyces cerevisiae
MVSLTFKNFKKEKVPLDLEPSNTILETKTKLAQSISCEESQIKLIYSGKVLQDSKTVSECGLKDGDQVVFMVSQKKSTKTKVTEPPIAPESATTPGRENSTEASPSTDASAAPAATAPEGSQPQEEQTATTERTESASTPGFVVGTERNETIERIMEMGYQREEVERALRAAFNNPDRAVEYLLMGIPENLRQPEPQQQTAAAAEQPSTAATTAEQPAEDDLFAQAAQGGNASSGALGTTGGATDAAQGGPPGSIGLTVEDLLSLRQVVSGNPEALRPLLENISARYPQLREHIMANPEVFVSMLLEAVGDNMQDVMEGADDMVEGEDIEVTGEAAAAGLGQGEGEGSFQVDYTPEDDQAISRLCELGFERDLVIQVYFACDKNEEAAANILFSDHAD

SEQ ID NO: 55501 - protein, 377 aa, Triticum aestivum
MMAAQPTANPGVRLGWKAPGALASPPRLALSRSAAAPLASHRVGRGKFSAAAITTDDYLPMRSTEVKNRTSVDGIKSLRLITAVKTPYLPDGRFDLEAYDSLINTQINGGAEGVIVGGTTGEGHLMSWDEHIMLIGHTVNCFGTNIKVIGNTGSNSTREAIHASEQGFAVGMHAALHVNPYYGKTSTAGLISHFDEVLPMGPTIIYNVPSRTGQDIPPAVIEALSSYPNMAGVKECVGHERVKCYTDKGITIWSGNDDECHDSRWKYGATGVISVTSNLVPGLMRSLMFEGENAALNEKLLPLMKWLFSEPNPIGLNTALAQLGVVRPVFRRPYAPLSLEKRTEFVRIVEAIGRENFVGQKEVRVLDDDDFVLISRY

SEQ ID NO: 55502 - protein, 385 aa, Bordetella pertussis Tohama I
MAKRDYYEVLGVAKNASDEDLKKAYRKLAMKYHPDRNPDSKEAEEKFKEAKEAYEVLGDEQKRAAYDRYGHAGVDPNAAGMGGGMGGGMGGGMGGGMGGGFADAFGDIFGEIFGAGRRGGGGPQVYRGADLKYALEITLEQAASGFDTEIRVPSWENCDTCHGSGAKAGTSPKTCRTCGGSGAVRMQQGFFSVQQTCPTCHGTGKEITDPCPSCDGVGRTRRNKTLQVKIPAGIDDGMRIRSSGNGEPGINGGPPGDLYVEIHIKQHKIFQRDGDDLHCELTIPFTTAALGGELQVPTLGGKAEISIPEGTQSGKTFRLRAKGIRGVRGSYPGDLYCHVVVETPVRLSDEQKAILRQFEASLNDGGDRHSPQSKSWTDRVKEFFS

SEQ ID NO: 55503 - protein, 445 aa, Pisum sativum
GGFSVVRKGTRKSNNDDEKSQSQSKSQSQSQVAIKTLRRLGTSNNLPRKKDGGENSTETMMKFPTMRQVSVSDALLTNEILVMRRIVENVSPHPNVIDLYDVYEDTNGVHLVLELCSGGELFDRIVAQDKYSETEASTVVHQIVAGLEAIHRANIIHRDLKPENCLFLDVGKDSSLKIMDFGLSSVEEFTDPVVGLFGSIDYVSPEALSQGKITTKSDMWSLGVILYILLSGYPPFIAQNNRQKQQMILNGNFSFYEKTWKGISQSAKNLISSLLTVDPAKRPSAQELLSDPWVKGEKAKDDQMDPEIVSRLQRFNARRKLRAAAIASVWSSTIFLRTKKLKSLVGSYDLKEDEIENLRMHFKKICADRDNATLCEFEEVLKAMKMPSLIPFAARIFDLFDNNRDGTVDMREILCGFSSLKNSKGEDALRLCFQMYDTDRSGCIT

SEQ ID NO: 55504 - protein, 159 aa, Glycine max
  misc_feature (122)..(122): Xaa can be any naturally occurring amino acid
  misc_feature (138)..(138): Xaa can be any naturally occurring amino acid
  unsure (1)..(159): unsure at all Xaa locations
MVGGDSSPPRALDAETREDLKRVSAHRALHMVESGVTLGFGTGSTAAHAFNRFGAFFRTGALRAVAGVPTSLKTEAHAARVGIPMLALAEGGQDPLLIDGRDEDRPGLHLFKGGGGSLLREXMIEGAGARFVVIVDEXKLVPRLGWTGFVPREDVPFGA

SEQ ID NO: 55505 - protein, 448 aa, Streptococcus pyogenes M1 GAS
MAITVADIRREVKEKNVTFLRLMFTDIMGVMKNVEIPATKEQLDKVLSNKVMFDGSSIEGFVRINESDMYLYPDLDTWIVFPWGDENGAVAGLICDIYTAEGKPFAGDPRGNLKRALKHMNEIGYKSFNLGPEPEFFLFKMDDKGNPTLEVNDNGGYFDLAPIDLADNTRREIVNILTKMGFEVEASHHEVAVGQHEIDFKYADVLKACDNIQIFKLVVKTIAREHGLYATFMAKPKFGIAGSGMHCNMSLFDNQGNNAFYDEADKRGMQLSEDAYYFLGGLMKHAYNYTAITNPTVNSYKRLVPGYEAPVYVAWAGSNRSPLIRVPASRGMGTRLELRSVDPTANPYLALAVLLEAGLDGIINKIEAPEPVEANIYTMTMEERNEAGIIDLPSTLHNALKALQKDDVVQKALGYHIYTNFLEAKRIEWSSYATFVSQWEIDHYIHNY

SEQ ID NO: 55506 - protein, 406 aa, Arabidopsis thaliana
MYAGEAELVVEGVEAVAEMVEKVATATDEMAEEMAEKLPEKNKLKQVALVLEHISEVAAHEAHLTQDFLHKSFGFAREFYCKQVLSKGIDIDPICVISWILNVLELDLHVSVDRGIGSDNVYFDFTNRSVSSKTFKRLKLCCIDYDQNPDTVSFDTPNLVYLEYSDYVAVKYPRVKFCSLVEASLNLQMTYDQCAQASYGFLVGNATDFLMGVSNVQILHLSDKSLEVLTFCCETIPVFNRLIHLTIKTHRHGEVGWESLPALLKNCPNLETLVFQGLHHKDTIKCEEVVGCLCKYFEDIPTCLSSSPVKVVKVLKFGETFFNYDDMKKQLEQDKHFLETMPNLEQMILYYNTPYDNDVLEVSKQLQILPRVASTKCKIQVISDNLSLSFSFSTSGLTFFNSTFPV

SEQ ID NO: 55507 - protein, 398 aa, Streptococcus pyogenes M1 GAS
MAKLTVKDVDLKGKKVLVRVDFNVPLKDGVITNDNRITAALPTIKYIIEQGGRAILFSHLGRVKEEADKEGKSLAPVAADLAAKLGQDVVFPGVTRGSKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKDLLEKSNGKLILPVDSKEANAFAGYTEVRDTEGEAVSEGFLGLDIGPKSIAEFDQALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 55508 - protein, 465 aa, Lactobacillus johnsonii NCC 533
MKNFFKKVPVNTFLKADSRLTRHLNARDLVALGIGAVIGTGIFILPGHEAAQHAGPAVAISFLLAAIVSGMVGMAYAEFSSAMPVAGSAYSFGSVIYGEVVGWIIGWGLLLEYFLAVSAEATGFASYFNNNILAPIGIHLPKALEAGPMEGGVINISAVLIVLIVALILYQGANLSKRVENIAVIIKVAIIILFIVIGMFYIKADNYVPFYPKKFQTPPLGIGGISTAAATVFFAFIGFDALAANSAETKDPEKNVVKGIMGTVIIAVLLYVSFSLVLTGMVNYKQLNVDDPAAYALKVVGLTAWNKLITVGALVGIFTAMITMLLGGSRLLYALGRDGLLPDSMGSVHAKKMIPDHAVIVSTIVAAVFAGLVPLMELASLINAGTLIAFALISFGIIPLRHRKDIVNDGFKMPLYPVLPVIAGLLSVYFIWMLPNTTKIMVGIWLIVGIIVYATYGIKHSKLQN

SEQ ID NO: 55509 - protein, 432 aa, Prochlorococcus marinus subsp. marinus str. CCMP1375
MIDSLDLVIDSIFAREVLDSRGNPTVEAEVLLEGGAKGRAIVPSGASTGAYEAHELRDGGTRYMGKGVLRVVEHIEDRIAPSLCGLSASDQVNVDQIMRELDGTENKENLGANAILAVSIATARSAANAFGMPLYRYLGNPMSSLLPVPLMNVINGGAHAANNLDFQEFMLVPHGAESFREALRMGAEVFHTLKKLLSDKGLSTAVGDEGGFAPDLENNNAAGDLLVQAIEKAGFRPGEEISLALDVASTEFFKNGLYHFGEGKFSSEKMVEELKKLVNLYPIISIEDGLSEDDWSGWELLTKELGNKVQLVGDDLFVTNTKRLRQGIDRSIANSILIKVNQIGTLTETLEAIDLSHRMGYTSIISHRSGETEDTTIADLAVATRAGQIKTGSLSRSERVAKYNQLLRIEDQLGAQAVYAGSVGLGPRGLSK

SEQ ID NO: 55510 - protein, 196 aa, Brassica napus
  misc_feature (191)..(191): Xaa can be any naturally occurring amino acid
  unsure (1)..(196): unsure at all Xaa locations
KRQRAAQSWMQRAIQDNRYKESVRAAIYQKRAAAESKRMGILEAERRRANTRLRQVFGAASSVQSQKEAERRKMKDRLEERLQRAKKLKAQYLRRGRGVDGARQRSETMRKKQAHLVRMLERCWRRFAKYKKSTILLASAYRDLGIDAKSIESVPFEQLAIQMNSVAVIRTVKELLDRLEIRLTLSQGSMXKNINH

SEQ ID NO: 55511 - protein, 456 aa, Arabidopsis thaliana
MAVAISGSSLISSTLQHYNNRIYIRDYPIPCHSSNPICNSFNFKRRSFSPSSPKFNDHVVNPSSSYLSSKLSPIRTHSSFAACGCSWIQDNSMVHDYATTTNGTSKRCSALPTTNTVDVSSVSDLFEFICSGPLVNKIGITPQRVGQSIDKWLLYGSQLCRLFQLNELKLTIPQKARLYHYYIPVFIWCEDQIALHNSKFKDGDDVPPLVIGFSAPQGCGKTTLVFALDYLFKTTKKKPATISVDDFYLTAEGQAELRKKNPGNALLEYRGNAGSHDLKLSVETLEALSKLTKEGLKMKVPRYNKSAYSGRGDRADSSTWPEVEGPLSVILFEGWMLGFKPLPADVVKAVDPQLEVVNKNLEAYYDAWDKYIDAWVVIKIQDPSYVYRWRLQAEIAMRQDGQAGMSDEEVNDFVSRYLPAYKAYLPTLYAEGPSGSDPDRVLAIDIDEERNPILAN

SEQ ID NO: 55512 - protein, 485 aa, Arabidopsis thaliana
  misc_feature (404)..(404): Xaa can be any naturally occurring amino acid
  unsure (1)..(485): unsure at all Xaa locations
MAMASLYRRSLPSPPAIDFSSAEGKLIFNEALQKGTMEGFFRLISYFQTQSEPAYCGLASLSVVLNALSIDPGRKWKGPWRWFDESMLDCCEPLEVVKEKGISFGKVVCLAHCSGAKVEAFRTSQSTIDDFRKFVVKCTSSENCHMISTYHRGVFKQTGTGHFSPIGGYNAERDMALILDVARFKYPPHWVPLKLLWEAMDSIDQSTGKRRGFMLISRPHREPGLLYTLSCKDESWIEIAKYLKEDVPRLVSSQHVDSVEKIISVVFKSLPSNFNQFIRWVAEIRITEDSNQNLSAEEKSRLKLKQLVLKEVHETELFKHINKFLSTVGYEDSLTYAAAKACCQGAEILSGSPSKEFCCRETCVKCIKGPDDSEGTVVTGVVVRDGNEQKVDLLVPSTQTECEXGPEATYPAGNDVFTALLLALPPQTWSGIKDQALMHEMKQLISMASLPTLLQEEVLHLRRQLQLLKRCQENKEEDDLAAPAY

SEQ ID NO: 55513 - protein, 398 aa, Chrysodidymus synuroideus
MLLKEKTLIRNLKNFTINFGPQHPAAHGVLRLILELDGEIIVNSDPHIGLLHRGTEKLIEYKTYLQALPYFDRLDYVSMMAQEHTYSLAIEKLMNIKIPRRAQIIRVLFCEITRLLNHLVAVGCHALDVGAMSPFMWGFEEREKLMEFYERVSGARMHAAYFRPGGVASDLPIGLLDDIFIFIKQFKIRLDEMEEMLTSNRIWKERLVDIGIVSAFDAINWGFSGVLLRGSGVPWDLRKSNPYEIYNELNFSYPVGTNGDCYDRYLIRIEEMRQSLSLISQCLNIINDGPIKTTNSKLTSPSLFELKNSMESLIHHFKYYTEGLIPGFGETYTATEAPKGEFGVYLISNNTEKPYRCKIKAPGFGHLQALNFMASGHMIADVVTIIGTQDIVFGEVDR

SEQ ID NO: 55514 - protein, 238 aa, Chromobacterium violaceum ATCC 12472
MPQADFTLLFDLDGTLTDTDELHFRAFRALLAEHGRELDHDGYLRHVHGSTNEAIMRALLPGIPERHRELAERKEQLFRASVGQLRPTPGALRLFDWAQAKGAAVAVVTNAPRANAELMLDGLGLASRVDALVIGDELAYGKPHPLPYLAGLARVGGRAERACAFEDSPSGIRAAKQAGLRTFAIAGMLPEVALREAGADSVIADFNSPELWQWLERASATASLNGRLGHVLNANRRL

SEQ ID NO: 55515 - protein, 1122 aa, Cryptococcus neoformans var. neoformans JEC21
MTSALLPTGQTLKGSAIMSQDFSIYREPADYHHSRLRDNISTGGSHYARSASHAYSEPASSQNFANSSPSPYPAQYRTPEEYIATPDSTVPIQQQQQAVYSRQAQAQAQQQQQMYQQQVYAQSGHPLSSQVAGPSSYRKPSANSVPSSSTIPEYRDGQASGNMSIIQGVNGHGGVERRDRGNRMTDPDAENDGRVGVEDPRADRVYTELKCLGDGSFGTVWLCDWHSPVKPDVLLSAMQCGAGARPEWSGKRLVALKRMKRVWEGGWTQAKSLGELVSLRNIPPHPAIIPLYDAFISPKSRELYFVFECMEGNLYQLTKSRRGRPLAAGLIASCFHQISSGLYHIHGHGYFHRDMKPENLLITTTGLADYLTAEALAEINMAGGDINRVGDLAYEKDVSVIVKLADFGLARATNSKPPYTEYVSTRWYRAPEVLLRSSEYGPPVDMWALGTILAEMLNLKPLFPGVSEIDQVYRICDTMGDPSSEYGVDERGMTIGGGPWNSGIKLAKNVGFSFPKRKPVRFRSLFNDSVPQSLVDCIADLLRYNPKYRMTAAQCIDHPYFHETLPHLQQTLPLPRIPFSAGQPPPHAIPRPTLSTARPAFANGDIRTLPPPIGTPDSQASSQRAFFPQHIPPHVSSSSLVHQLRELDLPTDDLGSYGQRPPEAAAADARAAQYAQSPVQLHQWVGDLQIDSRKPSAAQSMMYDSSVTEESQGGRSNQSLPNYSNVSLEQQPQVQVPPQSGQSAQSYGRSNISVAAYVQQQQRYAQEAPAQQVTAPAAPPPIEPTVGAARAEKLGVTSKKKKWGLSSVFGGADKSTASLAAVDEHEYSGTSLKRTQSGHRTIDRNPSVAGSSLTLGVPALGMNSSAGASSISVLDDPKKAKKEAERQAKELAKAQREAAALKQKERARAVMQKRNQLIESRSQLKTKGEIEYSSTNLASEAPTPNQDTRSIYASSSASVNQMRNYAASPVNQSLQSIRSQDSGHSGHSGHSGHSGHSGRSGRSGRSGLNASALADLDEHGRWDEMRHKARRRDDDDDHSMSSFGHNPLRSRSVLTVGTVDSDPGPRRRSEWADPLLRRDKRTTSASSASLQYQQSAQTLPSFSDIANYAFEGRNKQSQPPQQ

SEQ ID NO: 55516 - protein, 431 aa, Legionella pneumophila str. Paris
MDMDIKHKPLKRELSLFGATMMGLGSIVGTGVFVSIGIAAGVTGPSVILAIALAALVATCNAFSSAQLAANHAVSGGTYEYGYRYLHPAFGFTAGWMFLCAKSASAATAALGFAGYFIHLSGLETVPVIPIALAVSITLILLVLSGLRRTNTVNIIIVMITLITLTVFIISGLPDFMQRGTANLRPFFPVSKQEGLSHFFYATALMFVAYTGYGRIATLAEEVKNPGKFIPAAIIITLMVSAVLYILVGLVAIGAVGVEKLAQVTETNATPLESAAQAIGIPGLSVLVSIGACTAMLGVLLNLILGLSRVALAMGRKGDLPKIFCYVSETRHVPVSSVIGVGVVIIALVLTGSVETTWTFSAFTVLIYYAITNLAALHLPKEEQLYPPLFAIGGLLSCLFLAFWVPIGVWITGISLLVLGLLWKVVANRFL

SEQ ID NO: 55517 - protein, 129 aa, Brassica napus
MTLYIRRESSKLWKRFCSEITTEIGLLAENWKYLVAGIICRYIHGLAAKGVHYIHRPGPTLQDLGFFLLPELGQERSYISETVFTSVFLSFFLWTFHPFILKSKKIYTVWIWCRVLAFLVACQFLRVIT

SEQ ID NO: 55518 - protein, 497 aa, Oryza sativa
MPTLNLDLPNGIKSTVQAELFINNKFVPALDGKTFATVNPSNGKEIGQVAEASAKDVDVAVKAAREAFDTVWGENTPGDARGKLLMKLADLVEEHVDELAAIESLDNGKAFSIAKGFDVAAVAANLRYYGGWADKNHGKVMEVDTKRLNYTRHEPIGVCGQIIPWNFPLLMFAWKLGPALATGNTIVLKTAEQTPLSALKMCELIVEAGFPAGVVNVVSGFGPVAGAAISQHMDIDKIAFTSSTLVGRNIMKAAASTNLKKVTLELGGKSPNIVFKDADLDQAVRWSAFGIMFNHGQCCCAGPRVYVEESIYDQFMEKMTAYCKGLQVGDPFAENTFQGPQVSQLQYDRIMEYIESGKKDANLHLGGVRKGNEGYFIEPTIFTDVPHDAKIAKEEIFGPVVVVSKFKDEKDLIRIANDSIYGLAAAVFSRDVSRALETAHKLKAGTVWVNCYNMLVPQVPFGGYKASGIGRELGEYALANYTNIKAVHVNLSIPAPI

SEQ ID NO: 55519 - protein, 434 aa, Bacillus thuringiensis serovar konkukian str. 97-27
MVVEFTKSEALHKEALEHIVGGVNSPSRSFKAVGGGAPVAMERGKGAYFWDVDGNKYIDYLAAYGPIITGHAHPHITKAITTAAENGVLYGTPTALEVKFAKMLKEAMPALDKVRFVNSGTEAVMTTIRVARAYTGRTKIMKFAGCYHGHSDLVLVAAGSGPSTLGTPDSAGVPQSIAQEVITVPFNNVETLKEALDKWGHEVAAILVEPIVGNFGIVEPKPGFLEKVNELVHEAGALVIYDEVITAFRFMYGGAQDLLGVTPDLTALGKVIGGGLPIGAYGGKKEIMEQVAPLGPAYQAGTMAGNPASMASGIACLEVLQQEGLYEKLDELGAMLEKGILEQAAKHNIDITLNRLKGALTVYFTTNTIENYDAAQDTDGEMFGKFFKLMLQEGVNLAPSKYEAWFLTTEHTKEDIEYTIEAVGRAFAALADNK

SEQ ID NO: 55520 - protein, 499 aa, Colwellia psychrerythraea 34H
MENLNSAYWQKLSQNIKFRNQAFINGTFTDSTSNESYQVINPATEEVLASVTACNSQDVDSAVACARETFESGVWADKSPSERKAVILKLAQLIQDNKEELALLETLDMGKPVMDALNIDIGGASAILAWYGEAADKINDEIAPTGPGSLATITKEAIGVVAAIVPWNFPLDLAIWKLGPALAAGNSVIVKPAEQSPHSVLRLAELAIEAGVPAGVFNVVTGHGAVVGKALGLHEDIDVLTFTGSTGIGKLFLQYSAQSNMKSVWLETGGKSPNLVFADCEDLDKAADGAAMGIFFNQGEVCSANSRLLVESSIKDVFVEKMITRAKQVIMGHPLNTNTTMGPIVSDLQASRIFSKIEKAQQEGATLVTGGKRVTIDGSSLYIEPTIFDNVDNSMSIAQDEVFGPVLSVISFDTEAEAIAIANDTPYGLAASIWTDNLSRAHRVARKIKAGTISVNTVDALSPMTPFGGYKQSGIGRDLSIHAFDKYTETKTTWIKFSE

SEQ ID NO: 55521 - protein, 130 aa, Oryza sativa (japonica cultivar-group)
MAMALRRVLKHGVIPRDAAQVVGIRGFAIASKAKKGGKGAADAAKTPVLSKELKSTTVFGANILKEGSDPKLQPDSEYPEWLWHLLDKRPMLSELRRKDAKTLPYEDLKRFVKLVNRARIKEQNALTAKN

SEQ ID NO: 55522 - protein, 544 aa, Thermosynechococcus elongatus BP-1
MGIQVIATTPFKDQKPGTSGLRKPVPVFQQPHYLENFIQAIFDTIEAPQGQTLVLGGDGRYFNAEAIQVILKMAAAKGFARVKVGQNGILSTPAASCVIRKYGAVGGIILSASHNPAGPQGDFGVKFNIANGGPAPEKVTNAIYERSLALTHYSIYTAPDVNLHTLGEFPLGEMIVEVIDPVADYQALLETLFDFDRIAEVIRTGKLRLVFDAMHAVTGPYAQQILEKCLGAPPGTVQNGVPLPDFGGGHPDPNLVYAHDLVQQLFGEQPPDFGAASDGDGDRNMILGANCFVTPSDSLAILAANAQLVPGYRDGLAGIARSMPTSQAADRVAAKLGIDCYETPTGWKFFGNLLDAGKVTLCGEESFGTGSNHVREKDGLWAVLFWLNILAVRQTPVAEIVKDHWRTYGRNYYSRHDYEGIEGDRAHTLMSQLEQKLPSLVGQTLGAYTVATADNFSYSDPVDHSVSQNQGIRLIFEDGSRIVYRLSGTGTQGATLRVYLERFEPHPSQQHLDAQVALADLIQLANDVANIQSLTGRDRPTVIT

SEQ ID NO: 55523 - protein, 230 aa, Chromobacterium violaceum ATCC 12472
MSQADFSLLFDLDGTLVDTDILHFGAYQTLLADHKRSITMQIYKERIMGAPNDAIMRELFPDLSKDSHRRLAERKEELFRAAIGKLEPTPGALALFEWAEARRVPIAVVTNAPRTNAERMLAGLDLLGRIDALVIGEELPRGKPDPLPYLTGLQRLNGRPERALAFEDSLSGVRAASAAGIHTFGVGAALPAESLRGAGADEVIADFTAAELWRRLDALELSAAAEESGA

SEQ ID NO: 55524 - protein, 474 aa, Erwinia carotovora subsp. atroseptica SCRI1043
MHDKLLIEGKLIAGNGEALAVFNPATGEQIAAIPQADLHQIDAAVLAAESAFAHWGQTTPKTRATLLLKIADAIEENAEVFAKLESLNCGKPYHAVLNDEVPAVADVFRFFAGAARCLSGSAAGEYLEGHTSMIRRDPVGVVASIAPWNYPLMMASWKLAPALAAGNCVVLKPAEQTPLTTFYLAHLLADILPAGVVNIVFGRGADIGDALTGHEKVNMVSLTGSIATGAHILAHTAASVKRTHMELGGKAPVIVFDDADIDQVVDGIRSFGFYNAGQDCTAACRLYVQRAVYDEVVEALGKAVATLKIGDPRDETTELGPLITEPQLERVMGFVERAKALPHITVVTGGERVKGTGFYFQPTVLAGAKQDDEIVQKEVFGPVISITSFDDEAQVIGWANASNYGLASSVWTRDIGRAHRLAACLQYGCTWVNTHFMLVSEMPHGGQKLSGYGKDMSMYGLEDYTIVRHIMIRH

SEQ ID NO: 55525 - protein, 468 aa, Erwinia carotovora subsp. atroseptica SCRI1043
MSRSNAHLNPLECTQQALHWIHSDTLSPDDMAALNQEVLSCFREYVNPGFLEYRKSVTTGGDYGAVEWRASGPNTLIDTQGNEYLDCLGGYGIFNVGHRNPNVIAAVESQLARQPLHSQELLDPLRGLLAKTLAALTPGNLKYSFFSNSGTESVEAALKLAKAYQSPRGKYTFIAATGAFHGKSLGALSATAKPAFRRPFMPLLPGFHHVAFGDISAMRKQVQQCQKTGDDVAAIILEPIQGEGGVIVPPENYLPAVRALCDEVGALLILDEVQTGMGRTGKMFACEHYGVQPDILCLAKALGGGVMPIGATVATEAVFSVLFENPFLHTTTFGGNPLACAAALATVNELLTKNLPEQAAIQGEFLLQGLQQLAAEYPQLIIEARGMGLLQAIEFRKNEIGYAFAKELFQRNILVAGTLNNSKSVRIEPPLTITREQCARVLKEAKDVLKKLNGTMPDENKMKEYAVE

SEQ ID NO: 55526 - protein, 405 aa, Zea mays
  misc_feature (288)..(288): Xaa can be any naturally occurring amino acid
  misc_feature (344)..(344): Xaa can be any naturally occurring amino acid
  unsure (1)..(405): unsure at all Xaa locations
MRGGMLAPVMDYFSTCWGPRSGAGHRGKGSDAAGRQDGLLWYKDAGQLVTGEFSMAVVQANQLLEDQSHVESGSLSLADPGPQGTFVGVYDGHGGPETSRFINDHLFNHLRRFATEHKFMSADVIRKAFQETEEGFLSLVIKEWSFKPQIASVGSCCLVGVICAGTLYVANLGDSRAVLGRLVKATGEVLATQLSAEHNACYEEVRQELQSSHPDDPRIVVLKHNVWRVKGLIQISRSIGDVYLKKPEYNREPLHSKFRLRETFQRPILSSEPQITEHRIQPNDQICXIFASDGLWEHLSNKEAVDLVQSSPRNGIARRLVKAAMQEAAKKREMRYSDLKKIDXRGVRRHFHDDITVVVVFLDSDAMSKASWSKSPSVSLRGGGVTLPAKSLAPFSAPAQLNGTN

SEQ ID NO: 55527 - protein, 783 aa, Glycine max
MGEESSLLKESTSINDTNMVEEVEERDPESNPLNEPLLKRNRTLSSNPLALVGAKVSYIESLDYEINENDLFKQDWRSRSRTQVLQYIFWKWTLAFLVGLLTGVIATLINLAVENIAGYKFLAVVNFIQKERYLRGFLYFTGINFLLTFVASILCVCFAPTAAGPGIPEIKAYLNGVDTPNMYGATTLFVKIIGSIGAVSAGLDLGKEGPLVHIGSCIASLLGQGGPDNYRIKWRWLRYFNNDRDRRDLITCGASSGVCAAFRAPVGGVLFALEEVATWWRSALLWRTFFSTAVVVVVLRASIELCHKGKCGLFGEGGLIMYDVSDVTVRYNVMDIIPVVIIGVLGGVLGSLYNYLLHKVLRVYNLINQKGKMYKLLLSLSVAIFTSACQYGLPFLAKCTPCDPSLSDVCPTNGRSGNFKQFNCPKGYYNDLATLLLTTNDDAVRNIFSTNTPLEYQPSSIIIFFALYCILGLITFGIAVPSGLFLPIILMGSGYGRLLGILMGPHTNIDQGLFAVLGAASLMAGSMRMTVSLCVIFLELTNNLLLLPITMIVLLIAKTVGDSFNPSIYEIILHLKGLPFMDANPEPWMRNLTVGELVDVKPAVVSFKGVEKVANIVNALKNTTHNGFPVMDCGLVPTTGVANEATELHGIILRAHLIQVRKKKWFLKERRRTEEWEVREKFTWVELAEREGNIEDVAVTKEEMEMFVDLHPLTNTTPFTVLESMSVAKAMVLFRQVGLRHMLVVPKYQASGVSPVIGILTRQDLLAYNILTVFPHLAKSKRK

SEQ ID NO: 55528 - protein, 1501 aa, Candida albicans
MSDSKMSSQDESKLEKAISQDSSSENHSINEYHGFDAHTSENIQNLARTFTHDSFKDDSSAGLLKYLTHMSEVPGVNPYEHEEINNDQLNPDSENFNAKFWVKNLRKLFESDPEYYKPSKLGIGYRNLRAYGVANDSDYQPTVTNALWKLATEGFRHFQKDDDSRYFDILKSMDAIMRPGELTVVLGRPGAGCSTLLKTIAVNTYGFHIGKESQITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSAVILDTTPLIAIYQCSQDAYDLFDKVVVLYEGYQIFFGKATKAKEYFEKMGWKCPQRQTTADFLTSLTNPAEREPLPGYEDKVPRTAQEFETYWKNSPEYAELTKEIDEYFVECERSNTRETYRESHVAKQSNNTRPASPYTVSFFMQVRYGVARNFLRMKGDPSIPIFSVFGQLVMGLILSSVFYNLSQTTGSFYYRGAAMFFAVLFNAFSSLLEIMSLFEARPIVEKHKKYALYRPSADALASIISELPVKLAMSMSFNFVFYFMVNFRRNPGRFFFYWLMCIWCTFVMSHLFRSIGAVSTSISGAMTPATVLLLAMVIYTGFVIPTPSMLGWSRWINYINPVGYVFESLMVNEFHGREFQCAQYVPSGPGYENISRSNQVCTAVGSVPGNEMVSGTNYLAGAYQYYNSHKWRNLGITIGFAVFFLAIYIALTEFNKGAMQKGEIVLFLKGSLKKHKRKTAASNKGDIEAGPVAGKLDYQDEAEAVNNEKFTEKGSTGSVDFPENREIFFWRDLTYQVKIKKEDRVILDHVDGWVKPGQITALMGASGAGKTTLLNCLSERVTTGIITDGERLVNGHALDSSFQRSIGYVQQQDVHLPTSTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDRLLFLQKGGRTAYFGELGENCQTMINYFEKYGADPCPKEANPAEWMLQVVGAAPGSHAKQDYFEVWRNSSEYQAVREEINRMEAELSKLPRDNDPEALLKYAAPLWKQYLLVSWRTIVQDWRSPGYIYSKIFLVVSAALFNGFSFFKAKNNMQGLQNQMFSVFMFFIPFNTLVQQMLPYFVKQRDVYEVREAPSRTFSWFAFIAGQITSEIPYQVAVGTIAFFCWYYPLGLYNNATPTDSVNPRGVLMWMLVTAFYVYTATMGQLCMSFSELADNAANLATLLFTMCLNFCGVLAGPDVLPGFWIFMYRCNPFTYLVQAMLSTGLANTFVKCAEREYVSVKPPNGESCSTYLDPYIKFAGGYFETRNDGSCAFCQMSSTNTFLKSVNSLYSERWRNFGIFIAFIAINIILTVIFYWLARVPKGNREKKNKK

SEQ ID NO: 55529 - protein, 424 aa, Oryza sativa (japonica cultivar-group)
MVTIYWCSRQKVAWSATGCTLLISLLFFFSGSPHRILLNKKPLNFKTAPSRLLREISISSSRVQRVNNSSAEFVANLNDRNVEIVQHMEDNDHNIINATANVTSDWSIVKEEFTFPAGSAPFNSCHASTIVETEKDSFLVAYFGGSKEGAPDVKIWLQRYSDGCWHTPQVADEQDEVPMWNPVLFQLPSHELLLFYKIGQEVQKWSGAMKRSLDGGKTWSAREQLPPGILGPIKNKPFLVEDGRLLCGSSVESWNSWGAWLEVTKDAGRTWRKYGPIYIEGETLGVIQPVPYMTANGTIRVLLRSFETIGRVCMADSADGGVTWSYVHETDLPNPNSGIDGVKMKDGRVLLAYNTFSRGTLKVAVSMDDGDSWNDVMTLEDTEGMEFSYPAVIQTMDDLIHITYTYNRTQIKHVVLQPSGKVRW

SEQ ID NO: 55530 - protein, 336 aa, Alkaliphilus metalliredigenes QYMF
MKTITLIPGDGIGVEVTTAVQRVIEAANVAIDWEVVNGGETAYLETGQYIPDELIDSISKNKIAFKGPITTPIGTGFKSINVTLRQKYNTYANVRPVKSMSGIKTPFDNIDLVIFRENTEGLYCGIEHLVTEGVAEAIKVITEKASKRIGKSAFEYARKHKRKKVTAVHKANIMKISDGLFLDCIRSVAKEYPEIEYEEVIVDNMCMQLVMYPERYDVLVLPNLYGDIISDLAAGLVGGLGLVPGANIGDDIAIFEAVHGSAPLIAGKNMANPTACILSATMMLDYIGEESAAKRIRQAVEFVIKEGRYTTSDIGGTATTKDMTEAICQYIKSKNH

SEQ ID NO: 55531 - protein, 1201 aa, Oryza sativa
MDDDGETPMPSLELHKLPTLAGAAIPNPIARHPLYHPSPSFFISPTDVVLRDILFDASPASAAGERRRRHVAAYHRAGPRREVAFDPATVRAAIFTCGGLCPGTNTVVRELVVGLSELYGVRGGVFGVRNGYHGFYSDEVVPLDPAGGEHWHKAGGAGLGTLRGGVYAVGGDGTMRGAARIHREVRRRGRLAVAVAGIPKTVDNDVGVVDRSFGFHTAVEAAQQAIAAGHVEAESAANGVGLVKLMGRSAGHIALHATLSSRDVDCCLIPEEDFYLRGAGGLFDFLYRRIKDNGHAVVVVAEGAGQRLIPRTTTTSASGACAGADESGNETFLDVGAWLKAEMRAWWEEEHAGEVFTVKYIDPTYMIRAVPANAGDNLYCTLLAHAAIHGAMAGYTGFVSGTINGNYAYIPMDEVAEAKNPVDTKDHKWAWSFVVYLGGHSHGRGGAALASSQERAKNSHHEFLGSFLGSKEKARDAIFYSYTKYINGFAATLEEEEAMEISKHPSVISVFPNRGHRLHTTRSWEFLGMEKDGRIRANSIWAKARFGEGVIIGNLDTGVWPEAGSFSDDGMGPAPVRWRGICQDQASDDAQVPCNRKLIGARYFNKGYLSTVGQAANPASTRDTDGHGTHTLSTAAGRFVPGANLFGYGNGTAKGGAPGAHVAAYKVCWRPVNGSECFDADIIAAFDAAIHDGVDVLSVSLGGAPAGYLRDGVAIGSFHAVRRGVTVVCSAGNSGPGAGTVSNTAPWLVTVGASTMDREFPAYLVLGNNKKIKGQSLSPVRLAGGKNYPLISSEQARAANATASQARLCMEGSLERGKVEGRIVVCMRGKNARVEKGEAVRRAGGAGLVLANDEATGNEMIADAHVLPATHVTYSDGVALLAYLNSTRSPSGFITVPDTALDTKPAPFMAAFSSQGPNTVTTQILKPDITAPGVSILAAFTGQAGPTGLAFDSRRVLFNAESGTSMSCPHVAGVAGLLKALHPDWSPAAIKSAIMTTARVKDNMRRPMSNSSFLRATPFSYGAGHVQPGRAADPGLVYDMNDTDYLGFLCALGYNSSVIATFMASGSGAQPPYACPPARRPEDLNYPSFALPHLSPSGAARTVTRRVRNVGAAPAAYVASVAEPRGVSVAVRPSRLEFTAAGEELEFAVTFRAKKGSFLAGEYEFGRLVWSDAAAGGRHRVRSPLVVRVVDKKGKNGLPIS

SEQ ID NO: 55532 - protein, 108 aa, Arabidopsis thaliana
MSKPMEEDTNGKTEEEEFNTGPLSVLMMSVKNNTQVLINCRNNRKLLGRVRAFDRHCNMVLENVREMWTEVPKTGKGKKKALPVNRDRFISKMFLRGDSVIIVLRNPK

SEQ ID NO: 55533 - protein, 392 aa, Rhodococcus sp. RHA1
MNTVPNSIVVLGASLAGLSAVRALRAKGYTGRLIVAGSEQSLPYDRPPLSKEFLTGDLTDEDLLLMNSDDDTLDVEWRMNRTATGLVYSPGGLHRVTFDDGSHFDADAVVVATGARARTLPGHSGLAGVHTLRSIDDARALRDSLSRAQNLVIVGAGFIGAEVASTAARMSLNVTVVEASPTPLAGPLGIELGAICAGQHAAHGVRLLTGAVVAALLGDDAVEAVQLSDGTILPADAVVVGIGAVPNVEWARDSELMIDDGFLTDSSCRTNVPGVYAIGDCARTFDDAHQVHHRSEHWSNAVAQAATVADTIMATPSGPAAIPYFWSHQYGKMLQFAGTRHSTDEVRFVDGDPGTGTFVATYDRDGDTVGVFAMNSPRLFTRYKKQLARSRA

SEQ ID NO: 55534 - protein, 1053 aa, Acidovorax sp. JS42
MQACKALREEGYKVILINSNPATIMTDPATADVTYIEPITWQTVEKIIAKERPDAILPTMGGQTALNCALDLWRNGVLHKYKVELIGATPEAIDKAEDRLKFKDAMTRIGLGSARSGIAHSMDEAWAVQKNVGFPTVIRPSFTLGGTGGGIAYNPEEFETICKRGLEASPTNELLIEESLLGWKEYEMEVVRDKADNCIIVCSIENLDPMGVHTGDSITVAPAQTLTDKEYQIMRNASLAVLREIGVDTGGSNVQFSVNPKDGRMIVIEMNPRVSRSSALASKATGFPIAKVAAKLAVGYTLDELKNEITGGATPASFEPSIDYVVTKIPRFAFEKFPAADSRLTTQMKSVGEVMAMGRTFQESFQKALRGLEVGVDGMNEKTQDRELLEKELGEPGPERIWYVGDAFAMGLSVDEVHDLTKIDKWFLVQIEEIVKIELDLDQLTAEKGDGALASLDADTLRALKKKGFSDRRLAKLLKTNEKAVREARHALNVRPVYKRVDTCAAEFATNTAYMYSTYEDECEAESTNKKKIMVLGGGPNRIGQGIEFDYCCVHAALAMREDGYETIMVNCNPETVSTDYDTSDRLYFEPLTLEDVLEIVDKEKPEGVIVQYGGQTPLKLALGLEAAGVPIIGTTPDMIDAAEDRERFQKLLGDLGLRQPPNATARTEPEALEKAAALGYPLVVRPSYVLGGRAMEIVHEQRDLERYMREAVKVSNDSPVLLDRFLSNAIECDVDCVRDASGAVFIGGVMEHIEQAGVHSGDSACSLPPYYLKAETVAEIKRQTTAMAHGLNVVGLMNVQFAIQETDDGDVIYVLEVNPRASRTVPFVSKATGIQLAKVAARCMAGQTLASQGITKEVTPPYFSVKEAVFPFVKFPGVDTILGPEMKSTGEVMGVGKTFGEAFVKSQLGAGTRLPRSGKVFLTVKNADKQRAVAIARDLAAMGFELLATKGTAAAIEAAGVPVQVVNKVTEGRPHIVDMIKNDEIAMVINTVEERRNAIADSRAIRTSSLLARVTTFTTIFGAEAAVEGMKHLDNLDVYSVQELHARLAAAA

SEQ ID NO: 55535 - protein, 501 aa, Wolbachia endosymbiont strain TRS of Brugia malayi
MNFKSVVLCILDGWGNGIGDSKYNAISNANPPCWQYISSNYPRCSLSACGTDVGLPDGQIGNSEVGHMNICSGRVVMQSLQRIDREIKTIENNKNLRSFISDLKDKNGVCHIMGLVSDGGVHSHQKHISTLANKISQHEIKVVIHAFLDGRDTLPNSGKKCVQEFEENIKGNDIRIATVSGRYYAMDRDNRWERTIETYEAIAFARATCHNNVMSLIDNNYQNNITDEFIRPTVIGDYKGIELKDGVLLANFRADRMIQLASILLGKTGYTEVAKFSSILSMMKYKEDLQIPCLFPPAFFTNTLGEIIADNKLRQLRIAETEKYAHVTFFFNCGKEEPFSNEERILIPSPKVETYDLQPEMSAFELTEKLVGKIRSQEFTLIVANYANPDMVGHTGNMEAAKKAVLAVDDCLAKVLNTVKEINDAVLIVTADHGNVECMFDEKNNTPHTAHTLNKVPFIIYPNSCNNLKLKDGRLSDIAPTILQLLGIKKPDEMTGSSLIV

SEQ ID NO: 55536 - protein, 293 aa, Carboxydothermus hydrogenoformans Z-2901
MAVFGRLLTAMVTPFDRDGKVNLEQAQKLASFLVENGSDGIVVAGTTGESPTLSFEEKVDLFKAVVEAVGGKAAVIAGTGSNATEASIKLTKAAEKVGVDGVMLVAPYYNKPSQKGLVEHFQAIARATSLPVMIYNIPGRTGVNILPKTMAKIAELENVVAIKEAAGSVDQATELIRILPERVKVFSGDDSLTLPILAVGGYGVVSVASHLVGLKIKEMIDQFLLGNVAVAARLHQELYPLIKALFITTNPVPVKTALNLMGHKVGGFRLPLVDMTEEEKEELVRELKNLNLL

SEQ ID NO: 55537 - protein, 274 aa, Helicobacter pylori
MEFDVTIIDETGRATAPEILIPALRTKKLILIGDHNQLPPSIDRYLLEQLESDDIQNLDAIDRQLLEESFFENLYKYIPESNKAMLNEFRMPASIGSLVSQLFYKEKLKNGVIKNTSQFYDPKNIIRWINVEGEHQLEKTSSYNKNQVQKIIELLEQINRVLNQRKIRKTIGIITPYNAQKRCLRSEVEKYGFKNFDELKIDTVDAFQGEKADIIIYSTVKTYGNLSFLIDSKRLNVAISRAKENLIFVGKKSFFENLRSDEKNIFSAILQVCR

SEQ ID NO: 55538 - protein, 233 aa, Wolbachia endosymbiont strain TRS of Brugia malayi
MSFLIVANWKMNGTRSLFVNFIGKLNDKSNEITSKLVICPPFTSLPGNIELNSNISIGAQNCHYKKSGSYTGEISAEMLKELGCTYVILGHSERTHETNGEIKLKSETAIESGLHPIICVGENLEDRESSKTKEVVEYQCKSRLPIHGEYTVAYEPIWAIGTGHVPSNNAIAEVIEVIQSYTSKKHVIYGGSVSLENIENLSNILNLSGVLIGSASLDFDRFHKIVQQVEKAY

SEQ ID NO: 55539 - protein, 309 aa, Brassica napus
FPIFCLLVTISTVRSVPPQPPVRCDQTGCTVSSAYGTWPDRKTCKAANITYPTTEEELRKAVAYASERNLKVKTVTKFSHTIPKLACPSGSDAMLISTSKYNSVIEIEPDRLTVTADSGVSLRELIDKVEAAGFSIGTSPYWEGVSIGALFSTGSPGSSCSGRGGSVHDHVVGISLVVPANSSERYAKVIRLEEGRDDKLLNAVKVSLGVLGVISKVKLSIEKAFKRSITYNFTSDVALEDIFMDHGKRFEFGDITWYPSRKTAVYRYDVRSPVNVSGNGVNDFIGFQSNPILVSKGVRALEKSLEASK

SEQ ID NO: 55540 - protein, 725 aa, Cryptococcus neoformans var. neoformans JEC21
MSPVAVHNKHGDSASHGTALSKNPHVKSSEVDTEKLVINAIRCLAADLCQQYKGGHPGTVMGAAAIATALWKYSMRYNPANPDWINRDRFVLSAGHACLLQYIMLHLSGYSSWTLDQIKKYHAPTMDGIAAGHPEIEFPGVELTTGLLGQGIANAVGLAVANKNMAATYNKDGFPIIQNKVWCFTGDGCLQEGVGQEALSMAGHWGLDNMILVYDNNSVTVDGNIDICFTDDTSAKLKSLGWHVLEVEDGSNDLAAIVDAFEQAQKLTGKPVFINIKTIIGIGSINQNSGKVHGAALGEDDVARVKTALGFDPKDKFIVPDAVYDYFKETKIKGAQYEQEWNDLFKRYKESFPSEAAEFQRRLDGKLEEAWENKFPSKDALPKDPKATRQSSGIALRSVIPEDKSFLVGSADLCESTFVNWDGMVEFQNPKSGYGDYSGRQIRYGIREHAMVAAANGLAAWHKGAIVPIMSSYFIFWLYAAPSLRMAALMKLRFIAIATHDSIGVGEDGPTHQPIAFPLFLRALPNFNYIRPADAEEVIGAWILGLRDADHPSLLSLTRQPVPLLSGTDRNKVQYGGYVVYGDENSIPDITLVATGSEVARAVDTAELLKDKYSVRVVSMPHTGRFDAQPLEYRRSVIPSTKSLVVSIEPYASFGWAKYAHAGAHMTGFGHSAPYSVLFEHFGFGPKTLAEKIRAWAEPKRNGDGWDIPGVGEFEELLVNSGNGH

SEQ ID NO: 55541 - protein, 665 aa, Cryptococcus neoformans var. neoformans JEC21
MGAAAIATALWKYSMRYNPANPDWINRDRFVLSAGHACLLQYIMLHLSGYSSWTLDQIKKYHAPTMDGIAAGHPEIEFPGVELTTGLLGQGIANAVGLAVANKNMAATYNKDGFPIIQNKVWCFTGDGCLQEGVGQEALSMAGHWGLDNMILVYDNNSVTVDGNIDICFTDDTSAKLKSLGWHVLEVEDGSNDLAAIVDAFEQAQKLTGKPVFINIKTIIGIGSINQNSGKVHGAALGEDDVARVKTALGFDPKDKFIVPDAVYDYFKETKIKGAQYEQEWNDLFKRYKESFPSEAAEFQRRLDGKLEEAWENKFPSKDALPKDPKATRQSSGIALRSVIPEDKSFLVGSADLCESTFVNWDGMVEFQNPKSGYGDYSGRQIRYGIREHAMVAAANGLAAWHKGAIVPIMSSYFIFWLYAAPSLRMAALMKLRFIAIATHDSIGVGEDGPTHQPIAFPLFLRALPNFNYIRPADAEEVIGAWILGLRDADHPSLLSLTRQPVPLLSGTDRNKVQYGGYVVYGDENSIPDITLVATGSEVARAVDTAELLKDKYSVRVVSMPHTGRFDAQPLEYRRSVIPSTKSLVVSIEPYASFGWAKYAHAGAHMTGFGHSAPYSVLFEHFGFGPKTLAEKIRAWAEPKRNGDGWDIPGVGEFEELLVNSGNGH

SEQ ID NO: 55542 - protein, 257 aa, Zea mays
  misc_feature (236)..(236): Xaa can be any naturally occurring amino acid
  unsure (1)..(257): unsure at all Xaa locations
MPSQSTHTSSSLSSSTAPILPCSSAAALFRSVMAAVATETPFHVLAVDDSLPDRKLIERLLKTSSFQGKLSHRMIIPVSFASALMTTVDSGSKALQFLGLHDQDSTVPPVHTHQLDVAANQDVAVNLIITDYCMPGMTGYDLLKKIKESSSLRDIPVVIMSSENIPSRINRCLEEGADEFFLKPVRLSDMNKLKPHILKSRCNQEQHQQSDSHSGERRNPHISSSSSSSDSINNRXKRKGAGTEEILPQLANRSRHS

SEQ ID NO: 55543 - protein, 441 aa, Cryptococcus neoformans var. neoformans JEC21
MQAAVSLVQDYMGTEPTSTKSPYKHRQDGSTMRALAWFGKEDVRMVDAPIPDITQDTDVIVKVTGTTICGSDLHLYHSEMLGMQKGDILGHEFMGIIDRVGPSVNHLKIGDRVVVSFQIACGTCRYCQQKLSSFCDKTNDSSVVVNLWGQRDSAFFGYSHLTGGWPGGQSEYVRVPFGEVNCLKVPAEVPDEQALYLSDVLPTSYHAVVDTGVQKGDIVGIWGLGPIGICCVKWALLKGASKVYAIDTNPTRLALARSLGPEVITVDFKADDVKKRIHDEVPQGLDVCIDATTFHEPKTFLHKVEKALMLETDVSETPNEMIWLVKKMGRVGLIGVYTAYTNHFNIGALMEKGVRFIGNGQAPVHLYWEEILHDYIMTGKFDVGFMISHRVDLEDFPQLYDKFDRRVAGVEKVFVQTKASAPPAKGFPALSKVDDWADKII

SEQ ID NO: 55544 - protein, 358 aa, Oryza sativa (japonica cultivar-group)
MARGIRMKPTYVPHVVSPAAQSPWIYVVICWLIKSDAESVFLCEEKKAMQQPSSTSTQPHASRKQQPVSSSSTHRSNGQLKGNKKQNRDRGIFLRKTQSYHSSQSDSRRKKKKQQQQSSQPVRRARSNRGSKRRRREDSTVRLYRLMGEEDISNDSKSSCGCEDGTVEAPAAAAPKENGRAADPRLQAISDAIRVVPHFPKPGIMFNDITALLLRPAAFKDAVDMFVERYRGMRIAAVAGIEARGFIFGPAIALAIGAKFIPLRKPKKLPGEVISETYILEYGTDCLEMHVGATEPGERVVVVDDLVATGGTLCAAIKLLERAGADVVECACLIGLPKYKNFYKLNGKPVYILVESRK

SEQ ID NO: 55545 - protein, 508 aa, Psychrobacter arcticus 273-4
MLYAYPNTENSPVQFRKKYDNFINGEWVAPIDGEYFDNSSPIDGKTFCQIARSKEADVEAALDAAHAAKDAWGKTSVTERSNMLLKLADGIEANLEKIAIAESYENGKPVRETLAADIPIAIDHLRYFAGVIRAQEGGISQIDEDTVAYHFHEPLGVVGQIIPWNFPILMAIWKIAPALAAGNCVVLKPAEQTPASILYMLDVIGAADILPKGVLNVVNGFGVEAGKPLASNPRIDKVSFTGETTTGRLIMQYASENIIPVTLELGGKSPNIFFADVMDEDDDFLDKAVEGLVMFALNQGEVCTCPSRALVHESIYDEFMKRCIARVKAIKMGNPLDTDTMIGAQASSDQLEKILSYLDIGKKEGAKVLVGGELAKHDGDIANGYYVQPTIFEGTNDMRVFQEEIFGPVLAVTTFKDDEEAMALANDTLYGLGAGVWTRNGTRAYRFGRGIKAGRVWTNCYHLYPAHSAFGGYKQSGIGRENHLMMLDHYQQTKNMLVSYSPKAMGFF

SEQ ID NO: 55546 - protein, 570 aa, Bacillus cereus E33L
MTLNIQGIAASSGIAIAKAFRLENPEFNIEKKSITNEAAEIARLEAALEKAKTELEAIKDHAFAELGADKAAIFEAHLLVLNDPELVNPVKDKVTSEKVNAEFAMDEVASMFISMFENMDNEYMKERAADIRDVTKRVLAHLLGINFSNPGTISEEVIIIAEDLTPSDTAQLNRKYAKGFTTDIGGRTSHSAIMARSMEIPAVVGTKVVMEKIQNGDIVIIDGLDGEVIVNPSEETLRSFEEKKAKFEEQKAEWAKLKDQATVTSDGHHVELVANIGTPNDVQGIIDNGGEGVGLYRTEFLYMGRDNLPTEEEQFEAYKAVLEGVKEGQPVVVRTLDIGGDKELPYLHLPKEMNPFLGYRAIRLCLDEQDVFRTQLRALLRASVYGNLKIMFPMIATLDEFRQAKAILLEEKAKLVEAGTTVSDSIEVGMMVEIPASAVLADQFAKEVDFFSIGTNDLIQYTMAADRMNEQVSYLYQPYNPSILRLVKMVIDAAHKEGKWAGMCGEMAGDSLAIPLLLGLGLDEFSMSATSILPARTQLSKLSKVEMETLAEKALMMSTAEEVVELVKSI

SEQ ID NO: 55547 - protein, 346 aa, Burkholderia thailandensis E264
MKHASAESPESTGCAETPARAPAGSAADTAAPPAPDGRASGHLSRASSARHLGVAALPAAGTAAAIALWAGFGLAPRAQDIAMLAVFYVLNILGMELALHRYFAHRTFKAKPPVKIALAILGSLAYMGPLMWWVAIHRLHHANADRPGDPHTPQLGGRGFVGRAKGILHGHVGWLFDPSSARPKGWNQYANDMYRDPALLRIHLAYDYWLLLGLLLPAAIGWLLDPSWRGALLGLLWGGTVRIFLATNAIWAVNSIGHALGGRRPFPGRDQSRNAAWLALVTLGAGWHNNHHAFPQYASTRLTRWQIDVTGMLIALLERLGLVWDVQHPDRDAVRERLANARRDDA

SEQ ID NO: 55548 - protein, 809 aa, Rhodobacter capsulatus
MKQRLVVIGAGMASGRMLEHIFEAAPEAFDVTLFNAEPRGNYNRLMLSPVLSGEKTYAQIVTHDAEWYETQGITCRFGEPVVKIDRAAKTVTSAAGSVAYDKLVVATGSAPFILPVPGKDLPGVVAYRDLEDTNAMIAASAPGARAVVIGGGLLGLEAAAGMAARGAEVTVIHLMGHLMERQLDPAAGYLLQRDLERRGIRVHCKGATKAILGIDRVEAVLLDDGTTYPADLVCMAIGIRPETRLANDAGLEVNRGLVVSDQMQTSDPAIFALGECVEHQGQLFGLVAPLYDQAKVLAATLLGTEAAFRPVQTATKLKVTGVDLFSAGDFADAPGREEVVFRDPGRGVYKRLILEGERLIGAVMYGDTADGAWFFDKIKSGEDVTSARDTLIFGPAFAGGAAADPLAAVAALPPEAEICGCNGVCKGKITEAVAGGAVTLDAVRAVTKASASCGTCTGLVEKVMALTLGAAFKPVENPPMCKCTDHTHEDVRRLIKARRLKSIPAVMQELGWKTSGGCASCRPALNYYLLCDWPFDYKDDRQSRFVNERNHANIQKDGTYSVVPRMWGGVTTPSELRAIADAAEKYSVPMVKVTGGQRIDLLGVRKEDLPAIWSDLNAAGMVSGHAYSKGLRTVKTCVGEQFCRFGTQDSTGLGIKLEQLLWGSWTPAKLKLGVSGCPRNCAEATCKDIGVVCVESGYQISVAGAAGLEVRETELLVTVATEAEAMEAIAAFTQLYRENARYLHRVYKWVAKVGLDWCRAQIEDPQTRKALADRFEASQSIYRVDPWAELAAKPADWAPVADLTLRAAE

SEQ ID NO: 55549 - protein, 94 aa, Triticum aestivum
  misc_feature (31)..(31): Xaa can be any naturally occurring amino acid
  misc_feature (40)..(40): Xaa can be any naturally occurring amino acid
  misc_feature (48)..(48): Xaa can be any naturally occurring amino acid
  unsure (1)..(94): unsure at all Xaa locations
MISAMVLLLQCECTLICWPVCDLRFLCKDRXLPTLDKGVXLVVHDAGXYCMSMVRLQPEDEPAEYWVEDDGSIVKIRHGETFDDYMKFFDGLPA

SEQ ID NO: 55550 - protein, 863 aa, Rhodobacter capsulatus
MIRTTCPYCGVGCGVIATPDGRGGATIKGDPDHPANRGRLCVKGTALGETIATAGRLTTPRIDGAEASWGTALDLIARRFSETIAEHGPDAVAFYVSGQLLTEDYYVANKLMKGFIGSANIDTNSRLCMASSVAGHRRAFGSDTVPGQYADLEEADLVVLVGSNLAWCHPVLFQRIMAAKATRPGLKIVVIDPRRTATCEGADLHLSLAPGADAHLFNLLLAHLPETGRIDPAFLRHLSGLPEALVAARTSTPAATDLEPADLDAFLRLWAETEKVVTVYSQGINQSETGTDKVNAILNCHLATGRIGRPGMGPFSVTGQPNAMGGREVGGLANMLACHLEIENPDHRAAVADFWAAPRIAEKPGLKAVDMFRAVEEGRVKALWVMHSNPAVTMPEADRVARAIAGCDFTVVSDLWAETDTARRAHVLLPATGWGEKSGTVTNSERCISRQRPFLAPPGQARPDWWALAQVAKRMGFSGFDWESPADIFAEYCALSGVAGGLGSDFDISGLEAADYDALPPTYWPQAAQKGGRFFGTGQFHTPDGKARMIPVTARLPDPVTPAHPYRLNTGRIRDQWHTMTRTGQSPRLAAHLGEPFLEIHPDDAAQLGFATADLAEVTNAHGRALLRVMISDRVAPSHPFAPMHWTGETAPSGRVDALVTATTDPVSGQPASKSAAVAIRRFEVRWHGFAITRSDLRPGCEYWAKAPIPGGWRAELAGTTPPEDWALWAENLLRLGPATLQVSDPSRGLYRFAFFEGDRLCAAIFIAPGPVALSRSHLVTQLGSTARSILAGQPEAARPDPGPTVCACLNVGMNTILRAIADQGLASVEAIGRALGAGTNCGSCRPELATLLSRFSSREAAQ

SEQ ID NO: 55551 - protein, 523 aa, Haemophilus influenzae R2866
MTNIHNHKILILDFGSQYTQLIARRVREIGVYCELWAWDVTEQQIREFAPTGIILSGSPESTTEENSPRAPEYVFNASVPVLGICYGMQTMAMQLGGLTETSDHREFGYASVSLENSTALFANLNDNSTASEPKLDVWMSHGDKVTRLPENFKVTGTTPTCPIAAMSDENRRFYGVQFHPEVTHTKKGLELLTNFVVNICGCETKWTAENIIEDAVARIKEQVGDDEVILGLSGGVDSSVVALLLHRAIGKNLHCVFVDNGLLRLHEGDQVMEMFGDKFGLNITRVDAESRFLGELAGVSDPEAKRKIIGKVFVDVFDDESKKLTNVKWLAQGTIYPDVIESAASKTGKAHVIKSHHNVGGLPDYMKLGLVEPLRELFKDEVRKIGLALGLPAEMINRHPFPGPGLGVRVLGEVKKEYCDLLRRADAIFIEELRNSGWYEKTSQAFSVFLPVKSVGVMGDGRKYDWVISLRAVETIDFMTAHWAHLPYDLLGKVSNRIINEVNGISRVVYDISGKPPATIEWE

SEQ ID NO: 55552 - protein, 627 aa, Oryza sativa (japonica cultivar-group)
MASSASLQRFLPPYPHAAASRCRPPGVRARPVQSSTVSAPSSSTPAADEAVSAERLEPRVEQREGRYWVLKEKYRTGLNPQEKVKLGKEPMSLFMEGGIKELAKMPMEEIEADKLSKEDIDVRLKWLGLFHRRKHQYGRFMMRLKLPNGVTTSEQTRYLASVIEAYGKEGCADVTTRQNWQIRGVTLPDVPAILDGLNAVGLTSLQSGMDNVRNPVGNPLAGIDPDEIVDTRSYTNLLSSYITSNFQGNPTITNLPRKWNVCVIGSHDLYEHPHINDLAYMPAVKGGKFGFNLLVGGFISPKRWEEALPLDAWVPGDDIIPVCKAVLEAYRDLGTRGNRQKTRMMWLIDELVNHFFLHSSTPLTELRMSQCSYQLIAVLALQGMEAFRSEVEKRMPNGVLERAAPEDLIDKKWQRRDYLGVHPQKQEGMSYVGLHVPVGRVQAADMFELARLADEYGSGELRLTVEQNIVIPNVKNEKVEALLSEPLLQKFSPQPSLLLKGLVACTGNQFCGQAIIETKQRALLVTSQVEKLVSVPRAVRMHWTGCPNSCGQVQVADIGFMGCLTKDSAGKIVEAADIFVGGRVGSDSHLAGAYKKSVPCDELAPIVADILVERFGAVRREREEDEE

SEQ ID NO: 55553 - protein, 111 aa, Glycine max
  misc_feature (92)..(92): Xaa can be any naturally occurring amino acid
  unsure (1)..(111): unsure at all Xaa locations
YHIFLPSLLYDDDSMSCAGTYPNLNYNPVIGILTHPGDSAFCRLINATGVFYKSASYTKIVESGGARVISLIYNESPENLNKKLDFFNGVLXFTGGWACFCSYFDTLWNIF

SEQ ID NO: 55554 - protein, 567 aa, Arabidopsis thaliana
MEVEMHGDVSKWEGYADWRNKAALRGRHGGMLAASFVLAVEILENLAFLANASNLVLYLKNFMHMSLARSSSEVTTFMATAFLLALLGGFLADAFFSTFVIFLISASIEFLGLILLTIQARRPSLMPPPCKSSAALRCEVVGGSKAAFLFVGLYLVSLGIGGIKGSLPSHGAEQFDEGTPKGRKQRSTFFNYYVFCLSCGALVAVTFVVWIEDNKGWEWGFGVSTISIFLSILVFLLGSRFYKNKIPRGSPLTTIFKVLLAASIVSCSSKTSSNHFTSREVQSEHEEKTPSQSLTNSLTCLNKAIEGKTHHIWLECTVQQVEDVKIVLKMLPIFGCTIMLNCCLAQLSTYSVHQAATMNRKIVNFNVPSASLPVFPVVFMLILAPTYDHLIIPFARKVTKSEIGITHLQRIGVGLVLSIVAMAVAALVELKRKQVAREAGLLDSEETLPITFLWIALQYLFLGSADLFTLAGLLEFFFTEAPSSMRSLATSLSWASLALGYYLSSVMVPIVNRVTKSAGQSPWLGEKLNRNRLDLFYWLMCVLSVVNFLHYLFWAKRYKYISTGSIS

SEQ ID NO: 55555 - protein, 305 aa, Chromobacterium violaceum ATCC 12472
MTPPQFVAFGEALTDFIRVDGDAWQSRPGGAGWNVARVVGRLGVGAAFAGAVSDDLLGRQLLEASAAAGLDTRFLQPLPYPPLLAMVPSSQPPSYFFVGDNSADLHFDPARLPPDGLDALRIAYFGSISLARPPLADRLLELAHELAARGVAIAFDPNMRSAMSEAGYRRRFEALAGLASYIKVSDEDLQLLFPARDQDRALEALRRLAPRAAILYTRGADGMSLLGSGGALEQAALPAAVADTIGCGDASIGGLIASLLKYPARTMAEHLRFAAATAACTAGHAGAYAPDEAMVNAKLTLPSAA

SEQ ID NO: 55556 - protein, 558 aa, Zea mays
MASSQEDKMKALMKVLVDCTEDATKSLGGLVDHALDHMHDEEILARTLFAIKDKLELLQQDALEAKVQAFPKLAKYDWDDISVDPPSPSPPPTVTDPSVDEEEFYCPDASDEWYFSDSDRMDPSNNATSSQPMSNSSIGQQFAPPPPMWPTAYMQQSAMDCNLVGNLNFPNPAQGPTTMWAPMHTGNTSSQSSMIPASQSAMYWNHYLNFVRNPLGPPEVNPFPDCIPPSNTSTPLQGSNTIPSIPVNLDSDAEHSVQDINSPEKNAPPIQKPKKAKEQNFTGPEDLLLCTTWLQISSDPVVHTGQRREGLWARIEKRYNEQRGNFPCRVNRALSSRWDKIRADVSKFAGYYARVLREKQSGLTDDDKTSKAATLFAHEENKNFQYMHCWHQLKGEPKWESICSGQSFRGLNANPVGSTGTPSAPTTENDSSSAGLTGKRPRGRDFSKSERNKPASSSSPEYLSRLQEITEKQIQRSIEKGQKKEKCSEEDREMEKKRLELEAEKVIIRKRELKLQELDCAEKRLQRLCSTNEEDVDPEVWIMMKEQKKEVARIHIWL

SEQ ID NO: 55557 - protein, 374 aa, Glycine max
MSLNVDDDELVSEMDEAPSFASSLPVPNVQEMVRNNPLQVPERYARSQEELEKVNHMPHLSSEVPVIDLALLSNGNKEELLKLDVACKEWGFFQIVNHGVQEHLQKMKDASSEFFKLPIEEKNKYASASNDTHGYGQAYVVSEEQTLDWSDALMLITYPTRYRKLQFWPKTPEGFMDIIDAYASEVRRVGEELISSLSVIMGMQKHVLLGLHKESLQALRVNYYPPCSTPEQVLGLSPHSDASTITLLMQDDDVTGLEIQHQGGWVPVTPIPDALVVNVGDVIEIWSNGKYKSVEHRAVTSKKKRRISYALFLCPRDDVEIEPLDHMIDAQKPKLYQKVRYGDYLRQSMKRKMEGKTHMDVARIEDSHLTKKDD

SEQ ID NO: 55558 - protein, 470 aa, Geobacillus stearothermophilus
MVVGDFAIETETLVVGAGPGGYVAAIRAAQLGQKVTIVEKGNLGGVCLNVGCIPSKALISASHRYEQAKHSEEMGIKAENVTIDFAKVQEWKASVVKKLTGGVEGLLKGNKVEIVKGEAYFVDANTVRVVNGDSAQTYTFKNAIIATGSRPIELPNFKFSNRILDSTGALNLGEVPKSLVVIGGGYIGIELGTAYANFGTKVTILEGAGEILSGFEKQMAAIIKKRLKKKGVEVVTNALAKGAEEREDGVTVTYEANGETKTIDADYVLVTVGRRPNTDELGLEQIGIKMTNRGLIEVDQQCRTSVPNIFAIGDIVPGPALAHKASYEGKVAAEAIAGHPSAVDYVAIPAVVFSDPECASVGYFEQQAKDEGIDVIAAKFPFAANGRALALNDTDGFLKLVVRKEDGVIIGAQIIGPNASDMIAELGLAIEAGMTAEDIALTIHAHPTLGEIAMEAAEVALGTPIHIITK

SEQ ID NO: 55559 - protein, 112 aa, Brassica napus
  misc_feature (104)..(104): Xaa can be any naturally occurring amino acid
  unsure (1)..(112): unsure at all Xaa locations
MSSLRDGTLCSRKRYQMNVNGESFHGSFKRIKQGDQTQVQLEKNTTMFYQRSKSENARLMKPDVQLHLDTKGHSESFEDRRTYLDLELNLSLSASSTVKAIMKXDECSKGKT

SEQ ID NO: 55560 - protein, 537 aa, Bacillus thuringiensis serovar konkukian str. 97-27
MMMNVPLTISSMMERAEKLFSKKEIVSRTHDTVTTLTYKQLGERTRRLSSALKKLGIKEGERIGTLAWNHHRHVEAYFAIPGIASVLHTINIRLSPQHISYIIQHAEDRILLIDEDLVPLIENIQSQLATVQAYIIMTDKDELPNTTLEPVYHYEKLLEEGDPNFQFVKDIDENTPAGMCYTSATTGNPKGVVYTHRSTVLHCMALGLADTAALSESDAAMAIVPMFHVNAWGLPFAATWFGSKQVLPGPMFTPKILLEMIQAEKVTLAAGVPTIWLGVLQELENNSYDLSSMTRILCGGAAAPKSVIKAFEQKHNVPFIHAYGMTETSPLVTLARLKSYETELSYEEQLEIRSKQGYLVPGVEMKVVGTNGEVKWDSTEMGELCLRAPWIAESYYNDDRTVEGFRDGWLYTGDVVTVDEEGCVKIVDRTKDVIKSGGEWISSVDLENALMAHDAIFEAAVVAVPHPQWQERPVACVVQKKNSTVTKEEIYEFLKPQFAKWWLPDDIVFMEEIPKTSVGKFLKQALRKELEHLHKEK

SEQ ID NO: 55561 - protein, 106 aa, Brassica napus
  misc_feature (13)..(13): Xaa can be any naturally occurring amino acid
  unsure (1)..(106): unsure at all Xaa locations
TCLDGNRKAYVSXVQSKTYPVTGFQWHPEKNAFEWGSSKIPHSEDAVHVTQLIANYLVGEARKSQNRPSPEKVLSNLIYNYKPTYCGYEGRGYDEVYIFAQQRSLL

SEQ ID NO: 55562 - protein, 466 aa, Arabidopsis thaliana
MNSGDVFILSRSKGHDMLAPFTAGWQSADLDPLVIAKSEGSYVYDDTGKKYLDSLAGLWCTALGGNEPRLVSAAVEQLNTLPFYHSFWNRTTKPSLDLAKVLLEMFTANKMAKAFFTSGGSDANDTQVKLVWYYNNALGRPEKKKFIARKKSYHGSTLISASLSGLPPLHQNFDLPAPFVLHTDCPHYWRFHLPGETEEEFSTRLAKNLEDLIIKEGPETIGAFIAEPVMGAGGVIPPPATYFEKVQAVVKKYDILFIADEVICAFGRLGTMFGCDKYNIKPDLVTLAKALSSAYMPIGAILMSQEVADVINSHSSKLGVFSHGFTYSGHPVSCAVAIEALKIYKERNIPEYVAKVAPRFQDGVKAFASGSPIIGETRGTGLILGTEFVDNKSPNEPFPPEWGVGAFFGAECQKHGMLVRVAGDGILMSPPLIISPEEIDELISIYGKALKATEEKVKELKAQHKK

SEQ ID NO: 55563 - protein, 478 aa, Pseudomonas fluorescens
MSQKFDVVVIGAGPGGYVAAIRAAQLGLKTACIEKYIGKEGKVALGGTCLNVGCIPSKALLDSSYKYHEAKEAFKVHGIEAKGVTIDVPAMVARKANIVKNLTGGIATLFKANGVTSFEGHGKLLANKQVEVTGLDGKTQVLEAENVIIASGSRPVEIPPAPLSDDIIVDSTGALEFQAVPKKLGVIGAGVIGLELGSVWARLGAEVTVLEALDKFLPAADEQIAKEALKVLTKQGLNIRLGARVTASEVKKKQVTVTFTDANGEQKETFDKLIVAVGRRPVTTDLLAADSGVTLDERGFIYVDDHCKTSVPGVFAIGDVVRGAMLAHKASEEGVMVAERIAGHKAQMNYDLIPSVIYTHPEIAWVGKTEQTLKAEGVEVNVGTFPFAASGRAMAANDTTGLVKVIADAKTDRVLGVHVIGPSAAELVQQGAIGMEFGTSAEDLGMMVFSHPTLSEALHEAALAVNGHAIHIANRKKR

SEQ ID NO: 55564 - protein, 177 aa, Aegilops tauschii
MAGRDRDPLVVGRVVGDVLDPFIRTTNLRVTFGNRTVSNGCELKPSMVAQQPRVEVGGNEMRTFYTLVMVDPDAPSPSDPNLREYLHWLVTDIPGTTGASFGQEVMCYESPRPTMGIHRFVLVLFQQLGRQTVYAPGWRQNFNTRDFAELYNLGPPVAAVYFNCQREAGSGGRRMYN

SEQ ID NO: 55565 - protein, 533 aa, Pseudomonas aeruginosa UCBPP-PA14
MKLLAFRRLLRIQRVVIRYRLDDLILELPMLPWWLRLLGATLPWRWLPRRKLELTRGARLRLALQDLGPIFIKFGQILSTRRDLLPDDIANELAWLQDKVPPFPPELAVKRIEEQLGAKIEQVFARFEREPLASASVAQVHAARLKSGEEVVVKVIRPNLEPVIRSDIAWLFILARLAERVSSEARRLHPVEVVSDYEKTIVDELDLLREAANASQLRRNFEGSPLLYVPQVYWDWCRPKVLVMERIYGIPVTDLETLRDQRTDFKALAERGVEIFFTQVFRDSFFHADMHPGNIFVSTRAPWSPQYIAVDCGIVGSLTDEDQDYLARNLIAFFKRDYRKVAQLHIDSGWVPAETKVNDFEAAIRTVCEPIFEKPLKDISFGQVLLRLFQTARRFNMEIQPQLVLLQKTLLNIEGLGRQLYPELDLWATAQPFLERWMRERVSPKQLLRNFQQQVEQVPHLSQMARDTLERLSQPHAHNAPPPEWKGSRHDWLGRLVGAVLLVGAAEVGLGQQLEAWPAWVMLAGGVFLILRR

SEQ ID NO: 55566 - protein, 459 aa, Pseudomonas putida
MQQTIQTTLLIIGGGPGGYVAAIRAGQLGIPTVLVEGQALGGTCLNIGCIPSKALIHVAEQFHQASRFTEPSPLGISVASPRLDIGQSVAWKDGIVDRLTTGVAALLKKHGVKVVHGWAKVLDGKQVEVDGQRIQCEHLLLATGSSSVELPMLPLGGPVISSTEALAPKALPQHLVVVGGGYIGLELGIAYRKLGAQVSVVEARERILPTYDSELTAPVAESLKKLGIALHLGHSVEGYENGCLLANDGKGGQLRLEADRVLVAVGRRPRTKGFNLECLDLKMNGAAIAIDERCQTSMHNVWAIGDVAGEPMLAHRAMAQGEMVAEIIAGKARRFEPAAIAAVCFTDPEVVVVGKTPEQASQQGLDCIVAQFPFAANGRAMSLESKSGFVRVVARRDNHLILGWQAVGVAVSELSTAFAQSLEMGACLEDVAGTIHAHPTLGEAVQEAALRALGHALHI

SEQ ID NO: 55567 - protein, 392 aa, Legionella pneumophila str. Paris
MDIALAKRVQKVKPSPTLAVAAKAAQMKAQGLDIIGLGTGEPDFDTPQHIKLAAISAIEAGDTKYTAVDGIVELKEAVKNKFKRDNELDYQLNQILVSVGGKQSCYNLCQAYLNPGDEVIIPAPYWVSYPDMVLLADGVPVIIETTPAQRYKINAQQLEQAITPKTRMIFLNSPSNPSGIAYTQNELKELGDVLKKHPQILIATDDMYEHIIWSQAFTNILNACPELYDRTIVLNGVSKAYAMTGWRIGYAAGPAPLINAMKTIQSQSTSNPCSIAQRAAVAALNGSNESIEEMVNAFHQRHDYVADRLQSIDGIEVIPADGTFYIFPSVQAIIEKRGYANDIEFSEKLLNEVGVALVPGSAFGTEGCIRISFATGIDTLKDALNRLQRFCS

SEQ ID NO: 55568 - protein, 646 aa, Candida albicans
MTSLQQQQQQQRVKYGPPHHIKRRPYHPILESLEFQTNQHLIQEYSLDIVNTLSQLESLTLVNPAMIDLQPEIQWFMRPFLLDFLIELHSSFKLQPTTLFLCLNIIDRYCAKRIVFKRHYQLVGCTALWIASKYEDKKSRVPTLKELTIMCRNAYDEEMFVQMEMHILSTLDWSIGHPTLEDCLQLAIDSNNLSNNTTNDIENKSVRPNRKSSISSAVTAVARFLCELSLYDKYFLSVPPSLIAITANLLSCSMLQIPHASITLKNLIEQEIINPQQKKQKKAFSSNSSRTTTASYTHQNQSDVRHSSFDEDIDLDSGDEGDDDEDYIDEFYETNNYDDTNATTFDESINKSTTINDENQPPQIHTPFLSGLDEDSILSIKKICLMLIIQLSKVTEVLSKKYENLGVIQVINNFHSNYKFIIQSIYENQELLLNTINDSTNNNEIDYKLIQSSEILLQFPKFDEYLTEDEDENVSTDDEANSQPQGYDGSGSDGNNQLFTPKSPNAFSSNSSLTLNNHPQSMVPVTPPSATSQYSLFSNKNNRTHESTSGLNSTCNTPTHISISSFAPPQPPPGSILKPKLTSINSTNSLKIKKLTSNSNSSNINIHHGHHNTKQEKRYSHISIGSNSSSKYDGFSPIKSISTNGS

SEQ ID NO: 55569 - protein, 665 aa, Psychrobacter arcticus 273-4
MPAPISERKLANAIRVLSFDAVQKANSGHPGAPMGMADIAEVLWRKFLKHNPADPSWHNRDRFVLSNGHGSMLIYSLLHLSGYDVSVDDLKGFRQLHSKTPGHPELGYTPGVETTTGPLGQGIANAVGFAIAEKTLAAQFNRDGHNIVDHHTYAFLGDGCLMEGISHEVCSLAGTLELGKLVFFYDDNGISIDGDVEGWFTDDTQARFESYGWQVIKVDGHDTDEITQATEQAIKETTKPSLIICKTTIGAGSPNKQGLAASHGAPLGDDEIVLTRDALSWKHAPFELDDEIYQAWDAKAKGDVQQKNWDANFEAYKKAYPELAAELVRRLEGDLPADFEQKAQEYIQQTQDQGGDVASRKASQNAINILQPLLPELLGGSADLAGSNLTLFKDAKGIQDDDAGNYIYYGVREFGMTAIANGIALHGGFIPYVATFLMFMEYARNAVRMGALMKQRVIHVYTHDSIGLGEDGPTHQPVEQLTSLRTTPNLRTWRPCDATESASAWVEAIKSENNPSALIFSRQSLPHQARDTEQVANITKGGYVLAKEQGELQAIIIATGSEVGLAMQAYATLSENGVGVRVVSMPCAEIFSEQDASYREGVLPANIRARVAVEAAHVDYWYKFVGLDGKVIGMTTYGESAPADELYKEFGITTEAVVDAVNSLV

SEQ ID NO: 55570 - protein, 134 aa, Pseudomonas aeruginosa UCBPP-PA14
MKDWLDEIHWNADGLVPAIAQDHETGRVLMMAWMNREALALTASENRAIYWSRSRGKLWRKGEESGHVQKLHELRLDCDADVVILMVEQVGGIACHTGRESCFYRVFENGAWKTIDPVLKDPDAIYEHAGHHHE

SEQ ID NO: 55571 - protein, 465 aa, Candida albicans
MFPNSPDAFHQVRMMQSSIKASNFKLQSMEFRCHSNNVCEYQMEMLHHLLSVEAKTLPSLSLIEQQPEIKLGMRPLLLDFLMEVITILNLSRSTFPLTVNLIDRYCSTRIVKKQHYQLLGLTSLWISCKNLDSKFKVPTLNDLRKICVDSYYKELFVEMEKHILKSLEWVVNAPTFDAFIDLYSNLLISNSSNFEVANIIKKSSHKIKLFSNYIGELFQFYPNIYYDYTSSQIALIAILITVLTLKIPVDLISLLNFYNGLVKTEMFKSNVEQGAEDQFEEILSVDSFKSLFNKSFFKNLIKIIDNPPSSLKIKYFAENGKYSVLMKQLVTTASNTLKCILDPVPTTPKANSFVKHQQQQHHYHPRPPMSINTSMIPLTPVSNSTSPNRFSPDQIFSENESTPGIAFGTMTPDSQSTSPGEKRSYECIDELEIGTSTIAGYTLKNHDTLKRSKSANYGTLFYLQQ

SEQ ID NO: 55572 - protein, 428 aa, Medicago sativa subsp. x varia
MKFSEEKNVSNNPTNFEGGLDSRKVGQNRRALGVINQNLVVEGRPYPCVVNKRALSERNDVCEKKQADPVHRPITRRFAAKIASTKTSNAEGTTKRSNLAKSSSNGFGDFIFVDDEHKPVEDQPVPMALEQTEPMHSESDQMEEVEMEDIMEEPVMDIDTPDANDPLAVAEYIEDLYSYYRKVESTSCVSPNYMAQQFDINERMRAILVDWLIEVHDKFDLMHETLFLTVNLIDRFLEKQSVVRKKLQLVGLVAMLLACKYEEVSVPVVGDLILISDRAYTRKEVLEMEKVMVNALKFNISVPTAYVFMRRFLKAAQADRKLELLAFFLIELSLVEYAMLKFSPSQLAAAAVYTAQCTMYGVKQWSKTCEWHTNYSEDQLLECSSLMVDFHKKAGTGKLTGAHRKYCTSKFSYTAKCEPASFLLENEL

SEQ ID NO: 55573 - protein, 241 aa, Brassica napus
  misc_feature (217)..(217): Xaa can be any naturally occurring amino acid
  unsure (1)..(241): unsure at all Xaa locations
MAMTTMEIREEDWKVCCGSSDFAKLMVKASPFNSLNAAIESARDIWFNQVNVAAWLEAFAAHPQIGKSPSPSSNSDFARRSVTEQSRAFATTSASSLEELAEWNVLYRQQFGFIFIICASGRTHAEMLAELKGRYANRPIVELEIAAKEQMKITELRMAKLFSEKAKAVSQTESTKPQEDRLRILGGHLNVAEAPKRSRPPITTHVLDVSRGAPAAXGVEVHLEVWNGTTSPSFGHGGRGG

SEQ ID NO: 55574 - protein, 434 aa, Medicago sativa subsp. x varia
MVNTSEENNSNAVMPRKFQGGMNQVGHGGGRIVGQNRRALGGINQNFVHGRPYPCVVHKRVLSEKHEICEKKQADLGHRPITRRFAAKIAGSQQSYAEKTKNSNPLNLNEFGNSIAIDDELKSPEDQPEPMTLEHTEPMHSDPLEMEEVEMEDIEGEMILDIDSCDANNSLAVVEYIEDLHAYYRKIEYLGCVSPTYMDEQLDLNERMRAILVDWLIEVHDKFDLMQETLFLTVNLIDRFLAKQNVVRKKLQLVGLVAMLLACKYEEVSVPVVSDLIHIADRAYTRKDILEMEKLMLNTLQYNMSLPTAYVFMRRFLKAAQADKKLELVAFFLVDLSLVEYEMLKFPPSLVAAAAVYTAQCTVSGFKHWNKTCEWHTNYSEDQLLECSMLMVGFHQKAGAGKLTGVHRKYGSAKFSFTAKCEPACFLLENKNQP

SEQ ID NO: 55575 - protein, 392 aa, Bacillus cereus E33L
MKLFQPSEIVTSLPTQFFASLVAKVNKVVAAGHDVINLGQGNPDQPTPQHIVKALQDAAEKTIHHKYPPFRGHESLKEAVATFYQREYDVVVNPKTEVAILFGGKAGLVELPVCFTNPGDTILVPDPGYPDYLSGVALAKAQFETMPLIAKNNFLPDYTKIDDSIAERAKLMFLNYPNNPTGATASKDFFDETIHFANKHNILVVHDFAYGAIGFDGQKPVSFLQADGAKDTGIEIYTLSKTFNMAGWRIAFAVGNESVIETINLLQDHMYVSIFGAIQDAAREALLSSQSCVIDLVNSYESRRNALISACHSIGWNVDIPTGSFFAWLPVPEGYTSEQFSDILLEKAHVAVAPGVGFGEHGEGYVRVGLLHTEDRLREAINRIDKLNFFKK

SEQ ID NO: 55576 - protein, 399 aa, Bacillus thuringiensis serovar konkukian str. 97-27
MLENQINERSLLLHKELVGKIEITSKVEVNSADDLSLTYTPGVAESCKAIAADEETVYDYTARGNMVAVVSDGTAVLGLGNIGPKAAMPVMEGKSILFKKFANVDAFPLCLGTTDVDEIVTLVKNLEPTFAGINLEDIAAPRCFEIEKRLKEETNIPVFHDDQHGTAIVVLAAVINALKVVSKQMDHVKIVINGAGSAGIAIGKLLLKAGAQHITLVSLEGIVCEGEAWMNEAQIEVSKKTNREHVRGTLKEAIHQADIFIGVSAPNVLTKELVQMMNEKAIVFAMANPIPEIFPEDALEAGAAVVGTGRSDYANQVNNVLAFPGIFRGALDVRATDITEEMKLAAAYGIANIITDEERNANYVIPNPLDKRVVPSVAEAVAKAAIDSGVAQIMKIPSY

SEQ ID NO: 55577 - protein, 316 aa, Bradyrhizobium japonicum USDA 110
MMAGIAPRILCIGIPVRDLTFRVEAVPARGSKANATHLAEICGGNALNAAIAMARLGGRVSFAGPMGDARETSSGFILERMAQEGIDTGHIVRMPDVTTPVSAIMIEPSGERTLTIYRDPGLWSVKLPDADVLLADCRAVLVESRCAGFATSLCAEARRRGIPVIVGVDRAMSLQDGLLTAASHLLFASEQVQETAGIAADGEALRHLAKLTPAFLAATRGPLGTIWLNDAGELEETPAFPVHAVDTLGAGDVFHGAFTLRLAEGAVVREALRFAAAAAALKCTRHGGGLAAPQRVEVERLLDGPPARAPGGSPRL

SEQ ID NO: 55578 - protein, 362 aa, Kineococcus radiotolerans SRS30216
MPGRRASGPVCEDHRRVRESRGRGPSRPHGGRARRASPRRGVRPPAHPARQGAHHPLRGRPGVRRRRARRPGRGVRGDPRPVGGPRRDPHPRRPPRRPGDGHRGAGPGGAAAPGRRPGRDPAVLPHLRDGLLRAPRLRRDRGHAGRAGGLRRDAAQPRRGGRGVPRPGPRQAEHAGQQQDAAGPARRGGRRPVSAGSTTTVVVMGVSGGGKTTVAEGIAAARGWAFAEGDEFHSPANVAKMASGTPLTDEDRWPWLRSIAAWIAAREEAGESVVVTCSALKRAYRDLLARDNPSVVFCELEVPTEVLAQRLAQREGHYMPASLLRSQLDTLEGLQPDERGFRVPVRGGPDRVLAEVLSRVPA

SEQ ID NO: 55579 - protein, 377 aa, Sorghum bicolor
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTAEREIVRDMKEKLAYIALDYDQEMETAKTSSSVEKSYELPDGQVITIAADRFRCPEVLFQPSFIGMEAAGIHETTYNSIMKCDVDIRKDLYGNIVLSGGTTMFPGIADRMRQGNHCLAPSSMKIKVVAPPERKYSVWIGGSILASLSTFQQMWIAKAEYDESGPSIVHRKCF

SEQ ID NO: 55580 - protein, 495 aa, Zea mays
  misc_feature (272)..(272): Xaa can be any naturally occurring amino acid
  misc_feature (355)..(355): Xaa can be any naturally occurring amino acid
  misc_feature (377)..(377): Xaa can be any naturally occurring amino acid
  unsure (1)..(495): unsure at all Xaa locations
MTLSGMAVAFKASTSSVTQQHWSSPTKDQCQYGFTHLSRQKCRKRALCVTAISGKLDLDFTDPSWNQKYQEDWNRRFSLPHINDIYDLEPRRTTFSLKKNRIPLGDGDGSSTDMWNGYVNKNDRALLKVIKYASPTSAGAECIDPDCSWVEHWVHRAGPRKEIYYEPEEVKAAIVTCGGLCPGLNDVIRQIVFTLETYGVKNIVGIPFGYRGFFEKGLKEMPLSRDVVENINLSGGSFLGVSRGGAKTSEIVDSIQARRIDMLFVIGGNGTXMDKTFGFDTAVEEAQRAINSAYIEARSAYHGIGLVKLMGRSSGFIAMHASLSSGQIDVCLIPEVSFTLDGEHGVLRHLEQLLXSRGLIDVCLIPEVSPSHLMENXCLGDTLKVIYLVLGVHMQQKFKKHFKDIGVPADLKYIDPTYMVRACRANASDAILCPVLGQNAVHGAFAGFSGITSGVCNTHYVSLPITEVITTPKHVNPNSRMWHRCLTSTGQPDFH

SEQ ID NO: 55581 - protein, 361 aa, Streptococcus pneumoniae TIGR4
MKPSIHSLVHQTMQEWVLEQGEKKFRADQIWEWLYRKRVQSFEEMTNLSKDLIAKLNDQFVVNPLKQRIVQESADGTVKYLFELPDGMLIETVLMRQHYGLSVCVTTQVGCNIGCTFCASGLIKKQRDLNNGEIVAQIMLVQKYFDERGQDERISHIVVMGIGEPFDNYNNVLNFFRTINDDKGMAIGARHITVSTSGLAHKIRDFADEGVQVNLAVSLHAPNNELRSSIMKINRAFPIEKLFAAIEYYIETTNRRVTFEYIMLNEVNDGVEQALELTELLKNIKKLSYVNLIPYNPVSEHDQYSRSPKECVLAFYDTLKKKGVNCVVRQEHGTDIDAACGQLRSNTMKRDRQKAVAAVNP

SEQ ID NO: 55582 - protein, 158 aa, Zea mays
MAMGLINANPIIHEKKERRIRQAPETTDENAVESIDQLEIFDHIRDIKDPEHPYSLEQLNVVTEDSIELNDESNHVRVIFTPTVEHCSMATIIGLCIRVKLVRSLPPYYKVDIRVAPGSHATEAAVNKQLNDKERVAAALENPNLLDMVEECLSPTFD

SEQ ID NO: 55583 - protein, 477 aa, Medicago truncatula
MNAFDISARSSCHNIALATTPFRHLSSSYHLMTLKLQHHVSIGERRSIRVVRITASLWPNTDSTVSQPSPAESNGALEIDSPYSFLKCDGSKTVHAAERLGRGIVTDAITTPVVNTSVYFFKKTADLIDWKEKRQFSYEYGRYGNPTTAVLEEKMSALEGAESTLFLASGMCTSSVMFLALVPAGGHIVTTTDCYRRTRIFIANMLPKMGITATIIDPADVDALEAALENNKVSLFFTETPTNPFQRCVDIKLVSELCHRKGALVCIDGTFSTPINQKALSLGADLVVNSATKYIAGHHDVLAGCISGSEKLISQVRSFHFILGGTLSPNSAYLVIRGMKTLHLRVQHQNSTAMKMAQLLETHPKVTRVYYPGLPSHPEYALAKRQMTGFGGVVCFDIDGDIMRTIKFVDSLKIPYIAPSFGGVESVVNQPAIMSYWDLPRKEREKYRIYDNTVRFCFGVEGYEDLKDDVLQALDAI

SEQ ID NO: 55584 - protein, 411 aa, Corynebacterium glutamicum ATCC 13032
MSTPQSIVIIGGGLAGAKTAEALRVNGYEGSITLIAAEDYLPYERPPLSKEYMAGKVGFDKAIVHPAEWYKENNVTLRQGVRATAIDAGSRQVTVDDGGNTETINYDKLVLATGSAVRKLPIPGADASNVHYLRTVEDSDAIKATFGEGKKLVLIGGGWIGLEVASAARGAGTDVTVLEGGKLPLLKVLGETVAQVFADLHVANGVDLRTEVKITDIVTEDGRAVGVRLDDGEVVPADAVVIGIGVTPVIDLAETAGLEIDNGVLVDAALRTSDPDIYAVGDIANHDHPVLGHRIRVEHWATALNQPAAAVKSLLGKDAEFTNLPYFFTDQFDLGCEYVGHATGSQEKVFIRGNLETREFVAFWVDTENRILAAMNVNVWDVPDQIKPLIASGKSVDTEKLVDPEVPYSEL

SEQ ID NO: 55585 - protein, 472 aa, Rhodococcus sp. RHA1
MNTVHEPPKSTGLQQAMKPRQLVMMSLGGAIGAGLFVGSGAGIAVAGPAVLVSFLIAGFLVVLVMRMMGEMVAADPDSGAFSVHAENAMGPVAGRTIGWLYWVQVVIVVAAEATAAAAITAASIPAVPQWAAALAYMSVLTAVNLAGVSRFGEFEFWFAALKIVAIVAFLAVGSAMILGWIPSFDAPGLSNLTGHGGFAPNGVTGIAAGLLIVVFAFGGTEVMAIAAAETSEPRRNVSRAVRSIVWRILVFYVGSVLIMVTVLPWTADELATGPFVAVLNAAHVPGAGAVMTVVVVIALLSSLNAMLFSGSRMIYSLSERGAAAKVFGRVSGNGVPRVAVLASVTFGFVTVVLNYLAPDRVLPLLLNAVGSTILVLWTFVTVSQIVLRRRAERSGRTDLPLKMWGFPYLSYVALALLAAVAVLALFDDAAGNQLFATLTFTCAITVACWVLGRRQRGAAADSTPEKTPETVG

SEQ ID NO: 55586 - protein, 494 aa, Oryza sativa (japonica cultivar-group)
MGVTKAEAVAGDGGKVVDDIEALADLRKEPAWKRFLSHIGPGFMLLWVILIGLIFALIIQSLSANLGVVTGRHLAELCKTEYPVWVKTCLWLLAELAVIASDIPEVIGTGFAFNLLFHIPVWTGVLIAGSSTLLLLGLQRYGVRKLEVVVALLVFVMAGCFFVEMSIVKPPVNEVLQGLFIPRLSGPGATGDSIALLGALVMPHNLFLHSALVLSRNTPASAKGMKDVCRFFLFESGIALFVALLVNIAIISVSGTVCNATNLSPEDAVKCSDLTLDSSSFLLRNVLGKSSATVYGVALLASGQSSTITGTYAGQYVMQGFLDIKMKQWLRNLMTRSIAIVPSLIVSIIGGSSGAGRLIVIASMILSFELPFALIPLLKFSSSSNKMGENKNSIYIVGFSWVLGFVIIGINIYFLSTKLVGWILHNALPTFANVLIGIVLFPLMLLYVVAVIYLTFRKDTVKFVSRRELQAGDDTEKAQVATCVADEHSKEPPV

SEQ ID NO: 55587 - protein, 402 aa, Pseudoalteromonas tunicata D2
MTVNRELFDEVMVPNYAPSAVIPVRGEGSHVWDQADNEYIDFAGGIAVNCLGHCHPALVNALKVQSEKLWHVANVMANEPAIRLAKKLVDATFADKVYFANSGAEANEAALKLARRFALDNYGEHKSQIIAFNQGFHGRTFFTVTVGGQAAYSDGFGPKPGNIDHCNYNDLAAFEALISDNTCAVMLEPLQGEGGIISPTVEFIQGVRALCDKHNALLIFDEVQTGVGRTGHLYAYQGLAVTPDILTTAKALGGGFPIGAMLTTTDIAKHLKVGTHGSTYGGNPLACAVAEAAFDTVNTPEVLNGVKEKEALFRQLFTQINDKYHVFKEMRGEGLLLGAVVAEQYQGKARDFMLASIDNGLMALVAGVNVVRFAPSLVIPEADIREGMARFEKAVAQVVNAQ

SEQ ID NO: 55588 - protein, 486 aa, Pseudomonas sp. CF600
MKEIKHFINGAFVGSASGRTFEDVNPANGQVIARVHEAGRAEVDAAVQAARAALKGPWGKMSVSERAEILHRVADGITARFDEFLEAECLDTGKPKSLASHIDIPRGAANFKVFADLLKNVATEAFEMATPDGSGAINYAVRRPKGVIGVISPWNLPLLLMTWKVGPALACGNTVVVKPSEETPLTTALLGEVMQAAGVPAGVYNVVHGFGPDSAGAFLTEHPDVNAITFTGETRTGEAIMRAAAKGVRPVSFELGGKNAGIVFADCDLDKAIEGSMRSVFANGGQVCLGTERLYVERPIFDEFVARLKAGAESLVIGTPDDPQANFGPLISLQHREKVLSYYQKAVDEGATVVTGGGVPEMPAELAGGAWVQPTIWTGLADGAAVVTEEIFGPCCHIRPFDREEEAVELANSLPYGLAATIWTENTSRAHRVAGQLEAGIVWVNSWFLRDLRTAFGGSKQSGIGREGGVHSLEFYTELKNICVKL

SEQ ID NO: 55589 - protein, 209 aa, Brassica napus
GDNHLPKVYPVGPVLNIKTNGSDSMDNKQAEILRWLDEQPRESVVFLCFGSMGGFREDQAKEIAIALERSGHRFLWSLRSAKPKGTMGPPGEFTNLEEILPEGFLDQTAKIGKIIGWAPQSAILANPAARGFVTHCGWNSTLESIWFGVPIATWPLYAEQQVNAFEMVEELGLAVEIRNSFRANFMAEESELVTAEEKRRVSRCLMGTG

SEQ ID NO: 55590 - protein, 397 aa, Burkholderia mallei ATCC 23344
MNTAADSLLRLASRVDAIEPFYVMEIVKEAAVLERAGRDIIHMSIGEPDFTAPEPVVDAAAAALRRGVTQYTSALGIAPLREAIAAHYARAHGLSIAPERIVVTAGASAALLLACLALVGRDDEVLMPDPSYPCNRHFVATAEGRAVLVPSGPETRFQLTADDVKTRWGERTRGVLLASPSNPTGTSLEPAELGRIIDAVRARGGFSIVDEIYQGLSYDGAPVSALSFGDDVVTVNSFSKYFNMTGWRLGWLVVPPALVGTFEKLAQNLFICPSALAQHAALACFEPDTLAIYEARRAEFRRRRDFIVPAIESLGFKVPVMPDGAFYVYAQCGGVAHPAAGDSAALVNAMLHDAGVVLVPGMDFGVHAPRDYIRLSYATAYSRLEEAVERLGKLFGR

SEQ ID NO: 55591 - protein, 455 aa, marine gamma proteobacterium HTCC2080
MNATLDTATLKRLDQDHHFHPFTDFNDYAQNGGRIISRAEHIYIYDSDGHQIQDGMSGLWCCNLGYSMDAIKEAVAAQLHELPFYNNFFRCSNQPAVELASKLVEVTPDGFNHAFFTNSGSEANDTQLKLVHRYFDILGKPNKKHIISRKNAYHGSTIAASSLGGMSAMHDQTMGLNYIHHIDQPHWFERGGDLDEASFGIQAARELEAKIDELGEENVAAFIAEPVQGAGGVIIPPETYWPEIKRILDERDILFISDEVICGFGRTGRWFGCETYGMEPDLITFAKAVTNGFMPLGGSMINDKMADVLLSGGGEFAHGLTYSGHPASCAAGLATLDIYQNTGIIEKTATDLAPHFGMRVKELESHALVGQVRVLGMFAAAELVRDKSSRERLAPESAGAVYCRDRAIEDGLMVRQTGDAMIMAPPFVTTPAEIDTLFEKLTAALDKTAGHYSVT

SEQ ID NO: 55592 - protein, 505 aa, uncultured bacterium
MKRTALLTVAQMTKADEVTIQSGTAGHVLMDRAGRAVAKAILARWTERPVVVLCGPGNNGGDGLVIARYLLGEGWPVRVAVLGELWAYWGDALVHARGWDPSSCVPVGPEALAGAALVVDALFGAGLSRPLDGAAALTLHAAARAGMPVVAVDVPSGVFGDTGVDTGAAQAALTVTFFRKKPAHVLMPGRALCGEVIVADIGMGADVAESVQPGAFENAPECWASDWPFLGAEQHKYQRGHALVYGGGLMTGAARLSARAAARVGAGLTTVSVPELAWAVYAAALDSIMVQPLPGQDALALSASLHEVLGDARISAVLVGPGAGGGLAKGVRPLVEVALASGRPVVLDADALSAFESDPQALFTAIKASPGAVVLTPHEGEFARLFPQAAALPSRDKLSRARWAARQSGAVVVLKGADTVISSPDGRALVNTNAPPWLATAGAGDVLAGMVTGLLAQGMDALMAASAAVWLHGEAAQAFGPGLIADDLPAQLPAVLRKLLAPSSD

SEQ ID NO: 55593 - protein, 162 aa, Campylobacter jejuni
STTATLVMGDALAAALMKVRNFKPDDFALFHPGGSLGRKLLTKVKDLMVSSNLPIVHPDTEFNDLVDVMTSGKLGLCVVLENEKLIGIITDGDLRRALKTSDKPRFDFKAKEIMSTNPKVVDADAMASEAEEIMLKHKIKEIVVSKEDKVVGIIQLYAIGNV

SEQ ID NO: 55594 - protein, 64 aa, Actinobacillus pleuropneumoniae serovar 1 str. 4074
MPFGYVDILTNPDIRAELPKFANWPTFPQLWVEGELVGGCDIVLEMFQKGELQTLLKEVAAKHA

SEQ ID NO: 55595 - protein, 446 aa, Chromobacterium violaceum ATCC 12472
MNHPLTTRSEFDHLDLRAHWMPFSANRNFQRDPRLIVSGEGNYLTDADGRRIFDSLSGLWCCGAGHSRKEIAEAAYRQLSTLDYSPGFQFGHPLSFRLAERVAAMAPGALNHVFFTNSGSECADTAVKMARAYWRLKGQASKTKLIGRARGYHGVNIAGTSLGGMNGNRKLFGPLMDADHLPHTLLPANAFSRGLPEQGAELADDLLRLIELHDASNIAAVIVEPMAGSAGVIVPPQGYLQRLREICTQHGILLIFDEVITGFGRTGSLFGADHFGVTPDIMNLAKQLTNGAVPMGAVVASSEIYDAFMAQATPEYAVEFAHGYTYSAHPVACAAALAALDVLEQENLVARAAELAPHFERGIHGLKGLPHVIDIRNCGLAGAVQIAPSGGDAIVRPYEAAMALWRKGFYVRYGGDALQFGPPFTATPQELDSLFDAVGETLAKLA

SEQ ID NO: 55596 - protein, 209 aa, Oryza sativa (indica cultivar-group)
MATAAAADSTSAVPPAVVSAAEDTLAAAESVGDHLAEMVAAAGEDPDAIAELPPLRRARAFLAMAKAAASLFAGRQLSRCSGVDPDEHPIKKEFERLSLWEEKLNRFEDWDKAPLRPTTTVNTQAAARFIGHSLPHLTTDQKRSMQAISRGEGGSYSGNKRKPQPPRPNKKSVRAATEEFLAKAALELSGHNDSKVKGPIRLLSDEDED

SEQ ID NO: 55597 - protein, 177 aa, Arabidopsis thaliana
MSSNKIVLTSSDGESFQVEEVVARKLQIVKHLLEDDCVINEIPLQNVTGNILSIVLEYCKKHVDDVVDDDASEEPKGDDASEEAKQNLDAWDAEFMKNIDMETIFKLILAANYLNVEGLLGLTCQTVADYIKDKTPEEVRELFNIENDFTHEEEEEAIRKENAWAFEADTKHEDPKP

SEQ ID NO: 55598 - protein, 448 aa, Streptococcus pneumoniae TIGR4
MREYDIIAIGGGSGGIATMNRAGEHGAKAAVIEEKKLGGTCVNVGCVPKKIMWYGAQIAETFHQFGEDYGFKTTDLNFDFATLRRNREAYIDRARSSYDGSFKRNGVDLIEGHAEFVDSHTVSVNGELIRAKHIVIATGAHPSIPNIPGAELGGSSDDVFAWEELPESIAILGAGYIAVELAGVLHTFGVKTDLFVRRDRPLRGFDSYIVEGLVKEMERTNLPLHTHKVPVKLEKTTDGITIHFEDGTSHTASQVIWATGRRPNVKGLQLEKAGVTLNERGFIQVDEYQNTVVEGIYALGDVTGEKELTPVAIKAGRTLSERLFNGKTTAKMDYSTIPTVVFSHPAIGTVGLTEEQAIKEYGQDQIKVYKSSFASMYSACTCNRQESRFKLITAGSEEKVVGLHGIGYGVDEMIQGFAVAIKMGATKADFDATVAIHPTASEEFVTMR

SEQ ID NO: 55599 - protein, 430 aa, Glycine max
  misc_feature (53)..(54): Xaa can be any naturally occurring amino acid
  misc_feature (89)..(89): Xaa can be any naturally occurring amino acid
  unsure (1)..(430): unsure at all Xaa locations
SVFHSTFGEIKDGPKSLQSISGQSNSSTYVEAESRRSGSELNSMDASDNSTDXXRRSAFPSLSQRPSNLREFTVSELKTATKSFSRFSXMLGEGGFGCVYKGLIKSVDDPSTKIEVAVKQLGRRGIQGHKEWVTEVNVLGIVEHPNLVKLVGYCADDDERGIQRLLIYEYMPNRSVEHHLSPRSDTPLPWSRRLKIAQDAARGLTYLHEEMDFQIIFRDFKSSNILLDELWNAKLSDFGLARLGPSDGLTHVSTAVVGTMGYAAPEYVQTGRLTSKSDVWSYGVFLYELITGRRPIDRNRPKGEQKLLEWVRPYLSDGRRFQLILDPRLERRHILKSAQKLAIIANRCLVRNPKNRPKMSEVLEMVTRVVESSVSTNLQPPLKSVASAEASQAAEIKNKKVTKDQNPDCNWLRMWRPKLLRALDCCSFKV

SEQ ID NO: 55600 - protein, 438 aa, Psychrobacter arcticus 273-4
MYAEETNNVTAIKDIRAREILDSRGNPTIEADVILADGTIGRAAAPSGASTGSREALELRDGDKSRYMGKGVKKAVANVNSQIRSALMDKNVTAQQAIDDAMIALDGTDNKDNLGANAILAVSLAVAKAAAKSQSLPLHQYIADLRNQTSLTMPVPMMNIINGGEHADNTVDIQEFMIEPVGFSSFSEALRAGTEIFHSLKSVLKSQGLNTAVGDEGGFAPNLRSNEEAITVIMQAIEQVGYTAGKDIHLALDCAATEFYKDGKYILAGEGNKSFDSQGFSDYLVGLARQYPIISIEDGLDESDWDGWKYLTEQIGDKVQLVGDDLFVTNPAILQEGIDKHIANAILIKFNQIGTLSETLDAIYLAKKNGYATIISHRSGETEDSTIADLAVGTAAGQIKTGSLCRSDRVAKYNQLLRIEQQVRASYRGREEFIGLRG

SEQ ID NO: 55601 - protein, 245 aa, marine gamma proteobacterium HTCC2080
MYHGDEDRPIIIYFHGGGWVIGDLDTHDPFCRALVAATDCTLMSVDYRLAPEYPFPAAHDDSFQATRWILDNLNTLAPNNGTAIIAGDSAGGNLAACTLASMPEEPRLVGSILLYPTTEHYLHGFPSFSEHARSKPLTAPIMRWFFDTYMGDITPADPAAKQVFLNRRTDYRNFPRSLIVTAERDVLRDDGRRLGIRMRQAGVDVTYHHYDDEAHGFACSEGPTLGHQHFISLAQEWLKPFSTKP

SEQ ID NO: 55602 - protein, 125 aa, Ehrlichia ruminantium str. Welgevonden
MSNLLKEFNEQQIKLLSNREIPKFKSGDTLRVTMKIFDSAGERIQTFEGVCIKRRNNGLHSSFTLRKISYNESIQLQVFLYSPTIESIEVVKFGKVRRAKLYYMLSLFGKSARIKERIDRSKKSS

SEQ ID NO: 55603 - protein, 324 aa, Burkholderia thailandensis E264
MIRRLTYREALRDALRDALSNDPRVFLMGEDVGRYGGSYAVSAGLLEAFGPERVRDTPLSELAFTGMGIGAALGGMRPIVEIMTVNFSLLALDQIVNTAALYHHMSGGQFSVPLVIRMATGAGRQVAAQHSHSFEGWYAGIPGIKVLAPATVEDARHMLAPALADPDPVLIFEHAGLYNMEGDLSAMTSVDIRSAKVRRDGGDVAILAYGGSLPKALEAADALAGEGISAEVVDLRVLRPLDDATIMASVIKCRRAVIVDECWRSASVASEIVARIVEQAFYELDAPLARVCAEDVPIPYARHMEEAALPQVDKIVAAVKQLLS

SEQ ID NO: 55604 - protein, 978 aa, Bacillus thuringiensis serovar konkukian str. 97-27
MAEQTVRVTVDGKEFSASGEKTILQLFNESNLEHPQICHVPEVDPIQTCDTCIVEVDGKLMRACSTQIENGMHIERQSQRAKEAQTEAMDRILENHLLYCTVCDNNNGNCKVHNTVHMMGIEEQKYPYEPKVSACEVDMSHPFYRYDPNQCIACGQCVEVCQNLQVNETISIDWSLDRPRVIWDHGVSINDSSCVSCGQCVTVCPCNALMEKSMLGEAGFMTGLKPDVLDPMIDFVKDVEPGYSSILAVSEVEAAMRKTKVNKTKTVCTFCGVGCSFEVWTKDRHILKVQPVSDAPVNGISTCVKGKFGWDFVNSEDRITKPLIRQGDMFVEASWEEALEVVASNMQHIKSAYGSDAFGFISSSKVTNEENYLMQKLARQIYGTNNVDNCSRYCQSPATDGLFKTVGMGGDAGTVKDIAEAGLVIIVGANPTEGHPVLATRVKRAHKLHEQKLIVADLRKHEMAERADLFIHPRQGTDYVWLAGITKYIIDQDWHDKKFIAENVKNFDEYSKMVEKYTLDYTEEITGISKENLKEMARMVYEADGTCVLWGMGVTQNTGGSTTSAAISNLLLVTGNYRRPGAGAYPLRGHNNVQGACDMATLPNWLPGYQAVSDDTLRAKFEKAYGTTIPKAPGLNNIAMLLAAEEGKLRGMYVMGEEMALVDSNANHVQHILANLDFLVVQDMFLSKTARFADVILPAAPSLEKEGTFTNTERRIQRLYEVLKPLGDSKPDWWILQKVARALGGDWNYESPSEIMDEIASLAPLYSQATYDRLEGWNSLCWGSHDGSDTPLLYVDGFNFPDKLARLSLDEWIPPVVAPDEYDLLLNNGRMLEHFHEGNMTNKSAGILSKVSEVFVEISPELAIERNVKDGGLVELASPFGKIKVQALITDRVTGKELYLPMHATINEEAINILTGTATDLYTCTPAYKQTMVKMRVLREKGNRPLPSSNPRDKNRNPQNGVEIEQKWQRKQYVSLVD

SEQ ID NO: 55605 - protein, 453 aa, marine gamma proteobacterium HTCC2080
MTSEAFDFDLFVIGAGSGGVRAARVAASLGARVAIAEDRYMGGTCVNVGCVPKKLYVYASEFSKGFTDSAGFGWQGDAPTFDWPTLRDRKKAEISRLNAIYERLLEAPGATIISGRAQLSDPHTVTIEGQTFRAEKILIATGTWPYLPDLPGKQHMLTSNEIFDLEHFPKRLLIVGGGYIATEFAGIFNGLGAEVVQAYRGDLFMRGFDDDVRRFLAQEVRKTGVDLRFNTNPKSIDTSTNGYRVVFEDDTEVEVDAILCATGRRPNIADLNLQCTSVALNENGFIAVNDEFQTAEASVYALGDLIGGEQLTPVALAEGMAFAHREFGSGGHEVDYDFIPTAVFSQPNVGTVGYTEEEARQSFGRLDIYRSEYRPMKHTLSGRDERSMMKLIVDQASQRVLGVHMVGPDAGEILQGMAIALRMGATKRDFDQTIGIHPTAAEELVTLRDVDSD

SEQ ID NO: 55606 - protein, 167 aa, Panax ginseng
MFSMVTEFMNYGQQTVRAARYIGQGFMITLSHANRLPVTIQYPYEKLITSERFRGRIHFEFDKCIACEVCVRVCPIDLPVVDWKLEMDIRKKRLLNYSIDFGICIFCGNCVEYCPTNCLSMTEEYELSTYDRHELNYNQIALGRLPMAVIDDYTTRTILNLPEIKNA

SEQ ID NO: 55607 - protein, 923 aa, Glycine max
  misc_feature (34)..(34): Xaa can be any naturally occurring amino acid
  misc_feature (339)..(339): Xaa can be any naturally occurring amino acid
  misc_feature (694)..(694): Xaa can be any naturally occurring amino acid
  misc_feature (706)..(706): Xaa can be any naturally occurring amino acid
  unsure (1)..(923): unsure at all Xaa locations
VGDMGKRLLAFEKFAGRAGMIDFLRGLGQRFLVXGYSTPFLSLGSSYMYPSLAAAKAAVISVGEEIATQGLPLGICPLVFVFTGSGNVCSGAQEIFKLLPHTFVDPSKLRDLHRTDKDQPRHASKRVFQVGGRVGGRVGQDMVEPKDHVIVFDKADYYSHPEHYNPTFHEKIAPYASVIVNCMYWEKRFPQLLSYKQMQDLMSQGCPLVGIADITCDIGGSIEFVNRATSIDSPFFRYDPLTNSYHDDMEGNGVICLAVDILPTEFAKEASQHFGNILSQFVINLASATDITKLPAHLRRACIANKGVLTSLYDYIPRMRSSDSEEVSENAENSLSNKXVSLSGHLFDQFRLNEALDIIEAAGGSFHLVNCHVGQSVEAVSFSELEVGADDRAVLDQIIDSLTAIANPTENDRFSNQDSSKISLKLGKVEENGIEKESDPRKKAAVLILGAGRVCQPAAEMLSSFGRPSSSQWYKTLLEDDFECQIDVEIIVGSLYLKDAEQTVEGIPNVTGIQLDVMDHANLCKYISQVDVVISLLPPSCHIIVANACIELKKHLVTASYVDSSMSMLNDKAKDAGITILGEMGLDPGIDHMMAMKMINQAHVRKGKIKSFTSYCGGLPSPEAANNPLAYKFSWNPAGAIRAGRNPATYKWGGETVHIDGDDLYDSATRLRLPDLPAFALECLPNRNSLLYGXDLYGITEASTIXRGTLRYEGFSEIMGTLSRIGLFNNEAHSLLMNEQRQTFRKFLFELLKVVGDNPDELLIGENDIMEQILIQGHCKDQRTAMETAKTIIFLGLLDQTEIPASCKSAFDVACFRMEERLSYTSTEKDMVLLHHELEIEYPDSQITEKHRATLLEFGKTLDGKTTTAMALTVGIPAAVGALLLLTNKIQTRGVLRPIEPEVYTPALDIIEAYGIKLIETTE

SEQ ID NO: 55608 - protein, 222 aa, Erythrobacter sp. NAP1
MSKTETIPDQDALRRVGKQVRERLDNDPGVYKIDTPMAELYAVGDFLSMAECERLCLMVDQTARPSSLHEIGYDSGFRTSYSGDLDPFDSFVKGIGRRIDDLLGLPSEIGEAIQGQRYLPGQQFKPHNDWFYTTENYWKGERERGGQRSWTTMAFLNDVEAGGETHFTHIGIKIEPKPGVLLIWNNALPDGTPNEDTMHAGTPVLKGAKYIITKWYRTRKWK

SEQ ID NO: 55609 - protein, 393 aa, Panax ginseng
MTASATRNDLMIVNLGPQHPSMHGVLRLIVTLDGEDVIDCEPILGYLHRGMEKIAENRTIIQYLPYVTRWDYLATMFTEAITVNAPEQLGNIQVPKRASYIRVIMLELSRIASHLLWLGPFLADIGAQTPFFYIFRERELIYDLFEAATGMRMMHNYFRIGGVAADLPHGWIDKCLDFCDFFLTRVTEYQKLITRNPIFLERVEGVGIIGGAEAINWGLSGPMLRASGIQWDLRKVDHYESYDEFDWGVQWQKEGDSLARYLVRISEMTESIKIIQQALEGIPGGPYENLEIRRFDKVRDPEWNDFDYRFISKKPSPTFELSKQELYVRVEAPKGELGIFLIGDRGVFPWRWKIRPPGFINLQILPQLVKRMKLADIMTILGSIDIIMGEVDR

SEQ ID NO: 55610 - protein, 300 aa, Rhodococcus sp. RHA1
MHPVSTRHRIRLVGAAIATSLSPALHEHEAAALGLTDYRYDLLDVAAEGIPVDDSGDTLRQAVAAGCTGLNITHPCKQVVVDSLDELSDNARLLGAVNTVVVRDGRLVGHNTDHSGFLAALRRGLPDARLGRVVLAGAGGAGSTVAYALAAAGVTDLRVADLDPARAADVCARVAAAFPQTRVTAIPLDAIEATLGHCDGVVNASPIGMVGHPGTPFDTDALRPGLWVADIVYRPLRTELVTAAIALGCDVLDGGQMLVAQAADTFALLTGVVPDPDRMRRHLGELLADQCAPTVLEESR

SEQ ID NO: 55611 - protein, 298 aa, Haemophilus influenzae R2866
MSAQNPLFSGSIVALVTPMNHYGEVDFSCLEKLVEHHIEAGSNALVSVGTTGESATLSIEENVKVIEKTVEFAKGRIPIIAGAGANATSEAITMTKLLRDSGVAGCLSVVPYYNKPTQEGMYQHFKAIAECTDLPQILYNVPIRTGSDMKPETVARLAEIENIVGIKEATGDVSRIVKIKQLAGKNFIVLSGNDATGLEAIKLGAEGVISVTNNIAAKDMADMCRYALAGDFDKAEEINARLMRLHHDLFIESNPIPVKWAAYRLGLIKSPHLRLPLTTLSEEIQPKVEDALKIAGLL

SEQ ID NO: 55612 - protein, 179 aa, Actinobacillus pleuropneumoniae serovar 1 str. 4074
MNQLDLIKSSIKSIPDYPKAGIIFRDITSLLEVPEAFKATVDAIVAEFKDKGITKVVGTESRGFIFGAPVALALGVPFVLVRKPKKLPRAVISQSYALEYGEDTLEIHLDSVKENDNVLMVDDLLATGGTIDATAKLIRRLGGKVEHAAFVIWLPDLGGKERLEKEGINSFTLVEFAGH

SEQ ID NO: 55613 - protein, 105 aa, Brassica napus
ILWGLIFLYETRHVAFVSLRLVIVNTASSMASGAIRRFQDRVLGPSRTGIPSTTSEIWLLGVCYKISEAESLGEADAFRQDFSSLILITYRRGFEPIGETTYTSD

SEQ ID NO: 55614 - protein, 665 aa, Streptococcus pneumoniae TIGR4
MSEKNFYITTPIYYPSGKLHIGSAYTTIACDVLARYKRLMGYDVFYLTGLDEHGQKIQQKAEEAGITPQAYVDGMAVGVKELWQLLDISYDKFIRTTDDYHEKVVAQVFERLLAQDDIYLGEYSGWYSVSDEEFFTESQLAEVFRDEAGNVTGGIAPSGHEVEWVSEESYFLRLSKYQDRLVEFFKAHPEFITPDGRLNEMLRNFIEPGLEDLAVSRTTFTWGVPVPSNPKHVVYVWIDALLNYATALGYAQDEHGNFDKFWNGTVFHMVGKDILRFHSIYWPILLMMLDVKLPDRLIAHGWFVMKDGKMSKSKGNVVYPEMLVERYGLDPLRYYLMRNLPVGSDGTFTPEDYVGRINYELANDLGNLLNRTVSMINKYFDGQIPAYVEGVTEFDHVLAEVAEQSIADFHTHMEAVDYPRALEAVWTLISRTNKYIDETAPWVLAKDEALRDQLASVMSHLAASIRVVAHLIEPFMMETSRAVLTQLGLEEVSSLENLSLADFPADVTVVAKGTPIFPRLNMEEEIAYIKEQMEGNKPAVEKEWNPDEVELKLNKDEIKFEDFDKVEIRVAEVKEVSKVEGSDKLLQFRLDAGDGEDRQILSGIAKYYPNEQELVGKKVQIVANLKPRKMMKKYVSQGMILSAEHDGKLTLLTVDPAVPNGSVIG

SEQ ID NO: 55615 - protein, 216 aa, Legionella pneumophila str. Paris
MSELKIKAAKAAIAYIEDDMVIGVGTGSTVNFFIKELAAIKHKIEACVASSKATEALLRAEGIPVIDLNSVQDLPIYVDGADEVNERGEMIKGGGGALTREKIVANVATQFICIVDESKVVKRLGEFPVAVEVVPMARSFVARQIVKLGGDPEYREGFVTDNGNIILDVFNLNFSTPMALEDSLNVIPGVVENGVFAKRLADKVLVASASGVNNLK

SEQ ID NO: 55616 - protein, 94 aa, Triticum aestivum
  misc_feature (75)..(75): Xaa can be any naturally occurring amino acid
  misc_feature (78)..(78): Xaa can be any naturally occurring amino acid
  unsure (1)..(94): unsure at all Xaa locations
MKAHFCRTVLSLPPIINGALSAIPLQTKNVFIECTATDLTKAKIVLNTMVATFSEFCARKFEIEPVEVTYDDGKXHLXKDLAVYDMEVPLSVIT

SEQ ID NO: 55617 - protein, 347 aa, Bacillus thuringiensis serovar konkukian str. 97-27
MKDLIIIGAGQAGLTMGYYLKQEGYNFLLLEAGNRVGDSWRNRYDSLQLFTPRSYSSLPGMALIGEKNEFPYKDEIATYLEEYARHFQLPVQLQTEVLKIRKEKGIFELHTSTEILQTKKVIIATGGFQQPFIPSVSANLSSHVFQIHSSQYKSPSQIPQGKVLVVGGGNSGMQIAVEFAKTHEVTMSISHPLTFLPLHFFRKSIFNWLEKLGLLYAEVSTKRGKWFQKRKDPIFGFEGKELIRNGAIQLQEKVVSASENNIMFQNGETYSAESIIWSTGFIQNYNWIEIEKVVNENGLPNHIKGISPVRGLYYIGLPWQSQRGSALICGVGKDAAYLLSEIKKIDQ

SEQ ID NO: 55618 - protein, 729 aa, Oryza sativa (japonica cultivar-group)
MAGWLAWHVPQGLWKDVPLGTASSTTIASYLLGLWSRAHRHSLPAPAPAPAPAPAPETHRPGIRHPVPRHHRKRPHVAPPLPPPSSSERQVAPYQLFPRIDELEIEIAAGTFLKQSQVRIMGAGSSLQDPEKTTVTVDLVPLGQKFDRTSALLTSNRFLQKKVPINSSIFGDYNVIYVHYPGLPSLVPSVPGSLGPISSSQYPFSANVHNRRHQKINSKSVAIIALSAVVLVLMSFGICIIWKYKGFEKSRGTGRVSNSSATRKTGMRSSFSSMTSSTASFVSTIATCPPTVKTFSISELEKATENFSFNKIIGEGGYGRVYRGTIDDEVDVAVKLLTRKHQNRDREFIAEVEMLSRLHHRNLVKLIGICIERSTRCLVFELVPNGSVESHLHGSDKIYGPLDFDTRMKIALGAARGLAYLHEDANPHVIHRDFKASNVLLENDFTPKVADFGLAKEASEGMDHISTQVMGTFGYVAPEYAMTGHLLVKSDVYSYGVVLLELLSGRKPVDMTQPPGSENLVTWARPLLTDRDGLQQLVDPSMPAASYGFEKLAKAAAIASMCVHVEASHRPFMGEVVQALKLIYNGNNDDTCTSGSFGGGGGEEYEDEEASSPWNNRSWSHDFAVTPTPGVAQAGVPAGSGPPDDDGLQLGPGRRGGGDVVGVGAAAAVDVEPGAGQDRVAGGVRLVRPAEGQQGEELLQAEGKHERAWRPSFRRLLHGGLLDVVAKAE

SEQ ID NO: 55619 - protein, 467 aa, Pseudomonas aeruginosa UCBPP-PA14
MTHDTGLRRGLNARHIRFMALGSAIGTGLFYGSASAIQMAGPAVLLAYLVAGAAVYMVMRALGEMAVHEPVSGSFGHYASSYLGPLAGFVTGWTYAFEMIIVCLADVTAFGIYMGFWFPDVPRWIWVLSIVLFIGGLNLCHVKVFGELEFWLSLVKVGAIVAMILAGLGIMFFGFSLDGAATSATGVHNLWQHGGFLPNGWAGLVASLSVVVFAFGGIEIIGITAGEAQDPQRVIPRAINAVPLRILLFYVLTLFVLMAIFPWQQIGSNGSPFVQIFDGLGIESAAAILNVVVITAAISAINSDIFGAGRMLYGMARQGQAPVGFSRVSRHGVPWMTVLLMAVALLLGVALNYLIPQSVFLLIASIATFATVWVWLMILLAQVGMRRRMGPRQVAALKFPVPLWPFAPAAAIVFMLFIFVVLGYFPDTRPALWVGAIWIAVLVIAYRRWVRPKGDAAHGVLQAQGGL

SEQ ID NO: 55620 - protein, 396 aa, Myxococcus xanthus DK 1622
MKLAHRLQAIKPSPTLALNSRAKALVAKGVDVVVLAAGEPDFDTPDYVKQAAVDALRAGFTKYTPTNGIPELREAICAKLERDNGLRYTPDQVLVTSGGKQGLYNFCQAALEEGDEVIIFAPFWVSYPDMVRLAGATPVIVPTREEDGFAPDPDAIRRALTPRTRAVIINSPGNPTGAVYSRAALERIAEVLRPHDCLIVTDDIYEKLLYTDERLGISDVAPDLVPRLVVVNGMSKAYSMTGWRMGYVAGPKPLLAGMQMVQDQSTSNASSIGQKAALAALQGPPDTIAAMVKEYRERRDFFIAGLNALDGVRCRMPEGAFYAFADVRGLLGRSYKGKPVTSAMQLSEILLDDFRVAAVPGEPFGAEGYVRMSFVTSREVLQKGLARLGELVKALS

SEQ ID NO: 55621 - protein, 1030 aa, Burkholderia vietnamiensis G4
MTDPNTADVTYIEPITWEVVARIIEKERPDAILPTMGGQTALNCALDLHHHGVLEKFGVELIGASPEAIDKAEDRQKFKEAMTKIGLGSAKSGIAHSMEEATKVHAEIMAETGGSGYPVVIRPSFTLGGSGGGIAYNREEFEEICKRGLDLSPTRELLIEESLLGWKEYEMEVVRDRADNCIIVCSIENLDPMGVHTGDSITVAPAQTLTDKEYQILRNASLAVLREIGVDTGGSNVQFSINPKDGRMVVIEMNPRVSRSSALASKATGFPIAKVAAKLAVGYTLDELKNEITGGQTPASFEPTIDYVVTKIPRFAFEKFREADSRLTTQMKSVGEVMAIGRTFQESFQKALRGLEVGVDGLDEKSTDRDEIAIQIHEPGPDRIWYVGDAFRIGMTAEEIFAETSIDPWFLAQIEQIILKEKALSGRTLASLTFDELRFLKQSGFSDRRLAKLLGATPEDVRRRRVELNVRPVYKRVDTCAAEFATKTAYMYSTYEEECEAQPTTNKKIMVLGGGPNRIGQGIEFDYCCVHAALAMREDGYETIMVNCNPETVSTDYDTSDRLYFEPLTLEDVLEIVDKEKPVGVIVQYGGQTPLKLALDLEAHGVPIVGTSPDMIDAAEDRERFQKLLQDLGLRQPPNRTARAEEEALALAAEIGYPLVVRPSYVLGGRAMEIVHEPRDLERYMREAVKVSNDSPVLLDRFLNDAIECDVDCICDGEAVFIGGVMEHIEQAGVHSGDSACSLPPYSLSKETVAELKRQTGAMAKALNVVGLMNVQFAIQQVPQADGSKQDVIYVLEVNPRASRTVPYVSKATSLPLAKIAARAMVGQKLAQQGVTKEVEPPYFSVKEAVFPFVKFPTVDPVLGPEMRSTGEVMGVGRTFGEALFKSQLAAGSRLPESGTVLLTVMDADKPKAVEVARMLHDLGYPIVATKGTAAAIEAAGVPVKVVNKVKDGRPHIVDMIKNGEIALVFTTVDETRQAIADSRSIRMSAQAHKVTYYTTMSGARAAVEGLRYLKDLEVYDLQGLHARLN

SEQ ID NO: 55622 - protein, 151 aa, Hypocrea lixii
MSTAARRRLMRDFKRMQTDPPAGVSASPIPDNVMTWNAVIIGPADTPFEDGTFRLVMQFEEQYPNKPPQVKFISQMFHPNVYANGELCLDILQNRWSPTYDVAAVLTSIQSLLNDPNTGSPANVEASNLYKDNRREYIKRVRETVERSWED

SEQ ID NO: 55623 - protein, 415 aa, Burkholderia thailandensis E264
MTEQASADASAAPRTVVVIGGGQAAGWVMKTLRGEGFAGRIVMIADEAHLPYERPPLSKAVLAGEADISTVRVVQPDEFGALGVEAWQPERAVSIDRARRVVRAASGREIEYDRLVIATGGAPRRLPDAIVATPRLHYLRTLDEAVALGERLRASRRVLVIGGGWIGLEVAATARKLGVDAVVVEGAPRLCARSVPGAVSDFLLELHRANGVDIRLNASLASLGAHPADANRVRATLADGTAVDADFAVAGIGLALNTSLATEAGLHVDDGIVVDEYGATSDPAIFACGDVANHPNAWLKRRVRLESWANAQNQAIAAAKAVLGVRAPYAEIPWFWSDQYDVNLQILGDLPADAQLVVRGDIAAKRATLFFVTHGALRGVIAINSARELKLARKWMNQGRAIDVAALADTTRALA

SEQ ID NO: 55624 - protein, 119 aa, Zea mays
MASLDSDVTMVPAGESSSSVAPSSSSTKKAKRFEVKKWSAVALWAWDIVVDNCAICRNHIMDLCIECQANQASATSEECTVAWGVCNHAFHFHCISRWLKTRQVCPLDNSEWEFQKYGH

SEQ ID NO: 55625 - protein, 558 aa, Alkaliphilus metalliredigenes QYMF
MSFKSDIEIAQEAKLQDIREIAAKLNLTEEDIELYGKYKAKVDYNLLKKGNGQKKTKLILTTAINPTPAGEGKTTTTIGVADGLARLGKKTIVALREPSLGPVFGVKGGAAGGGYAQVVPMEDINLHFTGDFHAIGAANNLLAAMLDNHINHGNKLEIDNRKITWRRAMDMNDRQLRNLVNGMGGKGNGVVREDGFDITVASEVMAAFCLANDIVDLKGKLGDIIVAYTRDEKPVTAKDLNAHGAMAALLKDALKPNLVQTLEGTPAFVHGGPFANIAHGCNSVIATKMAMHFADYVVTEAGFGADLGAEKFLDIKCRKSDLKPDVVIIVATVRALKYNGGVAKDQLSQENLEALENGLPNLLKHVENITKVFKLPAVVAINRFPLDTEAELDLVRNKCKELGVNVALSEVWADGGAGGEELAKEVLRLAEQESQLEYAYSLDMAIAEKIKAIATKIYGADGVDFTPGALKEMNKLEKLGFGNLPICMAKTQYSLSDDASLLGRPKGFNITVRQIKVSAGAGFIVAITGEIMTMPGLPKVPAAERIDVDETGVITGLF

SEQ ID NO: 55626 - protein, 194 aa, Zea mays
  misc_feature (115)..(115): Xaa can be any naturally occurring amino acid
  misc_feature (140)..(140): Xaa can be any naturally occurring amino acid
  misc_feature (183)..(183): Xaa can be any naturally occurring amino acid
  unsure (1)..(194): unsure at all Xaa locations
RFFGVNNSSKVSLDSETMATKEDVQDPRIPKIASSIRVIPDFPKPGIMFQDITTLLLDTEAFKDTVDIFVERYKGKGISVVAGVEARGFIFGPPIALAIGAKFVPMRKPKKLPGXKVISEEYSLEYGTDKIEMHVGAVEXPGERAIIIDDLIATGGTLAAAIRLLERVGVTIAECACVIESPXVKGREKLGETP

SEQ ID NO: 55627 - protein, 457 aa, Salmonella enterica subsp. enterica serovar Paratyphi A str.
MRYRFPDNFWWGSACSALQTEGDSLNGGKSQTTWDVWFERQPDRFHQGVGPAETSTFYRHWKQDIALLKQLKHNSFRTSLSWARLIPDGVGEVNPQAVSFYNHVIDELLAQGITPFITLLHFDMPMVMQEKGGWENRDVVEAFGRYAQTCFTLFGDRVKHWFTFNEPIVPVEGGYLYDFHYPNVVDFKRAATVAYHTVLAHSTAVRAGRYDGEIGIVLNLTPSYPRSQHPADVQAAHHADLLFNRSFLDPVLKGEYPADLVALLKTYDQLPACQPGDRQLIADGKIDLLGINYYQPRRVKCRDTAVNPQAPFMPEWLFDYYDMPGRKMNPYRGWEIYAPGIYDIITNLRDNYGNPRCFISENGMGVENEQRFVQAGQIHDDYRIDFISEHLKWLHKGISEGCHCLGYHMWTFIDNWSWLNGYKNRYGFVQLDLATQTRTVKKSGEWFAATAEHNGFD

SEQ ID NO: 55628 - protein, 292 aa, Azoarcus sp. EbN1
MITGSLVAIVTPMHEDGSLDYPRLRSLIDFHVAEGTDGIVVVGTTGESPTVNVEEHCELIRTTVEHAAGRIPVIAGAGGNSTAEAIELASFAQEAGAVAQLSVVPYYNRPTQEGLYRHFRSIAEAVELPLILYNVPGRTVADLSNDTTLRLAEIPNIIGIKDATGSIDRACDLIERAPKDFALYTGDDMSAAAFILLGGHGTISVTANVAPRAMHEMCAAALAGEALRVREINGRLVGLHRDLFCEANPIPVKWAVARMGLIESGIRLPLTPLSSASQERVLLAMRRAGVNV

SEQ ID NO: 55629 - protein, 435 aa, Triticum aestivum
  misc_feature (237)..(237): Xaa can be any naturally occurring amino acid
  misc_feature (275)..(275): Xaa can be any naturally occurring amino acid
  unsure (1)..(435): unsure at all Xaa locations
RGGAMRWLKSLVGLRKVERQQQQQRRKEDGDAGRTKRDAVDQFHFQDQHSQDHASLVGPEEFPDGNVPSEDECGTPSCSGPGFSTLSVPLPQTEEELKEIWAATIIQTAYRALLARRARRALKGLVRLQALVRGHIVRKQAAITLRCMQALVRVQARVRARRVRVALENQMDEQQNNVEEQTDEAHVREVEDGWCDSIGSVEDIQAKLLKRQEAAAKRERAMAYALSHQWQAGSRQXAAITASELDRNSWSWNWLERWMAVRPWESRFLGMYAAXIGIAIDTGAQHAEGNATKAPYRKPVKKQVSALHSSVLIQKARPSNSEGGGSLSNPSAGSASAKPKRKLPPKEGSDEVSSRLSGLGARSSSNPKERPGQLQPRANKRFSLPGTGTEVGKRQVNKPAVNRSPKATEDSPALEGKHRRAGSVGLLLKRVELQA

SEQ ID NO: 55630 - protein, 1151 aa, Wolbachia endosymbiont of Drosophila melanogaster
MPKRTDIESILVIGAGPIVIGQACEFDYSGTQSCKVLKSEGYKVILVNSNPATIMTDPEFSDATYIEPVLPEIIEKIIIKERPDAILPTMGGQTALNCAIKLADDGVLDKYNVELIGVNREAIKKAEDRELFRQSMDRIGLKYPKSIIIKNQEQIKKALDYVGLPAIIRSSFTLGGAGSGIAYNKEEFFNIAESALKISPINEVQIDESIIGWKEYEMEVIRDCKDNCIIVCSIENVDPMGVHTGDSITVAPALTLRDVEYQQMRNASIAVLREIDVSAGGANIQFAVNPKEDGSLVVIEMNPRVSRSSALASKATGYPIAKVVTKLAIGYSLDEIRNDCAPIIPAAFEPVIDYIVTKIPRFEFEKFKGTNCELSTSMKSVGEVMSIGRTFNESLQKAFRSLETDFTGLDEVFPENIDIDHIKSQLAKLLPNRLLIAADAMRHGISIEEINSITGYDLWFLQNIQQIILTEQKIKENGFPGTAYEMLELKKMGFSDARLAKLSNRPTSVIPVPSNVIPVRDTGIQPALHAGDRVKQIEEIRKKFGIKQVYKRVDTCAAEFESSTAYMYGCYEGDVENKTECEANISDREKVVILGSGPNRIGQGIEFDYACVHAASAAKEMGYETIMINCNPETVSTDYDTADRLYFAPLIAEDVLEILSKEQENGTLVGVIVQIGGQTPLKLAKVLNERGFKILGTSFDSIDLAEDRMRFKNLALQLNLKQPENSICHSVEEALTNAEKVGFPLVVRPSYVLGGQSMSIRHDTQSFKEYVLDQTKIFEHGSLLLDKFLVNAVEVDVDAVCDGEKVFIAAVMEHIEEAGIHSGDSTCSIPTNTLSDEVIKEIELQTERIALALKVKGLINIQFAVQENRPLAEPVCDEKSLGKVQMSTTEYSNVFEERRQALTTKLPSEIELCKRSSDVYILEVNLRASRTVPFISKVINIPIAKLATQVILGKKLNQENKPFNHFAVKAAVFPFTRFAGVDTLLGPEMKSTGEVMGIDSSFEAALAKTHIAAGYKLPTEGTALVSVKDDDKKYILPVARMLKELSFEIYATKGTASYLNNNGIAAQAVNKVREGRPHIVDMLKDGKINLVINTSKGVKSVSDSKDIRRTAILQNIAYSTTASGSKALVLAIQYVKNSKLEVKSLQQIQNV

SEQ ID NO: 55631 - protein, 184 aa, Streptococcus pneumoniae TIGR4
MVKVAVILAQGFEEIEALTVVDVLRRANITCDMVGFEEQVTGSHAIQVRADHVFDGDLSDYDMIVLPGGMPGSAHLRDNQTLIQELQSFEQEGKKLAAICAAPIALNQAEILKNKRYTCYDGVQEQILDGHYVKETVVVDGQLTTSRGPSTALAFAYELVEQLGGDAESLRTGMLYRDVFGKNQ

SEQ ID NO: 55632 - protein, 354 aa, Emericella nidulans
MNSMSTTGPIRGGAIPKHYLQFTVRTYTRSMASAGLRYSNPPLVKKCYDQPTGKRFISSTPQSQIKDYFPPPDAPKIVEVKTAWAHPVYSEEEMRAVTVGHREAKNWSDWVALGSVRLLRWGMDLVTGYKHPAPGQEDIKKFQMTEKEWLRRFVFLESVAGVPGMVGGMLRHLRSLRRMKRDNGWIETLLEEAYNERLFLLTFLKMAGPGWFMRLMVLGAQGVFFNGFFLSYLISPRTCHRFVGYLEEEAVLTYTRAIKDLESGRLPHWEKLEAPEIAVKYWKMPEGNRTMKDLLLYVRADEAKHREVNHTLGNLKQAVDVNPFAVEWKDPSKPHPGKGIKHLKTTGWEREEVV

SEQ ID NO: 55633 - protein, 461 aa, Sorghum bicolor
MDERRTILMDRYEIGRQLGQGNFAKVYFARNLTDGQSVAIKMIDKDKITRVGLIVQIKREISIMRLVKHPNVLQLFEVMASKSKIYFVLEYAKGGELFNKISKGKFSEDVARRYFHQLISAVDYCHSRGVYHRDLKPENLLLDENENLKVSDFGLSALAESKRHDGLLHTTCGTPAYVAPEVLSRRGYDGTKADIWSCGVILFVLVAGYLPFHDPNLIEMYRKISKAEYRCPRSFSGELKDLLFRMLDPDPSTRISISRIKRSTWYRKPIEVNSAKIKHDTTRDKVCNGEATTSNSIECSNSEETRGSSSLPNLNAFDIISLSTGFDLSNLFEEKYGRREERFTTRQPAGTVFAKLNELAERLKLKIKKKENGVLKLASPKEGIKGFLELDAEIFELAPSFLLVELKKTNGDTIEYQRLVKEEIRPALKDMVWAWQSDRHQQRNESVQGEQQLSSPLPPQQ

SEQ ID NO: 55634 - protein, 641 aa, Burkholderia mallei ATCC 23344
MSTGAQTKAAAASQHADGPRLLADVGGTNARFALETGPGEITQIRVYPGAEYPTLTDAIRKYLKDAKIGRVNHAAIAIANPVDGDQVRMTNHNWSFSIEATRRALGFDTLLVVNDFTALAMALPGLTDAQRVQIGGGTRRQNSVIGLMGPGTGLGVSGLIPADDRWIALGSEGGHATFAPMDEREDLVLQYARRKYPHVSFERVCAGPGMEIIYRALAARDKKRIAANVDTADIVERAHAGDALALEAVECFCAILGTFAGNLAVTLGALGGIYIGGGVVPKLGELFMRSPFRARFEAKGRFEAYLANIPTYLITAEYPAFLGVSAILAEQLSNRTGGASSAVFERIRQMRDALTPAERRVADLALNHPRSIINDPIVNIARKADVSQPTVIRFCRSLGCQGLSDFKLKLATGLTGTIPMSHSQVHLGDTATDFGAKVLDNTVSAILQLREHLNFEHVEQAIDILNNARRIEFYGLGNSNIVAQDAHYKFFRFGIPTIAYGDLYMQAASAALLGKGDVIVAVSKSGRAPELLRVLDVAMQAGAKVIAITSSNTPLAKRATVALETDHIEMRESQLSMISRILHLVMIDILAVGVAIRRAAPNAELAEAMARAKARAGASAGDEAADVLDWLSHGAAPAAKD

SEQ ID NO: 55635 - protein, 461 aa, Rhodococcus sp. RHA1
MRRELRFVMSKILAVPPAQSQLQPVSGRSGLPGVGHVLEYIRDPLALMQKHWDRYGEVSWFSMVGRRWVAVLGPDACQEVLQNKDRAFVNGDGWSVLIGPFFHGGLMLLDSEEHLRHRRIMQQAFTRSRLENTVDVLNPAIDSALDAWTPTNGFRAYTALKALTLDLATDIFMGGAEGSTESEISSVKKAFVDCVQAATSVVRYPVPGTRWKRGLDGRRVLEDFFRQYLPARRSHETDDLFSVLCHIESEAGQRFSDDEVVDHMIFLLMAAHDTSTITISTMMQYLGQHPQWQDRCRAESLALGTPAPSYADLDGLDSLDLVMKECLRIVSPVPVMARRAVRDTQVQGHFVPAGTYAAVVPHFTHHMPQYWPEPERFDPERFAEHRREDKVHRYAWEPFGGGVHKCLGMHFAGAEIKAIMHHLLLRFDWHVDADYVAPLNFTSLPFPSDGQPVDLRLLATS

SEQ ID NO: 55636 - protein, 85 aa, Rickettsia prowazekii
MKGTKEMPACGFSGTVVAILNKLGVEFSDINVLFDTALREDLKKFSDWPTFPQLYINGVLVGGCDIAKELYQNGELEKMLKDVVV

SEQ ID NO: 55637 - protein, 457 aa, Alkaliphilus metalliredigenes QYMF
MKVAVIGGGPGGYVAAIKAAMLGAEVTLIEKKRVGGTCLNVGCIPTKSLLASSDVLEVVRDAKNYGINIDGTIEPDLPAIMKRKEKIVEQLVKGIEFLFDKKGVKLINGFGKLVDKNKIEVTKEDGSKEEIEADKIILATGSVPIVPPIFPHDGKKIITSDEALFLEEIPKSMSIVGGGVIGCEFGQFFSKMGTKVTIVEMAEQLLPFEDKDVAKQLERSFKRDKIKMLTGQKINKCEVQDNKVIAYLEGDKTLEADIMLVSVGRKPYLENLGLEDLGIEMEKGKVVVNKNMETNIKGIYAIGDIVDTPFLAHVASKEGLIAAENALGKDKAISYRAVPRCIYTGPEVAAVGMTEKEAEAKGMIYHVGKFEFRGLGKAQAIGHFQGFVKVLVDDQDVIIGAAIVGPHATDLLAELSLAVELQLTAERVGDIIHPHPTLSEGIMEALHDVHKACIHAV

SEQ ID NO: 55638 - protein, 380 aa, Synechococcus sp.
MTIRVAINGFGRIGRNFLRCWFGRQNTDLEVVAINNTSDARTAAHLLEYDSVLGRFNADISYDENSITVNGKTMKIVCDRNPLNLPWKEWDIDLVIESTGVFVTAEGASKHIQAGAKKVLITAPGKAEGVGTYVIGVNDSEYRHEDFAVISNASCTTNCLAPVAKVLHDNFGIIKGTMTTTHSYTLDQRILDASHRDLRRARAAAVNIVPTTTGAAKAVALVIPELKGKLNGIALRVPTPNVSVVDLVVQVEKPTITEQVNEVLQKASQTTMKGIIKYSDLPLVSSDFRGTDESSIVDSSLTLVMDGDLVKVIAWYDNEWGYSQRVVDLAELAARKSGRLGLVQTLLISSQDSLPLTGGFFVAKREHPRSQDSINPSGPD

SEQ ID NO: 55639 - protein, 669 aa, Prochlorococcus marinus str. MIT 9313
MVAATASLDTLCINSIRMLAVDAVNKANSGHPGLPMGCAPMGYTLWDQFLHHNPKNPQWFNRDRFVLSAGHGCMLVYALLHLTGYDSVSIEDIKQFRQWGSRTPGHPETFETPGVEVTAGPLGAGISNAVGLAIAEAHLAAKFNKPEAKIVDHYTYVVMGDGCNQEGIASEACSLAGHLKLGKLIALYDDNHITIDGRTDVSFTEDVLKRYEAYGWHVQHVANGDTDVNAIAKAIAAAKAVTDKPSIIKVTTTIGYGSPNKSDTAGVHGAPLGEEEATLTRQQLGWNYGPFEIPQEAYDQYRKAIDQGARLESEWNQALANYRSQYPNEAAEFERMLRGELPKGWEKDLPTYTPADSGLATRKHSQICLGALGPNLPELIGGSADLTHSNYTDIKGETGSFQPETPEKRYLHFGVREHAMAAILNGIAYHNSGLIPYGGTFLVFADYMRGSMRLSALSELGVIYVLTHDSIGVGEDGPTHQPVETIPSLRAMPNMLVFRPGDGNETSGAYKVAIQNRKRPSSLCLSRQGMANQANSSIENVALGGYVLEDCEGTADLILIGTGTELDLCVQAAKQLSAEGHKIRVVSMPCVELFEEQSSAYKQEVLPNAVRKRIVVEAAESFGWYKYIGLDGDSVTMNSFGASAPGGTCMEKFGFTVENVVAKSKALLN

SEQ ID NO: 55640 - protein, 427 aa, Xanthomonas campestris pv. campestris str. ATCC 33913
MSLQIDATAVRAAVAQLRAHSDAPLCAYVYDLAALDAHAAWMRAQLPPGCTLFYAAKANAEPQILQTLAPYVDGFEAASGGELAWLHQQQPDAALLFGGPGKLESELAQAVRLPDCTVHVESLGELQRLAAIARQIAQPDRRRIPVFLRMNIAVPGAQTTRLMMGGQPSPFGLDPDDLDAALLQLRASPALELRGFHFHLMSHQRDAAAQLHLIAAYLRTVQHWRQRHGLGPLLVNAGGGFGVDYLTPEASFDWAGFCAGLPAVLHAHGDGLQLRLEPGRYVSASCGWYLMEVLDIKRSHGAWFAIARGGTHHFRTPAAQGHDHPCVVVRGTHAPVLRDTPVTLVGQLCTPKDVLARNQRVAALAPGDCLAFPLAGAYAWNISHQQFLMHPPPQMVFLPVHAQATATTGTRMSARRSASATVSGSSR

SEQ ID NO: 55641 - protein, 506 aa, Allium sativum
MALAGLYRRVLPSPPAVEFASTEGKKLFAEALQNGTMEGFFKLISCFQTQSEPAYCGLASLSMVLNALAIDPGRKWKGPWRWFDESMLDCCEPLEKVKEEGITFGKVACLAHCAGANVQAIRTSQGSLEDFRQHIIRCTSSDDCHVITSYNRKAFGQTGTGHFSPIGGYHKGSDMALILDTARFKYPPHWVPLQLLWEAMKYEDPATGYPRGFMLISKLQRAPSLLYTLSCRHESWVQTAKYLMDDVPILLKKANLNTVQDVLSLIFKSLLSNAGDFIKWVAEVRRPEENSALSKEEKERLAIKEIVLQQIRETKLYKYVSEWLSDMRSCCCNASAFSGKDSLTDIAASVCCQGALLLAGNLGRDNKSCLKETCVNNVKSNGGGPITVVSGTVVSEGGEQGVDMLVPTSPSKSHGCNAGSSSFCAIAHPGHGDVLTILSLALFTNSWFDISNKKLLDEIRALVSFQNLPDVLQEEVLHLRRQLMFLKKCKDKEVDGDVLLPSISMV

SEQ ID NO: 55642 - protein, 423 aa, Kluyveromyces lactis
MRVIRQLHTSKRLLQSLVDKQKYQATTYARPNHLVLTRGKNAILYDDVNNKEYIDFTAGIAVTALGHANPEVAEIMYKQSKKLIHSSNLYYNEECLKLSENLVEATKSFGGQYDASRVFLCNSGTEANEAALKFAKRYGILKSPSKQGIIAFQNSFHGRTMGALSVTSNPKYREPFGSLIPGVEFLNINDELTKLDQQVSSLKEKTAGLIVEPIQGEGGVFPIPLDSLVGLKKICEDHDIIVIYDEIQCGLGRSGKLWAHSYLPKEAHPDIFTTAKALGNGFPIAATVTNDKVNDILKVGDHGTTYGGNPLGSAVGNYVVNVIAEQKFLDEVNKKGEIITNRLRKLQERFPEHIKDIRGKGLMIGCDFDEAPAKIVDAARDSGLLIITAGKTTVRFVPALTIEDNLLEKGLNIFEKAVEKVYS

SEQ ID NO: 55643 - protein, 353 aa, Acetabularia peniculus
AGFAGDDAPRAVFPSIVGKPKHQGVMVGMGQKDTYVGEEAQSRRGILTIRYPIEHGIVTNWDDMEKIWHHTFYNELRVAPEEHPVLLTEAPMNPKSNREKLTQIMFETFNVPAMYVSIQAVLSLYASGRTTGIVLDSGDGVSHTVPIYEGYALPHAILRLDLAGRDLTDYLTKLLMERGYSFTTTAEREIVRDIKKKLCYVALDIEQELTLLPRLEKSYELPDGQVITVGSERFRCPEALFNPGLLGMGSGIARYLFNSIMKCDVDIRKDLYSNTVLSGGTMMFPGIGERMQKEITTLAPSSMKIKVVASPERKFSVWIGGSILSSLSTFQQMWISKEEYDEAGPAIVHRKCF

SEQ ID NO: 55644 - protein, 375 aa, Ajellomyces capsulatus
MEEEVAALVIDNGSGMCKAGFAGDDAPRSVFPSIVGRPRHHGIMIGMGQKDSYVGDEAQSKRGILTLRYPIEHGVVTNWDDMEKIWHHTFYNELRVAPEEHPVLLTEAPINPKSNREKMTQIVFETFNAPAFYVSIQAVLSLYASGRTTGIVLDSGDGVTHVVPIYEGFALPHAISRIDMAGRDLTNYLMKILAERGYSFSTTAEREIVRDIKEKLCYVALDFQQEIQTASQSSSLEKSYELPDGQVITIGNERFRAPEALFQPSVLGLESGGIHATTYNAIMKCDVDVRKDLYGNIVMSGGTTMYPGISDRMQKEITRLAPSSMKVKIIAPPERKYSVWIGGSILASLSTFQQMWISKQEYDESGPSIVHRKCF

SEQ ID NO: 55645 - protein, 500 aa, Rhodococcus sp. RHA1
MQDQSIDDLLNTGLFVDGQWIRSSSGETRDCINPADGSVVATVDEASPEDATRAVAAARAAFDQGTWPCTPVAERTALVARIADLLERDKETLARIETLDTGKTLEESRIDIDDVVSVFRYYAQLAAVEADALVDVGRPEVISRVVREPIGVCVLIAPWNYPLLQISWKVAPALAAGCTMVLKPSEVTPLSTIAFTALIAEAGVPAGVVNLVQGSGAVLGAALTGTPDVDFISFTGGLATGRVILETAAKNVTKVAVELGGKNPHIVFADADGDDSVDQVLTGVFLHSGQVCSAGTRLIIEESIADRFVAALAARAEKIRMGNGLDPTSRTGPLVSEAHREKVERYVALGLSEGARLVTGGARPADPALADGSYYLPTIFDHCDRTMRLVQEETFGPILTVERFTTEEEALRLGNDTEYGLAAGVRTADSARGERMVRGLRHGTVWLNDFGYYTAAAEWGGFKMSGNGRELGPTGLAEYQETKHIWHNTSPTAAGWFDNG

SEQ ID NO: 55646 - protein, 371 aa, Populus alba
MSFLQQQETHNQSPALALDGLYCEEDGFGEDYSCGLDDETSQVYDQNVKKEQNLSSVLLEQDLFWEDSELLSLISKEKETHVVFDSVGSRDGSLMVVRREAVEWFLRVKAHYGFSALTGVLAVNYFDRFISSSRFRRDKPWMGQLAAVACLSLAAKVEETQVPLLLDLQVEDAKYVFEAKTIKRMELWVLSTLHWRMNPVTSISFFDHIIRRLGLKTHMHWEFLWRCERLLLSVISDSRFMSYLPSILATATMLHVIKEVEPRNQLQYQTQLMAVLKTNEDEVNECYRLILEQPGSQNQRHKRKYLSTPSSPNGVIDASFSSENSNDSWAVASSISSSSSVPQFKRSRAQVQQMRLPSLNRMCVDVLSSPH

SEQ ID NO: 55647 - protein, 228 aa, Arabidopsis thaliana
MPFIASMGIYVVSRDVMLDLLRNQFPGANDFGSEVIPGATSLGLRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETATEKSLLSAKGSVPIGIGKNSHIKRAIIDKNARIGDNVKIINSDNVQEAARETDGYFIKSGIVTVIKDALIPTGTVI

SEQ ID NO: 55648 - protein, 417 aa, Arabidopsis thaliana
MGFSTGKRKSRDEEEDRVSFFASEFPMDDLNDDVLERVLSWLPTSCFFRMSSVCKRWKSSQTSKSFKLACSQIPTRDPWFFMIDNDSNSSSFVFDSTENSWKNLNRRDFLHHHRQDFIPVASSGGLLCYRCSISGDFLLRNPLTGSSRDIPSQDNNNNKPLQAVAMTTTTVTPSSYTLVTISGEIPNLSFKIYESNADSWSKDQELESVKNNDSSLHDDYDTDSGTVYFLSKQGNVVVASNNLQRSPSKQYSSVITVTDEAEIVYFLSSYGTIVACDLTKRCFTELPKLLPPFLEYSIDLVECEGTMYVILLSEFFESASLRIWRLDNNREWVQVGMLPPALSHELYGKKGDINCVGGAGNKILVCFNASPPEVYCRYFVYDLVAEEWNELPKCFKDGEAVDFVSALSFQPRIEATV

SEQ ID NO: 55649 - protein, 502 aa, Oryza sativa (japonica cultivar-group)
MLHLLPLLRARAATHLPTSSLDLSRRRRLLLSTAARSAAATPFSVEEYLVDTCGLTGAQALKASKKLSHLRSPAKPDAVLAVLSGVGFSRADLAAVVASDPQLLCARADNIARRIASLRDRVGLSDPQIGSFLLAGGAKGIHACDVASRLEFWIPFLGSFETLLRILKGNNVLVLSDLEKVIKPNIALLQECGLTVCDIAKMARFAPRMFTSNPKQVEGFVRRADELGVPRTSGQFKYMVGIFANISEGSATARMEYLSRSLGCSMDKLRSAVQKLPQILGLSETNLGSKIEFLVGKVRLEPEYLLKTPKLFTYSLEKRLVARHYIVQVLAAKGLKGLKKDVPFCSYVQLGESCFVKNFIDQHENVVPGLSDAYAALRAGKVPPECPYSLTADAMTCFLNHYSPVQVSLYPFCSISHLFQDHITMIMIVLMIFLEKRLVPRHYVAEALAVKGLIRKGLDFYHCVCMRDEVFVAKYIDHYEDALPGLADAYAAVRAGKLPAQV

SEQ ID NO: 55650 - protein, 446 aa, Rhodococcus sp. RHA1
MECDAWNAPAVIGCDAKRGGVPTFWCCFQFRALSRLPQRHDSFGRSHVIACGRRAGIHRETQHQGVEMKALVYDGPREVHVKDMPDARIEQPTDVLVKITSTNICGSDLHMYEGRTDLEPGMVLGHENLGIVAEVGNAVVKVSPGDRVCLPFNIGCGFCRNCEEGLTAFCLTVHPDPKMAGAAYGFAGMGPFWGGQAEYLRVPFGDFNCLRLPEDAQDKETDYVMLSDIFPTGWHCTRLADMQPGDSMVVYGAGPVGLMAAYSAMIQGASKVMIVDRHPDRLKLAEQIGVIPIDDSKGDPVEQVLEQTRGQGADKGCECVGYQAHDPQGHEDAAMTMNRLVDSVRFTGHIGVVGIFLPQDRNGPDELERHGKIAFDMGKFWFKGQKVGTGQANVKHYNRQLRDLIHQGRAKPSWIVSHELPLAEAESGYQHFDARDDGWTKVVLHP

SEQ ID NO: 55651 - protein, 379 aa, Dunaliella salina
MDSGDVGSVSALVCDNGSGMVKSGFAGDDTPRSVIPSIVGRPRHTGVMVGMGHKDSYVGDEAQSKRGILSLRYPIEHGIVSNWDDMEKIWDHTFFNELRVAPEEHPVLLTEAPLNPKGNREKMTQIMFETFNVPAMYVAIQAVLSLYASGRTTGIVLDSGDGVTHTVPIYEGYALPHAILRLDLAGRDLTDYLMKILMERGYSFTTTAEREIVRDIKEKLAYVALDFEQEMATAQSSSALDKNYELPDGQTITIGNERFRCPEVMFNPNTVGMEAVGVHDTTFNSIMKCDVDIRKDLYNNIVLSGGTTMFPGIADRMSKEITALAPSAMKIKVVAPPERKYSVWIGGSILASLSTFQQMWIAKSEYDESGPSIVHRKCF

SEQ ID NO: 55652 - protein, 276 aa, Oryza sativa (japonica cultivar-group)
MSAYTVLLKTVKRSYRILTSDIEEVIKPNFAQLQECGLTVCDIVKTNPRLLSFNPERIKRYVHRADMLGVPRCSPAFRMAVCSTNEGSVTARMEFLSRTLGCSMDNILIAVGKRPTILGLSMDNLRRKIEFLVTEVGLKLECIVECLGILRYSLEKRMVPRHSVMEILRARGLMKKGASLYGLIMQGEADFVARYIDTHKDMVHGLADAYNASCFGKMPVVPDSTVKKRHGRRDIYCRGFAMFEIWNLLSYMLDNYTCRSALHLADTLLEFSELQQ

SEQ ID NO: 55653 - protein, 257 aa, Glycine max
SITSESHNQIVGNGLILGTGLIPYCATFFVFTDYMRGAIRLSALSEAGVIYVMTHDSIGLGEDGPTHQPIEHLASFRAMPNTLMLRPADGNETAGSYKVAVVNRKRPSILALSRQKLTQLPGTSIEGVEKGGYTISDNSSGNKPDVILIGTGSELEIAAAAAEDLRKEGKAVRVVSFVSWELFDEQSDEYKESVLPASVTARVSIEAGSTFGWHKIVGSKGKAIGIDRFGASAPAGKIYKEFGITKEAVIAAAKELS

SEQ ID NO: 55654 - protein, 371 aa, Oryza sativa (japonica cultivar-group)
MLHLRQCLLPLLRAAAAAHPHTSAASSSSLHLSRRLFSTAAGPDTAPPFSVEEYLVATCGLTGAQALKASKKLSHLRSPAKPDAVLAVLSGVGLSRADLAAVVAADPMLLCARAPNVARRLHSLRDRVGLSDADVARFLLAGRPNGLPKMRHRPEARVLDRLRRIVVKPNIALLQECGLSVCEIAKLSTLKWTVLSLSPERVKASVLCVEKLVVPRSSDRFKHVLKSACWISEDMLAMKMEFLRSTLGCSEDKLRAAVCISPHIFYLSDKNLCRKIDFLISEVGLEREFIVERPWVLGYSLEKRMVPRHSVMKILRTMGLMKDAVDFSSSLVYSEKKFVARYIDPYKQAAPTLADSYAAACAGKMPAHVHR

SEQ ID NO: 55655 - protein, 426 aa, Sulfolobus solfataricus P2
MDKGRCTILNSEELWAQAKQLFAGGVNSPVRAAVKPFPFYVERGKGAYIYTVDGKKFIDYVLGYGPLILGHSPESVKRRIVEQLERGWLFGTPSELEIELARKIRSHIPSAQKIRFVNSGTEATMAAIRLARGYTKRSKILKFSGNYHGAHDYALVEAGSAATEYNVATSDGVPMEIMKTVEICEFNDLDCVDKKLRNEDIATVILEPVMGNAGVILPEKDFLFGLRELTKTYNSLLIFDEVITGFRISIGGAQSYYQIYPDITTLGKIIGGGFPIGAVAGKAEIIDNFTPAGKVFNAGTFNANPISMIAGIATIEELEKEYPYIIANQAAKTLVEELERLLKTKHTINHVGSMFQIFFGIDEVRNYSDAKRADKEYYIKFHERLLKEGVFIPPSQYETIFTSAAHKDDVIADTIDKLMKVIGELN

SEQ ID NO: 55656 - protein, 167 aa, Solanum lycopersicum
MLPMITEFINYGQQTIRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSVIDDYTIRTISNLPQINNE

SEQ ID NO: 55657 - protein, 358 aa, Pseudoalteromonas tunicata D2
MSQSNYNIAVLAGDGIGPEVMAAAEQVLDAVSQKFSFTLNRTHHAIGGAAIDQFGQALPDATLAACEQADAILFGSVGGPKWEKLPPAEQPERASLLPLRKHFGLFCNLRPAQLLPALSAASPLRADISEKGFDILCVRELTGGIYFGEKGRSGEGESESAFDTQTYSRKEIARIAHFAFSAARLRRNKVTSVDKANVLASSVLWREVVTEVSKDYPDVALEYIYVDNAAMQLVKNPGQFDVLLCDNLFGDILSDECAMITGSMGLLPSASLNQSGFGLYEPAGGSAPDIAGKGIANPIAQILSAALMLRYSLKQEEAARTIEKAVAEAVAAGVGTPDIYPQAGCTTADVAAAIVARI

SEQ ID NO: 55658 - protein, 393 aa, Solanum lycopersicum
MTAPTTRKDLMIVNMGPQHPSMHGVLRLIVTLDGEDVVDCEPILGYLHRGMEKIAENRTIIQYLPYVTRWDYLATMFTEAITINGPEQLGNIQVPKRASYIRVIMLELSRIASHLLWLGPFMADIGAQTPFFYIFRERELIYDLFEAATGMRMMHNYFRIGGVAADLPYGWIDKCLDFCDYFLTGVAEYQKLITRNPIFLERVEGVGIIGRDEALNWGLSGPMLRASGIEWDLRKVDHYESYDEFDWQVQWQREGDSLARYLVRIGEMTESIKIIQQALEGIPGGPYENLEMRRFDRLKDPEWNDFEYRFISKKPSPTFELSKQELYVRVEAPKGELGIFLIGDQSVFPWRWKIRPPGFINLQILPQLVKRMKLADIMTILGSIDIIMGEVDR

SEQ ID NO: 55659 - protein, 350 aa, Oryza sativa (indica cultivar-group)
MATTSSKNERWSLAGATALVTGGSKGIGRAIVEELASLGATVHTCARTEAPLNRCREELTAKGLAVTVSVCDVSLRADREALAGTVRELFGGKLSILVNCAGMSFLKPAVELTPDDCSQVMGMNFESCFHLSQLAYPLLKASQRGCIVNISSIASVVAFCSLPNAVYSAAKDCSCLNSAGRATVVRNRGNRGMQGRVERRAMNQVTRNLAAEWANDGIRVNCVAPGFIRTPLLSEFVEGNELGRAEFSRVPMGRLGEPEDIASLVAFLSMPASSYITGRDDSVGHSNRCWKQSLGMVAFPLAALLKEASSSLPPLNSVGKQWHQGQDVDRSDRLALANGKDKVAKGAHHI

SEQ ID NO: 55660 - protein, 139 aa, Prochlorococcus marinus str. MIT 9313
MASTNENLFETAMARYQSGAEASELIEDFKTITATTPNQAAGWTCLAWLQLLNAQPDEALRSARTAVKLNAQDPQARINLSLALLETNSKGVRDQIDMVQKILAVAPEFAKDLKDSIADGLLRRPNWHALKKVKAWLEL

SEQ ID NO: 55661 - protein, 377 aa, Chlamydomonas reinhardtii
MADEGEVSALVCDNGSGMVKAGFAGDDAPRAVFPSIVGRPRHTGVMVGMGQKDSYVGDEAQSKRGILTLRYPIEHGIVTNWDDMEKIWHHTFFNELRVAPEEHPVLLTEAPLNPKANREKMTQIMFETFNVPAMYVAIQAVLSLYASGRTTGIVLDSGDGVTHTVPIYEGYALPHAILRLDLAGRDLTDYLMKILMERGYSFTTTAEREIVRDIKEKLCYVALDFEQEMATALSSSALEKTYELPDGQMITIGNERFRCPEVLFNPNMIGMEAVGIHDTTFNSIMKCDVDIRKDLYNNIVLSGGTTMFPGIADRMSKEITALAPSAMKIKVVAPPERKYSVWIGGSILASLSTFQQMWIAKSEYDESGPSIVHRKCF

SEQ ID NO: 55662 - protein, 248 aa, Gossypium hirsutum
MAGIAFGRFDDSFSLGTVKAYLAEFISTLVFVFAGVGSAIAYNKLTTDAALDPDGLVAIAVCHGFALFVAVAIGANISGGHVNPAVTFGLALGGQITILTGIFYWIAQLLGSIVACFLLKAVTGGLTVPIHGLGAGVGAIQGVVMEIIITFALVYTVYATAADPKKGSLGTIAPIAIGFIVGANILAAGPFSGGSMNPARSFGPAVASGDFNGIWIYWVGPLIGGGLSGLIYGNVFMNSDHAPLSNDF

SEQ ID NO: 55663 - protein, 736 aa, Oryza sativa (indica cultivar-group)
MPTRKKGLARNATTEHINPPNSRKSSRSTQAAAAEHKVNDLITSSSKKQIGGGLLKKNRALRGGKKLNSIYDSAGTGNDVAGVPSSSFFNHKQSHENDEDRSCDSIFSPSFHNQKEDVTDCLSEGLVHEEVIHEPVQNAEYVTNSISCNTFDGLSKHSYDIHMQSACGSTLEGDEFSELGSLSPEVSAIYLAMQHSKLECIDEQSQDSTSTDGCADPDETVELDYFDPYAFIKDLPDLSLVVPKFRPVLLPKQTRSCPRTTLVLDLDVNVNVPLLLCCHAETLVHSTLEPCEDSDFTFPVHFNLREHTIYVRCRPYLKEFLETVASMFEIIIFTASQSIYAEQLLNILDPKRRLFRHRVYRESCLFVEGNYLKDLSVLGRDLARVVIVDNSPQAFGFQLDNGVPIESWFDDRSDRELLTLLPFLQSLVGVEDVRPCIARKFNLHRTAQHTIDYPLGPKTMLNESMGEGDAAYAKRVLLTAAGDDVSRGIASTLATHGCRLVLVGDEGALAGTAEEARRGGGGGDAVAVVGLDLHGCDEAAVDAAVGTAWRCFDGLDAMVNCYSYEGEVQDCLNISEDEFKKTMKANVMTPWFLVKAIAKRLRDSESSCGGSVVFLTQIIGAERGLYPGAAAYGTSLGAIHQLVRLSAMELGKHKMRVNAVCRGLHLGDRFPVWVGKEKAEKATGEVMPLRRWLDPEKDVASTVLYLVGDESRYMTGSTIFVDGAQSIVRPRMRSFM

SEQ ID NO: 55664 - protein, 406 aa, Thermosynechococcus elongatus BP-1
MGLEWIQPADRLGALPPYVFARLDELKLKARQQGLDLIDLGMGNPDGSAPRPVIEAAIAAFEEPSYHGYPPFEGTAVFRQAITRWYQRRYNVSLDPEGEALPLLGSKEGLTHLALAYVNPGDVVLVPSPAYPAHFRGPAIAGANIYPLILKREKGWLIDLSEIPSDIARQAKVLYFNYPSNPTAAIAPRSFFEEVVAFAREYQILLVHDLCYAELAFDGYQPTSLLEIPGAKEIGVEFHTLSKTYNMAGWRVGFVVGNRHIIQGLRTLKTNLDYGVFSVLQKAAEVALSLPDSYIASVCDRYRQRRDFLIQGLNELGWQLTPTQATMYLWVPVPLGMSSTDFALKLLQETGIVVTPGNAFGEGGEGYVRISLIADCDRLGEALKRMAQANIRFDSLSHSLTPSSHD

SEQ ID NO: 55665 - protein, 377 aa, Cyanidioschyzon merolae
MTEEEITALVIDNGSGMVKAGFAGDDAPRAVFPSIVGRPRHQAVMVGMGQKDSYVGDEAQSKRGILSLKYPIEHGIVTNWDDMEKIWYHTFYNELRISPEDHPVLLTEAPLNPKANREKMTQIMFETFNVPAMYVAIQAVLSLYASGRTTGIVVDSGDGVTHTVPIYEGYALPHAIMRIDLAGRDLTDYLAKILTERGYSFTTTAEREIVRDIKEKCCYVAQDYDHELEIASSQPAKIDKQYELPDGQIITIGSERFRCPEVLFQPSLIGMEGEGIHNVAYQSIMKCDVDIRKDLYANVVLSGGTTMFPGIADRMQRELASVAPSSVKIKLVAPAERKYSVWIGGSILASLSTFQQMWISKAEYDEFGPSVVHRKCF

SEQ ID NO: 55666 - protein, 233 aa, Symbiobacterium thermophilum IAM 14863
MGVHAEFVLSAVAQGQFPQDGLPEVALVGRSNVGKSSLINALVRNRKLARTSNTPGRTQALNFYRVWPQGKPRPEGEPQPDKDAGRTALSGPVLQAARESGAFYLVDMPGYGFARVSEAQRREWARLIEGYLLTRGALRGVLQIVDLRHPPTRDDVTMREWIRHHRLPSLCVATKADKIGRTAWPRHRQVIARELGLDGDGEPLVLFSAETGLGRDDVWRWIREHVQDWTFDM

SEQ ID NO: 55667 - protein, 527 aa, Oryza sativa (indica cultivar-group)
MATLLSKLLALPQQWQLLLLLLLLPIASLLLVIGRNTGGRRRRRHLRLPPGPARLPVLGNLLQLGALPHRSLRDLARRHGPVMMLRLGAVPAVVVSSPEAAQEVLRTHDADCCSRPSSPGPMRLSYGYKDVAFAPYDAYSRAARRLFVAELFSAPRVQAAWRARQDQVEKLIGKLTRPEPEPVELNDHIFALTDGIIGAVAFGSIYGTERFASGGRKRFHHLLDDVMDMLASFSAEDFFPNAAAARLFDHLTGLVARRERVFQQLDAFFEMVIEQHLDSDSSNAGGGGGNLVGALIGLWKQGKQYGDRRFTRENVKAIIFDAFIGGIGTSSVTILWAMAELMRSPRVMRKVQAEIRATVGDRDGGGMVQPDDLPRLAYLKMVVKETLRLHPPATLLMPRETMRDVRIGGYEVAARTRVMVNAWAIGRDAARWEEAEVFDPDRFEAKRVEFNGGHFELLPFGSGRRICPGIAMAAANVEFTLANLLHCFDWALPVGMAPEELSMEESGGLVFHRKAPLVLVPTRYIQL

SEQ ID NO: 55668 - protein, 503 aa, Brassica napus
MAITVPRRQLFIGGQWTEPLRRQTLPVVNPATEDIIGYIPAATSEDVELAVEAARKALTRNKGNDWSKASGAVRARYLRAIAAKVTERKSELANLEAIDCGKPLDEAAWDMDDVAGCFEYYADLAQGLDSKQKAPLSLPLDTFKGYVLKEPIGVVGLITPWNYPLLMAVWKVAPALAAGCTAILKPSELASVTCLELADICREVGLPPGVLNILTGLGTEAGAPLASHPHVDKIVFTGSTATGSNIMTSAAKLVKPVSLELGGKSPIIVFDDVKIDKAVEWTMFGCFWTNGQICSATSRLLVHEKIADEFLDKLVKWTKNIKISDPFEEGCRLGPVVSKGQYERVVKFVSNARKEGATVLCGGARPGHLKKGYFVEPAIISNVTTSMEIWRDEVFGPVLCVKTFSTEDEAIQLANDSQYGLAGAVLSNDLERCDRVSKAFEAGIVWVNCSQPCFCQAPWGGTKRSGFGRELGEWGLENYLSVKQVTQYISNEPWGWYKSPSKL

SEQ ID NO: 55669 - protein, 146 aa, Oryza sativa (indica cultivar-group)
MASSSDPWMKEYNEASRLADDINSMIADRGSLPQSGPEIIRHTSAIRRKITILCTRLDSLEALLSKIPPKSLSDKELHKRQDTLSNLKSKTKQMATSFNMSNFANREDLLGQNKKAADDMSRVAGLDNQGIVGLQRQIMKGDKYVT

SEQ ID NO: 55670 - protein, 375 aa, Xanthophyllomyces dendrorhous
MDDEVAALVIDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNAPAFYVAIQAVLSLYASGRTTGIVLDSGDGVSHTVPIYEGFALPHAILRLDLAGRDLTGYLVKCLMERGYPFTTTAEREIVRDIKEKLCYVALDFEQEMQTAAQSSQLEKSYELPDGQVITIGNERFRCPEALFQPSFLGLEAAGIHETTYNSIMKCDLDIRKDLYGNVVLSGGTTMYSGIADRMQKEITSLAPSSMKVKIVAPPERKYSVWIGGSILASLSTFQSMWISKQEYDEAGPSIVHRKCF

SEQ ID NO: 55671 - protein, 375 aa, Puccinia graminis
MEEEVAALVLDNGSGMCKAGFAGDDAPRAVFPSICGGPRHQGVMVGMGQKDSYVGDEAQSKRGILTLKYPIEHGIVTNWDDMEKIWHHTFYNELRVAPEEHPVLLTEAPLNPKVNREKMTQIMFETFNAPAFYVAIQAVLSLYASGRTTGIVLDSGDGVTHTVPIYEGYALPHAILRLDLAGRDLTDYLIKILMERGYSFTTTAEREIRRDIKEKLCYVGLDFEQEMQTASQSSALEKSYELPDGQVITIGNERFRCPEALFQPSLLGLEASGIHETTYNSIMKCDLDIRKDLYGNVVMSGGTTMYSGISDRMQKEITALAPSSMKVKIVAPPERKYSVWIGGSILASLSTFQQMWISKQEYDESGPSIVHRKCF

SEQ ID NO: 55672 - protein, 374 aa, Triticum aestivum
MAIPLVLVLLPLGLLFLLSGLVVNTVQAVLFLTIRPFSKRLYRQINVFLAELLWLQLIWLVDWWAGIKVQVYADPETWKLMGKEHALLISNHRSDIDWLVGWILAQRSGCLGSAIAIMKKSSKFLPVIGWSMWFAEYLFLERSWAKDEKTLKSGLQRLKDFPRSFWLALFVEGTRFTPAKLLAAQEYAVSQGLTAPRNVLIPRTKGFVSAVSIMRDFVPAIYDTTVIIPEDSPKPTMLRILQGQSSVVHVRIKRHSMSDMPNSDEDVSKWCKDIFVAKDALLDKHIATGTFDEEIIPIGRPVKSLMVVLSWSCLLLYGAHRFLQWTQLLSTWKGVILFASGLAMVTAVMHVFIMFSQAERSSSAKAARDRVKKD

SEQ ID NO: 55673 - protein, 413 aa, Ralstonia solanacearum GMI1000
MHRELIERYLQGATSPVCAYLYDLDHLRERAARLSAMLPPGCELFYAIKANSDAPVLAALDGAVAGYEVASLGEVVRAREVGAQARIVFGGPGKTDDELQGALERGVELIHVESELQLRRLDAIACRMGRRARVLLRVNPNPLSADAVGKRAQGTLTMGGQPTQFGIEEDAVPDLIRLARTLPGVEVVGLHLHALSNNLDADSHLALMRHYLSLALRLRREHGLTLDTLNVGGGIGVDYADPSHAFDWRRFCDGLGVLLAEAGAGCRIVFECGRFIAADCGYYVTEVVDLKRNHGRWFAVLRGGTHHFRLPASWQHNHPFAILPNARWDYPFERPSVLAQAVTLCGELCTPKDVLARDVVVDRLRVGDRIVFQLAGAYGWHISHHDFLSHPHPERRFVGALHAASDARLEVAA

SEQ ID NO: 55674 - protein, 296 aa, Viscum album subsp. album
VAPVDSGFWWIILLRAYTKSTGDSSLADLPECQNGMRLILNLCLSEGFDTFPTLLCADGCCMIDRRMGVYGYPIEIQALFFMALRCALLLLKQDAEGKEFAERIVKRLHALSFHMRSYFWLDSKQLNDIYRYKTEEYSHTAVNKFNVIPDSLPDWVFDFMPIHGGYFIGNVSPARMDFRWFCLGNCIAILSSLATPEQSTAIMDLIESRWQELVGETPLKVCYPALETHEWRIITGCDPKNTRWSYHNGGSWPVLLWLLSAACIKTGRPQIARRAMELAESKLMGDNWPEYYDTRR

SEQ ID NO: 55675 - protein, 548 aa, Pseudoalteromonas tunicata D2
MSNRTALPSWQSLQLLAKNIQGVHLKQLFSDDAERFERYSIAIDGLLFDYSKNLITPEIHEQLLALAKDVNLIEWREKMFRGERINFTENRSVLHTALRQRADNPFMLDGENINQAVHTELKKMSVFVEQVRSGAWLGYDNQAITDVVSIGVGGSNLGPQMATEALKPYADDRLNVHYVSNADGVQIHQVLARLNPATTLFVVSSKTFTTSETMTNARTALAWLNAATDVEGAVAKHFVAVSSNLTKTAEFGIDSANVFAMWDWVGGRFSLWSAIGLPIALYLGFDTFTELLAGAADADEHFFNTELSQNIPVIMALLSVWNTSFLGAKAQAILPYDQTMHMLPAYLQQAEMESNGKSVTFAGDSVDYTTVPLIWGMTGINGQHAFYQYLHQGTTIVPADFIGSIEPSVAVGHHHQVLMSNFFAQTQALMNGVDANEVRAALGKKGLSDTEIEQLVAHKVHQGNRPTTSIILDKIDARGLGRLIAFYEHKIFCQGILLEICSFDQWGVELGKGLASNIEAELATNNIVLGHDSSTNGLVNYFKQKRTI

SEQ ID NO: 55676 - protein, 296 aa, Viscum album subsp. album
VAPVDSGFWWIILLRAYTKSTGDLSLADAPECQKGMRLILALCLSEGFDTFPTLLCADGCSMIDRRMGIYGYPIEIQALFFMALRCSLAMLKHDTEGKEFIERITKRLHALSFHMRSYFWIDFQQLNDIYRYKTEEYSHTAVNKFNVIPDSIPEWVFEFMPTRGGYFIGNVSPARMDFRWFALGNCVAILSSLATPEQSLAIMDLIEARWEELVGEMPLKICYPAIESHEWRITTGCDPKNTRWSYHNGGSWPVLLWILTAACIKTGRPQIARRAIDLAESRLLKDSWPEYYDTQR

SEQ ID NO: 55677 - protein, 467 aa, Theobroma cacao
  misc_feature (217)..(217): Xaa can be any naturally occurring amino acid
  unsure (1)..(467): unsure at all Xaa locations
MEGGSKKVKSLALVWLIFALLHPLRLISANVEGDALHSLRTNLNDPNNVLQSWDPTLVNPCTWFHVTCNNDNSVIRVDLGNAALSGQLVPQLGLLKNLQYLELYSNNISGQIPSDLGNLTSLVSLDLYLNSFSGPIPESLGRLSKLRFLRLNNNSLSGPIPMSLTNITSLQVLDLSNNRLSGEVPDNGSFSLFTPISFANNLDLCGPVTGRPCPGSXPFSPPPPFVPPPPISSPSGNSVTGAIAGGVAAGAALLFAAPAIAFAWWRRRKPQEFFFDVPAEEDPEVHLGQLKRFSLRELQVATDSFSNKNILGRGGFGKVYKGRLADGSLVAVKRLKEERTPGGELQFQTEVEMISMAVHRNLLRLRGFCMTPTERLLVYPYMANGSVASCLRERPPSQPPLDWPTRKRIALGSARGLSYLHDHCDPKIIHRDVKAANILLDEEFEAVVGDFGLAKLMDYKDTHVTNH

SEQ ID NO: 55678 - protein, 546 aa, Bruguiera sexangula
MAIAAQTPDILGERQSGQDVRTQNVVACQAVANIVKSSLGPVGLDKMLVDDIGDVTITNDGATILKMLEVEHPAAKVLVELAELQDREVGDGTTSVVIIAAELLKRANDLVRNKIHPTSIISGYRLAMREACKYVEEKLSMKVEKLGKDSLVNCAKTSMSSKLIAGDSDFFANLVVDAVQAVKMTNARGEIKYPIKSINILKAHGKSARDSCLLNGYALNTGRAAQGMPMRVAPARIACLDFNLQKTKMQLGVQVLVTDPRELERIRQREADMTKERIEKLLKAGANVVLTTKGIDDMALKYFVEAGAIAVRRVRKEDMRHVAKATGATLVSTFADMEGEETFDSSLLGQAEEVVEERIADDDVIMIKGTKTTSAVSLILRGANDYMLDEMERALHDALCIVKRTLESNTVVAGGGAVEAALSVHLEYLATTLGSREQLAIAEFAESLLIIPKVLAVNAAKDATELAAKLRAYHHTAQTKADKKHLSSMGLDLSKGTIRNNLEAGVIEPAMSKIKIIQFATEAAITILRIDDMIKLVKDETQNEEE

SEQ ID NO: 55679 - protein, 212 aa, Brassica napus
TGKTLDVNFEEEVIPKHISVKEAVFPFEKFQGCDVILGPEMRSTGEVMSISSEFPSAFAMAQIAAGQKLPSPPAVRLSWGGMTKPHLEKIAVSFLDLGFKIVATSGTAHFLELKGIPVERVLKLHEGRPHAADMVANGQIHLMLITSSGDALDQKDGRQLRQMALAYKVPVITTVAGALATAEGIKSLKSSAIKMTALQDFFEVKNESSLLV

SEQ ID NO: 55680 - protein, 369 aa, Rhodococcus sp. RHA1
MTENAPTRIVVFGATGYAGGLAVEALVRRGLRPVLAARSEHKLAHLAAAHGGLEYRVADVSDPASVQALIEPGEVLVTGVGPFERVGWVAAEAAARSGAHYVDSTGEIGFVRELHRRHDARARETGSVMLPAFGYDYVPGVLAGALAAEQGGAATWSLDIGYFATGPLWKGLSQGTRKTVAEGMTLPVTMYRDGTLADRRAAQDVRRFTVRGATRNAILASGTEVLQLPARYPGLRQVRVFNGWFPELARPMQAASLLATTLSRTALGRRVLDGAFARMAGPAGGPDAAERAKTRGLAVAVARASSGKVLAEVEVEGPSPYTVTAELMAMAAHRLALGLGRTPGVVGPIDGLGADEFPAACAEVGLARI

SEQ ID NO: 55681 - protein, 666 aa, marine gamma proteobacterium HTCC2080
MTSRLQLANAIRALSMDAVQAANSGHPGAPMGMADIAEVLWNGYLKHNPNNPDWPDRDRFVLSNGHGSMLLYSLLHLSGYDLTIEDLKNFRQFHAKTAGHPEYGYAPGVETTTGPLGQGLANAVGMALAEKTLAAQFNTEKHTLIDHRTWAFLGDGCLMEGISHEACSLAGTLGLGKLVAFYDDNGISIDGEVTGWFTDDTTKRFESYGWQVIPNVDGHDHASISAAIDLALQDGEKPTLICCRTIIGKGAPNKQGTESCHGAPLGADEIAATRAALGWEHGPFEIPEAVYEGWDAKARGAEQEQDWHSRFADFSKAAPQQAEELERRLEGTLPDTFEAQMDDYITQCAEAGTDMASRKASQQTLNTLGPLLPEMLGGSADLAGSNLTLWQGSKGVTATDASGNYVYYGVREFAMSAMMNGVALHKGFIPYGATFLIFMEYARNAVRMAALMRQRVIFVYTHDSIGLGEDGPTHQPVEQLTALRSTPNLETWRPCDTVESAVAWKMAVMRDAGPAALIFSRQTLPHQDRAEEGVKAIERGGYTLISETGELDAIIIATGSEVGLAVAAAQTLAENGRGIRVVSMPCAERFMAQEVTYRESILPSDVLARVAVEAAHADYWYKFVGLDGRVVGMQSFGESAPGGELMAHFGFTVENVVAAVEDVFLD

SEQ ID NO: 55682 - protein, 317 aa, Rhodococcus sp. RHA1
MTDIKPVLEPEAAEFAKATDTPPFLFQLPPAEGRKTVDEVQSGEIDKPAIDEEWITVEGGPTGSVKVRIVKPAGATGTLPVLFFIHGAGWVFGNAHTHDRLVRELAVGADAAVVFPDYDLSPEAKYPTAIEQNYAAAQWVFAHGAEKGLDATRFAVAGDSVGGNMSAVLTLMAKDRGDVHITQQVLLYPVTNGAFDTPSYHQFAEHYFLAREGMQWFWDQYTSNESQRAEIYASPLRATVDQLRGLPPALVITAEADVLRDEGEAYAAKLREAEVPVTHVRVGGVIHDFMMLNALRSTQGAAAAIKLAQDTLRTALH

SEQ ID NO: 55683 - protein, 246 aa, Oryza sativa (japonica cultivar-group)
MASKPSSRAESNQAAAAVPSLYGRALPSPPAVEFASAEGRRLFAEALQGGTMQGFFSLVSVFQTQSEPAFCGLATLAVVLNALRIDPGRRWKGPWRWFDESMLDCCEHLDTVRAEGITFGKVACLAHCSGADVRTFRAAQATLADLRRHLLRCASSQDCHLVASYHRKLLGQTGTGHFSPIGGYHAGQDMALILDVARFKYPPHWIPLPLLWEAMNTIDEATGLLRGFMLISRNTEAPLLIRAVVN

SEQ ID NO: 55684 - protein, 448 aa, Zea mays
  misc_feature (166)..(166): Xaa can be any naturally occurring amino acid
  unsure (1)..(448): unsure at all Xaa locations
MLMEEECVEAPSYIHIDSNAFSYRKHKSQTEEDIAVCECQYDILDPESPCGDRCLNLLTNTECTPGYCRCGVYCKNQRFQKCQYARTRLVRTGGRGWGLVADENIMAGQFVIEYCGEVISWKEAKRRAQAYETQCLKDAYIIYLNADESIDATRKGNLARFINHSXEATYLWEDDDDRFSVENIPLYDSADDEPTSINKEILVSSDGMVTQYSNISRVQSTENPGNTGTNEFAPIIVDELTTSSNGLAPMNVEPLTVSSNEFTPSNAMPMVARLVENGSTGYSAQDTHDASQNSAPKAANHANQTGPQNNSNHSTLVPVKPAPKRRGRKPKRVVHKQLDIPDICDRLTSSVACEEILYCEEVKNHAVSEIDALYDEIRPAVEEHERDSQDSVSTSLAEKWIEASCRKYKAEFDLYAAVLKNVASTPLRSKDDVGPREQNGLKYLENGS

SEQ ID NO: 55685 - protein, 515 aa, Pseudomonas aeruginosa UCBPP-PA14
MTATPKPLVLIILDGFGHSESPDYNAIYAAKKPVWDRLLATQPHGLISGSGMDVGLPDGQMGNSEVGHMNLGAGRVVYQDFTRVTKAIRDGEFFENPVIAAAVDKAVAADKAVHILGLLSPGGVHSHEDHLVAMAQMAARRGAGKIYLHAFLDGRDTPPKSAQPSLERLDATFAGLGKGRIASIIGRYFAMDRDNRWDRVQAAYELIVDGKAEFTADSSVAALEAAYARGESDEFVKATAVVPAGAEAVRVEDGDAVIFMNFRADRARELSRAFVEPAFKEFPREQAPQLAGFVMLTQYAASIPAPCAFPPEPLTNVLGEYLAKHGKTQLRIAETEKYAHVTFFFSGGREEPYEGEERILIPSPKVATYDLQPEMSAPEVTDRIVEAIEQQRYDVIVVNYANGDMVGHTGVFEAAVKAVECLDTCMGRIVEALDKVGGEALITADHGNVEQMEDESTGQAHTAHTCEPVPFVYVGKRKLSIREGGVLADVAPTMLTLMGLEQPAEMTGRSIVTLG

SEQ ID NO: 55686 - protein, 384 aa, marine gamma proteobacterium HTCC2080
MKLMHELDLSGKRVLIREDLNVPIKDGRVTSDARLLATLPTIRQALTSGAAVMLMSHLGRPEEGTWEDRFSLAPVAHRLSELLEVEVKLVTDWESAVPQQGQILLLENVRFNSGEKQNSDALGQRYAALCDIFVMDAFGTAHRAQASTHGVARFAAVACAGPLLAAELAALKSALAQPARPMLAIVGGSKVSTKLAVLEQLAKTCDSLIVGGGIANTFLAAAGYPVGRSLHEPDLIDTARELLQKSHIPLPLDVVVAKEFSENATPMLKLASEVAEDDMILDVGPQSASAMVEQLKQAETILWNGPVGVFEFESFSHGTEELARGVAASQAFSLAGGGDTLAAIDQFGVSDQVSYISTGGGAFLEYVEGKTLPAVAILEERALQ

SEQ ID NO: 55687 - protein, 456 aa, Erythrobacter sp. NAP1
MKQDVISRSDSERHPIAIPEAKRKTQIVIVGGGAGGLELVRKLGAKYGRKRHDIILVDQNLSHIWKPLLHEVAAGSLDANLDEVGYRGHCARWGYRFFQGRLESIDRKAKTIRLAPVMDDDDEEIIGAHTIRYDMLVLAIGSVSNDFGVPGVAEHCLYLDSRRQADRFRTLLLNHCLRVSRAMIENPGADSRVKVAIVGAGATGVELAAELYNAAGALKHYGLEVFDESRLDVTILEAGPRILPALPERLSTSARKELKALGVEVREGVQVVEAKRRQLITKTGETIEADLMVWAAGVKGAEFLSTLGLDTTMRNQIVVTETLQTVTDPDIFAIGDCASYSPDSDAPPIPPRAQAAHQMADTVFKNLRLREQGRPLKRFVYQDNGSLISLSRFSTVGSLMGNLVGGAMAVEGRIARFIYTSLYRMHLIAIHGWLKGMGLIVIGRVNRIVRPKLKLH

SEQ ID NO: 55688 - protein, 276 aa, Oryza sativa (indica cultivar-group)
MAATAAASVAAISPLPGASLPRPVSARVPLLPRASPPTWRLSVGSARARSARCLAAAGGGGLAPEMRATLDKVVGSHKVVLFMKGTKDFPQCGFSHTVVQILRSLDVPFETLDVLANEALRQGLKEYSSWPTFPQLYIDGEFFGGCDITVAGFERFGACCLLRIFSVNKTTTRAWPPTRASDLVKTILVDSAAVNAHLRELLHLHGVGAVVLLREVVHDAARRHVVHRRNLSIHGADGHFVFMRDGGVLQLDIHDAGARRAALSRGEATQWPEASN

SEQ ID NO: 55689 - protein, 270 aa, Triticum aestivum
MAESLDMSLEDIIKSNKKGNSSSGGGGRRREGRLGSAAAGSGAAAAAAGGVGPNRRAFKRSGNRAAPYQPPKAPESAWQHDMYSDASARGGGGGRVSAIETGTKLLITNLDFGVSTEDLKELFSELGDVKRCLIHYDRSGRSKGTAEVIFARRGDAVAALRKYNNVQLDGKPMKIEILGTNTPTAPAALPTNNGTYARNVAKSAPRGVSASLPQNRPRARGGRGRRGGGGGSGSGGRRGKERSQPRSAEELDAELEKYHAQGTTPMQTTE

SEQ ID NO: 55690 - protein, 147 aa, Brassica napus
LCISNPKVNVMDTLSRLSHDADADVSMAAIISLGLIGAGTNNARIAGMLRNLSSYYYKEAAHLFCVRIAQGLVHLGKGLLTLSPYHSDRFLLSPMALGGIVTVLHACLDMKSTILGKYHYILYIIVLAMQPRMLLTVDEDLKPLPVP

SEQ ID NO: 55691 - protein, 202 aa, Oryza sativa (japonica cultivar-group)
MDLSPNPDSPPSGGGNGGGGGSSSSNSSPSMGPGAPQSPSRYEAQKRRDWNTFGQYLRNHRPPLSLAQCSGAHVLEFLRYLDQFGKTKVHTAACPFFGHPSPPAPCPCPLRQAWGSLDALVGRLRAAFEENGGRPESNPFAARAVRLYLREVREHQARARGVSYEKKKRKKPQQQQLQGGDSSGLHGHQHHPPPPPPAGAAC

SEQ ID NO: 55692 - protein, 224 aa, marine gamma proteobacterium HTCC2080
MDQQGMKEAVALAALEWVKALPGDNLVLGIGTGSTAECFIRLLPAIKQRINITVSSSQRSAALLQELQIPLGDLNDVGQLDAYIDGADEANQRLQLIKGGGAALTREKIIAAAAKRFLCIADASKKVATLGAFPLPVEVIPMARSFVARELVKLGGQPIWRDGVVTDNGNVILDVHGLSIDHALETEEAINHITGVVCSGLFARRPADVLMLGTPQGVETLQAN

SEQ ID NO: 55693 - protein, 223 aa, Lactobacillus sanfranciscensis
MTKFSEIKGFAFDLDGVITDTAKFHTQAWHALADQVNVTWTPELQESLKGIDRMGSLEMILKAGNKQDDYTHDEKVALASWKNNHYVELISGLTPDDILPGMADFIKELNDKGYRASVASASKNAPFILDKLGLTDSFVGIVDPATLHAGKPDPEIFVRAAEILNLLPEQVIGLEDSAAGIASINGAGEVSLGIGDTTVLAAANLNFASTAEVTLANIAAKLD

SEQ ID NO: 55694 - protein, 540 aa, Triticum aestivum
MQLSRLNQHTFLSLLKAAASVSSRRLPSLHAVYIKLGFLAHTRVTNGFIQGYCATRRVTDARRVFAEMPRQDTVSFNSMIHGYAVSGDVASACRLFEQVPAPTPVTWTSMVAGLCRAGDVGSARRVFDKMPERDLVSWNAMISGHVGNRQPVEALCLFGRMMKEGFVPNRGTVVSALSACASAGALETGKWVHVFIEKNRLRWDEFLGTALIDMYAKCGAVELALEVFASLRARNTCTWNAMINGLAMNGYSAMALDMFRQMELDGRVVPDEVTFVGVLLACSHGGSVDAGREHFNMISKKYGIGLILEHYACMVDLLARSGHLQEAHKLITEMPMKPDVVIWRALLGGCRLHKNVKMAEIVITEMAATCSGDHVLLSNLYAAVGRWNGVEDVRRTMRSKGIEKIPGCSSVEMDGSIHEFISGDKSHPSYDDIHAKLIEIGGRMQQQGHVTEITEVFYDIEDEEKEQALGHHSEKLAIAFGLIGGPPDATIRIVKNLRFCMDCHKFAKLVSKIYQREIVVRDRARFHHFRGGTCSCNDFW

SEQ ID NO: 55695 - protein, 193 aa, Thuja plicata
MAIWNGRVLNLCILWLLVSTVLLNDADCHSWKKKLPKPRKNLVLYFHDIIYNGQNAENATSTIVAAPEGANLTILTGNNHFGNIAVFDDPITLDNNLHSPPVGRPQGFYFYDMKNTFSSWLGFTFVLNSTDYKGTITFNGADPILVKYRDISVVGGTGDLLMARGIAAINTDAYEGDVYFRLRVNITLYECYY

SEQ ID NO: 55696 - protein, 416 aa, marine gamma proteobacterium HTCC2080
MATFYWVLTLLMGIATLTALIPGRALGWWVPVWFLVSTATNELAAWGLIMHFFMLAIGVGFLDPNDALVRVGLGVLLLSGLGTLVLLKRHFETGGQLERALQVGLPSNFEDIIPLERRYRLSHQITAKDWLHPISFARHGVRRERNIAYGEAGKRNKLDIFTPVRPGSNRPVLLQIHGGAWLVGKKEEQALPLMHHMASLGWVVVAINYRLSPRATFPDHIIDVKKAIVWIRQNIHEWGGNPEFISVTGGSAGGHLTALTAMSGNYAPWQPGFEAADTRVQAAMPLYGVYDFCNRAGIRQGTGIDDYVMKRVMKSTPQDDPEAFDLASPECWVDGEVPPLFIIHGSHDTLVWVEEARRFVAELSAVSSTSLVYAELKGAQHAFETVHSPRTSHYLNAAAWWLEWAYADWCARRSQD

SEQ ID NO: 55697 - protein, 417 aa, Oryza sativa (indica cultivar-group)
MHSRHQRLASLTKLLTSHVNAGRHRDALAFFSRMVSDPSLPPLSDPSFAYAFPLALKSSSALRLPSAAAAADSLHALAAKCGFLSSPFFASALVASYGACASPALARRLFDELPHRNAIVCSAMISVHIRSGDLAGALRELDLMDVAPTASCFNSVIAAVAESGEHPARAIDLYRRMQRMGVLPSLITLLALVPSCTALGALSSIKEVHGFATRHGMFASCHLGSSLIEAYGRCGSLAGARNVFDQVQERDVVVWSSIVSAYAFHGHADVAMSLFRHMELDNVRPDGIMFLGVLKACGHAGHADDALKYFDVLTKIFGVEACGDHYSCLVDVLGRAGRLRQAYDVIQTMPVKVTAKAWGALLAACRKYGEVGLAEVAGRALFEIEPENAGMGMHDKAEQVRREMEQRVNCSERGNTL

SEQ ID NO: 55698 - protein, 425 aa, Nitrosomonas europaea ATCC 19718
MLIEVKVPALSESVAEATLINWHKQPGEYVERGENLIDIETDKVVLELPAPQSGILAEIIRNDGATVTSGEIIARIDTAAKETKTAAQQPAPIDSGHLEITESTVASMHPAQPLMPSAKKAAEENGLTMEEIAAIHGTGRGGRITRQDVLAHVRNKNSAVTDQQSDSRTDQSAAGIPQADTSPIPVDQTEKPDRLEKRVPMTRLRMRIAERLVQSQSTAAILTTFNEVNMQAIMDLRARYKDSFEKEHGIKLGFTSFFVKAVVAALKKFPIINASVDGNDIIYHDYYDIGIAVASPRGLVVPIIRDADKLTFAGIEKQIADLARRAQEGKLTLEELTGGTFSITNGGVFGSMLSTPIINPPQSAILGIHATKQRPVVENGQIVIRPINYLALSYDHRIIDGREAVLSLVAIKEALEYPVSPLFEG

SEQ ID NO: 55699 - protein, 347 aa, Sulfolobus sp. RC3
MRAVRLVEIGKPLVLKDIDIPKPKGAQVLIKVEAAGVCHSDVHMRQGRFGNLRIVEDLGVKLPVTLGHEIAGKIEEMGDEVVGYSKGDLVAVNPWQGEGNCYYCRIGEEHLCDSPRWLGINFDGAYAEYVLNPHYKYMYKLRRLNAVEASPLTCSGITTYRAVRKASLDPTKTLVVVGAGGGLGTMAVQIAKAVGGATIIGVDVREEAVETAKRAGADYVINASVQDPLAEIRRITEGKGVDAVIDLNNSEKTLSVYPKALAKQGKYIMVGLFGADLHFHAPLITLSEIQFVGSLVGNQSDFLGIMRLAEAGKVKPMITKTMKLEEANEAIDNLENFKAVGRQVLIP

SEQ ID NO: 55700 - protein, 456 aa, Brassica napus
MDPTQNPNPVYDIVILGASGFTGKYVVREALKFLQTPSSPLKSLALAGRNPTRLTQSLEWASRPNPPPSSVDILTADTSDPDSLRRLCTQTKLILNCVGPFRIHGDPVVAACADSGCDYLDISGEPEFMERMEAKYHERAQETGSLIVSACGFDSIPAELGLLFNSKQWEPRPPSVPNQIEAYLALESTKKIAGNFGTYESAVLGVANAEKLKELRRSRPRKPRPSIHGPPAKGPTLENQKKIGLWALKLPSADAVVVRRTLTTLTEKPHGLPGLNESPDQIQKREAFWSAIKPAHFGVKITSKSLFGIFRYVTLGVSLGLLSKFSFGRWLLLKFPSVFSLGWFQKKGPSRDAAVCPAFEMWFIGRGYSEESLVSEGKTKPPDMEIITRISGPEIGYITTPIALVRCGLIVLGQRESLVKGGVYTPGIVFGSTDIQQRLEDNGISFEVISKNKIQD

SEQ ID NO: 55701 - protein, 420 aa, Pyrococcus abyssi GE5
MVEQDPFEIAVKQLERAAQYMKISEEALEFLKRPQRIVEVTIPVEMDDGSVKVFTGFRVQYNWARGPTKGGIRWHPEETLSTVKALAAWMTWKTAVMDLPYGGGKGGIIVDPKKLSDREKERLARGYIRAIYDVISPYEDIPAPDVYTNPQIMAWMMDEYETIARRKTPAFGIITGKPLSIGGSLGRNEATARGASYTIREAAKVLGWDDLKGKTIAIQGYGNAGYYLAKIMSEDYGMKVVAVSDSKGGIYNPDGLNADEVLKWKREHGSVKDFPGATNITNEELLELEVDVLAPAAIEEVITKKNADNIKAKIVAEVANGPVTPEADEILFEKGILQIPDFLCNAGGVTVSYFEWVQNITGYYWTLEEVREKLDKKMTKAFYDVYNTAKEKNIHMRDAAYVVAVQRVYQAMLDRGWVKH

SEQ ID NO: 55702 - protein, 390 aa, Corynebacterium glutamicum ATCC 13032
MSTNYEAIIIGAGQAGLAAAHELSRRGFTPGKDFLVLDSNDGPGGAWRHRWDSLTLGKAHGIADLPGLPMNRPDPKTPASTLVAGYYGAYENEFSFAVVRPVKVSRVEPTSEDPSSPLRVSSDDGREWITRMVLNATGTWTNPYVPYIPGIDKFQGKQLHTVNYRKAEDFKGKKVLVVGGGLSAVQFLLELEGLAETTWATRRPPNFTQREFDAGWGIAVERAVRERTFNGKAPASVVRTTGIPQIPDYLAGVDRGLIVSRGMFEEITPTGVVFGEPPAERSEGLGPSAGTTLAVPESWKPYPAGTHLDVDVIFWNTGFRAALRHLAPMKLRGQGRGIELIDEVSPASDARVLLVGYGSTASTVGATRAGRVAGRVAAKRLLVDVSPHVN

SEQ ID NO: 55703 - protein, 551 aa, Burkholderia mallei ATCC 23344
MQRPSLFPTLTRRTQRIWRQYGVFWLGAVVVGLTAVMYARLIDWGYEAFRSLGQGRPWLPFLLTPAIAALSVWLTRRFFRGAEGSGIPQVIATLHAQPSAFGSRLLTLRILFGKVLISLLGIAGGFTIGREGPTVQIGASLMFNLRRFYPRSNALIERQLVLAGAAAGLSAAFNTPLAGVVFAIEELSRSFSARASGVLITAIIIAGVIALGLNGNYTYFGTIEIGQHFPKMLAAAVLLTALVTGVAGGLFGWLLLNTGRWLPARLLALYRERPIVFAAACGLAIAAVGVASGGTTFGSGYAEARGLLDGREQLSVLYPFLKMISMVASYLPGIPGGIFAPSLSIGAGFGNLLHFVFSGMHLPMLIALAMVGYLAAVTQSPITSFVIVMEMINGHALVISLMATALIASRVSRLFVPPLYETLAERYLKPPQPKQAATAPAHTGIAAVKMPEDAESAPADPLDTLRDEAANEANTNERDAGDAGGHTGAGAAAHADDAPCGAADAARAGAPPDASPASAPGAAGASNTRANDPTPPSGDGENREPPQRPAQ

SEQ ID NO: 55704 - protein, 373 aa, Saccharomyces cerevisiae
DYRPGGFHPAFKGEPYKDARYILVRKLGWGHFSTVWLAKDMVNNTHVAMKIVRGDKVYTEAAEDEIKLLQRVNDADNTKEDSMGANHILKLLDHFNHKGPNGVHVVMVFEVLGENLLALIKKYEHRGIPLIYVKQISKQLLLGLDYMHRRCGIIHTDIKPENVLMEIVDSPENLIQIKIADLGNACWYDEHYTNSIQTREYRSPEVLLGAPWGCGADIWSTACLIFELITGDFLFEPDEGHSYTKDDDHIAQIIELLGELPSYLLRNGKYTRTFFNSRGLLRNISKLKFWPLEDVLTEKYKFSKDEAKEISDFLSPMLQLDPRKRADAGGLVNHPWLKDTLGMEEIRVPDRELYGSGSDIPGWFEEVRDHKRH

SEQ ID NO: 55705 - protein, 104 aa, Zea mays
  misc_feature (33)..(33): Xaa can be any naturally occurring amino acid
  unsure (1)..(104): unsure at all Xaa locations
MSWLGKGGKGLGKGGAKRHRKVLRDNIQGITKXPEIRLLARRGGDKRISMLIYEETRVVLKIFLQNVIRDAVTYTEHARRKTLTAMDVHYALKRHGPTLYAFLC

SEQ ID NO: 55706 - protein, 239 aa, Blueberry stunt phytoplasma
FMTSVLQQALKEAHLTPQEIDLVAVTQGPGLVGSLLVGINAANVFAYTYQKPLLGVNHLLGHIYSAQIEHEIKFPALVLLVSGGHTDLFYLTDHLQIKPLGTTLDDAVGEVYDKIAKNLNLPYPGGPLIDQLAQQGKDTYHLVRPYLKNDNLNFSFSGLKSNLVNLVMKQNLKDINIPDLCVSFQASVIDVLYEKTKRALTKYPVKQLIVTGGVASNSGLRQKFMTSFSNLEVIFPSLQ

SEQ ID NO: 55707 - protein, 142 aa, Posidonia oceanica
ISGGHLNPAVTFGAFVGGNITFLRGILYWHGQLLGSIVACLLLKFVTGGMTTGGFAVSGVSVWNALVFEIVMTFGLVYTVYATAIDPKKGAIGTIAPLAIGLIVAANIFDGGVFTGASMNPAVAFGPALVSWNWVNQWVYWV

SEQ ID NO: 55708 - protein, 170 aa, Zea mays
MAPTVMMASSATAVAPFQGLKSTASLPVARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 55709 - protein, 445 aa, Actinobacillus pleuropneumoniae serovar 1 str. 4074
MTTETPLMTFEELDLAPQLLKALNKKGYKRPTSVQAETVPHALDGRDLLGSAPTGTGKTAAFLLPAIQHLLDYPRRKPGAPRILILTPTRELAMQVAEEAQAFAEFTKLSIATITGGVAYQNHGEVFNSNQDIVVATPGRLMQYIKEENFDCRAVEILIFDEADRMLQMGFGQDAEKIAAETRWRKHTWLFSATLEGELLVDFTDRILDNPLKIDAEPSRRERKKIQQWYYHADNVEHKTKLLARLISTMEMEKAIVFVRRREDVRELSDTLRKRGLRSTYLEGDMAQTQRNQAIARLKDGVVNVLVATDVAARGIDIDDVDYVINFDLPYSADTYLHRIGRTARAGKKGSAISLVEAHDYKLLGKIKRYTEELLKPRVIEGLEPRTKAPKDGELNTTTKKEKARIKKRKEAKKEAAKAKVKVRHKDTKNVGKRRKPASEAAKSA

SEQ ID NO: 55710 - protein, 272 aa, Synechococcus elongatus PCC 7942
MRKLIEGLRHFRTSYYPSHRDLFEQFAKGQHPRVLFITCSDSRIDPNLITQSGMGELFVIRNAGNLIPPFGAANGGEGASIEYAIAALNIEHVVVCGHSHCGAMKGLLKLNQLQEDMPLVYDWLQHAQATRRLVLDNYSGYETDDLVEILVAENVLTQIENLKTYPIVRSRLFQGKLQIFGWIYEVESGEVLQISRTSSDDTGIDECPVRLPGSQEKAILGRCVVPLTEEVAVAPPEPEPVIAAVAAPPANYSSRGWLAPEQQQRIYRGNAS

SEQ ID NO: 55711 - protein, 270 aa, Glycine max
MFSCSGNNLQVPLIAYSVGERGLISQLLSQKFGGFFVYESLAGNPIPGLPSLDNIQEAYKLEHVKADTKVFGLISKPISHNKGPILHNPPFRHINYNGPFCRLLAAVLKKFFSTYPSPDFSGFSVGIPYKEEVLRFCDEVHPLAQSIGAVNTIIRRPRDGKLVGYNTDCEAAITAIEDALIEHGCNDGEASLGSPLAGRLFVLVGAGGAGKALAFGANSRGARLVIFDIDFDRAKSLACAVFGEAQPFKELVNFSPREGAILANATPVGM

SEQ ID NO: 55712 - protein, 379 aa, Oryza sativa (japonica cultivar-group)
MATAGKVIKCKAAVAWEAGKPLSIEEVEVAPPQAMEVRVKILYTALCHTDVYFWEAKGQTPVFPRILGHEAGGIVESVGKGVTELAPGDHVLPVFTGECKEFDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 55713 - protein, 412 aa, Oryza sativa (japonica cultivar-group)
MATAGKVIKCKAAVAWEAGKPLSIEEVEVAPPQAMEVRLKILYTALCHTDVYFWEAKGQTPVFPRIFGHEAGGIVESVGEGVTELSPGDHVLPVFTGECGDCRHCLSEESNLCDLLRINTDRGAMIGDGQTRFTARGGQPVYHFLGTSTFSEYTVVHVGCVAKIHPAAPLDKVCVLSCGISTGFGATVNVAKPPKGCTVAIFGLGAVGLAAMEGARISGASRIIGVDLNPAKFELAKKFGCTDFVNPKDYDKPVQQVIIEMTNGGVDRSVECTGNAAAMISAFECVHDGWGVAVLVGVAGKDAAFKTHPTNFLNERTLRGTFFGNYKPRTDLPGVVEMYMNKELELEKFITHSVPFSEINTAFDLMLSGESSAAASGWRTSHPDRCRRRRIDGGGDCINGENKRLKLPMLQQ

SEQ ID NO: 55714 - protein, 310 aa, Mycobacterium tuberculosis CDC1551
MLLTGPPPSLPERIRTDEADVLMLPDGRALAYLEWGDSTGYPAFYFHGTPSSRLEGAFADGAARRTGFRLIAIDRPGYGRSTFQAGRNFRDWPADVCALADAFELEEFGVVGHSGAGPHLFACGAVIPRTRLAFVGALGPWGPLATPDIMRSLNAADRCYARLARSGPRLFGALFAPLGWCAKYTPGLFSTLLAAAVPAADKHLLSDERFGRHLRAIQLEAFRQGSRGAAYESFLQFRPWGFDLAEVAVPTHIWLGDRDSFVPRAMGEYLQRAIPHVDLHWAHGKGHFNIEDWDAILAACALDIGKRRGG

SEQ ID NO: 55715 - protein, 247 aa, Brassica napus
MADSTQPLLSDSNSSGSKLPPPRTLDETIEQCIGDFGWAQFLQAVLVSFAWVFDAQQTFITVFTDSQPTWHCLDSDRCNSSSNFCTLPNQTWSWDFNPHVSTISEWGLQCAGSLVKGLPASSFFLGCLVGGLALSTLADSSLGRKNMLLLSCLIMSLSSMLTAFSTSIWVYAFLRFLNGFGRATVGTCALVLSTELVGKKWRGQVGAMGFLCFTLGFLTLPLLGYINKRNSWRYLYVWTSIPTLIYC

SEQ ID NO: 55716 - protein, 138 aa, Sulfolobus solfataricus P2
MVAQRTFVMIKPDGVKRGLIGEIISRFEKRGLKIVSLKMVKMSRDTAEKLYEEHKGKSFFEELVNYVTSGPVVCMVIEGDDVVQVIRRMIGNTDPKEAPPGTIRGDYALSKSENVIHASDSIEKAQREMSLFFDKSDL

SEQ ID NO: 55717 - protein, 336 aa, Erythrobacter sp. NAP1
MTADVVPLPRKKPTLEPMLSLTANGMNSVNSVILERMQSEIPLIPRLAGHLISGGGKRLRPMLTLAGAALVGYEGTRHHKLAAAVEFIHTATLLHDDVVDGSELRRGKAAANIVFGNPATVLVGDFLFSRAFELMTEDGSLRVLKILSHASAVIAEGEVSQLTAQRQIETSEERYLHIIGAKTAALFAAASQISAVVAECSDEEERALEDYGRNLGVAFQLVDDAIDYDSDAAQMGKDQGDDFREGKMTLPVILAHARGDEAERKFWKDAILGHRSSDEDFAEAIRLIEKHNALEDTREKARHFAQRAIDAISIFADSKARAAMAEAAQFAVARGY

SEQ ID NO: 55718 - protein, 300 aa, Prochlorococcus marinus str. MIT 9313
MQDDGLNRGADSGARLAIRLLQDAAERGELDPWDVDVIAVVDGFLDQLRQRIEVPQQVAAQVQRQGGSYEQDLADSSEAFLAASVLVSLKAEVLEAQTFPPEPLFEEGFEAELGEQGWLDPSFALPRRPERHLLRRPAAPPPLRRPVTLGELIEQLESIAEQLESDELQQRRRKRNKRLSEREAIAQVTALAHREKLPETTAALGVFLNDWEQALHWVDFEQLVGQWEQVSTADLDTDRVGVFWALLFLCSQGKVELAQEGSLYAPLRLKRLLAPGTIAQLPLTSLNVPAATPAEVVNAA

SEQ ID NO: 55719 - protein, 497 aa, Glycine max
MAAGTGLFAEILDGDAYKYYADGEWKKSASGKSVSIINPTTRKTQYKVQACSQEEVNKVMDLAKSAQKLWAKTPLWKRAELLHKAAAILKEHKTPIAECLVKEIAKPAKDAVMEVVRSGDLVSYTAEEGVRILGEGKFLVSDSFPGNERTKYCLTSKIPLGVILAIPPFNYPVNLAVSKIAPALIAGNSIVLKPPTQGAVSALHMVHCFHLAGFPKGLINCVTGKGSEIGDFLTMHPGVNCISFTGGDTGISISKKAGMIPLQMELGGKDACIVLEDADLDLVAANIIKGGFSYSGQRCTAVKVVLVMESVADALVEKVKAKVAKLTVGPPEDDCDITPVVSESSANFIEGLVLDAKEKGATFCQEYKREGNLIWPLLLDNVRPDMRIAWEEPFGPVLPVIRINSVEEGIHHCNASNFGLQGCVFTKDVNKAIMISDAMETGTVQINSAPARGPDHFPFQGIKDSGIGSQGITNSINMMTKVKTTVINLPSPSYTMG

SEQ ID NO: 55720 - protein, 264 aa, Peanut witches'-broom phytoplasma
YKLWEETSIAITQDGKKVLANETCSQIKCHQKYGGVVPEIASRKHLEVITYLLQKTFVEAKINPKNIDLVAVTQGPGLIGSLLLGVSAANTWSYIYKKPLMGVNHLMGHIYSVQIEHEIEFPALALIVSGGHTELIYLNNHFDIQKLGATLDDAVGEVYDKVAKNLNLNYPGGPIIEKLALKGESVFKLTLPYIKNNNLDFSFSGLKSQIINLINQNSLNMSNKFIYDICASFQKVVIEVLLIKIKRALKKFPTKNLILVGGVA

SEQ ID NO: 55721 - protein, 392 aa, Prochlorococcus marinus str. MIT 9313
MKAMILAAGKGTRVQPITHVIPKPMIPILQKPVMEFLLELLKEHGFKEVMVNVSHLAEEIENYFRDGQRFGVEIAYSFEGRIEEGELIGDALGSAGGLKKIQDFQQFFDDTFVVLCGDALIDLDLSEAVKRHRAKGALASLVTKRVPKDQVSSYGVVVTDENDCVQAFQEKPSTDAALSDTINTGIYLFEPEIFEHIPSDQPFDIGSDLFPKLVEMGLPFFALPMDFEWVDIGKVPDYWRAIRSVLQGEVRQVGIPGKEVRPGIYTGLNVAANWDKINVQGPIYVGGMTRIEDGATIIGPSMIGPSCCICEGATVDNSIIFDYSRIGAGVQLVEKLVFGRYCVGKNGDHFDLQEAALDWLITDARRQDLVEPSPQQKAMAELLGTDLTPAPS

SEQ ID NO: 55722 - protein, 558 aa, Neisseria meningitidis Z2491
MSFKTDAEIAQSSTMRPIGEIAAKLGLNVDNIEPYGHYKAKINPAEAFKLPQKQGRLILVTAINPTPAGEGKTTVTIGLADALRHIGKDSVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERLGNILVAYAKDGSPVYAKDLKANGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLDALEKGLPNLLKHISNLKNVFGLPVVVALNRFVSDSDAELAMIEKACAEHGVEVSLTEVWGKGGAGGADLARKVVNAIESQTNNFGFAYDVELGIKDKIRAIAQKVYGAEDVDFSAEASAEIASLEKLGLDKMPICMAKTQYSLSDNAKLLGCPEDFRIAVRGITVSAGAGFIVALCGNMMKMPGLPKVPAAEKIDVDAEGVIHGLF

SEQ ID NO: 55723 - protein, 146 aa, Nitrosomonas europaea ATCC 19718
MKTVKHLLQEKGHTVVAIGPDDSVFNAMQKMAADNIGALLVMKDEKLVGILTERDFSRKSYLLDKPVKDTQVKEIMTRQVAYVDLNNTNEDCMALITEMRVRHLPVLDDGKVIGLLSIGDLVKDAISQHQFVINQLERYIYDTREI

SEQ ID NO: 55724 - protein, 368 aa, Oryza sativa (japonica cultivar-group)
MLWAARVSGFFSAAMVMVVLSPSLQSFPPAEAIRSSQFDSHVRFPGQIAGGARGLAFRRAPAFRNAADCGNATGNVCDPSLVHIAITLDEEYLRGSVAAVHSVVQHATCPESVFFHFLVSDPALGDLVRAVFPQLQFKVYYFDPDRVRGLISTSVRQALEQPLNYARNYLADLLEPCVRRVIYLDSDLVVVDDVAKLWRTDLGGRTVGAPEYCHANFTKYFTDRFWSDKQFAGTFAGRRPCYFNTGVMVLDLARWRRTGYTRRIERWMEIQKSPAGRIYELGSLPPFLLVFAGHVAPIEHRWNQHGLGGDNVFGSCRDLHPGPVSLLHWSGSGKPWARLGAGRPCPLDALWAPFDLYGPADSAAEGSR

SEQ ID NO: 55725 - protein, 292 aa, Nitrosomonas europaea ATCC 19718
MFTGSLVAIVTPMLEDGALDLDRFCALIDFHIEQKTDGIVVVGTTGESPTVDFDEHHLLIRTAVTHAAGRIPVIAGTGANSTREAIELTVFSKNAGADACLSVAPYYNKPTQEGLYQHFKAIAEAVDIPMILYNVPGRTVVDISNDTALRLAQIPGIVGIKDATGNIARGCDLLQRVPDNFAVYSGDDATALALLLLGGHGTISVTANVAPRLMHEMCTAAFAGDLARAREINTRLFRLHIDLFVEANPIPVKWAVARMGLINDSLRLPLTALSSQYHELIRKAMLQAGITV

SEQ ID NO: 55726 - protein, 376 aa, Solanum demissum
MMQDVWTQLGPTIAAIMFIWTMYQNYFPHELRGHIRRYTDKLVSYFYPYMHIIFYELETEGWFERSKAYVAIERYLSKNSSTQAKRLKANAVKDGQSLVLTMDDHEEITDEYKGEKYDVYELELTSVKDNTELRKLLIDTTGLYLMLGNMDNYRLHSKKDEDEKNLVSKKEVVKGVLLQQIVQAAVATVLFVLACDSGTHKLALALSLMIAEIQLFVAMLMLDTWQYFMHRYMHQNKFLYKHIHAQHHRLIVPYAFGALYNHPLEGHILDTIGGALAFLVSGMSPRTSILFFSFATIKTVDDHCGLWLPGNLFHIFFKNNSAYHDIHHQLYGTKYNYSQPFFVTWDRILGTYMPYELEKRPEGGFEAKLLKDCKEH

SEQ ID NO: 55727 - protein, 218 aa, Prochlorococcus marinus str. MIT 9313
MFGFLKKVVDYTRDAADAANYLIQGLAVTFDHLRRRPITVQYPYEKLIPSERYRGRIHYEFDKCIACEVCVRVCPINLPVVDWVMNKETKKKELRNYSIDFGVCIFCGNCVEYCPTNCLSMTEEYELAAYDRHSLNYDNVALGRLPTSVTTDPSVQPLRELAYLPKGVMDPHDVPANQPRAGQLPAEALKSLSLQQESVQGDEGESLQDASDQDQPSG

SEQ ID NO: 55728 - protein, 154 aa, Brassica napus
  misc_feature (36)..(36): Xaa can be any naturally occurring amino acid
  misc_feature (47)..(47): Xaa can be any naturally occurring amino acid
  misc_feature (88)..(88): Xaa can be any naturally occurring amino acid
  misc_feature (91)..(91): Xaa can be any naturally occurring amino acid
  misc_feature (152)..(152): Xaa can be any naturally occurring amino acid
  unsure (1)..(154): unsure at all Xaa locations
EYKNCLKEEKKKRKQADGGVSCLRSSEMMRVGIGGXESPPLDLDEVXVLAVDDSLVDRIVIERLLRITSCKVTAVDSGWRALEFLGLXNEXASAELDRLKVDLIITDYCMPGMTGYELLKKIKESSSFRQVPVVIMSSENVLTRIDRCLEEXAE

SEQ ID NO: 55729 - protein, 404 aa, Prochlorococcus marinus str. MIT 9313
MPRSCRDAVGQEQVGEIRHDRSGISFRPGLEGVPVTQSAICDIDGLQGRLAYRGYPIAELSAHSSFLETTYLLIWGDLPSPQQLRDFEAEVQMHRRVSFRVRDMMKCFPASGHPMDALQSSAASLGLFYSRRAIDDPKYVYNAVVRLIAKIPTMVAAFKLIRKGQDPIQPRDDLAYSANFLYMLTEREPDPLAARVLDRCLILHAEHSLNASTFSARVTASTLTDPYAVVASAVGTLAGPLHGGANEDVLAMLEEIGSPEHAGDYLDEAIASKRKVMGFGHREYRVKDPRAVILQGLAEELFARFGTDEMYDVAKALEQAAATRLGPKGIYPNVDFYSGLVYRKLGIPRDLFTPVFAISRVAGWLAHWREQLGANRIFRPSQIYTGPQNRTWIPSDERFSSTGA

SEQ ID NO: 55730 - protein, 326 aa, Symbiobacterium thermophilum IAM 14863
MAKLTLIQAINDALRVAMRQDSTIVLLGEDIGINGGVFRATDGLIQEFGPERVIDCPLAESGYIGAAIGMAVNGLKPVAEVQFDGFLAPAHEQVANHLSRIRHRSRGRFTCPMVIRIPSWGGIKALEHHSESIENWYLNIPGLKMVAPSNPYDAKGLLLAAIADPDPVLYMEPKRLYRAFRAEVPEGYYTVPLGQAAVVREGTDMTVLTYGVHVHTALEAAEQAASQYGWQAEVIDLRSLNPLDLDTIIGSVKKTGRAVVVSEAPRTGGFHSELVALINDHALEYLEAPVARVTGFDVPMPYLLSEDLYIPDAGRVLEAMQAVRTY

SEQ ID NO: 55731 - protein, 450 aa, Symbiobacterium thermophilum IAM 14863
MAYEFKLPDVGEGLHEAELLRWLVKEGDTVTEDQPIMEVQTDKATVEITSPVNGRVVKLLGQPGDILKVHSVVVIFDDGSPGALPTAGEVASGVAAAAPAGAQPQASLDVPAPAAQPAPAPAAPPAPAPAPAAGAGPADRPRRALATPATRRLARELGVDINQVPGTGPAGRVTSDDVRAFAARRTAPAPAQAPTQAPTEAAAPTPATPAPAAPAEADDERIPLRGIRKVIAERMVKSKYTAPHVTTVEEVDMTELMAFRAQAKELAARKGIKLSFMPFIIKAVVAALREFPYLNASIDDEAQEIVLHKRYHIGFALDTDAGLLVPVIKDADRKPVFAIAQEMNDLIARGREGKLAPDEMRGSTFTISNQGSIGGLFFTPVINYPEVAILGIGKTQPRPVVRDGEIVIRQMAHLALSFDHRLIDGGMATRFLNRLAELLSDPTLLMMEAM

SEQ ID NO: 55732 - protein, 470 aa, Symbiobacterium thermophilum IAM 14863
MGSIKTGTDVVVIGAGPGGYVAAQRASQLGLDVTLIEREELGGTCLNHGCIPSKALISVGDLLYKVNNAAERGLVVKGSVEVDFAKTQEWKETKVIKRLTSGVASLMKAGQVEVVKGTARFTDPHSLEVELNDGGTAAYTFKHAIIATGSTAVNPSFFPLDGENVVDARGALAFREIPPRFVVVGGGYIGVELGIAYAKLGSKVTIVEATGQLLPGTDPDLVNVLMRRLRRLGVTVMLNARASGGLQNGKVKVQDGEGKVHEIEADKVLVSVGRVPYTEGLHLDKAGVRVDEKGFIPVDEQMRTNVPHIYAIGDVCSPVMLAHKASAQGRVAAEAIAGRPSAADWQTVPAVIFTDPEIAYVGLTEAQAREKGYDPVVSRYNFAAVGRALTMGESDGMVKLVGDRQSGLLLGAQMVGPEVSELIGEIALAIEMGAQMEDVALTPHYHPTLSEGILEAALSWMHSIEKAGRK

SEQ ID NO: 55733 - protein, 403 aa, Pseudomonas fluorescens Pf-5
MAEQGSPRRFARIDRLPPYVFNITAELKMAARRRGEDIIDLSMGNPDGPTPPHIVEKLVTVAQREDTHGYSTSKGIPRLRRAISRWYKDRYEVDIDPESEAIVTIGSKEGLAHLMLATLDQGDTVLVPNPSYPIHIYGAVIAGAQVRSVPLVPGVDFFAELERAIRGSIPKPKMMILGFPSNPTAQCVELDFFERVIALAKQYDVLVIHDLAYADIVYDGWKAPSIMQVPGAKDIAVEFFTLSKSYNMAGWRIGFMVGNPELVSALARIKSYHDYGTFTPLQVAAIAALEGDQQCVRDIAEQYRQRRNVLVKGLHELGWMVENPKASMYVWAKIPEAYAHLGSLEFAKKLLAEAKVCVSPGVGFGEYGDDHVRFALIENQDRIRQAVRGIRGMFRADGLAPKS

SEQ ID NO: 55734 - protein, 177 aa, Pseudomonas fluorescens Pf-5
MSQPITALVIMGVAGCGKSSVSQALCQRSGAMAIEGDTFHPAANIAKMSAGIPLDDEDRAGWLDSLCDELRRALAAGQHPVLTCSALKRKYRERLRAATPGLGFVFLELTPAVAADRVAHRPGHFMPSTLIDSQFATLESPVGEPLTLALDASTLSVQRLAELANQWWLEHGLEPSH

SEQ ID NO: 55735 - protein, 466 aa, Mycobacterium tuberculosis CDC1551
MPRIRKPPSRSLPEPSAALANTTTRNLWLHFARHGAGIQHPVIVRGDGVTIFDDRGKSYLDALSGLFVVQVGYGRAELAEAAARQAGTLGYFPLWGYATPPAIELAERLARYAPGDLNRVFFTSGGTEAVETAWKVAKQYFKLTGKPGKHKVISRSIAYHGTTQGALAITGLPLFKAPFEPLTPGGFRVPNTNFYRAPLHTDLKEFGRWAADRIAEAIEFEGPDTVAAVFLEPVQNAGGCIPAPPGYFERVREICDRYDVLLVSDEVICAFGRIGSMFACEDLGYVPDMITCAKGLTSGYSPLGAMIASDRLFEPFNDGETMFAHGYTFGGHPVSAAVGLANLDIFEREGLSDHVKRNSPALRATLEKLYDLPIVGDIRGEGYFFGIELVKDQATKQTFTDDERARLLGQVSAALFEAGLYCRTDDRGDPVVQVAPPLISGQPEFDTIETILRSVLTDTGRKYLHL

SEQ ID NO: 55736 - protein, 378 aa, Glycine max
MGVSGNNEVLVTTKVVVDYDRASELKAFDDTQDGVMGLTDAGVTKIPLIFHNPKNSHHDESDDGSGSTQLSVPSIDLVGVAEDPATRKVVVEKIRQACETWGFFQVVNHGIPLSVLEEMKSGVNRFYEQDSEVKRELYTRDPLRPLVYNSNFDLFTSPAANWRDTFYCFMAPHPPKPEDLPSVCRDILLEYAKEVKKLGSVLFELLSEALELNPNYLNDIGCNEGLTLVCHCYPACPEPELTLGATKHTDNDFITVLLQDHIGGLQVLHENRWVDVSPVPGALVINIGDLLQLITNDKFKSVEHRVVANRVGPRVSVASFFSTSLQPSTKLYGPIKDLVSEDNPPKYRETTVQGYVSYSLGRGLDGTSPLPHFRIKDF

SEQ ID NO: 55737 - protein, 129 aa, Brassica napus
  misc_feature (5)..(7): Xaa can be any naturally occurring amino acid
  misc_feature (12)..(14): Xaa can be any naturally occurring amino acid
  misc_feature (16)..(16): Xaa can be any naturally occurring amino acid
  misc_feature (18)..(18): Xaa can be any naturally occurring amino acid
  misc_feature (21)..(21): Xaa can be any naturally occurring amino acid
  misc_feature (23)..(24): Xaa can be any naturally occurring amino acid
  misc_feature (26)..(26): Xaa can be any naturally occurring amino acid
  misc_feature (29)..(29): Xaa can be any naturally occurring amino acid
  misc_feature (31)..(32): Xaa can be any naturally occurring amino acid
  misc_feature (35)..(36): Xaa can be any naturally occurring amino acid
  misc_feature (38)..(39): Xaa can be any naturally occurring amino acid
  misc_feature (45)..(47): Xaa can be any naturally occurring amino acid
  misc_feature (49)..(52): Xaa can be any naturally occurring amino acid
  misc_feature (57)..(57): Xaa can be any naturally occurring amino acid
  misc_feature (63)..(63): Xaa can be any naturally occurring amino acid
  misc_feature (69)..(69): Xaa can be any naturally occurring amino acid
  misc_feature (86)..(86): Xaa can be any naturally occurring amino acid
  misc_feature (92)..(93): Xaa can be any naturally occurring amino acid
  misc_feature (102)..(102): Xaa can be any naturally occurring amino acid
  misc_feature (106)..(106): Xaa can be any naturally occurring amino acid
  misc_feature (110)..(112): Xaa can be any naturally occurring amino acid
  misc_feature (123)..(123): Xaa can be any naturally occurring amino acid
  misc_feature (125)..(125): Xaa can be any naturally occurring amino acid
  unsure (1)..(129): unsure at all Xaa locations
MASSXXXSAACXXXPXQXTMXAXXTXLKXSXXFPXXRXXNNDITXXXSXXXXVSCMXAWSPVXKKKFEXLSYLPDLTEVELGKEVXYLLRNXXIPCVEFELXHGFXNREXXXTPGYYDGRYWXMXKLPL

SEQ ID NO: 55738 - protein, 500 aa, Mycobacterium tuberculosis CDC1551
MTTLWQPHRNDYSPIPGRGVHARRGARRPRPRGGRAERPGTGQLTRSGRRALLVGLTAASVGVLYGYDLSAIAGALLSLSEEFELTTREQELLTTTAVLGQIAGALGGGILANAIGRKKSVVLIVAGYAVFALLGATSVSVPMLVVARLLLGVTIGLSVVVVPVYVAESAPAAVRGSLVTAYQLATLSGIVVGYLVGYLLAGSHGWRAMFGLAAAPATLLLPLLWRMPIPPAGICSRAGSPTRVAAADPAGRDIDAELADMAAAVDERGGGIGEMVRRPYLRATLFVIALGFLVQITGINAIIYYSPRLFAAMGFAGYFAMLALPAMVQVAGLAAVCASLFLVDRLGRRPILLSGIATMITADAVLITVFANDSDGGTGLVLGFAGVLLFIIGFNFGFGSLVWVYAAESFPSRLRSMGSSLMLTSTLTANAIVAAFSLTMLRVLGGAGVFAVFGTFAVVAFVVVYRFAPETKGRKLEEIRHFWENGGRWPAERSPAADEP

SEQ ID NO: 55739 - protein, 215 aa, Gracilariopsis lemaneiformis
MPFVSVRPVDYLFKVVLIGDAGVGKSNLLSRFTRNEFSLESKSTIGVEFATRSIQCEGKIIKAQIWDTAGQERYRAITSAYYRGAVGALLVYDITKKDSFDNVQRWLKELKDHADANIVIMLVGNKSDLQHLKAVTTDDASAFAESNGLSFIETSALDNSNVEEAFRSILSEIYRLGSKKALEKGSTSNFAPNATQTIVINPPADEGKTEKAKCC

SEQ ID NO: 55740 - protein, 339 aa, Sulfolobus solfataricus P2
MENRIAKYLSAHYNLFQISPSYKAKRLASKYRFLDYMIERYLNMFSTEEELEEYLNSCSFPLKKSIRCNTLKTDCKKLEEIMLEKGFVLEKVKWLQHGYVVKRTPPKPSLGSTLEYLMGYYHIQGLASMVPAYVLNPSYDDFVLDMAAAPGGKTTQLSQIMQNKGLVIAVEKKRSRIRALLSNVNRLGAENVVLIKTDALNLININKSQFDKILLDAPCSGEGLIQKDPTRRYKTTMDDLRDFAHLQLSLIEIAYELLKKGGYIVYSTCSVAPEEDELIVNFAIEELGMKAMSVEGYPASNGYIEYYTTRFSNDVKNCLRFFPHKQGTEGFFLCLLKKE

SEQ ID NO: 55741 - protein, 692 aa, Fulvimarina pelagi HTCC2506
MTETQYGAVPGAFFDIHTHGFVRVAVATPTVRNADPAFNATAIQAQAREASEAGADLVVYPELCLSGYANDDLHLQAALVARTAQEIASLAEATRELGPLLLVGAIVERSGSLYNTAVAIHRGTILGVVPKTYLPNYREYYEKRWFASGAGTEGQTIALAGTSVPFGPDLLFAAENMPSFTVHVEICEDYWSPSPPSIDGALAGGTILCNLSASNITIGKSRERHLLSASQSMRCLAAYIYSAAGHGESTTDLAWDGQGGIYELGDLMAESARFSHENALVYSDIDTGRIRQERLRMPTFHDAAVQRGKPESRFRRIAFEHRPGVAVTDLKRPVRRFPFVPNDAEKLDQDCYEAFNIQVEGLITRYKATPGEMMVIGISGGLDSTHALIVAAKACDRMGVSREKILAFTMPGFATGDSTKSNAWALMRAIGVTAEEIDIRPAARQLFADMGHPFSDGEPVYDITFENVQAGLRTDYLFRLANQRGGFVIGTGDLSELALGWCTYGVGDQMSHYAVNTGVPKTLIQYLIRWCVSSGQFDPETDTVLNAILDTEISPELVPPDAAGGLQSTEEKIGPYELNDFFLFHTLRYGLPPSKVAFLAYHAWRSTSEGRWPIGFPEAKKNAYDLETIADWLEKFLFRFFQTSQFKRSALPNGPKVSAGGSLSPRGDWRAPSDGRADLWLSELREALGRKN

SEQ ID NO: 55742 - protein, 641 aa, Rhodospirillum rubrum ATCC 11170
MCGLVGIYHPTASRPVDRALVEAMNQRQFHRGPDDGGVFIGPGIGLGHRRLSIVDLGGGRQPMTNDGGGVVLVYNGELYNNAELVAELKAAGHVFRTASDTETVIHAWEEWGEDSVRHLRGMFAYALWDDRSQTLFLARDRLGIKPLHYTCLADGRVMFGSELKSLTGVEDIPKVVDPLAIEDFLAYGYVPDPRSIFKDILKLEAGHTLTFRRGEAPGRPHCYWDVSFTTPSRPAKTDDLCAEVIDRLDEAVRCHLVADVPVGAFLSGGVDSSAMVALMAGATDRPVETCSIAFSEARFDESAYAKTVAERYGTHHRVHTLPAQALSEVGPLTAIYDEPFADSSALPTLKVCQAARETVTVALSGDGGDELFAGYRRYRFHTAEEAVRRILPQAARGPLFGALGRVYPKLDWAPQVLRAKSTFQALGRDRVEGYFNAVSVIPDGLRRGLYSKTMRAELAGYGASEVLRRHMTRAPADHPLSIAQYVDLKTWLPGDILTKVDRASMATSLEVRVPMLDHRFVEWTAGLSPDLKLSGGTGKYLLKRALRPLLPDEVLYRRKMGFSIPLTDWLRGPWSGRTRALAGRSALVTSGLFDGAAVAKLVEQHLGGNWDHGAALYALIVLDDFLTAHVGAACLPARMSA

SEQ ID NO: 55743 - protein, 411 aa, Pseudomonas fluorescens
MIKSIVIIGAGLAGATATRYLRAQGYQGKIHLVGEELHVAYDRPSLSKDTLSGKVVEPPAILDPCWYASADIDLHLGVRVTGIDVVNHQVLFESGDILAYDRLLLATGARARRMAITGSELAGIHTLRDRADSQALRQALEPGQSLVIVGGGLIGCEVATTAINAGAHVTVLEAGDELLLRVLGRSTGAWCRNELERLGVRVELNAQAAHFEGEGHVHAVVCADGRRIAAGTVLVSIGAEPADELARAAGIACERGVVVDATGASSCPAVFAAGDVAAWPLRSGELRSLETYLNSHMQAETAAAAMLGKSIPALQVPTSWTEIAGHRIQMVGDIEGPGEVVLRGNVENGQPLVQFRVLDGRVEAATAINAPEDFPVATRLVADHIPVSATKLQDASSNLRDFMKAKAERCE

SEQ ID NO: 55744 - protein, 196 aa, Arabidopsis thaliana
MKQSSFSSSSSSRNSTSLTNRLKTIFKKAEELSILCAIDVCVIYYGPDGELRTWPKERNTVKDMASRYKEATKRKKKRTLSTLQERLRIVESQKQQNKNLVHQSLTPSYLNQIQHLNPSNFSPYMYNHGDAATLSQLPLSASLSNQLQLPESLDAAWFWSEHVFGQHHQQQQLSTSWRVKHTRILTVSFGTSICSE

SEQ ID NO: 55745 - protein, 730 aa, Oryza sativa
VKPATLFLLFLLRLVSGLRMAADLGAWKNTRQQYSPSSPISLGSSVFSESSLELSTTTADGSTANAVLAAIVASIGNLLQGWDNAAIAGAIMYIKNEFNLQNDPMMEGLILAMSLIGATIITALSGMITNSIGKRPLLSVAAILYSISALIMFQASNEYMLLLARLIYGFGSGLVVTYAPLYISETAPTNMRGLLNTLPQFNGSLGMLLSYIMVFLMSLTLNPNWRIMLGSLSIPSFVFLLLCIFYLPESPVFLVSKGKIEEAKNVMKRLRGTNEVSSEIAFLIQGLTVDQDNYIEDYMIGHNNDEFDDQSISNTETTKLYGHEEGVTWFARPFKGKNVVESDHSPIPNLLDPIVTLFDSIHGNILNTPEFTSSGNMSNDIEQPKTDLESQEDLDTDYEDDLGHPLLFHQGSYMEGIDDACVNGGWHIAWKFVQRENEFGQTQDDFQQIFLQGDILQAGRVSHATALVSTPSFHHSIGPAMVHPSKFNLSTEGQSWSDLLQPGVKQGLIVGVTIQILQQLAGISGILYYTPQILEQAGAGILLKWFNVSSSSSSILTSALTTFTMLPSIGIAMKCMDRYGRRSLLLYTIPMLIVSLIILIVVNVMNLEAIFGAILSTFGVIIYVCCFVMGFGPIPNVLCSELFPPSCRNRCMSICTLTFWIVSIIVTYAFPVMLSSIGLIGVCGIYAVVCIVSFIFVLIKVPETKGMPLAVIANSLAVGARLSVKRNENI

SEQ ID NO: 55746 - protein, 526 aa, Candida albicans SC5314
MSSTTFNDIIDSVLPYLTKWYTILIGAGLIFVLSTNLKNAYYSYKLGCKNPVHLKRAGWTGIPALIDAIKAKNSGKLAEFGGDTFDELNSKNFYLNVAGVLKIIFTIEPENIKAVLATQFNDFSLGTRHAHFYPLLGDGIFTLDGEGWKHSRAMLRPQFAREQIAHVKSLEPHIQILAKQIKLNKGETFDLQELFFRFTVDTATEFLFGESVHSLYDDKLGIPPPNDIPGRDNFATAFITSQHYLATRSYSQTFYWLTNNKEFRDCNAKVHHLAKYFVDKALNSTEKEIEEKSQGGYVFLYELVKQTKNPKVLQDQLLNIMVAGRDTTAGLLSFAMFELARNPKVWNKLREEIEANFGVGEEARVEDITFENLKKCEYLKAILNETLRLYPSVPINFRTSTKDTTLPTGGGPNGTSPIFVPKGSTVAYTVFKTHRLEEYYGKDSHDFRPDRWFEPSTKKLGWAYLPFNGGPRICLGQQFALTEASYVISRLAQLFPVLESRDEQYPPNKCIHLTMNHDEGVFVSMN

SEQ ID NO: 55747 - protein, 172 aa, Salmonella enterica subsp. enterica serovar Dublin
MKRHILATVIASLVAAPAMALAAGNNILSVHILDQQTGKPAPGVEVVLEQKKDNGWTQLNTGHTDQDGRIKALWPEKAAAPGDYRVIFKTGQYFESKKLDTFFPEIPVEFHISKTNEHYHVPLLLSQYGYSTYRGANLEPIPLGYFTCYFGPGQCSPKRVSVLNASGAQGRA

SEQ ID NO: 55748 - protein, 204 aa, Glycine max
DVGSQPKDVTLALNNPEFAIVAIESGVVLLNGSKIVSTINLCFIVTAAAMSPDGSEAIVGGQDEKLHMYSVSGDTVTEQAVLEKHRGAITVIRYSPDFSMFASADLNREAVVWDRASKEVKLNNMLFNTARINCLAWSPDSTLVATGSLDTCVIIYEVGKPASSRRTIKGAHIGGVYGLVFIDQERVVSSGEDGCVRVWNLISE

SEQ ID NO: 55749 - protein, 87 aa, Glycine max
DSSMISSPMLPLSTVARAGMYAPFSGLESMAVFPTRMTNNDITSFASYLGILQCMSGCAPDVKKTFDTLSYLPDLDDALLDYEVSIL

SEQ ID NO: 55750 - protein, 194 aa, Oryza sativa (japonica cultivar-group)
MAAAAATPRHHHRLLLLLFILFLAAGAAVPVSGAWDAKGKTLCSGRLLGLTDCGDEEPSAYEMLERFGFPRGILPEGVTGYTLRPSDGEFAVYLGTGECEFEVDGGYRLTYQGRITGRVAGGSITGLRGVTVRVFMMNWGIDRVVVADADHLVFYVGPLSQAFPVDGFEESPQCRCRHGGGAAVSGVAAIWDDL

SEQ ID NO: 55751 - protein, 125 aa, Glycine max
MEFRVSVIWSLLLIVSLFSPEIKGEASGSVFFVDSSSNQFLRARSSNDEQPSMLLQEVGAAVSVLLGFAPPSTFSAASSSKLNEVLIPNPFKRPRAVFLLEVNGINALWPWINYNNQILYWFSLS

SEQ ID NO: 55752 - protein, 437 aa, Haemophilus influenzae 86-028NP
MEILMKSGDLNKYDLVKNTLVLVLAGGRGSRLHELTDKRAKPALYFGGNRRIIDFALSNCINSGLNRIGVVTQYAAHSLLRHLQTGWSFLPQERGEFVDMLPARQQIDDSTWYRGTADAVYQNMAIIKNHYRPKYILILAGDHIYKQDYSVMLMDHVNSGAKCTIGCIEVPRSEAHEFGVMAVNENLKVKAFVEKPKDPPAMVGKPDVSLTSMGIYVFDADYLYKMLDREVGTPNTSHDFGKDVLPKCLEEGALYAHPFSRSCMGRNTEGEIYWRDVGTLDSFWQSNIDLVSENPQLDIYDQSWPIRGNPVQAYPSKFFYKHSNVHPVDNSLIGGGCVITDASISNSVLFDRIKIDSFSKVDHCVVLPQVKIGKNCVLKNCIIDRECEIPDGMQIGVDMEEDKNRFRISSTGKVILVTPKMLKILEGHEIGEEGHLD

SEQ ID NO: 55753 - protein, 589 aa, Oryza sativa (japonica cultivar-group)
MHRMASLLLPPQFLCSLPCSTNSIRSHLHYKPHFLGNIMTKPKAKMRLLNRNVSSMAKKSSQDVAEGSSDDESDGETSKTKKRAPRRGRKKATIQASEGETQEGQVSTEEDESPEGTKKIKRRGRKKAATTASSSEEKDKAKEPKKRGRRKVKTVEELSDNEGEDLGEDLVPSNDRQEKISANDLESKIAALLLEDTDDNDINNLIPLVCCFGPAKYSFIPSGRPANRLIDHEIHEGMKDMFWSPDQFVRAPGGSSSNVALALAASGGRVEFMGKLGDDDYGQSTLYHLNVNGVQTRAIKMDPSAFTAMSLMKVTGRGSLKMSCAKPCAEDCFVQTDINPAVLKEAKMFYYNSSALLEPTTRSSLSKAIEVSKKFGGVTFFDLNLPLPLWSSSKETKSLVKEAWEAADIIEITKQELEFLCGIKPSEKFGTKDNDKSKFTHYSPEVVTKLWHENLKVLFVTNGTSKIHYYTKEHDGWVRGTEDAPITPFTGDMSQSGDAIVAALMKMLAINPHLVTDKDYLHTAMKHAITCGVIDQWLLARERGFLPRERADPTSEQFGVRFVTEKEYRTLPDSIHTEDSSESELLYVE

SEQ ID NO: 55754 - protein, 684 aa, Oryza sativa (japonica cultivar-group)
MAQSRSHAMAAFAFVVVFLLSGAPGARSQQPYGSQVADCPNKHNDTGLLGYFCSSGGGGGGAPSSSSSSCQTYLTFHATPRYPDLAAIASLLGADASSLAAANSAALPTAALAPGAKVLVPATCSCTGAAYYQRNATYVAVAGDTLLVIANDTFQGLSTCQAVQEQALGDAPARSLLAGQRVTVPLRCACPSAAQAAAGVRYLVTYLVDEFDEVGAIAARFGVDAGNISAANEMAITDTIYPFTTLLIPVKSKPDVSQLRSPPPPPPPPPAAPAPTTNRKNHTGVYVGIGAAAVAVLAVVTAVVAALAVRARRQRRRATAAVAAAGGKGGKGNDKASPAFTGGEVSVSISEAFSGLSDIKSSLKVFTYAELAAATDGFSPDRRVGGSVYRAVFNGDAAAVEVVDRDVSAEVEIMRKINHLNLVRLIGLCHHRGRWYLVSEYAEHGTLRDRLLAGGGAPPLSWSQRVQVALDVAEGLRYLHGYTRPPYVHMDVSSDSVLLAGGADLRGKLRNFGGARVIRGGGGEAFTMTSNIAGTRGYTAPEYLEHGVVSPKADVYSLGVVLLELVTGKGVDELEADGAGDPFAGMNALAGDLDGGSEDDAAVTRRMEEFLDPAMAATGSSCPREAVAMMVKLIERCVRRDAAARPGMGEVAQHLLMLHGVSGDGWHSSLEHYRSSGGDGGEQP

SEQ ID NO: 55755 - protein, 250 aa, Posidonia oceanica
MPFSRIAMGRREEVTHGDALKATLAEFISTLIFVFAGEGSGIAYNNLSGDGDTTASSLIAAALAHGLGLFVAVSVGANISGGHVNPAVTFGAFVGGNITFLRGILYWHGQLLGSIVACLLLKFVTGGMTTGGFAVSGVSVWNALVFEIVMTFGLVYTVYATAIDPKKGAIGTIAPLAIGLIVAANIFVGGVFTGASMNPAVAFGPALVSWNWVNHWIYWVGPLVGAAIAGIVYQLLFINHTHEQLPTTDY

SEQ ID NO: 55756 - protein, 598 aa, Streptococcus suis 89/1591
MLTTQSQLSLKQWKKKDWHKNMTEMLKGIAASDGVAVAKAYLLVQPDLSFETVTVEDTNAEEARLDAALEASQNELSVIRENAVASLGEEAAAVFDAHLMVLADPEMIGQIKETIRAKKTNAETGLKEVTDMFIAIFEGMEDNPYMQERAADIRDVAKRVLAHLLGVRLPNPATIDEESIVIAHDLTPSDTAQLNKQFVKAFVTNIGGRTSHSAIMARTLEIAAVLGTNNITEIVKDGDVLAVNGITGDVVINPSEEVIAEFKVAGEAYAKQKAEWALLKDAQTVTADGKHFELAANIGTPKDVEGVNDNGAEAVGLYRTEFLYMDSQDFPTEDEQYEAYKAVLEGMNGKPVVVRTMDIGGDKELPYFDLPHEMNPFLGFRALRISISETGNQMFRTQLRALLRSSVHGKLRIMFPMVALLTEFRAAKAILEEEKANLLAEGVAVADDIQVGIMIEIPAAAMLADQFAKEVDFFSIGTNDLIQYTMAADRMNEQVSYLYQPYNPSILRLINNVIKAAHAEGKWAGMCGEMAGDQQAVPLLVGMGLDEFSMSATSVLRTRSLMKKLDTAKMEEYAHRALTECATAEEVLELQKEYVDFD

SEQ ID NO: 55757 - protein, 372 aa, Streptococcus suis 89/1591
MTETNGLKDAIACDTRISAIENDRLSYAGYDIAELMENNASFEEVIYLLWNLHLPTQIELNYFEKSLRKEYAISDAVEQCILIQSRRHLHPMSVLRSTVSLLGVYNVHAEENSLEALYEQSIQIMGKVPTIIATFARLRRGLVPIEPRSDLGFAANFLYMLNGEEPSDLQIKAFNKALVLHADHELNASTFAARVTASTLTDLYSCVTTAIGTLKGSLHGGANERVFDMLLAIRESGDAERYLQKKLDSKEKIMGFGHRVYKTVDPRQEYLKEMARDLTFGTDDEAFYRLSEEVESFIKNKKGLIPNVDFYSATVYHVLGIDSDIFTLIFAMSRMAGWIAHVQEQRKNNKLIRPRSSYLGGRNLVYIPIGKR

SEQ ID NO: 55758 - protein, 404 aa, Rhodospirillum rubrum ATCC 11170
MTASPPPGFGVSGSDLTIGGQRVSHLARIAGGTPFYAYDRGAVSARIAALRAALPAGMAIRYSLKANPMAALLAHMAPLVDGFDAASAGELRAGLAVGMAPAALSIAGPGKSPADILSAVAAGALVVVESLAEVGRVAQAGNASGLRPRVLVRVNPEAEIQGAGLRMGGGARPFGIDADQVPGVLAAIAAHDLDYQGLHCFWGSQALDAERIARAFAVVGQTLLDLAGPRPPRQIVIGGGFGIPYTPTSAPLDLARAGAAVAETAGLLGDHLPGVSLGLELGRFLVGEAGVYVCAIRESKRSRGNLFLVTDGGLHHNQAATGNFGQVVRRPYPLVIATRMGEPVSERATITGCLCTPLDVFAEALAIPAAAEGDLVAIFQSGAYGASASPSAFLGHPPAVELLV

SEQ ID NO: 55759 - protein, 313 aa, Oryza sativa
SRSNKQQPFPGGRGSWKPEMVAAAGDRLDLPVVELASSELRSSAESIRKACVECGFFYVHEDGIEEGLLEKVFAESRRFFEQPLEEKMALLRNSSHLGYTPPYTEKLDASSKFRGDLSEKFKIGPIGDEGGQNDANQWPSEERLPCWKETMKLYRATALATGKRILSLVALSLNLDAEFFDCPLAFLRLLHYPGEINESDDGNYGASAHSDYGILTLLATDCIPGLQICREKDRCPQLWEDVHHIEGALIVNIGDLLQRWTNCVFRSTLHRVVAVGKERYSVAFFLHTNPDLVVQCLESCCSEACPPRSSSSC

SEQ ID NO: 55760 - protein, 373 aa, Desulfotalea psychrophila LSv54
MTIDYYETLSVERDADQGTIKKAYRKLAMKYHPDRNQGDKEAETLFKECTEAYEVLRDESKRRIYDTYGHEGLKNNGQRDTGGAGDIFSHFGDLFGFGGGGGRSQARRNGPIEGNDLRYDVSISFMESIQGVSKEVKLSRRETCWTCEGTGSRPGYQPQTCPTCNGRGQVLRSQGFFQVSTTCPECEGEGQVIKEPCNDCHGEGLVKKTKTVAIKIPAGVDTGARMRLRGEGEGGRRGGPSGDLFVIVHVSSHEFFERDGDTIYCRLPVSMTTAALGDTVDVPTVHGKKNLKIPAGSQSGERFTLRGEGVPSLRGRGNGDMVVELHVETPTGLCEEQKKMLRDFHSFCEEHGQHEKTKGFFAKLFDEVLGKNK

SEQ ID NO: 55761 - protein, 562 aa, Pseudomonas fluorescens Pf-5
MQPDFWNDKRPAGVPNEIDLGAFKSVIEVFERSCKKFADRPAFSNMGVTLTYAELERYSAAFAGYLQSHTDLVPGDRIAVQMPNVLQYPIAVFGALRAGLVVVNTNPLYTAREMRHQFKDCGARALVYLNIFGQKVQEVLGDTDIQFLIEARMGDMMPSAKGWLINTVVDKVKKMVPAYHLPQAISFKSALRLGRGQSIKPLQVGHDDVAVLQYTGGTTGLAKGAMLTHGNLVANMQQARACLGQHGPDGHTQWREGQEVMIAPLPLYHIYAFTANCMCMMVTGNHNVLITNPRDIGGFIKELKKWRFSALLGLNTLFVALMDHPDFKNLDFSNLKLTNSGGTALVKATAERWQKLTGCRITEGYGLTETSPVACTNPYGERSRLGTVGLPVPGTTLKIIDDQGVELPLGERGELCIKGPQIMKGYWNKPEATAEVLDAEGWFKSGDIAVIDPDGFVRIVDRKKDMIIVSGFNVYPNEIEDVVMAHPKVANCAVIGIPDERSGEAVKLFVVPREAGVSLEELKAYCKENFTGYKVPKHIVLRDSLPMTPVGKILRRELRDIA

SEQ ID NO: 55762 - protein, 426 aa, Candidatus Desulfococcus oleovorans Hxd3
MTETATIVINGKTYEFPVITGTEGEKAIDIRELRAKTGYITFDPGFSNSGSCTSTITYMDGAKGVLRYRGYPIEQLAETSCFVEVCYLLLNGDLPSRAEYQRMSVMLNDHSLVHEDMQIFFQNFPRSANPMGILSSMVNALRSFYPELMTTEEAIETTFLRLISKVRTMAAMSHRISRGHKIVYPRPDYSYCANFLNMMHDSPVRPYEIKKEFVEALNMFWVLHADHEQNCSTSTVRAVGSARANIYAALSAGIAALWGPLHGGANRAVVEMFEDIRKSGGDVKKAVKRAKDKNDPFRLMGFGHSVYKTYDPRAKIMKKMCDKVLAVANTEDPLLDIAMELEEVALKDSYFTDHNLYPNIDFYSGIVLRTLGIPVEMFTVMFAIGRLPGWIAQWKELMDDPFKKLFRPRQIYVGETMREVLPIDER

SEQ ID NO: 55763 - protein, 255 aa, Euglena intermedia
MPRKFFVGGNWKCNGTRESIASLLKDFNGAVGEPDLDVQIVVAPPFVHCDFTKEKLPKGWELSVQNCWIGKGGAFTGEVSAEMIKDAGIPWVILGHSERRHLPQLKESDETVAVKVAYALANGLKVMACIGELLEEREAGQTQAVNERQLKAIAAKLKEEDWKNVVIAYEPVWAIGTGKVATPEQAQEVHEHVRAWVASNVSPSVAAEVRILYGGSVTAKNCVELAGKPDVDGFLVGGASLKPEFLDIIAAHKHK

SEQ ID NO: 55764 - protein, 297 aa, Triticum aestivum
  misc_feature (253)..(253): Xaa can be any naturally occurring amino acid
  misc_feature (260)..(260): Xaa can be any naturally occurring amino acid
  misc_feature (268)..(268): Xaa can be any naturally occurring amino acid
  unsure (1)..(297): unsure at all Xaa locations
QGLSVEVDAFVGSRALPTLWNSATNFLQGLVGRLASSNKRTINILQNVNGIIKPSRMTLLLGPPSSGKSTFMRALTGKLDKALKVSGSITYCGHTFEEFYPERTSAYVSQYDLHNAEMTVRETLDFSRRCLGVGARYDMLAELAVREREAGIKPDPEIDAYMKATAVQGQESNIVTDLTLKVLGLDICADMPIGDEMIRGVSGGQRKRVTTGEMLTGPAKALFMDEISTGLDSSSTFQIWEYIRQLVHVMNEXTVMISLXLQPPPKDXYTCFDDNYFGLSEGYVTVTMGPRQKNILG

SEQ ID NO: 55765 - protein, 176 aa, Solanum demissum
MDDHEEIIDEYKGEKVWWISSQKPANRQTISFYREDEKRYFKLKFHKKNRDLITNSYLKYVLDEGKAISVKKRQRKLYTNNNGDRGGCRYRGGRMWSGVVFEHLSTFDTLAMDPNKKQDIIYDLETFSKSKDYYAKIGKAWKRGFLLYGPLGTGKSSKIAVMANFLKYDVYDLGKV

SEQ ID NO: 55766 - protein, 209 aa, Neisseria meningitidis Z2491
MNLFQNAKFFTTVNHLKDLPDTPLEIAFVGRSNAGKSSAINTLTNHVRLAYVSKTPGRTQHINFFELQNGNFMVDLPGYGYAQVPEAVRAHWVNLLGDYLQQRKQLIGLVLIMDARHPLKELDIRMLDFFHTTGRPVHILLSKADKLSKNEQIKTLSQVKKLLKPYSDRQNISVQLFSSLKKQGIDEANRTVGSWFDAADAAASSPKEN

SEQ ID NO: 55767 - protein, 331 aa, Acidobacteria bacterium Ellin345
MGLNSPATKSVKEVFELISEDLLAIEREFGRDTVSNVAAITEIGEYLRNGGGKRLRPALLLLSAKLMAYRGLGAVRLGAVVEIIHTATLVHDDIIDDAEIRRGRPSANTQWGNSKCVLAGDWLYMQAFKVAVAERNFAVLDTLIELTQKMVEGELLQIEKLGKLISLQEHFDLIDRKTACLFSVCMRLGGILGGATAEQIEKLGEYGHCVGMAFQIVDDVLDLTASEEVLGKPVGSDLREGKVTMAVIDALEHCTPAERDTIVAVMRENGFVSVQHADILKILKRYDSVENALLRANEFAVKAKAAIEEFPDSEYKRALIWVPEFVVERDK

SEQ ID NO: 55768 - protein, 440 aa, Glycine max
  misc_feature (423)..(423): Xaa can be any naturally occurring amino acid
  misc_feature (425)..(425): Xaa can be any naturally occurring amino acid
  misc_feature (431)..(431): Xaa can be any naturally occurring amino acid
  unsure (1)..(440): unsure at all Xaa locations
MKKLSLLPSDLDTKCSTPSLMSMMGFFVASFVLCSVVFSVSIVLRDPPSDAALHEPSSLAPLLQITQTLRDLVNETSDSVELQQDKLLGGLLADGFDEKSCLSRYHFHKGLSEKPSSYLISRLRKYEAQHKQCGPYTDSYNKTVEQLRSGGQFTESSECKYVVWISFSGLGNRILTLASAFLYALLTNRVLLVDPGADMVDLFCEPFPDSSWLLPSDFPLNAQFNNFSQNSDHCYGKMLKSKAVTDSTVASFVYLHIAHDYDDHDKLFFCDEEQRFLQIVPWLIMKTDNYFVPSVFLMPSFEQELNDLFPNKETVFHFLSRYLFHPTNSVWGLVVRYYQAYLSKADERVGIQIRVFDTEPGPFQHVLDQILACTLKKNILPDVNHQQDATNSSGIPKSKAVLMTSLNSGYFEKVRDMYWEYPXVXGGVGGXYQPSPERFP

SEQ ID NO: 55769 - protein, 244 aa, Oryza sativa (japonica cultivar-group)
MPSFVDGPTLRSLLRPSTNGRRTKASDGGGGGGGGGIFKMFKLMPMLTSGCKMVALLGRHNRALLADHATTVTLFGHRRGRVSLAIHEDTRAPPVFLIELPMLTSALHKEISSGVVKLALESDTRSARRRLVEEYVWAVYCNGRKAGYSIRRKEASDDERHVLRLLRGVSMGAGVLPAAPEKEGGVPAGPDGELTYVRARVERVVGSKDSEAFYMINPNEGGVGGDSAGDGSAPELSIFLVRMK

SEQ ID NO: 55770 - protein, 321 aa, Frankia sp. EAN1pec
MAGMSALPPAPFGRMITAMITPFTADGGLDVPGAAALAEHLVDAGNDALVINGTTGESPTTSDAEKDILVRAVRDAVGSRAQVIAGVGTNDTRHTVELAEAAEKAGANGLLVVAPYYNKPPQAGLLAHFRAVADATSLPVMIYDIPGRSGVPVATETLLKLAEHSRIVAVKDAKDDLSASSWVLANTGLAYYSGTDVLNLPLLSVGACGVVSVVGHVASPAIRAMIEAFGAGEVGRAIALHKGLLPAYQGIFRTQGVITAKAALAMAGLPAGPVRSPLVDATEAERAQLRADLAAAVLDPGPPPGPAGPGAAAVVPGTAAS

SEQ ID NO: 55771 - protein, 671 aa, Acidobacteria bacterium Ellin345
MSKDKFYITTPIYYVNARPHIGHTYTTVACDAIARRKRMLGVDTFFLTGTDEHGQKIERSAMASGKSDQQFVDEVSAEFRGLWDRMGLSYDKFIRTTDPEHIRGVQALIKRLQDRGYIYKGKYSGQYCVYDELYVDVDTPGAPCPECGRPTETVHEENYFFKLSAMEEPLLKLYASDPNFIRPEARRNEVISFVRGGLKDLSISRTTFKWGIPVPDDPAHVIYVWIDALCNYITALGFGSDDTKLYDKFWPADVHMVGKEIVRFHCVFWPAVLMAAGLPLPKSIVAHGWLLFEESKMSKSRGNIVRTETILDVLGADALRYFLMREVVFGQDGSFSFDALVQRFNADLANGLGNLASRTLSMITRYFKGEVPYPSSAATRTAADDAIAKIAAKTIEDFGAAFDQYQFSKALEAAWGLVAAVDKYIVENEPWALAEKQDEQSRARLATVLYTAAEALRIVTALAYPVIPDSTAKIWSQLGLGDIKQFKLAEIKWGQLHLGTKLGKVEGVFPRADKTAIERMQQMEQERQAPAPEVTPETAQPAVAPAPAVEAPVAANNGFTPIAPQITIDDFTKVDLRVAVIKHAEKVKNADKLLRLEVDLGFEQRQIIAGIALAYEPEKLIGRKIVIVANLAPRKLKGLESNGMLLAGSLDGGTPVLAGFHEDVPPGARLK

SEQ ID NO: 55772 - protein, 426 aa, Gluconobacter oxydans 621H
MSAIVDITSREILDSRGNPTVEVEVELSSGARGRAAVPSGASTGAHEAVELRDGDKSRYGGKGVLKACSHVENDILEVLQGAESEDQIAIDNAMIDLDGTPNKSRLGANAILGVSLAVAKATAEELELPLYRYVGGAYAHLLPVPMMNIVNGGEHADNPIDIQEFMIQPVGAPTVADAIRMGSEIFARLKKGLSEAGYNTNVGDEGGFAPNLKSADEALGFIAKSVEAAGYKLGEDVTFALDCAATEFYADGRYNLKGEGKEFDASGMISYLEDLANRYPIVSIEDGLAEDDWEGWAELTTRLGKKLQLVGDDLFVTNPERLRRGIKAGTGNALLVKVNQIGTLTETLEAVETAHKAGYACVMSHRSGETEDSVIADLAVATNCGQIKTGSLSRSDRTAKYNQLIRIEQQLGSAARYAGRSILKNS

SEQ ID NO: 55773 - protein, 266 aa, Gluconobacter oxydans 621H
MPPSPRLVVGNWKMHGLREQSGRLARAVAEGAQSLPDDVRLVLCPPFTQLASVHGIINAEGPATPLRLGAQDCHTTSSGPHTGDISAEMLADLGVRYVILGHSERRQAHGETDVLIRQKVEAAEAAGLIPIVCIGETTQERLEGRTTTVLATQVEGSLTDGFTGILAYEPVWAIGSGTIPPIDELERTLSLLHGLLQSRLKTDDIRVPILYGGSVTPAQAPTIFSIGSLGGVLVGSASLEAESFLRIAEAASFRLTSQPLSGPYRS

SEQ ID NO: 55774 - protein, 339 aa, Hordeum vulgare subsp. vulgare
MENILHATPAHVSLPESFVFASDKVPPATKAVVSLPIIDLSCGRDEVRRSILEAGKELGFFQVVNHGVSKQVMRDMEGMCEQFFHLPAADKASLYSEERHKPNRLFSGATYDTGGERYWRDCLRLACPFPVDDSINEWPDTPKGLRDVIEKFTSQTRDVGKELLRLLCEGMGIRADYFEGDLSGGNVILNINHYPSCPNPDKALGQPPHCDRNLITLLLPGAVNGLEVSYKGDWIKVDPAPNAFVVNFGQQLEVVTNGLLRSIEHRAMTNSVLARTSVATFIMPTQECLIGPAKEFLSEENPPCYRTIMFRDFMRIYNVVKLGSSLNLTTNLKNVQKEI

SEQ ID NO: 55775 - protein, 143 aa, Vitis vinifera
MERRGICKVVVLLSLVACAAAQSASNVRATYHYYNPEQNGWDLNAVSAYCSTWDASQPLAWRSKYGWTAFCGPSGPTGQAACGKCLSVTNTATGTQATVRIVDQCSNGGLDLDSGVFNKLDTNGAGYNQGHLIVNYEFVDCGD

SEQ ID NO: 55776 - protein, 656 aa, Burkholderia cenocepacia
MCGIDGFLNSVAFDEETARGTLARMTASLAHRGPDGQGIWVDPEAGIALGHRRLAIVDLSVHGRQPMASACGRYVLVFNGEIYNHRELRAELERAGRAPAWRGHSDSEVLIAAIVAWGVEATLRRATGMFAFALWNRASRVLTLARDRIGEKPLYYGRIGDALVFASELKALRGYPGFDGTVDRDALCLYLRQSSVPAPYTIYRGIRKLPPGTYIQFEHARDTPRLRAYWTLEQVIEAGRAQPFEGTPDEAVGQLDAILRQAVARQMEADVPLGAFLSGGVDSSAIVALMQAQSATPVDTFTIGFHEAGYDEAGYAKAVARHLGTRHTELYVTADHALGVVPKLPSIYDEPFSDASQIPTFLVSELTRRHVKVSLSGDGGDELFGGYTRYFLTPRLWRKLHRVPGAVRARIAAALHALRPDHADQLAAVAQGAWGGGVEARESTSRIGDRLHKLGHVMTAESRIGLYRLLMSSVHHPERIALSGQEPPTPLDTVSAWPAHLSFAEQAMAIDTLTYLPTDILAKVDRAAMAVSLETRMPFLDHHVVEFAWRVPASVRLPEGQSKALLRRLLDRYVPSALIDRPKQGFCAPVDHWLRGALRDWAEALLRPSRLREEGFFDAAAVERLWRQHQTGRMNWQHQLWTVLMFQAWLEAQRAA

SEQ ID NO: 55777 - protein, 644 aa, Oryza sativa (japonica cultivar-group)
MPSLALLRAVAMALLLLLARSMEGVDGAGGGGNATCPLDLSYVTTFPWDADLCAGGAGNMTRCCNTLLSVLAIGLAEQVRATGHFRIPSVGESAACLKDYGAKLSAAPLSLPGASLVQTCFPSPEQFVSSPSFCAGVTTAAEYRAVVGNDSVAALDSACGDLSSTPHCLRCLDAGIAATSRLKAAANISANATTDGAATTRNCFYLTVTYAAGISNVAGPTNPPTAACTLGLALSNPPAAPPKSHDTVIYATAIPVAFLLLASLLAFLVWRRHDKKKKKKKIHEISKEGSAKRRSHPRPNTGSILYDIAELSKATDAFADRNLVGRGGFGAVYCGVLADGSVVAVKKMLDPDVEGGDEEFTNEVEIISHLRHRNLVPLRGCCIVDDDAEEGKQKFLVYDFMPNGALEDFIFRDGKRPALTWAQRRSIIMDVAKGLEYLHYGVKPAIYHRDIKATNILLDGDMRARVADFGLARRSREGQSHLTTRVAGTHGYLAPEYALYGQLTEKSDVYSFGVLVLEVLSARRVLDMSAPSGPVLITDWAWAHVKAGQAREVLDGALSTADSPRGGAMERFVLVGILCAHVMVALRPTITEAVKMLEGDMDIPELPDRPLPYGHSAMFSEAGSNFSASPAFSGPFIDNGDMLR

SEQ ID NO: 55778 - protein, 602 aa, Thiomicrospira crunogena XCL-2
MCGICGEIYWDGQMASETKLVPMLAELEKRGPDDGGTWVQNHVGLGHRRLSIIDLSDGGHQPMLDDEISLVFNGCIYNYETLSAELIELGHEFRSHSDTEVILKAYRQWGMECVSRFEGMFAFAIWDDHQHQLLLARDRFGIKPLYYAPVEGGVRFASNTQALLASGGINTDIDPVGLHHQFTLHAVVPAPHTILKGIRKLEPGHWMIVNPDGQMYKKSYWHLEAKRPTADNAPQTEKEWIDAIHESLKQAVHKRLTAADVPVGVLLSGGLDSSLIVALLAEAGVEDIRTFSIGFEDVPEEKGSEFEYSDLVVEQYQTAHQKYLIPNETVLPRLTEAVDAMAEPMFGQDAIAFYLLSEKVSEDVKVVMSGQGADEVFAGYFWYPMMAKAAESLKDASRPVDAFAPYYFDRSHEEWLEMIEDEFHVYDVTSELINDRLSDKGADSYLDQVLRLDTTTLIVDDPVKRVDNMTMAWGLEARVPFLDHHLVELAMSAPTDLKLKDFKYILKKIARGIVPNEVIDRPKGYFPMPALKYVRGPFYEMMKSILTSPQAKARGIFKPAYIQKLLDHPEADESFTAIKGSKLWHAALLELWLQRHVDPYVQ

SEQ ID NO: 55779 - protein, 496 aa, Oryza sativa (japonica cultivar-group)
MGENGVVASKLCYPAAAMEVVAAELGHTAGSKLYDDDGRLKRTGTMWTASAHIITAVIGSGVLSLGWAIAQLGWVAGPAVMLLFSFVTYYTSALLADCYRSGDESTGKRNYTYMDAVNANLSGIKVQVCGFLQYANIVGVAIGYTIAASISMLAIKRANCFHVEGHGDPCNISSTPYMIIFGVAEIFFSQIPDFDQISWLSILAAVMSFTYSTIGLGLGVVQVVANGGVKGSLTGISIGVVTPMDKVWRSLQAFGDIAFAYSYSLILIEIQDTIRAPPPSESRVMRRATVVSVAVTTLFYMLCGCTGYAAFGDAAPGNLLTGFGFYEPFWLLDVANAAIVVHLVGAYQVYCQPLFAFVEKWAQQRWPKSWYITKDIDVPLSLSGGGGGGGRCYKLNLFRLTWRSAFVVATTVVSMLLPFFNDVVGFLGAVGFWPLTVYFPVEMYIVQKRIPRWSTRWVCLQLLSLACLAITVASAAGSIAGILSDLKVYKPFATTY

SEQ ID NO: 55780 - protein, 115 aa, Thiomicrospira crunogena XCL-2
MDNQEKETLDRIHEQVTNNPVVIYMKGTPQMPSCGFSSRTAQAMVETGEKFAFVNVLADPLIFEYLPKYQDWPTFPQVYIGGELQGGCDITLELAESGELKTLMAKANEAVSEEA

SEQ ID NO: 55781 - protein, 253 aa, Zea mays
MAETLDMTLDDIIKNNKKSNPSSGGARRSRGGSAPGGGSGGVGPTRRSFKRAGNRQAPYQPPKAPDAAWQHDMYPAVAAGGGGGGRVSALETGTKLYISNLDFGVSNDDIKELFSELGDLKRFSIIYDRSGRSKGTAEVVFARRSDAVAAVKKYNNVQLDGKPMKIEIVGTNTPTASAALPVSNGGHARNAVRSAPRGAAPAGMPQRRPHQRGGRRSGGSGGGRRGKERSKPKSAEELDADLEKYHADAMQTN

SEQ ID NO: 55782 - protein, 352 aa, Magnaporthe grisea 70-15
MATAAKIPVIDLASKDEAQVAKDLVDAAVEHGFVYIKNQGNDIPVDAIDGAFDLARKLFASPMEEKASCPIQKDNRGYSGMHVETLDPANQRVGDFKEAFNFGECKDGKPQQPLPPALTPHAHQIGAFFDYCYRLALRLNTLLGIGLATDPPSFFRDAHLRERGPSGSILRMLHYPPLGDAAGASADDVRAGAHSDYGSLTLLFRLRGQAGLEILTPEGSWAPVPVTPPGTEDDPSPPILVNIGDLLSYWTAGLLRSTVHRVVFPVAGGAEGETAVDPRYSMAFFCHPVGNAALEPVPSERVRAEGLKAAAREGNPHALKKDEILTADEHLQMRLRASYAGLYGDEGKKRCQ

SEQ ID NO: 55783 - protein, 715 aa, Escherichia coli
  misc_feature (140)..(140): Xaa can be any naturally occurring amino acid
  misc_feature (382)..(382): Xaa can be any naturally occurring amino acid
  unsure (1)..(715): unsure at all Xaa locations
MKKVVTVCPYCASGCKINLVVDNGKIVRAEAAQGKTNQGTLCLKGYYGWDFINDTQILTPRLKTPMIRRQRGGKLEPVSWDEALNYVAERLSAIKEKYGPDAIQTTGSSRGTGNETNYVMQKFARAVIGTNNVDCCARVXHGPSVAGLHQSVGNGAMSNAINEIDNTDLVFVFGYNPADSHPIVANHVINAKRNGAKIIVCDPRKIETARIADMHIALKNGSNIALLNAMGHVIIEENLYDKAFVASRTEGFEEYRKIVEGYTPESVEDITGVSASEIRQAARMYAQAKSAAILWGMGVTQFYQGVETVRSLTSLAMLTGNLGKPHAGVNPVRGQNNVQGACDMGALPDTYPGYQYVKDPANREKFAKAWGVESLPAHTGYXISELPHRAAHGEVRAAYIMGEDPLQTDAELSAVRKAFEDLELVIVQDIFMTKTASAADVILPSTSWGEHEGVFTAADRGFQRFFKAVEPKWDLKTDWQIISEIATRMGYPMHYNNTQEIWDELRHLCPDFYGATYEKMGELGFIQWPCRDTSDADQGTSYLFKEKFDTPNGLAQFFTCDWVAPIDKLTDEYPMVLSTVREVGHYSCRSMTGNCAALAALADEPGYAQINTEDAKRLGIEDEALVWVHSRKGKIITRAQVSDRPNKGAIYMTYQWWIGACNELVTENLSPITKTPEYKYCAVRVEPIADQRAAEQYVIDEYNKLKTRLREAALA

SEQ ID NO: 55784 - protein, 816 aa, Neurospora crassa
MPGGSWRALGCRRYLLYLPKIPGPGRAVVNTSTSTSRCGRGLLQNSSISSKIPPPQPTPIANHLPSNIPLRTLSAHAAARDDPSTHSHGNRKQGSSSFLAPHPAERLRYSEDGDGDDSNDYGSSESSWIDTGDIAEQLDHEDPLRQRLYDTLEDDTLVGVVHHRHPKRHRHSGKHVHYHESVSSSSAHSSRPSGQAGVVDKEAIRIPDAAPRTVSRAERLIASIMAGTRNPIHGLTGKPLMFDVSCCPAIYFTSIFVSLGVFLFGYDQGVMSGIITGPYFKDYFNQPTSAQIGTMVAILEIGALISSLLVGRIGDIIGRRKTILYGSCIFFVGGALQTMATDMAMMMTGRIIAGLGVGMLSTIVPVYQSEISPPHNRGKLACIEFSGNIIGYTTSVWVDYFCGFLEGNISWRLPLLMQCIMGALLGLGSLIIVESPRWLLDNDHDEEGIVVIANLYGGGDIHNPRARDEFREIKMGVLLARQEGERTYSEMFKRYSRRVFIAMSAQALAQLNGINVISYYAPLVFESAGWVGHDAVLMTGFNGITYLLSTIPPWYIVDRWGRRHILLTGAVAMVLSLSAISYFLYLDTHWTPSAVVVMVMIYNAAFGYSWGPIPWLYPPEILPLKIRSKGASLSTATNWAFNFLVGEMTPILQELIHWRLYLIHAFFCAVSFVIGEYLLTATPQGIQLTEFPVYFLYPETCGVRLEDMDALFGDSTNAFGTPTVSTPSLHAEVDPLVGPGSPVPRLDIRGRPLASAAIPGLPIDPPDEVEIINKSSSNQNRGGIGGLLSRLVGRRGRGSAEGSDSGSYAPLRQGDD

SEQ ID NO: 55785 - protein, 498 aa, Bradyrhizobium sp. BTAi1
MSRIEPMRRYQCFIGGQWRQPASGDYFESFDPFLAQPWALIPRCDARDVDAAVAAARQALEQGEWANMHPSQRGQLLRRFGDLIARDADHLARIEVQDNGKLYAEMRGQVGYIPQWFHYFGGLADKVEGAVVPIDKPDMFTYTRHEPVGVVAAITPWNSPLLLATWKLAPALAAGCTIVIKPSEFTSASTIELMRLVEEAGFPPGVLNVVTGFGADVGEPLTSHKGVDKIAFTGGENSGRHVLRNAAQTFKRTTLELGGKSAQLVFPDADLDNAVKGVVSGIFAATGQTCIAGSRLLVHESIHDAFLDKFVALARTARMGDPMNMDTQVGPVTTQPQYRRVLSCIAMAREEGAECVMGGKPADRPECGQGWFVEPTVFAGVNNAMRIAQEEVFGPVLSVIKFREDDEAYAVANDTAYGLAAGVWTNDQRRAFTAARRLRAGTVWTNTYRAVSYMAPFGGFKASGIGRESGQDAIMEYLETKCVWMSYGKDVPNPFVMR

SEQ ID NO: 55786 - protein, 340 aa, Dipodascus capitatus
MAEIPEKQTAFVFKNGSFALEKKEIEVPKPDAGKVLLKVAAAGVCHSDLHVLHGGLPYPDGLILGHEIAGHIVAYGDGVDKAAFPSDALYAVVGPNPCGMCKACRTGADNVCEDPSRTHMGLGSPGGYEQYTQVSARNITKVPEGIPAAVAAASTDAVLTPYHALKRAGINGMTRLLIVGLGGLGINAVQIAKAFGSYVIAVDPKESSRDLAKQYGANEVYAKLPEESLDVDVAADFYGSQGTFDLCQKHVKAQGILLPVGLQDPKITFDLNHLAFREYTIIGNFWGTSQDQTEVFELVKKGLVTPQVETTSWLNVNKVLKDLDEGKIKSRMVLVHNEDN

SEQ ID NO: 55787 - protein, 707 aa, Bradyrhizobium sp. BTAi1
MASTHTFTKLRYRFIPDHVIGELLSKKWIDNAIPFLVLLCVIAIFGSLIPNFFGGANLAISARELGEFGLVCMAMMVVIIVGGIDLSVGSNFALGNFMTLALLNLGGWPVGLAIPAVVLICGGVGLLNGYLIGFLRLRAFLTTLVTLIIVRAIVDMLLLKYAQAMSVSFYQSDVWDMIGLGGVAEVPSSFIILVIVALIGHVLLTRSRPGWRMMAIGGSRRSAHNIGLSVRGMVCAAYTISGMLCGLAGVLYAARLSGAGTDTGMGLEISALTAAVLGGNSLGGGRGSVAKALIGAVIVLVMTNGVLRIGLNSGSGPMVLGLTLLLAVFIDVRWLKNRDKLLSKVYVSPTYVELPTPRSTSVETGGAFALNDRLGQVEIIGLGEVESPEDVILDDDDYLYCGTRHGDIVRFAPPDYTSWEVYAHIGGSPLGMAFDRAGDLHVCVGGMGLYKIDRARNVGKVTDETNRSAFSVVDDSRLRLADDLDIAPDGRIYFSEATIRYEMHDWPVDALESRGNGRIICYDPKSGKTHTALRNLIFPNGVCLAHDGQSVLFAESWACRVSRLWIAGPKAGQVERVLDALPGYPDNINRASDGSYWCAIMGMRSPALDLALRMPGFRRRMARRIAPDQWLYPNLNIGCVIRFNDKGEVLESLWDQGAKNHPMITSMREHRGYLYLGGITNNRIGRIRLDKADPNWSGMRSYWGQRA

SEQ ID NO: 55788 - protein, 455 aa, Gluconobacter oxydans 621H
MASLILMPALSPTMTEGTLARWVKKAGDAVAAGDVIAEIETDKATMEVEAVDEGMIGKTLVDEGTQNIAVNTPIAVLLAEGEDASAADDVVRSSDPAVGAPVAIETPSDPAITEAPEVAQAEDDRDWGETSEITVRQALRDAMAAELRRDEDVFLIGEEVAQYQGAYKISQGLLEEFGEKRVIDTPITEHGFTGMAVGAALTGLKPIVEFMTMNFSLQAIDHIINSAAKTLYMSGGQMGCPIVFRGPNGAAARVGAQHSQCFASWYAHIPGLKVVAPWSAADAKGLLRAAIRDPNPVIVLENEILYGQKFPCPVDEDFILPIGRAKIEREGTDVTLVAFSIMVGVALEAAAILADEGISAEVINLRSIRPLDTETIVRSVKKTNRIVSVEEGWPVAGIGAEICTVAVEQAFDWLDAPPARVCGLDLPMPYAANLEKLALPKPEWVVDAVRKQLRD

SEQ ID NO: 55789 - protein, 389 aa, Thermotoga maritima
MGSDKIHHHHHHMVSRRISEIPISKTMELDAKAKALIKKGEDVINLTAGEPDFPTPEPVVEEAVRFLQKGEVKYTDPRGIYELREGIAKRIGERYKKDISPDQVVVTNGAKQALFNAFMALLDPGDEVIVFSPVWVSYIPQIILAGGTVNVVETFMSKNFQPSLEEVEGLLVGKTKAVLINSPNNPTGVVYRREFLEGLVRLAKKRNFYIISDEVYDSLVYTDEFTSILDVSEGFDRIVYINGFSKSHSMTGWRVGYLISSEKVATAVSKIQSHTTSCINTVAQYAALKALEVDNSYMVQTFKERKNFVVERLKKMGVKFVEPEGAFYLFFKVRGDDVKFCERLLEEKKVALVPGSAFLKPGFVRLSFATSIERLTEALDRIEDFLNSR

SEQ ID NO: 55790 - protein, 403 aa, Gluconobacter oxydans 621H
MPALSPTMTEGKLARWLKAEGDTVSAGDVIAEIETDKATMEVEAVDEGILSRILIQEGVEGIPVNTPIAVLVEDGEAVPEASSTQAPAAPKAEAAPAVLTGTAPAKAAPEEKGERIFVSPLARRMARERGIALDALTGSGPNGRILKRDVEKGVTAPKTSPKAAPSAAPLAASEETVRHVPNSTMRKVIARRLTESKTQVPHFYVSVDIELDALLDLRAKLNATAQENSFKISVNDMMIKAVALALKKVPGVNVQFTDAETLHFENVDISMAVSVPDGLITPIIRNADRKSLRQISVEAKDLAKRARAGKLKPEEFQGGTFSISNMGMFGVREFAAIINPPQAGILAIASGEKRAVVRGSEIAVATVMTATLSVDHRAVDGALGAEWLNALRDIVQNPYTLVV

SEQ ID NO: 55791 - protein, 468 aa, Gluconobacter oxydans 621H
MCDTFDLIVVGGGPGGYVAALRASQLGMSVALVESTHFGGVCLNWGCIPTKALLRSSEIHHLLHELGTFGLSADNISFDLSKIVGRSRSIARRMGGGIAHLLKKTKVTTFDGRAKLAGRSGEAHQVAITKDGAAVATIKAPHVILATGARGRQLPGLETDGTLIWGAREAMTPKELPKRLLVIGSGAIGIEFASFYRNMGSEVTIAEVADRILIAEDPEISAAARKAFEKQGMKIITSAKVGPLNKGENEVSTTIESPTGKVDLTVDRVICAVGIVGNVEDLGLEGTKVQVERTHIVTDGFCRTGEPGIYAIGDVAGAPWLAHKASHEGILCVEKIAGRSPQPLHPLNIPGCTYSRPQIASVGLSEEKAIAAGHKVKVGRFPFIANGKAVAMGETDGMVKTVFDATSGELLGAHMIGAEVTEMIQGYVITRTGELTEAELVETVFPHPTISETMHEATLAAFDGPLHI

SEQ ID NO: 55792 - protein, 249 aa, Xylella fastidiosa Temecula1
MTRKLVLLRHGQSQWNSMNRFTGWVDIGLTEQGHQEATMAGHLMKKEGLEFDVAHTSLLKRAIHTLQDALKALDQDWLPIYKSWRLNERHYGALQGLDKIDTAAKHGEEQVNIWRRSYDIQPPPIDLDDPSHPMRDRRYAALDRKVLPVRESLKNTLERVLPYWNDAIAPQLNDNKTVLISAHGNSLRALYKYLNKESDEKILNVNIPTGIPLLFELSDTLQVVSYRYLGDPDAAQRAAEMVANQGKAK

SEQ ID NO: 55793 - protein, 348 aa, Zea mays
MAKYGEGDKRWIVEERADGTNVHNWHWAERDCLEWSRARLSSLLAGLTILDGEGGLSLRTVALDKLDGEAYVNIRKGKVIPGYELSLTLSWEAEAASESGAAKVTGTAEVPYLADENADEDPDLRVTVRGDETPLALRAKDAFLSRGKPMVLEKIREFVAAMAKGGPAKDELDSKKTPTKVAGSAPAKEAVLAPAPAVEKKKAKGKDKEGFKTIEMTEKFYCRSKDIYEILMDENRWKGFTQSNARISREVGGEFSLFDGSITGVNEELQEGKLIAQKWRFGSWPDGLYSSVRLVFDEPESGVTIIKLKQTDVPEEDKYGNSTVVENTERGWRELIFQRIRGVFGFGI

SEQ ID NO: 55794 - protein, 335 aa, Achromobacter xylosoxidans
  misc_feature (154)..(154): Xaa can be any naturally occurring amino acid
  unsure (1)..(335): unsure at all Xaa locations
TIRVAINGYGRIGRNILRAHYEGGKSHDIEIVAINDLGDPKTNAHLTRYDTAHGKFPGTVSVNGSYMVVNGDKIRVDANRNPAQLPWGALKVDVVLECTGFFTTKEKAGAHIKGGAKKVIISAPGGADVDATVVYGVNHGTLKSTDTVISNASXTTNCLAPLVKPLNDKLGLQDGLMTTVHAYTNNQVLTDVYHEDLRRARSATMSMIPTKTGAAAAVGDVLPELDGKLNGYAIRVPTINVSIVDLSFVAKRNTTVEEVNGILKAASEGELKGILDYNTEPLVSVDYNHDPASSTVDASLTKVSGRLVKVSSWYDNEWGFSNRMLDTTVALMSAA

SEQ ID NO: 55795 - protein, 682 aa, Synechococcus sp. WH 5701
MHDSTQGRSHPIGATLEHGGANFSLFSRTASAVDLLLFDGVNETHPSRVVTLDPQTNRTYHYWHGFVPGVEPGQLYGYRVHGPWDPSRGLYFDPSRVLLDPYGRAVAVPEGSEAMKSVVVDPGAYDWQDDQPLRHPCARTIIYEMHVRGFTAHPNSGVSAERRGTYAGLIEKIPYLQDLGITAVELLPVFAFDRQAAPSGHVNYWGYQPLGFFAPHPGYSCGEDPLEAVDEFRDMVKALHHAGIEVILDVVFNHTAEGGVNGPTFCFRGIDNPNYYLLRDGGSQYADFSGCGNTLNANHPVVRRMIVDSLRYWVGEMHVDGFRFDLASILSRDSAGNVLPNPPVLWDIESDPLLAGTKLIAEAWDAAGLYQVGSFVGDSWREWNGRFRDDARDFFRAAPGSLGRFADRLIGSPQIYGHKEREAEQSINFVTCHDGFTLNDLVSYNGKHNEANGENNRDGTDDNRSWNCGVEGPSDDSAVEDLRNRQIRNFFAVTLLSLGVPMLLMGDEVRRTQHGNNNAYGLDDSSNWFDWALLQRHGDLHRFVKLLIARRLQRDLRSERERTSLNTLIRRASKAWHGTRLNHPDWGDQSHSISLTVKLLQDKAWLHLILNAYWQPLEFALPMITPDGSSPWHRWIDTSRPSPSDIVPWEEAAECPAGPYRAMEHSVVVLIAGAGVGPEQGG

SEQ ID NO: 55796 - protein, 395 aa, Desulfotalea psychrophila LSv54
MTRQQKKALFILWFGYANFYLLRLNYGIAMPGIMAEYGYSRGELGLGASFFFMLYALGLVVSGVLSDRLGPKRILVFGLLCSILVNLAFPSIAGSLFGIVFLWSINGFFQAMGWAPTVKMTSPWFEEGQKGRASAILGTSYIIGSALSWLLAGYLAQNYSWRLVFYGPTLIAAVILALYLIYIEQYPQATTPARQSILKTLGAVLAEREIWYVGFTLLGLNIVIYGFMTWAPIYYFEQGGDIQEATHKALLFPIAGALGSLFIGWLCDKFFAKRRLFVGVMAMVVLLFSVLLFPYSTDPLVSLTCLVFVGATAYGTEVLLVSQFPMIFGKQKNMATIVGVIDSIGYLGAAITSVTSGFLTDIWGWSAAFYFWIGGGLFAMIFLLICQRQLGHTLR

SEQ ID NO: 55797 - protein, 232 aa, Arabidopsis thaliana
MPIILCGDWNGSKRGHVYKFLRSQGFISSYDDAHQYTDSDAHRWVSHRNHRGNICGVDFIWLCNPSDSRKPLRTSWVEAVFSIIKYQLHKASIAEDDAFTFLGAKNHSDSLTYSDFCLALQKVNLTGIPHGLSFEETKELWVRADLDGNGVFDYEELKKIWNMTMVNQPGNCKESVMESKKEEGEDEAIGLKVNKAILFPQEAEKGLWPENYNISDHACLTVQFSPVKMLCS

SEQ ID NO: 55798 - protein, 1178 aa, Arabidopsis thaliana
MKYKDEKYEKAEKGSRILPKTVLLILLCGLSFYLGGLYCGKNIIEVSDVAKAESSSLDVDDSLQVKSVSFSECSSDYQDYTPCTDPRKWKKYGTHRLTFMERHCPPVFDRKQCLVPPPDGYKPPIRWPKSKDECWYRNVPYDWINKQKSNQNWLRKEGEKFIFPGGGTMFPHGVSAYVDLMQDLIPEMKDGTIRTAIDTGCGVASWGGDLLDRGILTVSLAPRDNHEAQVQFALERGIPAILGIISTQRLPFPSNSFDMAHCSRCLIPWTEFGGVYLLEVHRILRPGGFWVLSGPPVNYENRWKGWDTTIEEQRSNYEKLQELLSSMCFKMYAKKDDIAVWQKSPDNLCYNKLSNDPDAYPPKCDDSLEPDSAWYTPLRPCVVVPSPKLKKTDLESTPKWPERLHTTPERISDVPGGNGNVFKHDDSKWKTRAKHYKKLLPAIGSDKIRNVMDMNTAYGGLAAALVNDPLWVMNVVSSYAANTLPVVFDRGLIGTYHDWCEAFSTYPRTYDLLHVDGLFTSESQRCDMKYVMLEMDRILRPSGYAIIRESSYFADSIASVAKELRWSCRKEQTESASANEKLLICQKKLCSGFRLFPSSATVVLPVGSEVISGFNLSGLSSSEIWNKFLSGQAATTIGFSHSKKRSIGGFLAEVCKFFLRIVLEKPLCSSLSYLVLMGAGSFLLAKTVFLVGSFASLSSQYVFSSSLALFLLPKWSTRLCSKYKLIKEVGDGTFGSVWRAINKQTGEVVAIKKMKKKYYSWDECINLREVKSLRRMNHPNIVKLKEVIRENDILYFVFEYMECNLYQLMKDRQKLFAEADIKNWCFQVFQGLSYMHQRGYFHRDLKPENLLVSKDIIKIADFGLAREVNSSPPFTEYVSTRWAPEVLLQSYVYTSKVDMWAMGAIMAELLSLRPIFPGASEADEIYKICSVIGTPTEETWLEGLNLANTINYQFPQLPGVPLSSLMPSASEDAINLIERLCSWDPSSRPTAAEVLQHPFFQSCFYVPPSLRPKPSVARTPPPVGPRGSFEHQSVKRYPVSLANAKPFNSYVSPKSNAAFGSGVQRKLDMVNQDGTRNTKPVRSSVRDSKYRPPGKKSPPAASLNKNRVTRSSVSETADKLANMTIGATGSRRHSVSVVGQHQQLKPPPMKAGWVGETRDMFLRPTQPTTNAYSRKVAG

SEQ ID NO: 55799 - protein, 131 aa, Desulfotalea psychrophila LSv54
MATMIEKKIIETEAAPAAVAAYSQAVQAGNLLFTSGQLPLDPSSGKIVTGDIVAQAHQAIKNLIAIVEAAGSSIDDVIKVTVYLADVKDSAAVNEVYNQYFFQPYPARSAFQVAALPLAAGLEIEAIAIVK

SEQ ID NO: 55800 - protein, 960 aa, marine gamma proteobacterium HTCC2143
MLQYYDPAKGLDVSKDYGTPAFNRQADRNTELVNLTIDGRELAVPAGTSIMRAAALADISIPKLCATDSLEAFGSCRMCLVEIAGRKGFPASCTTSVEQGLVVRTQTDRVAKLRRNVMELYISDHPLDCLTCPANGNCELQDVAGEVGLRDVRYGFDGKNHLSASKDTSNPYFTFDASKCIVCSRCVRACEEVQGTFALTIDGKGFDSVVAAGQAQSFMESDCVSCGACIQACPTSTLMENTVIDQGQPQRSVVTTCAYCGVGCAFKAELKGDQVVRMVPHKGGEANRGHSCVKGRFAFGYTTHQDRITTPMIRETIDDPWRKVSWDDAVNFAAARIKTIQQQYGRNSVGGITSSRCTNEETYLVQKLVRAAFGNNNVDTCARVCHSPTGYGLKTTLGESAGTQTFDSVEVADVVLVIGANPTDAHPVFASRLKKRLRQGAQLIVADPRRIDLINSPHANTPYHLKLLPGTNVAFINAIAHVIVSEGLEATEFIARRCDSEAFGRWKRFVKEQKNSPEAMASITGVPAEQLREAARVYANANNGAIYYGLGVTEHSQGSTMVMGIANLAMLTGNIGREGVGVNPLRGQNNVQGSCDMGSFPHELPGYRHISDDTVRHQFEQAWGVTLDHEPGFRIPNMLDAAVAGHYKGLYCQGEDIAQSDPNTKHVEQALRSLDCLIVQDLFLNETANFAHVFLPGASFLEKDGTFTNAERRISPVRKVMSPLGGKADWEGTTALSNALGYPMNYNHPSEIMDEIASLTPTFSGVSYQRLDQEGSLQWPCNSAMPDGTPTMHVDEFVRGKGYFAITEYVATDEKVNKRFPLLLTTGRILSQYNVGAQTRRTANVDWHERDLLEIHPHDAEDRGISDGDLVQVSSRAGKTVLTADVTERVQAGVTYTTFHHPESGANVVTTDNSDWATNCPEYKVTAVELKKVTAESSWQRDHDAFSIKQRGLVDTEVLP

SEQ ID NO: 55801 - protein, 222 aa, Nitrosomonas europaea ATCC 19718
MTHPLFRHAEFYTTVNRLQDLPQTAGVEVAFAGRSNAGKSSAINTLVGRERFAFVSKTPGRTQHINFFQLGEERFMVDLPGYGYAQVPLAIRQHWGHLLSSYLQTRQSLYGMILIMDIRHPLTKLDLQMLDWFRQTKKPVHVLLTKADKLSKSRALVALNEVRQFLTVNYPHCTVQTFSSLKVAGVEEASQLLQNWFDTGHASVQQENGEISEQKKTPAKGD

SEQ ID NO: 55802 - protein, 137 aa, Glycine max
DMYWEYPTVTGEVVGVYQPSHEGYQQTQKQMHNQKAWAEMYLLSLTDVLVTSSWSTFGYVAQGLGGLKPWILYKPENRTAPDPPCRRAMSMEPCFHAPPFYDCKAKRGTDTGELVPYVRHCEDMSWGLKLVDSDSYR

SEQ ID NO: 55803 - protein, 318 aa, Pseudomonas fluorescens Pf-5
MKLALVGDIGGTNARFALWKDQQLEAIEVHATADYSCPEDAIKAYLRDQGLALGAIGSVCLSVAGPVSGDEFRFTNNHWRLSRQAFCQALQVDQLLLVNDFSAMALGMTRLQPDEFRVVCEGVAEPLRPAVVIGPGTGLGVGTLLNFGDGRYMALPGEGGHVDLPLSSARETQLWQHIHDEIGHVSAETALSGGGLPRVYRAICAVDGHEPRLETPEAITAAGLAGDPIAREVLEQFSCWLGRVAGNNVLTTGGRGGVYIVGGVIPRFADFFIHSGFAKSFADKGCMSDYFKGIPVWLVTAPYSGLTGAGVALEQAQG

SEQ ID NO: 55804 - protein, 334 aa, Pseudomonas fluorescens Pf-5
MTLRIAINGFGRIGRNVLRALYTQGYRQDLQIVAINDLGDSAINAHLLKYDTVHGTFDAQVEHDQESLTVNGDRIAVSAIRNPAELPWAAEKIDVVFECTGLFTDRAKAAAHLTAGARKVIISAPAKGADATVVYGVNHDILRQSHQIISNASCTTNCLAPVAQVLHRELGIDNGLMTTIHAYTNDQNLTDVYHSDPYRARSATQNMIPSKTGAAEAVGLVLPELAGKLTGMAVRVPVINVSLVDLTVTLKRDTTAEEVNALLKSASQHSTILGYNTLPLVSSDFNHNPLSSIFDANHTKVSGGRLLKVLAWYDNEWGFSNRMLDNCLALCNAE

SEQ ID NO: 55805 - protein, 231 aa, Cryptococcus neoformans var. neoformans JEC21
MNTSHPIPTTMASKSFLSLLVALFVAICFVLSPGVDAAKGPVITNKVYFDIEHGGKPLGRIVMGLYGKTVPKTAENFRALATGKNSDGEDLGYGYEGSSFHRIIKNFMIQGGDFTKGDGTGGKSIYGSKFPDENFKLKHTGPGVLSMANAGRDTNGSQFFICTVKTAWLDNRHVVFGHVLEGMDVVYAMENVKTSRGDKPVEPITIAASGELPIEHEVDEQGNQVPFRIEL

SEQ ID NO: 55806 - protein, 337 aa, Synechococcus sp. CC9605
MGRSSRIRSLSALTRCLEEEASAIATAAARLSSDQVEAALALLDRCANRKAKLVITGVGKSGIVARKIAATFSSIGLMALFLNPTDALHGDLGVVAAEDVCLLLSNSGETTELLEVLPHLTRRGTGRIAIVGRADSSLARGSDVVLEASVDREVCPLNLAPTASTAVAMAIGDALAAVWMERRGISPADFALNHPAGSLGKQLTLTASDLMVPASQLHPLQPHTPLPEVIGGLTRDGIGSGWVENPDSPGSLLGILTDGDLRRALQDHGAETWTHLTAKDLMTADPITVQTDVLVVKALEQMERNRRKPISVLPVVNQDKQLMGLLRLHDLVQAGLA

SEQ ID NO: 55807 - protein, 308 aa, Arabidopsis thaliana
MMMMTSLGGGAGGGGGGGGSGGGRFVTYPPPLSVPPSAPQSPNFSGGLRSQPSFLVEQEKYLSELLAERHKLTPFLPVLPHVCRLMNQEILRVTTLLENALSQSRFDHPSPLASGGIFQNSRADMNGWASQFPSERSVSSSPAPNWLNSPGSSSGLIVKRTIRVDIPVDKYPNYNFVGRLLGPRGNSLKRVEASTDCRVLIRGRGSIKDPIKEDMMRGKPGYEHLNEPLHILVEAELPIEIVDARLMQAREILDDLLTPVEETHDFYKKQQLRELALLNGSLREEGSPMSGSISPYNSLGMKRAKTRG

SEQ ID NO: 55808 - protein, 152 aa, Zea mays
MTTEQTFIAVKPDGVQRGLIGPIITRFENRGFKLAGIKMVPPSKEHLEKHYADLSDKPFFPGLIAYMGSGPVCAMVWEGRDAVKTGRSILGATNPLASAPGTIRGDYALDGGRNVCHGSDSGENGKKEIALWFKDGEVQSWKSAQHDWVYEK

SEQ ID NO: 55809 - protein, 323 aa, Aspergillus oryzae
MAHATPDFHAIHSSSPITTLRFSQQAPVILERQLHSEKNLISALIGKQEEPEKYGIIEQLFFSCLQTGDDRSALLCLEQLTRRFGSSNEKVMGLRGLYEEAICENQSDLEDSLRKYDSYLLENPLNLPILKRRIALLRSLARPADAITGLVELLKAVPTDAEAWCELADLYQSQGLSSQAIFSLEEALLIAPNAWNIHARLGEVLYICARAAETEVTSRYLRRSIQYFCRSVELCDDYLRGFYGLILATSLQLGREYTMDFSQASASASSEDFLPKEKVEKLNLLARRKLEDIVKQRSVNRQLWEHAQGELIAAKELLDRESC

SEQ ID NO: 55810 - protein, 177 aa, Triticum aestivum
  misc_feature (36)..(36): Xaa can be any naturally occurring amino acid
  misc_feature (55)..(55): Xaa can be any naturally occurring amino acid
  misc_feature (117)..(117): Xaa can be any naturally occurring amino acid
  misc_feature (127)..(127): Xaa can be any naturally occurring amino acid
  misc_feature (134)..(134): Xaa can be any naturally occurring amino acid
  misc_feature (143)..(143): Xaa can be any naturally occurring amino acid
  unsure (1)..(177): unsure at all Xaa locations
MAPTVMASSDTSVALFQGLKSTAGLPVSRRSNGASXSASVSNGGRIRCMQVWPIXGIKKLESLFYLPPLTTEALLKQVDYLIRSKWVPCLEFSKVGFIFRDHNASPGYYEGRYWTKXKLPMFGCTDXTHVINEXEEVKKEYPXDPYVRIMGFDNMSEVPRGHFIAYKPPGCHESAKA

SEQ ID NO: 55811 - protein, 543 aa, Thiomicrospira crunogena XCL-2
MGVETSSAWQALQLHSDSGMGSIHLSKLFQDTNRQDDYSLELSDVYVDFSKNRITQETVQLLIELAEQQKLPKEIHRLMTGEHVNDTEDRPALHTALRALGKDVSGGAETVQPEIEQVLQKMELMTKKIRSGHWRGYSGKPITDVVNIGVGGSDLGPLMITHSLQTISSPINLHFISSIDGTQTSNLLRGLKQETTLFILASKSFTTIDTLSNAETAKDWLKECISDERVIFSQHFIGVSTKPDKMQEWGIPPENQLMFWDWVGGRYSLWSAIGFPIALKIGMDGFRELLQGAHEMDQHFATADLKKNIPVILALIDIWNINFLNIHDKAILPYDARLRYLPAYLEQLVMESNGKSVARSGESVPYKTCPVLWGEVGPNAQHAFYQLLHQGTQAVMCDFIAPVERDDFDANSHTERDESLRHQHELALANCFAQSRVLMLGDNAIPSDLKASFDSPFKHYPGNQPSNTILIKTISAKTLGMLVAMYEHKTYVESVIWEINPFDQWGVELGKLIAKETYNAIKDKPLADSFDSSTKGLIDRVVK

SEQ ID NO: 55812 - protein, 449 aa, Synechococcus sp. RS9916
MTITASASSALTAKATFDDLGLSAPLLQALREKGYSTPSPIQEQAIPAVLSGRDLMAAAQTGTGKTAGFTLPMLETLSHGARPGRGQIRALVLTPTRELAAQVLDNARDYSRHLRLRSEVVFGGVKINPQIQRLQQGVDLLVATPGRLLDLHQQGAVRFERVEFLVLDEADRMLDMGFIHDIRRVLSRLPERRQNLLFSATFSPSIRKLATGLLNDPLQIQITPPNQTARTVQQVVHPCDMKRKPDLLSHLIRSNDWQQVLVFSRTKHGANRVAEKLTNEGLVAAAIHGNKSQGARTRALQGFKDGSVRVLVATDIAARGIDIQQLPHVVNLDLPNVAEDYVHRIGRTGRAGECGHAISLVAAEEALLLKAIERTTRESLEKVLVPGFEPTVLDAPPLDLSGGRGRRSPRGGGPTRNHHERNRGGGGSRGGSSRSASGRPKRSGRPPQR

SEQ ID NO: 55813 - protein, 310 aa, Debaryomyces hansenii CBS767
MSSLLSPQVGKVHEYLPRLTAFEFDGNSGSEAAPNVVLFIGGLSDGLLTVPYLPRLAKSIESISSQHGQWVLVQALISSSYLGWGTGSLEADAKELSLLVKYLRSEKGGNRKKIVLMGHLTGCQDSMQYLTKLCKKADAPEDILLDGVILQAPVSDREAVADHMGGMKKLEPLLEKVKKEFILTGKGQHILPHEFDIFKTPVTAYRFCSLMSIRGDDDYFSSDLNSDDFKQTFGIVDRPLLVLYGSKDECVPEFVDRELLVEKWKNATDTKYWSPLSKVLKGANHNVGPISDDGTVEDFLEIVCKFILSI

SEQ ID NO: 55814 - protein, 308 aa, Silicibacter sp. TM1040
MILCCGEALIDMIPGTTETGQAAFVPHTGGAVFNTAIALGRLGRRVSLLSGVSRDLMGRKLEAALRESGVSEGHLIRSDRPTTLAFVELQNGHAKYAFYDENTAGRLITVADLPKLGAEVEALFFGGISLACEPCADTYASMLKRYGAERAVVLDPNIRPGFVPDEARYRARLKEMLAQADMVKVSDEDLAWLMPEQSDPQAQAAALQAWGPAVVLVTRGGDGAMGLLPNGESVTVAAERAEVVDTVGAGDTFNAGVMARLDESGALNKEALRKLDASTLAEALRWGAKVAAVTVSRAGANPPWRSEL

SEQ ID NO: 55815 - protein, 137 aa, Oryza sativa (japonica cultivar-group)
MATCRSRGVERGGAPHVLAVDDSSVDRAVISGILRSSQFRVTAVDSGKRALELLGSEPNVSMIITDYWMPEMTGYELLKKVKESSRLKEIPVVIMSSENVSTRINRCLEEGAEDFLLKPVQPSDVSRLCSRVLRCCG

SEQ ID NO: 55816 - protein, 1144 aa, Fulvimarina pelagi HTCC2506
MPRRTDIKSILIIGAGPIIIGQACEFDYSGTQACKALKAEGYRIILVNSNPATIMTDPDLADATYIEPITPEVVAKIIEKERPDALLPTMGGQTALNTALSLQRMGTLERYKVEMIGANAAAIDKAEDRALFREAMAKIGLETPRSVLANAAGPKAQDRKIHEDQRAVIRAEHADDEDARNAALDKLEAEWNLGESDRKQRYMNHALAAAAQALDEVGVPAIIRPSFTLGGTGGGIAYNRQEFFEIVENGLDASPTTEVLIEESVLGWKEYEMEVVRDRADNCIIVCSIENVDPMGVHTGDSITVAPALTLTDKEYQIMRNASIAVLREIGVETGGSNVQFAVNPETGRLVVIEMNPRVSRSSALASKATGFPIAKIAAKLAVGYTLDELENDITGGATPASFEPSIDYVVTKIPRFAFEKFPGAVPILTTAMKSVGEVMAIGRTFAESLQKALRGLETGLTGLDEIAIPDTGQGDDLNALRAALGTPTPDRLLMVAQAMRMGMSNDAIHAACKIDPWFLARIRAIVDLEGRVRDHGLPQDEDNLRFLKSCGFSDARLATLAGVDEVAVADKRRELNVHPVFKRIDTCAAEFASPTPYMYSTYERPFAGSPRSEAEVTDARKVIILGGGPNRIGQGIEFDYCCCHAAFALDDAGYESIMINCNPETVSTDYDTSDRLYFEPLTAEDVLEIIYAEQERGTLHGVIVQFGGQTPLKLAEALEAAGIPILGTSPDAIDLAEDRDRFQQLLNELNLKQPNNGIARSFEEAHAIVDRIGYPVVIRPSYVLGGRAMEIVRSEQGFERYMREAVVVSGKSPVLIDGYLKDAIEVDVDCLCDGENSFVAGIMEHIEEAGIHSGDSACSLPIHSLSKSITDELERQTREMAIALKVGGLMNVQFAIQGEDIYVLEVNPRASRTVPFVAKTIGRPIAKIAARIMAGEDLETAFAAYGGKPDVKSLRHIAVKEAVFPFSRFQGVDTLLGPEMRSTGEVMGLANDYALAFAKSQLGAGVDLPREGTVFVSVKDADKERILPTIQRLSEIGFSVMATGGTQRFLTENGIEAVRVNKVLEGRPHIEDAMRNRQVQLVFNTTEGAKALSDSLSLRRAALLHKLPYYTTLAGMEAAAEAVGALKKGNLEVRPLQSYFTAA

SEQ ID NO: 55817 - protein, 455 aa, Arabidopsis thaliana
MSKMKDFGGGRDIISDLPDALIGHILSFLPTIEAVATTVLAKRWKPLLSFVHSLDFDDSLCLHPAKTNEEKRTNATSFMRFVDGVLALQGNARINKFRLNGKHIINERWVLDWIQNVLKRDVSDIRLYVSSCSDGFDSSFYHLPPEIFVSQTLVTLIIMFEGDINISVGREVSLPKLKTLHLYHFKIKLSTFNKLISGCHALEELMMINWKWDESSEPEPCFVTIYLPNLKILEYCRFERYDEANDKVSLLFHNPKVVYLEFFDSIADRYQQVSFGSLVEARLGIRLTYDQVYNHLETEYYVSSKEKSNVTNLLTGICNVKILYLSDETLEVFGCCRDTIPVFSNLIELTIQTKPHIIWKPLPAMLNNCPNLITLIFEGMHHIYSDRCEDEDGCLCRYPTNFVGGVVARPCLSSSPVKVLKILNFGEICDVHEDDEDDDDDDDDEDEEFVYCLRE

SEQ ID NO: 55818 - protein, 698 aa, Sinorhizobium meliloti 1021
MNLTFSELDFMKPELGAEYTGQGTHFAVFSAHAEKIELCLFSEDGREETARMPLPKREGDIWSGYIEGIGPGTLYGYRAHGPYDPHNGHRFNPNKLLLDPYAKLVAGDLIWDDALFGYTIGSPEGDLSFDERDSAPFMVKGVVQDPTFDWAGEEAIRRPWTETIIYESHVRGMTMTHPGVPDELRGTFLGMASDPIIEHLTKLGVSAIELMPVQYFLDDRYLVERNLRNYWGYQTLGFFAPHDRYLKGDRFTEFKTMVKRFHSVGIEVLMDVVYNHTAEGSERGPTLSFRGLDNFSYYRQSPDKPRHTYDTTGTGNTLNVAHPLVLRMVLDSLRYWVGVMHIDGFRFDLASTLGREYMEFDREGGFFDAIRQDPILAGVKLIAEPWDVGEGGYQLGGFPPPFREWNDRFRDDVRRFWKGDGGMVPVLAERILGSPVQFRHSDRAATSSINLVSAHDGFTLMDTVSYGEKHNEANGEENRDGHSDNHSDNMGAEGPTDNREIIEARKRRRAAMLATLMISQGVPMVLGGDELGNSQQGNNNAYCQDNEIGWLDWSGADDGFVDFCRKLLAFRKDRPVLRQERFLDGEPDENGRVEIAWYKADGSPMDEDAWHDAELRLICAYICRAGQGEAPPAGEIVLVLNAGGDCEIALPHGNGSRRWLRVLDTAADEPFGMRASADRDTIPAQSVVAFVPQEGSNG

SEQ ID NO: 55819 - protein, 526 aa, Schizosaccharomyces pombe 972h-
MARETEFNDKSPSSTDDGMSQSHFSDKLKNLFHFRRNRAATVSTSVRNDQRDNDSDDSTFDINVNQLNELDLNDSSDQLDSRPSLRRVSSAPDSHKGVEAPPPRPLINMSNIRKAQVKILKNPGNYIFGRTEYGKRTYSGNSTKISRVEVTPHSFEKIRLLGQGDVGKVYLVRQKSNHRLFAMKILNKREMIKRHKVNRVLAEQEILTKSKHPFIVTLYHSFQSRDYLYLCMEYCAGGEFFRALHSLPKHILPEKDACFYAAEVTAALEYLHLMGFIYRDLKPENILLHQSGHIMLSDFDLSKPISIVTHPTVVLPKHSTFSQEKPALDTNSYFSNFRTNSFVGTEEYIAPEVIRSCGHTVAVDWWTLGIFIYEILYGTTPFKGKNRHATFSNILYSDVSFPEYHGAPNVSSTCKSLIRRLLVKDESKRCGSVAGASDIKQHPFFRHIQWALLRSMKPPIIPKIEDGMEAVEPSDNDNEEEDFLNSQYLISANLPAVDMHSSTPVNEQSNPFDSFSSVTLHHAGDE

SEQ ID NO: 55820 - protein, 131 aa, Desulfotalea psychrophila LSv54
MATMIEKKIIETEAAPAAVAAYSQAVQAGNLLFTSGQLPLDPSSGKIVTGDIFAQAHQAIKNLIAIVEAAGSSINDVIKVTVYLADIKDSAAVNEVYTHYFFQPYPARSAFQVAALPLAAGLEIEAIVIVK

SEQ ID NO: 55821 - protein, 135 aa, Zea mays
MASADARLAGIASSIRVIPDFPKPGIMFQDITVVAGVEARGFIFGPPIALAIGAKFVPLRKPKKLPGEVISEEYSLEYGTDKIEMHVGAVQANDRALVVDDLIATGGTLCAAVKLIERVGAKVGECACVIELPEL

SEQ ID NO: 55822 - protein, 320 aa, Nicotiana glutinosa
MESFPIVDMEMLNTEQRAVIMEKLKDACENWGFLELVNHGISHELMDTVEKLTKEHYNKSMEQRFKEMVTNKGLEVVQTEIDDLDWESAFFLKHLPVSNISDIPDLDHDYRKVMKEFAQKLEKLAEDLLDLLCENLGLEQGYQKKAFYGTFGPTFGTKVANYPPCPKPELIKGLRAHTDAGGIILLFQDDKVSGLQLLKDGKWIDVPPMSHSIVVNIGDQLEVITNGKYKSVEHRVIAQPDGNRMSIASFYNPGSDAVIFPAPELAEKEEKENKLKYPKFVFEDYMKLYAALKFQAKEPRFEAMNKAMKTTVNLGPIATA

SEQ ID NO: 55823 - protein, 354 aa, Mycobacterium tuberculosis CDC1551
MRLRMGGVLTLDAAFLGSVPADLGKALLERARADCGPVLHRAIESMREPLATMAGYHLGWWNADRSTAAGSSGKYFRAALVYAAAAACGGDVGDATPVSAAVELVHNFTLLHDDVMDGDATRRGRPTVWSVWGVGGAILLGDALHATAVRILTGLTDECVAVRAIRRLQMSCLDLCIGQFEDCLLEGQPEVTVDDYLRMAAGKTAALTGCCCALGALVANADDATIAALERFGHELGLAFQCVDDLIGIWGDPGVTGKPVGNDLARRKATLPVVAALNSRSEAATELAALYQAPAAMTASDVERATALVKVAGGGHVAQRCADERIQAAIAALPDAVRSPDLIALSQLICRREC

SEQ ID NO: 55824 - protein, 353 aa, Chlorobium tepidum TLS
MNILGIETSCDETSAAVLSDGSVRSNIVSSQRCHTDFGGVVPELASREHERLIVSIVDAAITEANIAKNDLDVIAATAGPGLIGAVMVGLCFAEGLAWALGKPFVPVNHVEAHIFSPFISDEPGHREPKGDFVSLTVSGGHTLLSVVRQDLGYEVIGRTIDDAAGEAFDKTGKMLGLGYPAGPVIDRLAREGDSDFHRFPRALTASSQTSKSYRGNFDFSFSGLKTSVRTWLEAHDSEYVQKHQADLAASIQSAIVEVLVEKSVAAALLHKVNAISVAGGVSANSGLRSAMQAACDRHGIELFIPALAYSTDNAAMIATMAQLMIARGKYRIEDNSYGVAPFARFEAARKGAR

SEQ ID NO: 55825 - protein, 514 aa, Yarrowia lipolytica CLIB122
MSSNTGQGPGIASPAPLTNGHTSQPSNTHQDAPVRPTLENGRSYINLDNLSKEKHLRTGSSSTIQEEEPSTRARRSASTSKPPLLVNQNQIQNHQHQQSQYNPQYQPPRVATPKRTPLFDSGQSYSQRFHNRSSSFSVRSARARSLSASSQEALKHLAPPVSVPLVVCCLMWYLSSAMSNTLGKAILTKFGYPVTLSQIQFLVAVCCGATTIQLSQMSPKFRQALPPGMVGPQGLIFPPTRDMLKTTAPMGCFQLSGHILSHMATGMIPVSLVHTIKALSPLFTVAAYRLLFNVQYSPSTYLSLIPLVTGVILTCSTSFRAQFMGIIYALLAALVFVSQNMFSKKLLTSGTTAGPGGPASATHTRKLDKLNILCYCTALAFLFTSPLWFFSEGWTLLKLFFRGEALVKDDSSLFVLMIQLLLNGVVHFAQNLLAFQVLSMVSPVTYSVASLLKRIVVIVWAIIWFGQSVSGIQGFGIFLTFTGLYLYDRCGGDKKKGGQGSSVDGTEKDAQLPK

SEQ ID NO: 55826 - protein, 303 aa, Brassica napus
MASYLHVVSFIGFLSILRLLYPLLKWFITRFLLTDPRRLKSYGSWAMVTGATDGIGQAFAHELAKHGLNLVLVSRNPSKLASVSDDFRQEFPQIKIKIIPFDFSSERGYEAIEEGIRGLEVGILINNVGITYPRAMFFHEVDELTWTKILRVNLEATTWVTRSLIGPMLHRRRGAIINISSGAAVVVPSHPLYAIYAATKAYVDKLSRSLHVEYKQFGIHVQCQVPLYVATRMVLEVADIDKPSFFVPSPEVYAKAAVEQIGIGSRCSPFWAHSLQWFLAGLLPENLLDTWRLSIGLRRRSLS

SEQ ID NO: 55827 - protein, 141 aa, Thiomicrospira crunogena XCL-2
MLERTFSIIKPDAVKRNLIGQIVSKLEQNGLKVIASKMVFLTVQEAKGFYAEHDGKPFFDTLIKNMTAGPIVVQVLEGDDAIAKNREIMGPTDPENAPAGSIRKEYAISMQQNSVHGSDSPESAQREISYFFSEIEVFSAS

SEQ ID NO: 55828 - protein, 112 aa, Candidatus Desulfococcus oleovorans Hxd3
MSDCLFCKIAAGLIPCDKVYEDDDYVAFADINPQAPVHILVVPRRHIAKVADMAPADGNLVGGLFDVAAKICAEKGIADYRLVINNGAEAGQSVFHIHLHILAGRSFGWPPG

SEQ ID NO: 55829 - protein, 316 aa, Yarrowia lipolytica CLIB122
MVDLNHYQKLEKVGEGTYGVVYKARDTLNNNRLVALKKIRLEAEDEGVPSTAIREISLLKEMRNDNIVSLYNIVHSDSHKLYLVFEFLDLDLKKYMESISPGVGLGADMVKKFMNQLILGTRYCHAHRILHRDLKPQNLLIDREGNLKLADFGLARAFGVPLRTYTHEVVTLWYRAPEILLGGRQYSTGVDMWSIGCIFAEMVTRKPLFPGDSEIDEIFKIFRLLGTPTEETWPGVTALPDYKPTFPQWSRKDIGRTVTPLDHEGLDLLEHLLAYDPACRISAKRAADHAYFDVGTNMKSGYNAAAGPGLMMSTRA

SEQ ID NO: 55830 - protein, 849 aa, Magnaporthe grisea 70-15
MAKSTTTDGENVKANSENGSTAAASPNDEHVKIEPSTKDKGEDKPKAADARDDGSEAEARADQHPEKPAQANGPETADGDHHPFANSYQVDSARAADDPNVVYLRDDEIETFLDELDHNGDGCIDYSEVERKLDEVHDELAPTAQPHHLHHDSKQDRERHVFLRSVIGSDQDRIPRADFARVVKSWRVPSMKQEGDKKDDQDKYLRDMSTFRRVRAYWAVHGPEIAFLGIVVGLQLGLGIWQCHKYASGEQYQAAFGWGVALAKLCAGALYPTFFFLILSMSRYFSTFLRRSYHLSRFINWDLSQEFHIKISIVALVLASLHALGHLSGTFNWGSRPERQDAVGVLLGEDQVPRPYSAYVSSLPGITGLTALGLFYTLALLSMPQVRRWNYEVFQLAHLLMFPIIGLLAAHGTAQLLQYAMFGYWLAVPTILVLTERLVRVGTGFHRIPASLKVLDDETVELRATIPSERIWKYQAGQWAYLQVPTISMWQWHPFTISVCVGKEMRMHIKTDGNWTGRLRDLAKDAPQGQEVDIEIGINGPFGAPAQRFYDFNHTILVGAGIGLTPFSGILADLQAKEDRLHGGPTQKLQEQAEKGGDVRGSTSADAPDGRRIGTSREAEAMPQRTDVDMQAPTSGDQSNTTLQETADADSDSASSISRPSSSFSSFASDYRRVDFHWMVRDRNHLLWISELLNTVSRSQAWHHRHDAPGEYHLDIRMQTHVTQKRKNVSTHVYRWLLEQHRTPEHPASPITGLINPTQFGRPDFVSILDRHYDDMRKYKAGLVARASRGGGGEDDAASVADDEVKVGVFFCGTPIVGEILADRCKALTARGRHDGSKIEYHFMIEVFN

SEQ ID NO: 55831 - protein, 1422 aa, Vibrio parahaemolyticus RIMD 2210633
MIEIVIDGKYRIVEEGLTLLEAAKVCGVEIPSLCGMNKSNEKIPCDLCVVEVESGGTKRACDLKVYRGLNVVTQSEQLSEHRRKALNRIMTDHYADCEAPCKTACPAGVDIQSYLYHISQNDHQKAIEVIKRTLPMPLSIGRVCPAFCESECRRSLVDEPIAIRQLKRHAADADLAAHEAYVPEKKPAKHRKIAVVGSGPGGLTAGYYLSNEGYDVTIFESMPKAGGWLRYGIPEYRLPKDILDKEIELMCRNGMQVETNKKLGVDFTLSQLSEDYDAVCLAVGASQAVEMNYPGSDLDGCYLGVDYLKDYVTEQNYVTGKKVAVIGGGNTAIDCARTARRAGADTTLIYRRTRDEMPAEDYEIVEAEHEGVTFHFLTNPAENIADENGRVKAIRLERMALGEPDASGRRSPKPTGEFFTEAFDTVIAAVSQKPDLSFLENDDLSIPLTRWNTSESDSQTMHTGTGNIFSIGDFRRGPATAVEAVGDGRVAAKAIDLFLNGDMADMPKPAFNSRKEKKLAQVDPLHFENIQKVARSIMPELTPAQREQSFAEVELGFDNEEAMKEAARCLECGCQANTDCALRDYSTEYHAEQHFDVSVDVSSASVIGHQDWLDLRAKDLRHKYEVDRSSEFIEFDANRCISCGQCIQACREQAVHGVLSFVSDKNGRPALRPDDRPRFRSDEKGVGCSGLTLMGDSKCVQCGVCVQACPTGAMVDSRDRSQGRTEQLKAVDTICTYCGVGCKLTMFVDERQNKIRYVKGADSPVNQGMLCVKGRFGFDFISSEERLTTPLIRKDGWLQPATWDEAIQLVASKLSTIKQDFGSNALAGFSSAKTTNEDNYAFQKFIRRELGTNNVDHCARLCHASSVTGLEASLGSGAMTNDIPSIKHSDVIFIIGSDTTSAHPIIASHIKQAIRHHGARLIVADPKRVDMAEHAELYLAHRPGTDVMLLNGVMQQIIKNGWYDQEYIEERVDGFDTLLQEVMSPAYNLDKVELVTGVKADDIFAMARMIGTAKRTAVYYSMGITQHTTGHDNVRSIANLQLLCGNIGIEGGGINPLRGQSNVQGACDMGALPNCYPGYQKVYNPIVRQKFAIEWDAPNLPSEQGLTLTEIIDAACKREVRGMYIMGENPVLSDPNQAHVIEGLEALDFLVVQDIFLTETAQYADVVLPSCSFAEKSGHFTNTERRVQRVNAAVKAPGEAKEDWWIIQAIANAMGSDWHYQCVSEITSEIARVTPQYAGLRWDAITPNGVQWPSNKNNPNGTRIMHQTQFTRGKGQMVGVPFRYAAELPDEEYPLVLTTGRVLEQFHTGTMTRKTKGLDNLAGPRAMISVEDAEAIGIHNGQRLKVSTRRGNIEIDAFVTKRMQKGVVFIPFHFVESPVNRLTTTATDPHAKIPEFKVAAVKIEISETAAQPEPVEEAVHHV

SEQ ID NO: 55832 - protein, 111 aa, Gluconobacter oxydans 621H
MSETVFQHIQNLIDANPVMLFMKGDKLFPQCGFSARVVQILTHLGVPFETCNILESAELRQGIKDFSQWPTVPQLYIKGEFVGGCDIVTDMYQSGELETLLTEKGITTANA

SEQ ID NO: 55833 - protein, 480 aa, Gluconobacter oxydans 621H
MTTPLWRTKPVSSAADSQTGLKRVLGPWQLVALGVGVTIGAGLFSLTGVAAGQNAGPAVTLSFVIAAVACGFAGLCYGELASMIPSGGSAYSYAYASMGELIAWIIGWDLVLEYTVGAAAVASSWSGYLASLLGGWGIHIDPRLLATPMTPVTMPDGSMASAWLNLPAVCALWGVTALLMRGVSESTTINTIVVCIKLAVIVAVIAACAPHISFEHYHPFIPQNTGTFGQFGMSGVMRAAGMAFFAYLGFDIVSTTAQDSRNPARDIPIGILGSLLVCSVVYAVFSMVLTGVVDYRAMANDPSPVATAIDVAGMPWLASLVKLGITAGYISVLFGLLMGQARVFLIMSHDGLLPPVFSKLNARTHTPWTSHLMFAALTSVFAAVLPIGQLGNMTSIGTLLAFIIVCIGVPVLRHRYPEAPRQFRVPGGLLVPVLGILSCGAVMVSLDRLTWIRLVVWLAIGLAVYFAYGIRNSRLCRSES

SEQ ID NO: 55834 - protein, 414 aa, Schizosaccharomyces pombe 972h-
MSLSTKLAITDVDLKGKNVLIRVDFNVPLDGDRITNNARIVGALPTIKYALEQQPKAVILMSHLGRPNGARVAKYSLKPVAAELSKLLGKPVKFLDDCVGPEVEKACKEAKGGEVILLENLRFHIEEEGSAKVDGKKVKADASAVEAFRKSLTSLGDIFVNDAFGTAHRAHSSMVGVDLPRVSGFLMKKELDYFSKALENPARPFLAILGGAKVADKIQLIDNLLDKVNRLIICGGMAFTFLKVLNGMKIGDSLFDEAGSKNVESMMAKAKKNNVEVFLPVDFVTADKFDKDAKVGSATAEEGIPDGWMGLDCGPKSSAKFAEVITTSKTIVWNGPAGVFEFDNFAKGTKSMLDACVKTCEAGNVVIVGGGDTATVAKKYGKEDALSHVSTGGGASLELLEGKALPGVVALSSK

SEQ ID NO: 55835 - protein, 401 aa, Synechococcus sp. RS9916
MGTRWRGAALMLRPSLLSNRAIALQPSLTLAISARAAAMKQAGRDICSMSAGEPDFGTPEFIVEAAIKALRDGVTRYGPAAGDPQLREAIANKLTRDNGIPSTAANVLVTNGGKQAIFNLFQVVLNPGDEVLIPSPFWLSYPEMARLAGAEPVTVPASAETGFRLDLEALEAAITPRTRLLVINTPGNPTGRVSDRDELLALADMVRRHPQLLVMSDEIYEYLLDEGVEHHSFAAVAPDLAERTFVVNGFAKGWAMTGWRLGYLAGDSAVIKAASALQSQSTSNVCSFAQRGALAALMESKDCVRSMATSYNSRRSQLVTGLQAIDGLTLVKPKGAFYAFPKLPEHVEGSMQFCEVALEQEGLALVPGLAFGDDRCIRLSCAVSRETIDDALSRLGRLLSA

SEQ ID NO: 55836 - protein, 306 aa, Chaetomium globosum
MASAVLNSTISGLTSSASITTVFEEVSKYNVQLNVFERLWAAWYLWMQNDTIATGIMSFVMHEFVYFGRSLPWIIIDAIPFFNKYKLQNTKVPTWKEQWECAGLVLLSHCTVELPQIWLFHPVATYFGLDYGVPFPPAWKMAMQIAIFFAVEDAWHYWMHRALHYGPLYKSIHKLHHTYSAPFGLAAEYASPIEVMLLGFGIVGTPIIWVSITGELHLITMYLWIVLRLFQAIDAHSGYDFPWSLRRILPFWAGADHHDLHHERFIGNYASSFRWWDYCLDTEAGEAASKQRRERKLAEIRAKKAQ

SEQ ID NO: 55837 - protein, 323 aa, Prochlorococcus marinus str. MIT 9515
MNTVTELLQPVENDLDDLILELKNLIGAGHPILQAAAEHLFSAGGKRLRPGIVLLISKAISRDFNLTTKHKRLAEITEMIHTASLVHDDVVDEASTRRGVDTVHSRFNTRVAVLAGDFLFAQASWHLANLDNVKVVKLLSRVIMDLAEGEIKQNLNRFDSGQTFSKYINKSYCKTASLIANSTKAAGVLSNLEDDKLNCLYEFGKNIGLAFQVVDDILDFTGNDKQLGKPAVSDLASGYLTAPVLYALEENKNLSVLINRELVEKEDLNNALNIVMNSQAIQRSRKLAEDFAVLSKEAILWLPNSEYKRALLALPEFVLSRIS

SEQ ID NO: 55838 - protein, 302 aa, Gibberella zeae PH-1
MYGQRKGIQMSNILGDPFALATLSISTLAWFITFVSCIIGRIQQNGDDDLAKNDPFPTFVWWSCIYCLCLITGVFVVIGSDAVHTYHVAVTGYLAAGIVLVSSSINQLLYSNSGAREAASAGFILLAMVIVIWTFYFGSNPSSTPRAFLDSFALAKESTTIHRSTMNAYGGRPETSNSVQPPQMYTSAQLNGFENPSPVGGIAGPRGSAVPQSYTNSGMQQQPPQSKPGHSPGNDTEVVPPTEYPYRAKAIYSYEANPDDANEISFSKHEILEVSDVSGRWWQARKESGETGIAPSNYLILL

SEQ ID NO: 55839 - protein, 352 aa, uncultured bacterium
ITSANNLLAAALDNHLQQGNTLGIDPKRVVLRRCLDMNDRALRNIVIGMGKRMDGVVREDHFIITVATGVMAILCLAEDINDLSERLSRIIVAYTYQGKPVTAADLKVVGAMTVLLKDAIRPNLIQTLEHTPAIVHGGPFANIAHGCNSVRATKTALRSADYVVTEAGFGADLGAEKFLDIKCRMAGLTPDAAVLVATVRALKYNGGIPKDQLSDENLEALEKGICNLGKHIENLKKYGLPLVVTLNRFVSDTDAEIEYVRNYCAERGVKLTVSEVWAKGGEGGAELAEEVLRLLEEEKSDYHPIYDTALPLEEKIRVIATEIYGAKDVEYTAEARKALADLTALGFGEMPV

SEQ ID NO: 55840 - protein, 355 aa, uncultured bacterium
LTSTINLISAVIENSVFQGNLLNINPDRIVWTRALDMNDRSLRDITVTSSDSKHSITHKSEFVITVASELMAIFCISNDEEEFLNRTEDIIVAYTYDEKPIRVRDLHIRGAIYKLMHQAMNPNLVQTLEANPVLVHGGPFANIAHGCNSVIATKLGLKLADVVVTEAGFGADLGAEKFLDIKCQRAGLKPDAVVVVATVRALKLHGGVKFEELDKENVEAMKAGECNLWKHRENMSLYSNKVVIAINRFPSDTDNEINTLLEDIKAKGWVGVINTGALEGGKGAEELAKAVKACLEENDSTFSPLYDIKDEKLSIKDKIERICTKIYGAGQVVYTDLANEQIKQYTDMGYQNLVV

SEQ ID NO: 55841 - protein, 352 aa, uncultured bacterium
ITSAHMLLSAMLDNSIQQGNPLNIDPRRIIWKRVVDMNDRALRNIVIGLGGKAHGVPREDGFDITVASEVMAILCLASNLHDLKERLKRIVVAYNYDGKPVTAEDLHAAGAMAALLKDAVKPNLVQTLEHVPAIIHGGPFANIAHGCNSVMATRTALRLADFTITEAGFGADLGAEKFFDIKCRQAGLAPDACVLVATVRALKMHGGVAKADLKEPNVEAVKKGLPNLGKHIENIFKFGVPVVVAINIFAQDTKEELQAVYDYCAGMGVNVALSDVFAKGGEGGAELAKEVVALAESGMARFKPVYPLDIPLRKKVETIVKEIYGGDRVEFQAKAAQALDQYEKEGYGNLPV

SEQ ID NO: 55842 - protein, 369 aa, marine gamma proteobacterium HTCC2143
MKSRAAVAWEAGKPLTIEEVDVEGPKQGEVLVRIVATGVCHTDAFTLSGADPEGVFPAILGHEGGGVVEEIGRGVTSVAVGDHVIPLYTAECGVCKFCLSGKTNLCQAIRVTQGQGVMPDFTSRFSLNGKPIYHFSGTSTFSEYTVMPEIAVAKINKAAPLDKVCLLGCGITTGIGAVLNTAKVEPGSTVAIFGLGGVGLSVIQGAVLAKASRIIVVDINEDKFEMAKMLGATDFINPKNYDDPVQDVIVDLTDGGVDYSFEAIGRTETMRSALECCHKGWGESTIIGVAGSGQEICTRPFQLVTGRVWRGSAFGGVKGRTQLPGYVDRYLKGEIKVDEMITHTMGLEDINRAFDLMHSGESIRSVILY

SEQ ID NO: 55843 - protein, 353 aa, uncultured bacterium
IGAANNLLAAMLDNHIQQGNALGIDVKKITWKRCVDMNDRQLRFVVDGLGGRANGTPREDGFDITVASEIMAVFCLASSMADLKERLSRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPNAVVVVGTVRALKMHGGLDKKQLANEDLAALERGIPNLLRHVHNITNVYQLPCVVAINRFPTDTDAEIDFIVKKCRELGVNTILSTVWAEGGKGGEDLASEVVRLCEEEKGNFTFSYELDSSIEEKLEAVAKKIYGGAGVVLTPAAKKQAERLTALGFDRMPV

SEQ ID NO: 55844 - protein, 429 aa, Agrobacterium tumefaciens str. C58
MTEKSATVTLGEKQVELPVREGTIGPSVVDIATLYKHTGSFTYDPGFTSTASCESKITYIDGDEGVLLHRGFPIEQLAEQGDFLETCYLLLYGELPTAAQKKDFDTRVTRHTMVHEQMSRFFTGYRRDAHPMAVMCGTVGALSAFYHDSTDITDPHQRMVASLRMIAKMPTIAAMAYKYHIGQPFVYPKNDLDYASNFLHMCFAVPCEDYKVDPVLARAMDRIFILHADHEQNASTSTVRLAGSSGANPFACIAAGIACLWGPAHGGANEAALNMLNEIGSVDRIPEYIARAKDKNDPFRLMGFGHRVYKNYDPRAKIMQKTMYEVLEATGNSDDPIMQVALELEKIALSDPYFVEKKLYPNVDFYSGITLKALGFPTTMFTVLFALARTVGWIAQWNEMIEDPQQRIGRPRQLYTGAGKRDYVPVSKR

SEQ ID NO: 55845 - protein, 353 aa, uncultured bacterium
IGAANNLLAAMLDNHIQQGNALGIDVKKITWKRCVDMNDRQLRFVVDGLGGRANGTPREDGFDITVASEIMAVFCLASSIKDLKERLSRIIVAYTYDDKPVTAGDLKATGAMAALLRDALKPNLVQTLEGIPAFVHGGPFANIAHGCNSVMATRMAMRMGDYTVTEAGFGADLGAEKFLDIKCRMAGLTPDAVVVVGTVRALKMHGGLDKKQLASEDLEALERGIPNLLRHVNNIKNVYQLPCVVAINRFPTDTDAEIDFIIRKCRELGVNTVLSTVWAEGGKGGEDLAREVVRLCEEEKGNFTFSYELDASIEEKLEAVTKKIYGGAGVMLTPAAKKQAERLTELGFDKMPV

SEQ ID NO: 55846 - protein, 317 aa, Methanococcus maripaludis S2
MVFDREILSKIDSELKKYMEKDTKLYGASKHLLLAGGKRVRPYLSILTYLLKKDELTEIMAPALSVELIHNYTLVHDDIMDNDDQRRGIPTVHTVYGEPIAILAGDLLYAKAFEALSNIEDSNKAHEVLKVLSKACVEVCEGQTEDMEFEERFPTLDEYLEMISKKTGALIVAPVEIGAVMADCTPEEREALCNYAKRIGMTFQIQDDVLDLIGDQKTIGKPVGSDIVEGKKTMMVIHAMENLSEDKKERLLQILGNQDANQQEVAEAIELLADSINYAKDTMKNATEEAKDYLKIFDAEKRKNLENIADFIIERIH

SEQ ID NO: 55847 - protein, 227 aa, Zea mays
  misc_feature (163)..(163): Xaa can be any naturally occurring amino acid
  unsure (1)..(227): unsure at all Xaa locations
SKTFHFHGVLHIAPHVSVSAPPFAPCGGVPGPPLCRKTTLSRQASAGSAGAAQSTTPHYYCPAPLYSPVLLRPPAARSPPRKPAANSWPHRHRNEDLTGGRAGVRRGGGGGAMEASRRGRFHRHDGPAAPVPVVDQADCTAQTCRSCVAVTLADAIALGCCPXCAVVSLLGLALVKAPLALARRCLRRLRGELRHRKRVRDMHGPADKAKCRSSDAGAASRGAWALE

SEQ ID NO: 55848 - protein, 68 aa, Triticum aestivum
MPEHMMSTPRFPDIASVQLRMPNLHFLPVNLGGKENPGLVKFADDVYMPTDEPHGTIEATLSRANSKL

SEQ ID NO: 55849 - protein, 343 aa, Solanum lycopersicum
MDVRRRPVKPLCTSKDASAGEPLKQQQVSSPKASDALPLPLYLTNGLFFTMFFSVMYFLLVRWREKIRNSIPLHVVTLSELLAMVSLIASVIYLLGFFGIGFVQSFVSRSNSDSWDIEDENAEQLIIEEDSRRGPCAAATTLGCVVPPPPVRKIAPMVPQQPAKAALSQTEKPAPIIMPALSEDDEEIIQSVVQGKTPSYSLESKLGDCMRAASIRKEALQRITGKSLEGLPLEGFDYESILGQCCEMPVGYVQIPVGIAGPLLLDGREYSVPMATTEGCLVASTNRGCKAIFVSGGANSILLRDGMTRAPVVRFTTAKRAAELKFFVEDPLNFEILSLMFNK

SEQ ID NO: 55850 - protein, 201 aa, Solanum lycopersicum
LALVLCISLTSVTNAQQCGRQRGGRLCGGNLCCSQFGWCGSTPEYCSPSQGCQSQCRGGPTPTPTPGGGAQVRATYHIYNPQNVGWDLNAVSAYCSTWDANKPYSWRSKYGWTAFCGPVGPRGRDSCGKCLRVTNTRTGAQTTVRIVDQCSNGGLDLDINVFRQIDTDGVGNQQGHLIVNYQFVNCGDNVNVPLLSVVDRE

SEQ ID NO: 55851 - protein, 382 aa, Pseudomonas syringae pv. syringae B728a
MIDSKLPNVGTTIFTVMSQLAAETGAINLSQGFPDFDGPQALRDAVCRHVTQGHNQYSPMTGLPALRQQVAAKIARSYGRTVNPDSEITITPGATQAIFCAIHSVIRAGDEVIIFDPCYDSYEPAVELAGGRCVHVQLGLDDFSIDWQKLSDALSPRTRMIVINSPHNPSGALISRAELDRLAALIADRDIYLLSDEVYEHLVFDGARHVSVLDHEALYQRAFVVSSFGKTYHVTGWKTGYVVAPPALSAELRKVHQYVSFCGVTPLQYALADFMAEHPEHVDELPGFYQAKRDFFCGHLAESRFSFRPVGGTYFQLVDYSQIRPDLNDVDMALWMTREHGVASIPISVFYQSPPAGQRLIRLCFAKQEETLRQAAEKLCAI

SEQ ID NO: 55852 - protein, 425 aa, Silicibacter pomeroyi DSS-3
MSTIIDIHAREILDSRGNPTVEVDVVLEDGTMGRAAVPSGASTGAYEAVERRDGDKSRYMGKGVLEAVAAVNGEIAEELVGFDATEQVAIDAAMIELDGTENKGRLGANAILGVSLAVAKAAADFTAQPLYRYVGGTSARVLPVPMMNIINGGEHADNPIDIQEFMIMPVAAEDIRDAVRMGAEVFHTLKKELSAAGLSTGIGDEGGFAPNIASTREALDFVLKSIEKAGYKPGEDIYLALDCAATEYFKDGKYVLSGEGKTLSSDENVDYLAALVADYPIISIEDGMAEDDWAGWKALTDRLGGKVQLVGDDLFVTNPARLAEGITRGCANSMLVKVNQIGSLTETLKAVDMAHRARYTNVMSHRSGETEDATIADLAVATNCGQIKTGSLARSDRLAKYNQLIRIEEALGEVAEYAGRSILRG

SEQ ID NO: 55853 - protein, 361 aa, Oryza sativa (japonica cultivar-group)
MDVEATKDVGHEQAAVPGRGRAARWLLVALNCGMLVVGTTGGPLISRLYFSKGGHRQWLSAWLQTAGWPLLLVPVAASYLSRRARDRRAPLFLTPTRVLLAGVGLGFLNGADDFIYAYGLAYLPVSTSAILISTQLAFTVFFACLIVRQRFTAATLNAVALLTIGAVVLGLHASKDRPAGVTSGKYWMGFFLTLGAAALYGLILPLVELAYKHAAGGGRAVTYALVMEMQLVMGFFATAFCTVGMVVNKDFQAIPREAKQYELGEARYYVVLVFNAVLWEFFFVGAVGVIFCVHTLLAGIIIAVFIPITEVLGVIFLHEKFSSEKGVALVLSLWGLASYSYGEYADAKAKKKAALEAEEAS

SEQ ID NO: 55854 - protein, 240 aa, Prochlorococcus marinus str. MIT 9515
MIYSKYQFSNYCYWPSNPKKIIEFIGGSYLASKPDLTYKRFIKSLINKNYAVHAYRYTPQFDHQELAIKAWKDFKNCQRSLSKRIGISIPSIRIGHSLGCKLHLISPDGGRNCEKFISISFNNFSANRSIPFLKQFSQKLEFKSEFSPSPNRTYGIIEKTYTQKNNFLIKFNSDKLDQTDKLLSCLRARKEDNSKGIKLKGTHTIIASAGLRENLLGDWADDDLKRYTIKQISNLIENSI

SEQ ID NO: 55855 - protein, 444 aa, delta proteobacterium MLMS-1
MEKVTEFMKVVTDKNPGESEFHQAVLEVVETLMPFIEDNPKYQETKILERMVEPERVIIFRVPWVDDKGEVQINRGYRIQMNSAIGPYKGGLRFHPSVNLSILKFLAFEQVFKNSLTTLPMGGGKGGSDFDPKGKSDNEVMRFCQSFMTELYRHIGAETDVPAGDIGVGGREIGFMFGQYRKITNEFTGVLTGKSRNWGGSLIRPEATGYGAVFFAEEMFKVRGDSLAGKTCIVSGSGNVAQYTIEKVNQLGGKCVTLSDSAGFIHDPEGIDDEKLAYVMELKNVKRGRISEYAEKYGCKYYPGERPWKIPGDVAFPSATQNEIDAQDAETLVAGGCTCVSEGANMPSTSEAVRIFLKAKIMYGPGKAANAGGVATSGLEMSQNSLKLSWPREEVEERLRQIMEGIHEACYKYGKEGDFVNYVKGANIAGFVKVADAMIEQGVI

SEQ ID NO: 55856 - protein, 2062 aa, Streptococcus suis 89/1591
FLSGAGQLVQAEEVVLPASTSSTTLSEQDGGAVEATTTAIEATDSMVAEATAVTETADATAPEEAPIEEGSIRLHFENVDETAPESQGLWTWGGVAEPSDSNQWPTDTANFSSSQVDDYGHYVDIKKSETPGTIGYLVLKNGEKITESDQKVELLVPEQNEAWISSDYSVSSYEPLKDENVLRINYTREDNNYEGWGVWTWGDTTEASDGWPTGAVDFKLGKYGAYVDIPLSNGLDSKLGFLLINQNNPDLAGNKTIDLAFADRKRHSQIFLRNGDDKVYTNPYFIEEKVELDTSKATPGTKNVTVEASVKAPFNYNESGLVSVTVTNPENAEIVKMEVDTSAIGGGLVPISTELNRVTIKATSSTAPGTYSLPVKVYDKDNGYYETKLDVTITERVKADGEKDWDEQVIYFMMTDRFYNGDTSNDKLVEGTVTNPRGLYQGGDFKGVTAKLDYLKELGVDSIWLTPIVENIPQNVGSVKDGEYYAYHGYWASNFEKLNPHLGSLADFHELIDAAAEKGINIVVDVVLNHAGYGTEETFAGMVRTKEEDKQADDQLGSLSGLPDFKTEEAAVRNQLVAWQASWLERSTTAKGNSIYAFRVDTVKHVDDTTWQHFKNELVDRDPDFHLIGETWGANYKDTKGDLGIGTMDSLLDFGFKDIAKYLVNGQLKAAGKELEERSKVLTSAASLGQFLGSHDEDGFLYSLGGAEKEGNLDKLKLAASLLITAKGQPVIYYGEEVGQSGQNNWPVYDNRYDFDWSKVETSDITDHYQKLLAFRNANSTLLSRGDTSTLAGNDSQGWLISKRSYQDQAAYLVFSTNTESKEMALEVSSKDVVVTDAYTGKSYQAIEKGGKWVVQVELPTIGQGGTMLLQTEAGDIVNASVQGATEEPIEAGYFRVHFKTLPSDNLSSLGLWTWDDVEKPSSDVGAWPTGATNFSTAKQDDYGYYLDIKMKDETASKISLLINNTSGDNITGDKTIERISTKMNEAWFDENYQLSLYQPLKEGCIRINYFRTDGNYDQKGLWIWGDVTDLTLGDWPNGIDFENQGKYGAYIDVKLTDLPSSIGFLLLDESKSGDDVKIQQKDYSFKDLKNQTQIFLKDDDATIYTNPYFVNNVRVTGVSHVSLTALEAAFTTLEGADKDSILEKLSVTDKNGQTVAVTDLVLDLTSNKVRVLGDFNQENAGYTLKYGNDSFTTTMSWQLKDELYAYDGELGARVRQAGSVVDMTLWSPSADSVAVVLYDKDDQSKVVGKLAMTKGDKGQWDLELNSQSGLGIADYRGYYYHYEITRGGQSVLVLDPYAKSLAEWNSDLADTDPSYRIAKAAIVDPAEVGPSDLNYATIPNFNQREDAIIYEAHVRDFTSDPAISDELTAQFGTFAAFAERLSYLKDLGVTHIQLLPVMSYYFVNELKNAERMSEYASSNSNYNWGYDPQSYFAFTGMYSTDPTDPMKRIEEFKNLVNEIHKQGMGVILDVVYNHTSKTFLFEDLEPNYYHFMEADGTAKSSFGGGGLGTTHYMSRRVLVDSIKYLVDEFKVDGFRFDMMGDHDAEAIELAFTEAQKLNPNIIMLGEGWRTFTGDANQPVQPADQDWMSSTDTVAVFSDEIRNTLKSGYPNEGQPAFITGGAKSVESVFNNIKAQPGNFLADDPGDVIQYIAAHDNLTLFDIIAQSIKKDPSIAENYTEIHQRQRLGNLLVLTAQGTPFIHSGQEYGRTKQFRHPDYKEPVSEDKVPNKAHLLTNADGTPFDYPYYIHDSYDSSDAVNKFDWTKATDEALYPENTRTQAFTKGLIALRKSTDAFRLGTKEEVEQKVSLISIPGQNGIAKNDVVIAYQTIASNGDRYAVFVNADSKERSFVLSDIYKELLKGHVLVDGKRAGIAALTDLVGVTLTDDAVVLAPLTATVIRLPYITTAVPDTAPTAEEKPSLDFTTKERTEEKILPIVEEIRYDASLSTDQSYVLQEGKTGKKVLVYQDVLIDGKVVATNLLSETVVDSETRIVVKGSMEAKKEAEKPSLSTTAQASGQATSGASKASLPITGDRQSDLALLGLGLAGLGLTVAAQGRTKKSEE

SEQ ID NO: 55857 - protein, 506 aa, Gibberella zeae PH-1
MSRPRRRGHKDGGYGGQATTLSSVVNLLNTSFQVVGAGTLAMPSVMSHMGIMLGVILIIWSGLTAAFGLYLQSRCARYLERGTASFFALSQITYPNAAVIFDAAIAIKCFGVGVSYMIIIGDLMPGVVLGFLSNANSAPYLVDRNFWITAFMLLIIPLSFLRRLDSLKYTSIVALVSIGYLIVLVIYHFASDKHADPGSIRVIQWGGAIETLSALPVVVFAYTCHQNMFSILNELKDNSPRSVVGVIGTSIGSASSIYIVVAITGYLTFGNAVVGNIVSMYPTGAASTIGKAAIVVLVTFSVPLQVHPCRASLDAVLKWRPNRNSSNNGRTATPLLPASPPGDHGSTAPMSDLRFAVITTFILTFAYMTALSVTSLDRVLAFVGSTGSTSISFILPGLFYYKISNPDSTYHQRLVKEDDDIDEDSSTSDVEESAALAQSTTSVRSGVSVVSNASTRSNRNSWRWRRKWRWDLEHIEHHHLRRMALALAIYGAVVMSTWYWVALQYK

SEQ ID NO: 55858 - protein, 254 aa, Zea mays
MNSQTIKRDQSNNFSEDEDLMLVSSYLNVSKDSITGRDKKEGTFWERVWKYYNQNRTFESDHSWSSLKHRWLAIQKEVNIFQGYYDAIERKNQSGQTSDDKHAEAEVEFREKQGKAFSVFHVWMILRHEPKWAFRESKIKDQHEANNANTDAPAKIYRPQGRKAEKEKARVRKHGGSDVNGDPFIKGVKNMREAREETERDRKTRDDKFYELEKSKLELEIMQTDTSTMDEESKQYFKLMKQEILARRFGSSQP

SEQ ID NO: 55859 - protein, 364 aa, Kluyveromyces lactis NRRL Y-1140
MAFWWKKSPKTPSDYVRHLIEQLDKLESSSIGSDNRKKAQDECGRHIAGTKHFLLKETDPVPTQEALDELYYSIYQSDLFFMLLHSFPNLDFEARKDVAMIYCICLGRSKDNKLPTVDYLLAKPKFMSTLLKTSETCITKPGGSDIFLTASGMILETIKQEQLCRIIIRDPQIWKYFDFTRLGSFEISSSSLQVLTELFTAHPKLVSTEFFCNEENLTRFIDKINKLMAHGNYVTKRQSVKLLGTLIFNRINKTLMTTYINNSDNVKLVMILLSDRSKNLQLESFNIFKVVVANPRKSKPVLDVLVKNRDKLLNFFEQFGTDNKDSTFLDEKEFIVEQIEALPRIVAANGEYALGTSPQKNLVM

SEQ ID NO: 55860 - protein, 328 aa, Capsicum annuum
MASQSFVPPIFENPFLNIEELAGDTIVRKPEPLTQANSDPNGTSLVVSKDVDLDINKKTWLRIYVPQRIITNHNDDEKLPVIFYYHGGGFVFFHANSFAWDLFCQGLAGNLGAMVISLEFRLAPENRLPAAYDDAMDGLYWIKSTQDEWVRKYSDLSNVYLFGSSCGGNIAYHAGLRVAAGAYKELEPVKIKGLILHQPYFSGKNRTESEEKLKDDQLLPLHAIDKMFDLSLPKGTLDHDHEYSNPFLNGGSKHLDDVIAQGWKILVTGVSGDPLVDNARNFANFMEEKGIKTFKLFGDGYHAIEGFEPSKAAALIGATKDFICATTN

SEQ ID NO: 55861 - protein, 409 aa, Synechococcus sp. WH 5701
MPISERVTRLGQGVFARNDRRKIAYGEGLLNPELPAGRPPLLDLSLGSTDLAPPPVALEAMASALQQPSSASYCLHGATLPFREAVAAWAQRRFGVTVDPEREVLLLVGSQEGTAHLPLAVLNPGEPALLLDPYYPSHRGGLLLASACTELLPLRADQGWRPPFEAISLVAWDQLRLMVLGFPHNPTATVGEQAWLDQAVARAQRHGFVLAHDNPYVDLALEGEAPALLRNPHWRSCGIEFFSFSKSWCLGGFRLAFAIGAEPLITALRQLKGVVDFNQSLALQAGAIAALEQAPEWPAQLRKVYRLRRDRMASALEAQGWALQRPSMALYLWLGLPEVALARGLDSESFCAALLEATGVALTPGNGFGPSGEGWMRLALVHPVEELEAGAERIGEWLRSLNGPLSPSH

SEQ ID NO: 55862 - protein, 455 aa, Zea mays
CSAQHFRSCTARPTPQPVLKRKTLYFARRGHNISDLQSSSPRCASLDLLASMAPVRGAKKRKRPEKPAPAPTPGLPLPPLPDGSDWWGVFYRRVAGHSPFPREHQNMESVLKMSRRTFDYICSLVKKDLTTKTYGFRNFRFGDKKVLGVEDQVAVALMRLTTGESLQNIGMWFGMNHSAISNITWRFIESVEERAICHLKWPSPEEMATIKTRFDKVYGLPNCCGAIDTTHILMCSSAQPNSKVWLDNENKNSMVLQAVVDADLRFRDVVSGWPGSMDDTCILRTSGLYRLCEKGLRLGGQMELPGGSAVREYLVGDASYPLLPWLMTPYREHGLQAAKVEFNKRHTAAAAVVQTALATLKGRWRVIQGELWRPDKHRLPRIIFVCCLITNIIIDMEGTPSRDELVSGNHDLGYKQQFSDAADDNAIKQRDDLSRHVDNAIKRRDDLSHHVTAGE

SEQ ID NO: 55863 - protein, 461 aa, Bacillus halodurans C-125
MAMVEDTRPEHTYAEQTPRSKSWIEQAKKVMPGGITANIKHFAPYPIVMKKGCGAFITDVDNHQYVDYLLAYGALMLGHGHPEVKQAIDEMFADSGTLLFGAPHPLEVTFGHEIQQLYPSMERLRYTNSGTEATLLAMRIAQAYTNKKRIAKFEGHYHGGYNDVLYSVSPTLSEAGPADAPIPVKESKGMHVTDGEEPLILPFNNLTACERLLRAQQDSIAAVMIEPLQGGFIPATDTFIAGLRELTEELGIVLIFDEVKTGFRIRLGGAQEWYGVSPDLTTLGKVIGAGFPFGIVGGRKDIMEVTSPTTGSDVFDQSQSTFSRAKDVVFHSGTYNGHPLILAAGLKTVDVLKRDIKDVFARTDMLKDELEALFVRKGVPMKAVGIGSIFSVVLTEEDIFNYRDLQASDLQTRKLIDLHLLNEGIYTKPLNRYSLSTAHTEREVERTISAYDRVLSRLFGG

SEQ ID NO: 55864 - protein, 291 aa, Schizosaccharomyces pombe 972h-
MSLITFKAGKLRRVPGTKLLRADPEKGYIVMNRDAYGLIHFQWAKRNDLENPEDDIIVFSSECTFEKVTECTTGRAYMLKYPSSAHSLFYWMQEASDDNDTSYAERINSYIKDQDLLDPARSDVATVSDMMEVDTVEQSEPIAQPTESSKESSEIGAPNSDEINSSEAVRNLLATISAQAGFGGSTVDLCEILKPSNLTDLLCQEGVIDRLMPYMPPDTPNNLEGVLAIVSSPQYAQALRSFSQALNSPGGVNIISALGLSLDESANPNEGGALQFLKAIARFVSRNNGSE

SEQ ID NO: 55865 - protein, 352 aa, uncultured bacterium
ITSANNLLAAMLDNHIRQGNELGIDPRQVIWKRCLDMNDRNLRNIVVGLGNKMDGMVREDHFVITVASEIMAILCLADDIADLKARLSRIIVAYNFKGEPVTAGQLKATGAMAALLKDALKPNLIQTLEHTPALVHGGPFANIAHGCNSVRATKMALKLADITITEAGFGADLGAEKFLDIKCRKAGLKPDAVVLVATIRALKYNGGVPKAETSKENLEALRKGIVNLEKHIENIQKYDVPVVVTLNSFVSDTQAEYDYIRNFCEEKGCEFALSEVWAKGGDGGIELAEKVLETLETKESHFHPLYEDNLSLKEKIEVISTEIYGADGVVYEPSAAKQLAKIESMGFGNLPV

SEQ ID NO: 55866 - protein, 377 aa, Glycine max
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNAPAMYVAIQAVLSLYASGRTTGIVLDSGDGVSHTVPIYEGYALPHAILRLDLAGRDLTDFLMKILTERGYSFTTSAEREIVRDMKEKLAYIALDYEQELETSKTSSSVEKSYELPDGQVITIGAERFRCPEVLYQPSMVGMEASGIHETTYNSIMKCDVDIRKDLYGNIVLSGGTTMFPGIADRMSKEISALAPSSMKIKVVAPPERKYSVWIGGSILASLSTFQQMWIAKAEYDESGPSIVHRKCF

SEQ ID NO: 55867 - protein, 350 aa, uncultured bacterium
GAANNLLAAMVDNHIYQGNELDIDPRRITWHRAVDMNDRQLRNAVDGLGGKAQGYVREDHWDITVASEVMAVFCLSTSIDDLKERLARIVIGYSRAGKPITAGDLNAQGAMAALLKDALKPNLVQTLEGTPAFVHGGPFANIAHGCNSVLATQMAMHFADYVVTEAGFGADLGAEKFMDIKCRMAGLKPDAVIIVATVKALKYNGGVPKADVQKENLEALEAGIPNLLKHVENIKNVFGIPAVVALNKFVTDTDAEIELVTRKCKELGVNVKLSEVWGKGGEGGLELAEEVIRLCDQPSELHYAYELDMPITEKIEAIATKVYGADGVDFAASAKKEIDNLTKMGYDKIR

SEQ ID NO: 55868 - protein, 260 aa, Sinorhizobium meliloti 1021
MNQPSPVALITGAGSGIGRATALALAADGVTVGALGRTRTEVEEVADEIVGAGGQAIALEADVSDELQMRNAVRDLVLKFGHLDIVVANAGINGVWAPIDDLKPFEWDETIAVNLRGTFLTLHLTVPYLKQRGGGAIVVVSSINGTRTFTTPGATAYTATKAAQVAIVQQLALELGKHHIRVNAVCPGAIETNISDNTKLRHEEETAIPVEWPKGQVPITDGQPGRSEDVAELIRFLVSERARHVTGSPVWIDGGQGLLR

SEQ ID NO: 55869 - protein, 417 aa, Oryza sativa
  misc_feature (100)..(100): Xaa can be any naturally occurring amino acid
  unsure (1)..(417): unsure at all Xaa locations
VFAFLGACQAWGVLLVARCGGANKRKGEGLGEMHDDVLERVLARLPPASYFRLRGVCRLWSDAASSPTFLAACGRVPARDPWMLMLTEGEGQERRLPAVXAFDASQGEWARCGGAPEHEMPVVAASGGRVLYRAPDTGELTVANPLTGASRVLPAPPPGAALHAVAMYGSSPYRVVLITGDLPDLSMTVFDSSKNAWDDAVALSRKPDASSPERDAEGGVGGGGGGGDDETVYFLSKSGDVMATNMQRSASRQYSSAVTCGDGGEAVAYFLSNSGAVVACELSRRAFAELPRILPVYFEYSIDVVACGGRAYVVVLSELLGTASLRLWEFAGGAWRQVAAMPPAMSHAFHGKKADVNCVGHGDRVMVCVSSGEANGCFMCDVPTNRWEELPPCAGAGGEPMDFVAAFSFEPRMEVTV

SEQ ID NO: 55870 - protein, 352 aa, uncultured bacterium
ITSANNLLCAMLDNHLLQGNELRIDPKRVVIKRCLDMNDRALRNITVGLGKRLDGVVREDHFCITVATEVMAILCLAENLEDLKARLGRIIVAYNYDNEPVTAADLKAVGAMTVLLKDAIRPNLIQSLENNPVFVHGGPFANIAHGCNSVRATKLALKAADYVITEAGFGADLGAEKFLDIKCRMAGIKPDAVVLVATARAMKYNGGIPKDELNNENVEALKKGIVNLGKHIENLKKYNVPVVVTINKFVADTDAEVAAIKEFVEAQGCRFAISEVWEKGGEGGLALAEQVLDAIEEGSPNFKFLYEDSLSLTEKIETISKEIYGADGVEYSPEAVNALKRIESLGFGNAPV

SEQ ID NO: 55871 - protein, 390 aa, Crocosphaera watsonii WH 8501
MATLLEQLREFTVVVADTGDIQAIETFTPRDATTNPSLITAAAQMPQYQSIVDDTLKTARKELGKDADESAVVTLAFDRLAVAFGLKILEIIPGRVSTEVDARLSYDTEATLEKARYLISEYEKAGVSRDRILIKIASTWEGIKAAEVLEKEGIHCNLTLLFGMHQAVACAEANVTLISPFVGRILDWYKKETGKEYAPTEDPGVMSVTTIYNYYKKFGHKTEVMGASFRNIGEICELAGCDLLTISPKLLDQLNSTEETLPRKLDPEAAAKMDIAKIAMDKAIFDKMHQEDKMAYEKLDEGIKGFTKALETLEEMLKERLTRIEGETRVNNAAADIFRVYDLDGDGFITREEWAGTDVVFDAIDINHDGKITPEEMAAGLGAAICLVEA

SEQ ID NO: 55872 - protein, 352 aa, uncultured bacterium
IGAANNLLAAMLDNHTYQGNKLGIDPRRITWRRCVDMNDRQLRFVVDGLGGRVNGTPREDGYDITVASEIMAVLCLANSLSDLKARLSRIIVGYTYDELPVTAGQLNAAGAMTALLKDALKPNLVQTLEGTPAFVHGGPFANIAHGCNSVIATKMALKLGDYTVTEAGFGAGLGAEKFLDIKCRYAGLTPSAVVVVATIRALKMHGGLAKTELGTENLEALEKGLPNLLRHVSNMKNVYKLPCVVAVNRFPTDTDAEVALVIEKCRELGVNVRLSTVWADGGAGGTELAEEVVRLCEEPNNFSFSYDLDGSIEEKIEAVVKRVYGGAGITIMPKAKKAIDTLTSLGYGNIPV

SEQ ID NO: 55873 - protein, 525 aa, Mycobacterium tuberculosis CDC1551
MVQPADIDVPETPARPVLVVDFGAQYAQLIARRVREARVFSEVIPHTASIEEIRARQPVALVLSGGPASVYADGAPKLDPALLDLGVPVLGICYGFQAMAQALGGIVAHTGTREYGRTELKVLGGKLHSDLPEVQPVWMSHGDAVTAAPDGFDVVASSAGAPVAAFEAFDRRLAGVQYHPEVMHTPHGQQVLSRFLHDFAGLGAQWTPANIANALIEQVRTQIGDGHAICGLSGGVDSAVAAALVQRAIGDRLTCVFVDHGLLRAGERAQVQRDFVAATGANLVTVDAAETFLEALSGVSAPEGKRKIIGRQFIRAFEGAVRDVLDGKTAEFLVQGTLYPDVVESGGGSGTANIKSHHNVGGLPDDLKFTLVEPLRLLFKDEVRAVGRELGLPEEIVARQPFPGPGLGIRIVGEVTAKRVDTLRHADSIVREELTAAGLDNQIWQCPVVLLADVRSVGVQGDGRTYGHPIVLRPVSSEDAMTADWTRVPYEVLERISTRITNEVAEVNRVVLDITSKPPATIEWE

SEQ ID NO: 55874 - protein, 353 aa, uncultured bacterium
AITSAHMLLSAMLDNSIQQGNPLNIDPRRIIWKRVVDMNDRALRNIVIGLGGKAHGVPREDGFDITVASEVMAILCLASNLHDLKERLKRIVVAYNYDGKPVTAEDLHAAGAMAALLKDAVKPNLVQTLEHVPAIIHGGPFANIAHGCNSVMATRTALRLADFTITEAGFGADLGAEKFFDIKCRQAGLAPDACVLVATVRALKMHGGVAKADLKEPNVEAVKKGLPNLGKHIENIFKFGVPVVVAINIFAQDTKEELQAVYDYCAGMGVNVALSDVFAKGGEGGAELAKEVVALAESGMARFKPVYPLDIPLRKKVETIVKEIYGGDRVEFQAKAAQALDQYEKEGYGNLPV

SEQ ID NO: 55875 - protein, 359 aa, Mycobacterium tuberculosis CDC1551
MRGTDEKYGLPPQPDSDRMTRRTLPVLGLAHELITPTLRQMADRLDPHMRPVVSYHLGWSDERGRPVNNNCGKAIRPALVFVAAEAAGADPHSAIPGAVSVELVHNFSLVHDDLMDRDEHRRHRPTVWALWGDAMALLAGDAMLSLAHEVLLDCDSPHVGAALRAISEATRELIRGQAADTAFESRTDVALDECLKMAEGKTAALMAASAEVGALLAGAPRSVREALVAYGRHIGLAFQLVDDLLGIWGRPEITGKPVYSDLRSRKKTLPVTWTVAHGGSAGRRLAAWLVDETGSQTASDDELAAVAELIECGGGRRWASAEARRHVTQGIDMVARIGIPDRPAAELQDLAHYIVDRQA

SEQ ID NO: 55876 - protein, 642 aa, Arabidopsis thaliana
MKKKQAGPQQTCEFVSYKTLLISPSHLSRHLTTSLLSPLSPPWRDYSFPPMDLRRRPPKPPVTNNNNSNGSFRSYQPRTSDDDHRRRATTIAPPPKASDALPLPLYLTNAVFFTLFFSVAYYLLHRWRDKIRYNTPLHVVTITELGAIIALIASFIYLLGFFGIDFVQSFISRASGDAWDLADTIDDDDHRLVTCSPPTPIVSVAKLPNPEPIVTESLPEEDEEIVKSVIDGVIPSYSLESRLGDCKRAASIRREALQRVTGRSIEGLPLDGFDYESILGQCCEMPVGYIQIPVGIAGPLLLDGYEYSVPMATTEGCLVASTNRGCKAMFISGGATSTVLKDGMTRAPVVRFASARRASELKFFLENPENFDTLAVVFNRSSRFARLQSVKCTIAGKNAYVRFCCSTGDAMGMNMVSKGVQNVLEYLTDDFPDMDVIGISGNFCSDKKPAAVNWIEGRGKSVVCEAVIRGEIVNKVLKTSVAALVELNMLKNLAGSAVAGSLGGFNAHASNIVSAVFIATGQDPAQNVESSQCITMMEAINDGKDIHISVTMPSIEVGTVGGGTQLASQSACLNLLGVKGASTESPGMNARRLATIVAGAVLAGELSLMSAIAAGQLVRSHMKYNRSSRDISGATTTTTTTT

SEQ ID NO: 55877 - protein, 381 aa, Oryza sativa (japonica cultivar-group)
MASSTQGQVITCKAAVAWEANRPMTIEDVQVAPPQAGEVRVKILFTALCHTDHYTWSGKDPEGLFPCILGHEAAGIVESVGEGVTEVQPGDHVIPCYQAECRECKFCKSGKTNLCGKVRAATGVGVMMNDRKSRFSINGKPIYHFMGTSTFSQYTVVHDVSVAKINPQAPLDKVCLLGCGVSTGLGAVWNTAKVEAGSIVAIFGLGTVGLAVAEGAKSAGASRIIGIDIDSKKFDVAKNFGVTEFVNPKDHDKPIQQVIVDLTDGGVDYSFECIGNVSVMRSALECCHKGWGTSVIVGVAASGQEISTRPFQLVTGRVWKGTAFGGFKSRSQVPWLVEKYLNKEIKVDEYVTHSMNLTDINKAFDLLHEGGCLRCVLATDK

SEQ ID NO: 55878 - protein, 526 aa, Candidatus Desulfococcus oleovorans Hxd3
MYTLGDISTNGAVHFPDWEAIVFEETRMTYRQLNTRVNRLANALTALGCKKGDHLAVLAENCSQYVEIYFAAAKIGACVCPQNHRLADEELTYVINHGESTLFLVGHGFEDRACSIQSGLTNIRYWISIENFIDGYLSYEELIKTHPDTEPVPESPVDEQDLAILMYTGGTTGLPKGVMLTHRNLMTTTANAVLTAATALANLGPGRRFSTCMVLPMFHVSLWPVLLTLSIGGKAVINRKMDLGEILRLIQDEECAHINLVPTIYGWLVDYPDADKYDISSLIYMTYAGSPFPTEVLKKCIRRFGNIFSQGYGATETAGGAATMLSYQDHEIEGSRSRLLASAGKTAPCSRIKIADDEGRALPYGQSGEICVTGKHIMAGYWKDPVKTAEALRDGWYHTGDMGYMDEDGYVFLTDRKADMIISGGENVYPKETEDVLYQHEAVAECSVVSAPDPRWGEIVKAVVVLQPGKTATEEELIAFCKERLAGYKCPKSIVFWDNLPTSIIGKVLKKEIKATFWQGQDRKIG

SEQ ID NO: 55879 - protein, 525 aa, Pseudomonas syringae pv. syringae B728a
MALDIHAHRILILDFGSQYTQLIARRVREIGVYCELHPFDMDDEAIREFAPKGVVLAGGPESVHEADSPRCPQAVFDLGVPVFGICYGMQTMAEQLGGKVAGSELREFGYARVDVVGKSRLLDGIEDHIDADGLFGLDVWMSHGDKVTKLPENFHILASTPSCPIAGMADDARGYYGVQFHPEVTHTKQGGRILSRFILDICGCEALWTPSKIAEDAIAQVRAQVGTDNVLLGLSGGVDSSVVAALLHKAIGDQLTCVFVDNGLLRLHEGEQVMAMFAENMGVKVIRANAEEQFLNNLAGESDPEKKRKIIGRTFIDVFDAESCKLDNIKYLAQGTIYPDVIESAGAKSGKAHVIKSHHNVGGLPEEMNLKLVEPLRELFKDEVRRLGLELGLPYDMVYRHPFPGPGLGVRILGEVKKEYADLLRRADHIFIEELRKADWYHKVSQAFVVFQPVKSVGVVGDGRRYAWVVALRAVETIDFMTARWAHLPYELLETVSGRIINEIEGISRVTYDVSSKPPATIEWE

SEQ ID NO: 55880 - protein, 183 aa, Brassica napus
MEEVRKKKDVYSVWALPDDETEPRFRKLMEALRSEFSGPRFDPHVTVVGATSLTAEEAKKMFESACDGLKAYTATVDRVSTGTFFYQCVFLLLKSTPEVMKAGEHCKNHFKCSTTTPYMPHLSLLYAELDEEGKKKAREKAYTLDNSLDGLSFRLNRLALCKTDTEDKTLESWEKVAVCNLGP

SEQ ID NO: 55881 - protein, 307 aa, Triticum aestivum
MAPMLKGIVDAAPKRAAYVTFLAGSGDYWKGVVGLAKGLRAVNSAYPLVVAVLPDVPEDHRRKLVDQGCLVREIEPVYPPESQTQFAMAYYVINYSKLRIWEFVEYERMVYLDADIQVFDNIDHLFDLDKGSFYAVMDCFCEKTWSHTPQYKIGYCQQCPDRVAWPERELGVPPPPLYFNAGMFVHEPSLATAKALLDRLVVTDPTPFAEQDFLNMFFRDVYKPIPPVYNLVLAILWRHPENVELEKVMVVHYCAAGSKPWRYTGQEANMGREDIKMLVKKWWDIYNDEGLDYKAGDETTNLLRGAL

SEQ ID NO: 55882 - protein, 324 aa, Glycine max
MATLVLYQFFLKLLLLISVFQLSFAARRLNQLVQDQSQLLHYHNGPLLYGKIAVNLIWYGHFKPSQKAIITDFVTSLSSPSSQSSQPSVATWWKTTEKYYHLSPKNKKAASSLSLSLGDQFLDEGFSLGKSLTSKNLVELASKGGQRNAINVVLTSADVAVEGFCMSRCGTHGSSSSASHVKKNNNGKNYKFAYIWVGNSETQCPGQCAWPFHQPIYGPQSPPLVAPNNDVGLDGMVINLASLLAGTATNPFGNGYFQGPAEAPLEAASACPGVYGKGAYPGYAGDLLVDSTTGASYNVKGANGRKYLVPALYDPSTSSCSTPV

SEQ ID NO: 55883 - protein, 223 aa, Botryotinia fuckeliana
MLFVPRTASALKSTSLPLLRNTFINNSFTSISSRQFHASKSNMAIKTYFDVTWEGPVLDASGKPTSTVQEQAGRITFNLYDDVVPKTAENFRALCTGEKGFGYAGSSFHRIIPQFMLQGGDFTRGNGTGGKSIYGEKFADENFERKHTRPGLLSMANAGPNTNGSQFFVTTVVTSWLDGKHVVFGEVADDESLMIVKALEATGSGSGKVQYNKKPTIVKSGEL

SEQ ID NO: 55884 - protein, 219 aa, Synechococcus sp. WH 5701
MPPPSPNTSLSRRQARQLVETAYLASATALLWAGLYYLPVGGALFRLALPLPLALLQVRQGWRPGWEGAVVASLLLVALMGPIRGPLVLFPYGLLALWLGWGWAERRSWWLTWSVGLLIGSAGFLVRVAVLSLLLGENLWVLITAAAAGLLERLSSLLNLGVGPDLLQVQLMALVLVLVQNLIYVLALHAVAYWIFPRLQAPISEPPPQLRSLVALDPL

SEQ ID NO: 55885 - protein, 181 aa, Botryotinia fuckeliana
MAIKTYFDVTWEGPVLDASGKPTSTVQEQAGRITFNLYDDVVPKTAENFRALCTGEKGFGYAGSSFHRIIPQFMLQGGDFTRGNGTGGKSIYGEKFADENFERKHTRPGLLSMANAGPNTNGSQFFVTTVVTSWLDGKHVVFGEVADDESLMIVKALEATGSGSGKVQYNKKPTIVKSGEL

SEQ ID NO: 55886 - protein, 336 aa, Streptococcus suis 89/1591
MKRIAVLTSGGDAPGMNAAIRAVVRQAISEGMEVYGINEGYAGMVAGDIHELSARSVGDIISRGGTFLGSARYPEFAKLEGQLKGIEQLKKHGIEGVVVIGGDGSYHGAMRLTEHGFPAIGVPGTIDNDIVGTDFTIGFDTAVTTAMDAIDKIRDTSSSHRRTFVIEVMGRHAGDIALWAGIASGADVIVVPEEDFNINDIVDRIKAGYDNGKKHSIIVLAEGVMPAAQFAEELKAAGDTSDLRVTELGHIQRGGSPTARDRVLASRMGAHAVKLLKEGRGGLAVGIRNEQMVENPILGTAEEGALFSLTTDGKIVVNNPHKADLELADLNRNLSI

SEQ ID NO: 55887 - protein, 231 aa, Prunus armeniaca
NILVRLPAKSLVRFLCTCKSWSDLIGSSCFVSTHLHRNVTKHTHVYLLCLHHPNFERNDDPDDPYVEQEFQWSLFSNETFEECSKLRHPSGSTEHYMIYGSSNGLVCISEEILNFDSPIHIWNPSVKKFRTPPMSTNINIKFSYVALQFGFHPGVNDYKAVRMMRTNKNALAVEVYSLKTDSWKMIEAIPPWLKCTWQHHKGTFFNGVAYHVLLKGPIFSIMSFDSGSEEI

SEQ ID NO: 55888 - protein, 212 aa, Aspergillus niger
MNFKNIFLSFFFVLAVGLALVHAEDAQPRGPKITSKVFFDIEHGDKPLGRVVLGLYGKTVPKTAENFRALATGEKGFGYEGSTFHRVIKDFMIQGGDFTRGDGTGGKSIYGEKFADENFKLRHTRKGLLSMANAGKDTNGSQFFITTVPTPWLDGRHVVFGEVLEGYEIVAQIENVPKGRSDRPVETVKIVKSGELESEDKAGEKGSSHEEL

SEQ ID NO: 55889 - protein, 441 aa, Kluyveromyces lactis NRRL Y-1140
MNSVGHIERPISNDVTQGVSYNPTVGLPLSKQGQLPHQQSHHKIFAALKEKIDSINHETCDAGDENSFFVCDLGEISRLRNYWTQILPRVTPFYAVKCNPNIEIIKRLASMSTNFDCASKSEIEKVLACGVDPERIIYANPCKASSFIRFAAKNGVKKSTFDNIDELYKIKKYHPESELLLRIVTDDSSAQCRLSTKYGCELDDVPVLLETVKELGLNLIGVSFHVGSGASDFSTVTQAVKDGRKVFDMAESRGLPALKMLDVGGGYQFDTITEVADVLNAALDYFFPQETHSDVSFIAEPGRYFVATAFTLAATVIGKRNNSDSESMIYINDGVYGNMNCILFDHQEPSPRVLYHKNRFHYMDINSSSKAKCDACNYKVSIWGPTCDGLDCVSKEYYMKYDLDIGDWVHFDNIGAYTCSAATPFNGFEQTVDIIFIDSAL

SEQ ID NO: 55890 - protein, 352 aa, uncultured bacterium
VGAANNLLAAMLDNHIQQGNDLNIDPRRITWRRAVDMNDRQLRSIIDGLGGKPNGVPREDGFDITVASEVMAILCLASDITDLKERLSKIVVAYTYDNRPVTAGQLKAQGAMAALLKDALKPNLVQTLEGTPAFVHGGPFANIAHGCNSLTATRMALKLGDYAVTEAGFGADLGAEKFLDIKCRMSGLRPDAVVTVATVRALKHHGGAEKDKLQEEDLDALEKGLPNLLQHVENITKVFKLPCVVAVNVFPSDTEAELKLIQDKCKELGVNVAISKVWAEGGEGGKALAEEIVRLCDQPNDFTFAYDLDLSIKEKLLTIARKIYHADGIHLPGNVPKQIKQLEDLGFGSLPI

SEQ ID NO: 55891 - protein, 256 aa, Agrobacterium tumefaciens str. C58
MSNQIIFDLGGRTALVTGSSRGLGRAMAEGLAVAGARILINGTDPSRVAQTVQEFRNVGHDAEAVAFDVTSESEIIEAFARLDEQGIDVDILVNNAGIQFRKPMIELETADWQRVIDTNLTSAFMIGREAAKRMIPRGYGKIVNIGSLTSELARATVAPYTVAKGGIKMLTRAMAAEWAQYGIQANAIGPGYMLTDMNQALIDNPEFDAWVKARTPAKRWGKPQELVGTAVFLSASASDYVNGQIIYVDGGMLSVL

SEQ ID NO: 55892 - protein, 371 aa, Agrobacterium tumefaciens str. C58
MECCRFSRTAAILDANRNWREETRMRGVVIHAAKDLRVEDVAGQPLAADEVRVAVAVGGICGSDLHYYNHGGFGTVRVREPMALGHEFAGTVVEVGSSVSHLVPGMRVAVNPSLPCGTCRYCAQGRQNQCLDMRFMGSAMRSPHVQGGFREVVTVHSTQPVQIADGLSMGEAAMAEPLAVCLHAARQAGSLLGKTVLITGAGPIGMLSLLVARLAGAAHIVVTDVADAPLDLARRIGADEAVNILRDADMLEKYRFEKGVFDVLFEASGNQAALLPALDLLRPGGIIVQLGLGGDFTIPMNLIVAKELQLRGTFRFHEEFAQAVNMMGRGLIDVKPLISATLPFDQAREAFDLAGDRAKSMKVQLAFSGAA

SEQ ID NO: 55893 - protein, 353 aa, uncultured bacterium
IGAANNLLAAMLDNHIQQGNALGIDVKKITWKRCVDMYDRQLRFVVDGLGGKANGTPREDGFDITVASEIMAVFCLASSMKDLKERLGRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVIVGTVRALKMHGGLDKKQLVNEDLAALEKGIPNLLRHVNNIKNVYQLPCVVAINRFPTDTDAEIDFIIRKCRELGVNTVLSTVWAEGGKGGEDLAREVVRLCEEEKGNFTFSYELNASIEEKLEAVTKKIYGGAGVSLTPNAKKQAERLTELGFDKMPV

SEQ ID NO: 55894 - protein, 351 aa, uncultured bacterium
ITSANNLLAALLDNHIQQGNVKRIDSRSVVWKRCMDMNDRALRNIVVGLGSKSDGFVREDHFVITVASEIMAVLCLAEDLKDLKRRLGRIIVAYDLDGNPVTAEDIQAVGAMTALLKDAIRPNIIQTLEHTPAIVHGGPFANIAHGCNSVIATRTALKLADYCITEAGFGADLGAEKFLDIKCRQAGLTPSAVVLVATVRALKYNGGIPKDQLGTENLDALGKGIENLGKHIENIQSYGLPVVVALNAFVSDTDAEIEFVKEYCASKNCTMSVARVWEKGGEGGTELAELVIKATEEKSDFKFCYPDELSITGKIEAVAKKIYGADGVDIASSAAKQIAKIEEMGFGNLPV

SEQ ID NO: 55895 - protein, 279 aa, Brassica napus
  misc_feature (218)..(218): Xaa can be any naturally occurring amino acid
  misc_feature (233)..(233): Xaa can be any naturally occurring amino acid
  unsure (1)..(279): unsure at all Xaa locations
MASATHLLSQPSSSLRRNLNQYQSNQSPLSRIPVLSLKSTLKPLQRLSVKAAASPPNSVKTVTKDSSDQSAFNHCFKKSSDGFLYCEGTKVEDIMESVERRPFYLYSKPQITRNVEAYKEALEGVSSVIGYAIKANNNLKILEHLRGLGCGAVLVSGNELRLALRAGFDPTKCIFNGNGKLLEDLVIAAQAGVFVNVDSEFDLDNIVEASRISGKQVXVLLRINPDVDPQVHXYVATGHTNSKFGSGLEKLQWFLDEVKAHPNELKLVGAHCHLGSTIT

SEQ ID NO: 55896 - protein, 352 aa, uncultured bacterium
ITSAHMLLSAMLANSIQQGNPLNIDPRRIIWKRVVDMNDRALRNIVIGLGGKAHGVPREDGFDITVASEVMAILCLASNLHDLKERLKRIVVAYNYDGKPVTAEDLHAAGAMAALLKDAVKPNLVQTLEHVPAIIHGGPFANIAHGCNSVMASRTALRLADFTITEAGFGADLGAEKFFDIKCRQAGLAPDACVLVATVRALKMHGGVAKADLKEPNVEAVKKGLPNLGKHIENIFKFGVPVVVAINIFAQDTKEELQAVYDFCAGMGVNVALSDVFAKGGEGGVELAKEVVALAESGMARFKPIYPENMSLREKVATIVKEVYGGDRVEFQTKAAQALDQYEKEGYGNLPV

SEQ ID NO: 55897 - protein, 202 aa, Synechococcus sp. CC9605
MARQGTIHRVTGETDVKVRLDLDGSGQCQASTGVPFLDHMLHQISSHGLIDLEINAVGDTHIDDHHTNEDVGIAVGQALAQALGDRRGIHRFGHFVAPLDEALVQVALDCSGRPHLSYSLAIPSQRIGTYDTELVKEFFVAVVNNSGLTLHIRQLDGVNSHHIVEACFKAFARALRMATEVDPRRAGAIPSSKGVLEQAGAS

SEQ ID NO: 55898 - protein, 539 aa, Glycine max
MASSLRISRLLSRSFLSASTTTPLFSRGGSGALGAGLSKFSTAAAIEEPIKPPLKVEHTQLLIDGKFVDAATGKTFPTLDPRTGDVISHVAEGDHEDVDRAVAAARKAFDHGPWPKMTAYERQRILLRAADLFEKHNDDLAALETWDNGKPYEQSAQIEIPMLVRLFRYYAGWADKIHGLTVPADGPYHVQTLHEPIGVAGQIIPWNFPLVMFAWKVGPALACGNTIVLKTAEQTPLSALYASKLLHEAGLPPGVLNIISGFGPTAGAAIASHMDIDKLAFTGSTETGKVVLELAARSNLKPVTLELGGKSPFIVCEDADVDEAVELAHFALFFNQGQCCCAGSRTFVHERVYDEFIEKAKARALKRAVGDPFKGGIEQGPQIDSEQFQKILKYIRSGVESGATLETGGDRFGNSGFYIQPTVFSNVKDDMLIAKEEIFGPVQSILKFKDLDDVIQRANNTHYGLAAGVFTKNINTANTLTRALRAGTVWVNCFDTFDAAIPFGGYKMSGQGREKGEYSLKNYLQVKAVVTSLKNPAWL

SEQ ID NO: 55899 - protein, 396 aa, Synechococcus sp. CC9605
MSTPTSIPSRAAVVIVGGGMAGLSCAASLARRGVRDVVLLEAQTLAHAKASSYGETRMFREMYSDPVLCRLAQEANRLWREEENHAGQQLRETHGLLFYGESWDEETIEGSIPGARRVMDNQGIPYEALDANQIAARFPLKPKAGFTGLFEPTAGAVRSDRVVAHWINTARNASHQLIEHCPVAGLDPDGGGVTLESGEHIAAGQLVVACGIWSQLLLAPLGLAPKLEVWPMLWAHYTVDPALADRYPQWFCFQQERGDDGGLYYGFPVLSQTADGRPRIKAGIDWAPSELRVAEPNAMVTGPPARLVELLDAFLFNELDGVQERVETVISPYSMASDVNFVLDRLTPKLSLFAGGSGQAFKFAPLIGDSLARLASGEQPAVDLSCWSHQRTAVRA

SEQ ID NO: 55900 - protein, 115 aa, Thiomicrospira crunogena XCL-2
MSDIIKRIEAEQMTKELPEFGPGDTVVVQVKVKEGSNERLQAYEGVVIAKKNRGLNSSFIVRKISHGVGVERTFQTYSPLVDSVEVKRRGDVRRAKLYYLRDLSGKAARIKEKVK

SEQ ID NO: 55901 - protein, 536 aa, Anabaena variabilis ATCC 29413
MTDTATTPKASLNKFEKFKAEKDGLAIKSEIEKIASLGWEAMDETDRDHRLKWVGVFFRPVTPGKFMMRMRMPNGILTSDQMRVLAEVVQRYGDDGNADITTRQNIQLRGIRIEDLPHIFNKFHAVGLTSVQSGMDNIRNITGDPIAGLDADELYDTRELVQQIQDMLTNKGEGNREFSNLPRKFNIAIAGGRDNSVHAEINDLAFVPAFKEGIGDWVLGGGEESSTHQKVFGFNVLVGGFFSAKRCEAAIPLNAWVTAEEVVALCRAVLEVYRDNGLRANRLKSRLMWLIDEWGIDKFRAEVEQRLGKSLLYAAPKDEIDWEKRDHIGVYKQKQEGLNYVGLHIPVGRLYAEDMFELARIADVYGSGEIRMTVEQNIIIPNITDSRLKTLLTDPLLERFSLDPGALTRSLVSCTGAQFCNFALIETKNRALEMIKGLEAELTFTRPVRIHWTGCPNSCGQPQVADIGLMGTKARKNGKAVEGVDIYMGGKVGKDAHLGSCVQKGIPCEDLHLVLRDLLITNFGAKPRQEALVSSQ

SEQ ID NO: 55902 - protein, 586 aa, Frankia sp. EAN1pec
MTSPARPPRAARPQSPSRPKGQGQWALGYSEPLNPNERMKKDQDGLAVRERILNEYPHTGFDGIDPQDLRGRFRWWGLYTQRRPGISGGRTAVLEPEELDDRYFMQRIRLDGGRMTSEQLRIIADISTRYGRDVADVTDRQNIQLHWIRIEDVPAIWGALEAAGMTTEESCGDTPRVILGCPLAGVDADEVIDATGVIDQVVERFVGDTTLSNLPRKFKSAMSGCPDQCTLHEINDIAFVGVVHPELGPGYDLWVGGGLSTNPKLGVRLGTFVTPERVPEVWHGVIQLFRDYGYRRMRTRARLKFLVADMGVEWVRSTLEKEYLDAALPDGPAPLPPRNEGRDHIGVHQQRDGFFAVGFAPRAGRLTGTTLTAVANLADRFGQGRIRATTTQKLVILDVPGEDLDALEAELAALDLVVRPSVFRRGTMACTGIEFCKLAIVETKGNARDLIVELERRLPDFDEPIGININGCPNACARFQVADIGLKGSLVPDDNGEMVEGFQVHLGGHLGTRSRLGRKSRGLKVTADGLVDYVVGLLETYQEHRADGDTFADWAERADEALLTGVGSGSASAGPAAGRRAEGGAT

SEQ ID NO: 55903 - protein, 401 aa, Synechocystis sp. PCC 6803
MLSKQSIANLTEADLAGKRVFVRVDFNVPLDNGSITDDTRIRAALPTIKDLLSKGAKVILGSHFGRPKGKVVDSMRLTPVGDRLGELLGQPVVKCDDCIGAEVTAKIASLPNGGVALLENLRFHAGEEGNDAEFAKALAANADLYVNDAFGTAHRAHASTEGVTHFLSPNVAGYLIEKELQFLQGAIEAPKRPLVAIVGGSKVSSKIGVIETLLDKCDKLIIGGGMIFTFYKAQGLNTGKSLVEEDKLDLAKSLMAKAKEKGVEFLLPTDVVVADNFAPDANAQTVGVDAIPDGWMGLDIGPDSVKTFQDALAGCGTVIWNGPMGVFEFDKFAVGTEAIACSLAELTASGTVTIIGGGDSVAAVEKVGVAEKMSHISTGGGASLELLEGKVLPGIAALDDR

SEQ ID NO: 55904 - protein, 740 aa, Silicibacter sp. TM1040
MNSSLASFFARTPAATLDSCDSEPIHLSGLIQNTGALIVQDPETGLIIGASENAHLFLGRPVEAILGFSLTEIAPDIADELAEPDNGQNIVHEILESQRNVDDCVYDTICHVHDGRRVIEFVLNEAPSASQARKRMRMSGPACAQIMAAPTFDAAMQIACNTVRTLTGFSRVKIYRFLPDWSGETIAESNDGSLPSYLGMHFPSGDIPKQVRALMEIVPFRFVGRVDDDNIAIRALTSGAGDIDLTWAMNRSVSAMHTAYLRNIGAGSSFSCSLMDKGKLWGLIACHSGGSMVVPADSWSLVQEIGTALMLKFDQTERMATADMISRLRRIENEFAAEMRRTGDVEDVIKTLVPILQKFLRADGFAFQFGTNMHTSGEVPPENFIRKLVQWSKTNMEDVDQFQTASLHADLPEAKHHIDTACGVLVQPIVMHRVCQLLWFRGPITRRVAWAGRPDAQAKIDPKTGVTLGPRQSFDKWVEEHRDQSLPWEEAELEAAREIFKEFLDIITSQLLLKEENSSLRKFAHTAAHDIKGSLRGISAALGWMEEDDFEKTTTREHQELALAQARKLQNLTESLLEMTLLREQPTAKFSKTDLKKLAEDTKLLIKYDLEQAGGQINVGALPDCTVASDLITRLLLNLCGNAIKYAKSDQPLQIDITGEVLDGEMNRLIVTDNGPGIESKHAEKIFEQATRLHDGGEGCGFGLAICTEIAKSHHGQIYLDTSYSDGARFVFEWPCEDPT

SEQ ID NO: 55905 - protein, 352 aa, uncultured bacterium
ISAANNLLAAMIDNHIFQGNELGINPGTVVWRRCVDMNDRQLRFVVDGLGGAKNGVPREDGYDITVASEVMAILCLSTSISDLKKRLGRIIIGYSYEGNAITAADLKAEGAMTAILKDALKPNLVQSLEGTPAFIHGGPFANIAHGCNSVLATRMALKCGEYIVTEAGFGADLGAEKFMDIKCGITGLRPKAVVVVATVRALKMHGGLKKDNLGTEDLAALEKSLPNLLRHVSVMTDVYKIPCVVAINRFPTDTVAELELVEKKCRELGVNVVLSEVWGKGGEGGIALAEEIVRLCKKESKLELTYEDSDSIETKISKVVKRIYGGSSVSYAPGVRTKIKKLEAAGFASVPV

SEQ ID NO: 55906 - protein, 352 aa, uncultured bacterium
ITSANNLLCAMLDNHLLQDNELRIDPKRVVIKRCLDMNDRALRNITVGLGKRLDGVVREDHFCTTVATEVMAILCLAENLEDLKARLGKIIVAYNYDNEPVTAEQLKAVGAMTVLLKDAIRPNLIQSLENNPVFVHGGPFANIAHGCNSVRATKLALKAADLVITEAGFGADLGAEKFLDIKCRMAGIKPDAVVLVATARAMKYNGGIPKDELNKENVEALKKGIVNLGKHIENLKKYNVPVVVTINKFVADTDAEVAAIKEFVEDKGCRFAISEVWEKGGEGGIELAKQVLDAVEEGSPNFKFLYEDSLSLKEKIETISKEIYGADGVEYSPEANNALKKLEALGFSNVPV

SEQ ID NO: 55907 - protein, 353 aa, uncultured bacterium
IGAANNLLAAMLDNHIQQGNALGIDVKKITWKRCVDMNDRQLRFVVDGLGGRMNGTPREDGFDITVVSEIMAVFCLASSMADLKERLSRIIVAYTYDDQPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLANEDLAALEKGIPNLLRHVNNIRNVYQLPCVVAINRFPTDTDAEIDFIVRKCRELGVNTILSTVWAEGGKGGEDLAREVVRLCEEEKGNFTFSYELDASIEEKLEAVTKKIYGGSGIALTPAAKKQAERLTALGFDKMPV

SEQ ID NO: 55908 - protein, 587 aa, Magnetospirillum magnetotacticum MS-1
MEGAVALGMRRLSVIDLAGGNQPIHNENGSISVVFNGEIYNFRELRRELEEEGHIFSSHTDTEVLVHLYESHGRGMLDRLNGMFAFCLLDRRAGRLFLARDRVGKKPLYYAHGDGAFAFASEIKSLLCHPAVRREADPAAAALYFTHGYVPAPFTPFMGIRKLPAGHWLELDLASGEIQVGRYWDLDYSQVDEDLCEEEAVAGLESALLAAVERRLISDVPLGVFLSGGVDSSLVVAMMARFREGRDIHAFSIGFHEKAFDESGYAESVARAWGVDHHVTRFSDAEMFSVIDEILPRMDEPLSDPSLIPTYLLSKVTQDSGIVVALSGDGADEMFGGYPKYYIHRYAAWLDRLPGILGRDVPAWLFSQVPLKAENNIFNYKVERFVSGLRLAPRHRNQFWVAPFMPDELTRLLPEQEVPRAVWEVTDQYDSRFNGRGVVDRMMYFDAKMMLQDMYLAKVDRASMAVSLEVRSPFLDLEVMDAAVHLPWQLKVRGRETKYLLKKLASRYLPHDVVYRFKRGFGLPLAVWMRTLAPRISETLTQGDCGGIDAAYVQSLLREHLDGTRDHAVKLWAVYAYLTWLRNWGGS

SEQ ID NO: 55909 - protein, 148 aa, Zea mays
ESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIALWFPEGPADWQSSQHPWIYEK

SEQ ID NO: 55910 - protein, 353 aa, uncultured bacterium
IGAANNLLAAMLDNHIQQGNALGIDVKKITWKRCVDMNDRQLRFVVDGLGGKANGTPREDGFDITAASEIMAVFCLASDMADLKARLSRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLATEDLAALEKGIPNLLRHVNNITKVYQLPCVVAINRFPTDTDAEIEFIVRKCRELGVNTVLSTVWAEGGKGGEDLAREVVRLCEEEKGNFTFSYELDASIEEKLEAVTKKIYGGAGVALTPAAKKQAERLTELGFGGLPI

SEQ ID NO: 55911 - protein, 353 aa, uncultured bacterium
IGAANNLLAAMLDNHIQQGNALGIDVKKITWKRCVDMNDRQLRFVVDGLGGKANGTPREDGFDITVASEIMAVFCLASSMSDLKERLSRIIVAYTYDDQPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLANEDLAALEKGIPNLLRHVNNITNVYQLPCVVAINRFPTDTDAEIDFIVRKCRELGVNTILSTVWAEGGKGGEDLAREVVRLCEEGKGNFTFSYELDASIEEKLEALTKKIYGGAGVALTPVAKKQAEQLTRLGFDKLPV

SEQ ID NO: 55912 - protein, 487 aa, Synechococcus sp. CC9605
MASAPLPLSPAPIKFGTDGWRGITGVDITVERLLPVAAAAAQELAHRAPEGLSSRTVVIGYDRRFLAPELAEAIAAAVRGCELEPLLTDTAVPTPACSWAVVERKALGALVITASHNPPEWLGLKIKGPFGGSVEGDFTAAVERRLAAGGITAPIKAQVPRFDGRGEHLEGLRRKLDLNALVEGLKAINLKVIVDPMHGSAAGCVTELLGPEAAGVVEEIRSERDPLFGGHPPEPLAPYLGGLITAVKASTAAGTPAVGLVFDGDGDRIAAVDETGRFCSTQLLMPLLIDHLARARQLPGAVVKTVSGSDLMRLVAEAQGRKVLELAVGFKYIAAEMLAGDVLIGGEESGGVGFGMHLPERDALFAAMLVLEALVEGKQPLGARLDALQQQHGGSSHYDRLDLRLADMEARRRLETLLAQSTPSSVAGAEVLEVISTDGIKLRMGPNHWLMLRFSGTEPLLRLYCEGPDASRVNEVLAWARQFAEAA

SEQ ID NO: 55913 - protein, 359 aa, marine gamma proteobacterium HTCC2143
MSRKVLVISGDGIGPEITAETVKVLDVVNQRFELGIEFDEALLGGAALDETGVPMPDETLNKAKDSDAILFAALGGPKWDANDRDLRPEKGLLQFRSGLGLFGNLRPAILYSQLADASSLKPEIVAGLDILIVRELTGGIYFGEPRGIRTLENGEREGYNTYKYNETEIRRIAKMAFEAAQKRSGKLCSVDKSNVLEATVLWREIVEGMAADYPDVELSHMYVDNAAMQLVRDPKQFDVIVTGNMFGDILSDAAAMLTGSIGMLPSASLDKNGRGMYEPCHGSAPDIAGQGKANPLAMILSAAMMLRYSLDAVEAADAIEIAVGVVLDQGIRTSDIFSAGTELVSTRVMGDAVAAALQL

SEQ ID NO: 55914 - protein, 56 aa, Vitis riparia
DTCCPVLQGLVDLDAAVCLCTGIKVKLLNVNIIIPIALQVLVGCGKTPPSGFQCPA

SEQ ID NO: 55915 - protein, 174 aa, Vitis riparia
MCERLITEALDLLAENRTQKLIIEMLHATCSEVQSFKQQCITLVDYYAALIFSELALITPGNFCEKANLCGSTFTAGQLYQDSCVFCRMLVMKVLIKLRDPDTQLEILELLLKGCDAVKGLVRKCKRMVFEYGPIILNNTERFLEKNDVCTTVHACGVPPAASVEEAAAKVSDS

SEQ ID NO: 55916 - protein, 110 aa, Arabidopsis thaliana
MELEFESKYEIDRTAEFIMSKSVTRVALQFPDELLRGSTKVVSSRKSKTRLRTDREVRFVVMADTTYGSCGIDEVGALHIDSECVVHYGQTCRSPTSVRPAIPSVFRGSF

SEQ ID NO: 55917 - protein, 219 aa, Glycine max
  misc_feature (145)..(145): Xaa can be any naturally occurring amino acid
  misc_feature (181)..(181): Xaa can be any naturally occurring amino acid
  misc_feature (214)..(214): Xaa can be any naturally occurring amino acid
  unsure (1)..(219): unsure at all Xaa locations
MAASHILYNPPPLSKTFINHPLNQNPSPQNLILPLKATIKPRVLRAVHPQKITANSSLHNSDTRTRFQHCFTKSEDGLLYCEGLKVHEIMDSVERRPFYLYSKPQITRNVEAYKDALEGLRSIIGYAIKANNNLKILEHLRQLGXCGAVLVSGNELRLALRAGFDPTRCIFNGMGKVLDDXLVLAAKKVVFVNIDSEFDLENIIAAAKIAQKRXNVLLR

SEQ ID NO: 55918 - protein, 352 aa, Glycine max
MGTVAPRVESLASSGIKCIPKEYVRPQEELKSIGNVFEEEKKEGLQVPTIDLREIDSEDEVVRGKCREKLKKAAEEWGVMHLVNHGIPDELIERVKKAGETFFGLAVEEKEKYANDLESGKIQGYGSKLANNASGQLEWEDYFFHLAFPEDKRDLSFWPKKPADYIEVTSEYAKRLRGLATKILEALSIGLGLEGWRLEKEVGGMEELLLQLKINYYPICPQPELALGVEAHTDVSSLTFLLHNMVPGLQLFYEGQWVTAKCVPDSILMHIGDTIEILSNGKYKSILHRGLVNKEKVRISWAVFCEPPKEKIILQPLPELVTDTEPARFPPRTFAQHIHHKLFRKDQEGLPN

SEQ ID NO: 55919 - protein, 220 aa, Salmonella enterica subsp. enterica serovar Typhi str. CT18
MLPATFLISDEGKIMATPTFDTIEAQASYGIGLQVGQQLSESGLEGLLPEALVAGIADALEGKHPAVPVDVVHRALREIHERADAVRRERFKAMAAEGVKYLEENREKDGVNSTESGLQFRVLTQGEGAIPARTDRVRVHYTGKLIDGTVFDSSVARGEPAEFPVNGVIAGWIEALTLMPVGSKWELTIPQELAYGERGAGASIPPFSTLVFEVELLEIL

SEQ ID NO: 55920 - protein, 727 aa, Anabaena variabilis ATCC 29413
MTESTKTLCPYCGVGCGLEVTPPAQLNKATNRDSQGNPIWRVRGDKAHPSSQGMVCVKGATIAESLDKNRLHYPMVRDSLDQEFRRVSWDEAFDLITKRIQTVRLTQGAEAICMYGSGQFQTEDYYIAQKLMKGCLGSNNFDANSRLCMSSAVSGYIQSFGADGPPCCYEDLELTDCAFLIGTNTAECHPIVFNRLEKYHRKNHQVKMVVVDPRRTPTAEAADLHLAIKPGTDIDLLNGIAHLLMRWNMIDVGFIDDCTSNFSAYAEVIRHYSPEVVARQCGITVEDLEIAARYWGESQRVLSLWSMGVNQSSEGTAKVRTIINLHLMTGQVGKPGMGPFSLTGQPNAMGGREAGGLAHLLPGYRLVKNPQHRAEVEGFWGFPSGQISPHPGLTAWDMITGLEDGNVGLLWIAATNPAVSMPDLERTKKALLRSPFTIYQDAYHPTETTAYAHVLLPAAQWGEKTGVMTNSERRVTLCQAFRQPPREAKPDWEIFAEVGRRLGFEDKFAFGNSDQVYAEFAQLTKGRPCDMSGISHQKLQAQGPTQWPYPEMGNGDKNKRLYTDLRFHTPDGRARFGAYYSQGLAEPPDPAYPFVLTTGRLYGHWHTQTRTGRIEKIRAMHPEPFIEIHPRDAAKLGIIDHQVVEVRSRRGSAKFPAKVTKAISPGTVFVPMHWGTLWAEDAEANALTHSESCPDSLQPELKACAVQLIPISVEITAENYQLQSSQW

SEQ ID NO: 55921 - protein, 152 aa, Anabaena variabilis ATCC 29413
MKRLIKRIVGIASDENFMHIIENVEVLVSKVLSLFMVLVILVAIGDLGIFIVKEVFTVPYGKINTTLFKVFGLFLNILIALEILENITAYLKRHVFQVELVIVTSLIAVARKIIILDLEKVNGIDIIGLGVAVLALSISYLIIRSSNYGNRN

SEQ ID NO: 55922 - protein, 249 aa, Vitis berlandieri x Vitis rupestris
MPKIAFGRFDDSFSLASFKAYLAEFHSTILFVFAGVGSVMAYNKLTSDAALDPAGLVAVAVAHGFALFVAVAVSANISGGHVNPAVTFGLVVGGQITILTGILYWIAQLVGSILACFLLKLVTGGLTTPVHSLGAGVGVIDAIVFEIVITFALVYTVYATAVDPKKGSLGIIAPIAIGLVVGANILAAGPFSGGSMNPARSFGPAVVSGDFKDNWIYWVGPLIGGGMGGSVYAFMYLGSDHQPLASSEF

SEQ ID NO: 55923 - protein, 593 aa, Schizosaccharomyces pombe 972h-
MTSFTESKKLDEIESPVPEIIVPSTTNGNGTIESYKEKSVGTSFLDFFRSYKLRPDNEFAEVHNSEDFLKPRHLQMIAIGSCIGTGLFVSTGKSLKNAGPGSLMINFIILSAMILALILSLGEMCCFLPNQSSITMYTGRLLNNNIGFAQSWLYFWIWLTVLPSEISAACEVVDFWTTQHLNPAIWVTIFLAYVVLVNAFGARSYGECEFVSSFLKVVIVIIFFFVAIIINCGAAPKGGYIGAHYWHHPGSFRNGFKGFCSVFISSAYSLSGTENIGTAAGNTSNPQRAIPSAVKKVFYRMGFFYIITIFLITLVVPYDNPDLGNVSPFIIAIKNGGIHVLPHITNAVILVSVLSVGNAAVFAASRNAMALVKQGWAPRFLGRVDQKGRPVISYLCSLAMACIAYVNAAPDGSVVFDWLMSVSGGGAFVIWGLSFIDHIRLRYAMKAQKIPDTVLPYKFPGSVYLSYYGVLINFLALCALVYISIFPVTHEKPSAYGFFVSFLGPSVFIAYLLISPIFVKPTFQSLKDVDLTTGRYDLVNSQMYVAESSTSELSEKDLTKPNLQSNDNKNSEDLESNTPPQKKSALQKVADFL

SEQ ID NO: 55924 - protein, 289 aa, Streptococcus suis 89/1591
MPKTILITGSTDGIGKHLAMKLASEGHEVILHGRNSEKFRVALSDIQLKTGNKKIHGYLADFSKLADVYRFSQEIKRDFEQIDVLVNNAGAYFGDARVATAENIEMTFMLSVQVPYILTTELLPLLEKAVGRVIHTSSFMHHFAQTRGLDFGLEQSYSAAMAYNNAKLYTIWLAIAQAEALEKQGSSVTVNAYHPGLIATNLGNDGVKRNLRSRILTSLMKPFSKDLDQGIETGYYLSLSPEVAGQSGRYFAEKKVAKVSLKGFDVPKSQALLAYLDKKIQVFKESYRD

SEQ ID NO: 55925 - protein, 467 aa, Glycine max
MAATRPVQCLLRRVCRGSRTIGVATEVNASSSSQKIIDKEYEHSAHNYHPLPIVFAQAKGTSVWDPEGNKYLDFLSGYSAVNQGHCHPKILKALQEQAERLTVSSRAFYNDRFPDFAEYVTNMFGYDMVLPMNTGAEGVETALKLARKWGYEKKRIPKDEAIIVSCCGCFHGRTLGVISLSCDNEATRGFGPLLPGNLKVDFGDAEALEQIFKEKGEHIAAFILEPVQGEAGVIFPPDGYLKAVRDLCSKYNVLMIADEIQTGLARTGKMLACEWEEVRPDVLILGKALGGGVIPVSAVLADKDVMLCIQPGQHGSTFGGNPMASAVAIASLEVIKNERLVERSAQMGEELTGQLLKIQQQYPDYVKEVRGRGLFIGVEFNSKKLFPVSGYELCKKLKYRGVLAKPTHDAIIRFTPPLCISVDEIQQGSKALADVLEIDLPKLQKTKPIDAAPVATSACDRCGRVLY

SEQ ID NO: 55926 - protein, 344 aa, uncultured bacterium
GAANNLLAAMLDNHIQQGNALGIDVKKITWKRCVDMNDRQLRFVVDGLGGKANGTPREDGFDITVASEIMAVFCLASSMKDLKERLSRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVIVGTVRALKMHGGLDKKQLVNEDLAALEKGIPNLLRHVNNIKNVYKLPCVVAINRFPTDTDAEIDFIIRKCRELGVNTVLSTVWAEGGKGGEDLAREVVRLCEEEKGNFTFSYELDASIEEKLEAVTKKVYGGAGVALTPNAKKQAERLTE

SEQ ID NO: 55927 - protein, 424 aa, Agrobacterium tumefaciens str. C58 [sequence omitted]

SEQ ID NO: 55928 - protein, 352 aa, uncultured bacterium
ITSANNLCAAMLDNSIKQDNELNIDPEKVVWKRCVDINDRVLRNIIVGRGRDVDGVEREDHFVITVASEIMAILCLANDYADLKDRLGKIIVAYTYDGKPVTAKDIKAVGSMAALLKDAMKPNLIQTLEHTPALVHGGPFANIAHGCNSVRATKTALKMADYVITEAGFGADLGAEKFLDIKCRKADLKPDAVVLVATVRALKYNGGMPREDLQTEDLDALSKGIVNLEKHIENIQQYDVPVVVTLNQFGTDTDAEIEFVKNFCEEHDCDFAPAKVFKEGGEGGIELAKKIIETIETKPSNYHPLYTDDMSIKEKIETVATKIYGADGVTYSDEADEAIAKIEELGFGDCPV

SEQ ID NO: 55929 - protein, 349 aa, Rubrobacter xylanophilus DSM 9941
MARIAVIGGDGIGPEVVGAGVRVLEAAARADSSLELEFERFPWGCEHYLKHGRMMPEDALETLSSFDAIYLGAVGWPSVPDHVSLWGLLLPIRRGFDQYVNLRPVRLLRGVGSPLAGRAQPDLLVVRENTEGEYSDAGGRLHRGTPHEIAVQESVFTRRGVERIVRYAYERARERRGLLTGATKSNGISVTMPFFDEIFREVGEEFPEVEASLMHADALAARLVLDPAAFDVIVGSNLLGDILSEITAAVCGAIGIAPSANLDPTGEHPSLFEPIHGSAPDIAGRGVANPAGAIWAASLMLDHLGHGEAASRVLGALEETLAGGVRTPDLGGDAGTEEVTRAVVRRLLF

SEQ ID NO: 55930 - protein, 557 aa, Aspergillus oryzae
MSLYYDAVKILTSPSPTGGSFKSRIYNARNIKANPAQIYALTIEASKWDTVLKEVIDNAGILKLEPKLTPLLALLLVHDHLLAKNGIAAPSSHPIRQAIERHKTRLKGEFIKARVRRGCASVEQLKDAVQKEKQPLGSAAFYPRWIRINNVRTTAEKQFESTFASYKRVNALSELAVKDDTKRIYVDSNIPDLVAVAPGVDFTATPAYKNGEIILQDKASCFPAYLLFGEGSVWSGGDLVDGCAAPGNKTTHLASLLCKNEKRKKPRQRIISMDASQVRAKTLQKMVSAAGADHFTTVLPGQDFLALDPEDERFEKVSALLLDPSCSGSGIIGRDDVPKFVLPVSPAEERKKQGKKRKRGQDEAGDAADGSVSISATDENEMASTHLDLERLTKLSNLQTRIVEHAMSFPAATRITYSTCSIHLTENESVVERLLTSEVAKRRGWRIMRRNEQPEGLRTWKHRGVRTESRGSGDSETQDGTQGAELKVDLSDEVLEGCLRCWPGDDEGLGGFFVAGFVRDESLAGKVEDPQHGHEDKSEDDDGEDEDDEDEWAGFSD

SEQ ID NO: 55931 - protein, 352 aa, uncultured bacterium
IGAANNLLAAMIDNHIYQGNALDIDPRRVVWRRCVDMNDRQLRNVVDGLGGKANGYTREDGFDITVASEVMAAFCLATGLDDLKERFSKIVVAYNRSGDPVTAGQINAQGAMTALLKDALKPNLVQTLEGTPAFIHGGPFANIAHGCNSVMATKMAMHFGDYVVTEAGFGADLGAEKFIDIKCRLTGLRPDAVIIVATIKALKYNGGVPKADVGKENLEALEAGIPNLLKHVENVTKVFGLPAVVALNRFVNDTDAEIELVTKKCAELGVNVKMSEVWGKGGEGGIELAEEVIRLCEQPNEFKFAYDENLGIKEKIEAIATKVYGADGVDFAPKAAKEIEELEKFGYGNIPV

SEQ ID NO: 55932 - protein, 473 aa, Agrobacterium tumefaciens str. C58
MPVEILMPALSPTMEEGTLSKWLKKEGDKVTSGDVIAEIETDKATMEVEAVDEGVIGKLLIDAGTEGVKVNTPIAVLIQEGESADDISSSAKKEEPKAEAANSGSDAAGGKTREAAEEPSAAKEAAKVPAAPKIEVAADPDIPEGTEMVMTTVREALRDAMAEEMRADEKVFVMGEEVAEYQGAYKITQGLLQEFGERRVIDTPITEHGFAGIGVGAAMTGLKPIVEFMTFNFAMQAIDQIVNSAAKTLYMSGGQMGAPMVFRGPSGAAARVGAQHSQCYAAWYSHIPGLKVVMPYTAADAKGLLKAAIRDPNPVIFLENEILYGQSFEVPKLDDFVLPIGKARIHRKGKDATIVSFGIGMTYAIKAVAELEKLGIDVELIDLRTIRPMDLPTVIESVKKTGRLVTVEEGFPQSSVGDFIANQVMRAAFDYLDAPILTIAGKDVPMPYAANLEKLALPNVDEVVQAVKTVCYK

SEQ ID NO: 55933 - protein, 365 aa, Thermoplasma acidophilum DSM 1728
MAKDYYKILGVDRNATDEEIKKAFRELAKKWHPDLHPENKQEAEEKFKEISEAYEVLSDPQKRRMYDQTGTVDFGAGGQNFNWDNFTHYSDLNDIFNDIFGGNFASDFFSGFGRGQREEQYDLDLYTNLDITLEDAYYGTEKRIKYRRNAMCPDCNGTGAKNGKLITCPTCNGTGQQRIVRGQGFFRMVTVTTCQTCGGRGRIPEEKCPRCNGTGTVVVNEDISVKIPKGATDNLRLRVQGKGQSYNGRTGDLYVVLRVRNDRNVQRINDDLMIDQKINFAQAALGDTIEVNLFREKYSLKIPEGTQPGEVLRIKGAGMPHLNGHGSGDLLVRVNVEVPKRLTQKQKDLIREIFDIKENHRSWFH

SEQ ID NO: 55934 - protein, 1442 aa, Magnaporthe grisea 70-15
MAPKKKIAVMTSGGDAPGMNAAVRAIVRMSIHLGCDAFCVYEGYEGLVQGGNFIRQMQAEDVRGWLSEGGTLIGTARCMAFYERPGRLTAAKNMVLNGIDALIICGGDGSLTGADKFRAEWPSLLEELVSKGELKEEQIAPYKHLNIVGLVGSIDNDLSGTDATIGCYSALSRICEMVDYIEATAASHSRAFVIEVMGRHCGWLALLAGVATGADFIFIPEHPQEGNWKEGMYAVVEKHRKLGKRKTIVIIAEGANDRNGKKITPEEVKDLLADKNGLALDTRITTLGHVQRGGRAVAYDRIIATQMGVEAVRAVIEATPETETCFIAVNENKIVRKPLMQAVKDTKKVATAIEAQDFDQAMSLRDSEFAEQYQSFQIMTTPEPALLLPKEKRMKIAFINVGAPAGGMNAAIRAGVLWCQSRGHEAIAIHNGFAGFARHHGDKPLGAVRPFDRLEVDGWASRGGSEIGTNREVPSQSGMELIAKLIGQYGFDALFVIGGFEAFQAVSELRRAQEEYPSLRIPMALLPATISNNVPGTEYSLGSDTALNALVDYSDMIKQSAAATRRRVFVIETQGGKCGYLATLAGMACGASAVYTPEEGISLDMLAADVAHFKEIFAHDKGQSRAGRLVLVNEKASNGGVPSPMDRSRAVRLAIKCIQHLEQYGPKPHEKVKADPRSAGVIGIRGADVVMTPMKEVEDTETDWPNRRPLNAFWTEMKESVDILGSRGPYPRPEPTLKGLKAKDVKRGLEARASEFLTRVLLSAQPREPFVWLACFSTPTALVICNGMEYDGFTDADFVSLLFTSRLCRLSFAILLNFSRDLYWLRKERQQLPFRSRLLLSTTSPTHFGQVLAKVKEGRDAEEVPDSQMDNTIAQSLEGLQAQHQESIKGLRATTAGMVTLASPRALPSCLVLLSLAVQLCSASMAAWWVGDKRAPQILRWNATLGAITYSSCHTKDTPAFPLDPPNVLDVAQKPRNGTSLTGQGWWNSKTTAASIFYQAEDGSLVNTYQECDLSTGKFRRLTTDIISKDAPAPIHPESGLASVLLANEGTNEGYRLFYHDDKKQVNVIGFRPATSKFYYDGIVSQDLPSGMALAAGFNSNRNYSVVFPRDDENLEHARATADDSRHGITILPRPLKDSNVGNMTSLANRTGLVLDKDFNMTTVPRLPNWTSNPKLALSTDSGTKRNVFWLGSDRRPHKLYITTQGWALQDTNVGVDEWPAADADSDLALAYERGTDNVRLYYVVGGILHELRHDKARTGNGYEWKIAAALPVVAPPDSQSGGDGGLSTGAKIGLGVGIALGVVAVGAACMSVWYVRRLKKTQAADRAQADDEEEEKRRRYEQVQQEQQQYNPYQYQQVQQHGGPHYPQSNGTSQFGSEMGSPKTTYHYGGYIPDKKAPLASASPVPQEMNATPVVYELPEQRRATEMDGGSDVMSPQSTHR

SEQ ID NO: 55935 - protein, 457 aa, Agrobacterium tumefaciens str. C58
MGGLVMPINITMPALSPTMEEGNLTKWLVKEGDKVAPGDVIAEIETDKATMEVEAVDEGTVAKLVVPAGTEAVKVNALIAILAAEGEDVAEAAKGGDAVPAKAEAPKPEAAKAEAPKEEAAPVKAEKPVADQAAASSTPAPVAKSGERIFASPLARRLAKEAGLDLSAVSGSGPHGRIVKTDVEKAAASGGAKAAPAAAASAGAPAPALAKGQSDEAVLKLFEQGSYELVPHDGMRKVIAKRLVESKQTVPHFYVSVDCELDTLLALRAQLNAAAPEKDGKPVYKLSVNDMVIKALALALRDVPDANVSWTESAMVKHKHADVGVAVSIPGGLITPIIRKAEEKSLSTISNEMKDYGKRAKERKLKPEEYQGGTTAVSNMGMMGVKSFSAVINPPHATILAVGAGEQRAVVKNGEIKIANVMTVTLSTDHRCVDGALGAELIGAFKRYIENPMGMLV

SEQ ID NO: 55936 - protein, 336 aa, uncultured bacterium
SANNLLAAILDNHIQQGNDLKIDSRQITWKRCLDMNDRVLRNVVVGLGNKTDGFVREDHFCITVASEIMAILCLANDMKDLKERLSRIIVAYNYDGEPVTAGQLNAVGAMAALLKDAIKPNLVQTLEHSPVLIHGGPFANIAHGCNSVIATKAALKMADYCITEAGFGADLGAEKFLDIKCRKAGLKPDCVVLVATVRALKYNGGVAKEDLKTPNVEALKNGACNLLRHIENIQKYNLPVVVAINSFVSDTKEELDTLESIVKEAGAEYSLSDVWAKGGEGAMDLADKVAAIVDSRESQFKVLYEDNLSIKEKIESVATNIYGAGKVVYSSKAGTV

SEQ ID NO: 55937 - protein, 401 aa, marine gamma proteobacterium HTCC2143
MTDKEALRQRILADAQMDTLAIRAGHSPSEEGEHSEPIFMTSSYVFESAAQAAARFSGDEEGNVYSRYTNPTVRIFEQRIAAMEGGEAAVATSSGMAAILSTCMSLLKAGDHVVCSRNVFGTTTNLFLKYLCKFGLEVTFVDLTDMANWEQAIQPNTRLLFCETPSNPICEVADLSALSALAKKNDCIFVVDNCFCTPALQKPLEFGADLIIHSATKYLDGQGRCVGGCVVGANHYIDQIVGFLRTCGPTMSPFNAWVFLKGLETLRLRMDAHSSNTMALAEWLEQQPAIEKVYYCGLDSHPGKALASKQQRGYGGVMSFQVRGDRAAAWRFIDATCLCSLTANLGDVKTTIIHPATTTHSRLTQQQRIEASITDNLIRVAVGLEDINDLKADMQRGLGAI

SEQ ID NO: 55938 - protein, 248 aa, Glycine max
  misc_feature (85)..(85): Xaa can be any naturally occurring amino acid
  unsure (1)..(248): unsure at all Xaa locations
YLSLHEQNGCIYFRWSGFIKRSYDKGKTWTEREQLPSGILGPIKNKLYLIYSSLLLNLLIMFQPILLENGILLCGSSVESWNSCXWGAWVEVTTDFGRSWSKHGPIYIENEPLSVIQPVPYQTADGKLRVLLRSFDGIGRVCMSESSDGGKTWGYAKPTQLPNPNSGIDGVKLRDGQLLLAYNTVSRSVLKVALSKDDGDSWCEVLTLEDTSGMEFSYPAVIQDSDGRIHITYTYNRTQIKHVVLRPS

SEQ ID NO: 55939 - protein, 379 aa, Triticum aestivum
  misc_feature (141)..(141): Xaa can be any naturally occurring amino acid
  misc_feature (371)..(371): Xaa can be any naturally occurring amino acid
  unsure (1)..(379): unsure at all Xaa locations
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAXVLSLYASGRTTGIVLDSGDGVSHTVPIYEGYALPHAILRLDLAGRDLTDSLMKILTERGYSFTTSAEREIVRDIKEKLAYVALDYEQELETAKNSSSVEKSYELPDGQVITIGAERFRCPEVLFQPSMIGMESSGIHETTYNSIMKCDVDIRKDLYGNIVLSGGTTMFPGIADRMSKEITALAPSSMKIKVVAPPERKYSVWIGGSILASLSTFQQMWISKDEYDESGPXAIVHRKCF

SEQ ID NO: 55940 - protein, 358 aa, uncultured bacterium
FTGDFHAITSANNLLAALLDNHIQQGNVKRIDSRSVVWKRCMDMNDRALRNIVVGLGSKSDGFVREDHFVITVASEIMAVLCLAEDLKDLKRRLGRIIVAYDLDGNPVTAEDIQAVGAMTALLKDAIRPNIIQTLEHTPAIVHGGPFANIAHGCNSVIATRTALKLADYCITEAGFGADLGAEKFLDIKCRQAGLTPSAVVLVATVRALKYNGGIPKDQLGTENLDALGKGIENLGKHIENIQSYGLPVVVALNAFVSDTDAEIEFVKEYCASKNCTMSVARVWEKGGEGGTELAELVIKATEEKSDFKFCYPDELSITGKIEAVAKKIYGADGVDIASSAAKQIAKIEEMGFGNLPV

SEQ ID NO: 55941 - protein, 344 aa, Candidatus Desulfococcus oleovorans Hxd3
MRPGCYTALITPFDDHGVDEEGLSRLVAFQMENGIAGIVAVGTTGESPTLTWNEHNRVTESIARQVKGRGICIAGTGSNNTAETLSATEHSVRAGADAVLLVDPYYNGPSSLEIRREYIEPVARAFPDTRIIPYVVPGRTGAQVLPEDLALAFQRFANVDTVKEATGNLENMRRTRQCCGDAFNILSGDDNLVFQMMTDPEIRACGVISVYSNIFPGAMSQMVAALDRGDKEEGRKISLALSPLLERVTVVSTEETPLGPVTCRARNPLPVKTLMALLGMPSGFCRQPLGRMTPAGIDSLVAAARKVFAGAPELFTPVAESFGVDVEARLFDGGVMKSLVYPDY

SEQ ID NO: 55942 - protein, 302 aa, Mycoplasma pulmonis UAB CTIP
MIILGIETSHDDTSIAIIEKGKILKMITWSQSDFFAQYGGTIPELSSRQHSQNIIRIIDKLKSEFDFSKIDAIAYTEKPGLIGTLQIGFLVAQALSRVLKIKAYPIDHIEGHFFSASFEKNYLFPALALIVSGGHSQLMLAKDKDNIEVIGSTLDDAIGEVFDKVATKLNLGFPGGPKIEALCKDNDFDLVKLTKPKTQGEFDFSFSGMKSQVINLANQKKHSSKNLACSFQKEAVDYLLEKTKKCLEKYKINSLILGGGVAANFLLREGFKKLHENVYIPSKELATDNAAMIAKVLYEKLK

SEQ ID NO: 55943 - protein, 528 aa, Burkholderia vietnamiensis G4
MKKHAWIRCTPIALAAALSLTACGGDDVTQQGLSAVKNVVVIYAENRSFDNLYGNFPGANGLQNATAANSVQKDRDGSTLATLPKVWGGLTATGITPAVTEAMTANLPNAPFAIDDPKGFNQPMSIATRDIVHRFYQDQMQIDGGKNDMYAAWTDAGGLTMGHYTPDPSKLPLWKLAQQYVLADNFFMGAFGGSFLNHQYLVCACAPYYPNADKSVAAGKIAVLNADGKSLQVASNSPASALSGPPKFVNDGALTPDFYGVNTMQPAYQPSGNKAATGGDPLLADPANPSTMPPQTATNIGDLMTGAGVSWAWYSGAWGQALQASQNGTSNVIYGADLSTPNFQPHHQPFNYYANQAPGTANRAQHLLDGGANGADFIKAIDAGTLPQVTFYKPQGNLNEHPGYTDVTSGDQHIADVIAHLQASPQWKNMVVIVTYDENGGFWDHAAPPSGDRWGPGTRIPALIVSPFAKKGFVDHTQYDTGSILRFITRRFSLPRLAGLQQRDDALKANGAQPMGDLTNALALSPNL

SEQ ID NO: 55944 - protein, 817 aa, Debaryomyces hansenii CBS767
MNEFPDEHRNSTSFTMHLLGDQVLGELYQDSRELKQWLIKSNCQHHYNKFIENGITFDLLKELDSSSLKEIGINKLGDRLRLELAISSMKSEKLADNITVDELYKIMNLHLTDSITLLSGGNISNGSVSTPTNESGTLTTLTNNPYLHSNVSSSSNAANKDANKNVTFILQDGSTKKVNVTGCFNAQSIKRKVLKRLGIKQQETLYNTYIHTSLNSKSNPGVNLLFDVELVTICYSPDRLEKHRIILCRKDEYPSDMAIESSKRLMAKYERYSQTDSLKTKSQDNFSQYHMPDPRKTHASPILRNFFGQRPPSELISSNLAEYFPEAHQKDLEATVRNSVRYSVRLSRRFNLPSSILSGASSNISIHNSQNKRSSILSNGTVSGPNGAPGTPSVSSMDQNSVAAKRKPSGRTIGEMMVNNINAIDQAVSSNDVQSVFSKPQSIGSDISGPGQGSFEPKSMKSHTSPILNRSSIAASFVDPFHTDNNRNSRIELLSIDSDDDEDDFIDEYGTYTSGELDHDFKDNMLDSISEDGPKNWLQGARIGAGSFGTVYLGMNPLTGELMAVKQVSLPDKNSINNSLQTAMIEALQHEMTLLKEINHENIVRYLGSSTDDNFLNIFLEYVPGGSVQSMLSSYGPFEEPLIRNFIRQILIGLSYLHGEDIIHRDIKGANILIDIKGTVKISDFGISKKVGNSDVDMDDETNSQKKGERRASLQGSVYWMAPEVVKQTAYTKKADIWSVGCLIVEMFTGKHPFPDFSQMQAIFKIGTHITPQIPEWCTSEAKDFLYKTFELDYEKRPDAIDMLAEPFLNPLIMSKQ

SEQ ID NO: 55945 - protein, 353 aa, Candidatus Desulfococcus oleovorans Hxd3
MELTLTRAQELKPHPKDDELAFGTVFTDHMFNMDYSPEKGWHTPRIEPYGPFELSPASMVLHYGQAVFEGLKAYRTASGGVQLYRPKKNLARLNESCRRLCIPEFNEEDLLDGLKQLVSLDQAWVPSTHGTSLYIRPFVIATDPYVGLRSSHTYRLAIILSPVGAYYPEGFNPVKIWVTRKYVRAVRGGVGHVKTAGNYAASLYATEEAHKEGYTQVLWLDGVEQKYVEEVGSMNIFFVINNELVTPALNGSILPGVTRDSVIEVARSWDMPVAERKISIDEVFEAQKSGALSEVFGSGTAAVISPVGMIKCDDLEVTIGDGSAGPMSKKFFDTLTGIQYGDAPAPDGWIEPV

SEQ ID NO: 55946 - protein, 300 aa, Helicobacter pylori 26695
MQFHSSSALITPFKKDLSVDEAAYETLIKRQIFQGMDACVPVGTTGESATLTHKEHMRCIEIAIETCKNTKTPSNSRMKVLAGVGSNATSESLSLAKFAQKIGADAILCVSPYYNRPTQQGLFEHYKTIAQSVEIPVMLYDVPSRTGVSIEVPTALKLFREVPNIKAIKEASGSLKRVTELHYYEKDFKIFSGEDSLNHSIMFSGGCGVISVTGNLMPNLISQMVNCALKQKYQQALEIQNKLFCLHQALFVETNPIPIKMAMHLAGLIENPSYRLPLVAPSKETIQLLEKTLQQYEVIA

SEQ ID NO: 55947 - protein, 162 aa, Zea mays
MRRNSPPTASGNRLAVIASHLSLPPLGSPAAISGEKEAALATDLNSTPTIFDKIIRKEIPSEVVYEDEKVLACRDISPQAPTHIIIIAKVKYGLSRLSKAEEGHVELLGNLLYAAKVVAEQEGLADGFRIVMDDGPRGSQSVYHRHLHVHLLGGRQMNWPPG

SEQ ID NO: 55948 - protein, 525 aa, Colwellia psychrerythraea 34H
MSKDIHDHRILILDFGSQYTQLIARRVREIGVYCELWSWDVTEEQIKGFNPTGIILAGGPESVTEANSPRAPEYVYTAGVPVLGICYGMQTMAEQLGGGVESSSHKEFGYAAVELIAQSALFNKVEDSIGDNGNALLDVWMSHGDKVSAIPEGFVTVAQTASCAYGAMANEEKQFYGVQFHPEVTHTKQGSRILENFVVDICKCEKLWTSASIIDDAIAKMKAQVGDDEVILGLSGGVDSSVVAMLLHRAIGDKLTCVFVDNGLLRLDEGQQVMDMFGDHFGLNIIKIEAEDRFLNRLAGESEPEAKRKIIGNVFIDVFEEESNKLDNAKWLAQGTIYPDVIESAASATGKAHVIKSHHNVGGLPDYMKLGLVEPLRELFKDEVRKIGLELGLPYDMLYRHPFPGPGLGVRILGEVKKEYADLLRRADAIFIEELHKHDLYTKVSQAFTVFLPVKSVGVMGDARKYDWVVSLRCVETIDFMTARWSHLPYDFLGLVSNRIINEIDGISRVVYDISGKPPATIEWE

SEQ ID NO: 55949 - protein, 783 aa, Gibberella zeae PH-1
MAPKKKIAVMTSGGDSPGMNAAVRAVVRMSLHMGCDAFCVYEGYEGLVQGGDFIRQMQWDDVRGYLGEGGTLIGTARCMAFYERPGRLVAAKNMVLSGIDALIICGGDGSLTGADRFRAEWPSLLEELISTGHLKEEQTTPYKHLNIVGLVGSIDNDLTGTDATIGCYSALARICEMVDYVEATASSHSRAFVVEVMGRHCGWLALMAGVATGADFVFIPERPRENDWQEEMKVVVRRHRALGKRKTIVIVAEGARDNNGTKIGAEEIKDILADKSKGGLALDTRITTLGHVQRGGTAVAYDRMLATLQGVEAVKAVLEATPETETPFIAINENKIVRKPLMQAVAETQELAKAVDAKDFDKAMSLRDAEFADQWNSYMLTTNVMVDDEKLPERERMRIGFINVGAPAGGMNAAVRAAVAYCLSKGHEPLAIHNGFAGFARHHDDKPLGAVRPFDWLEVDGWASKGGSEIGTNRELPAESGMELIANLIEEHNFDALFIVGGFEAFHSVTQMRKARTQFPSLCIPMCLLPATISNNVPGTEYSLGSDTCLNELVNYCDKIKQSASATRRRVFVIETQGGRSGYIATLAGLDVGASAVYIPEEGISLEMLNSDVNHLKEVFRKDKGQTRAGRLILVNEKASKVYSAKLIADIIREEAHDRFESRESIPGHVQQGGVPSPMDRCRAVRLAIKCIQHLEGYGRNAHNHVKKDPKSASVIGIQGSEVVFSGVEDLEENGTDWPNRRPKTAHWMGLSETVDMLAGRPSYPVPEKSLTGLIAKDTKRGL

SEQ ID NO: 55950 - protein, 417 aa, Rhizopus niveus
MSLSNKLSIRDLNLKDKRVLIRVDFNVPMKDGAITNNNRIVQALPTVKYALDNGASAVILMSHLGRPNGEAVAKYSLKPVAAEVEKLLGKPVEFLNDCVGPDVEKACQSAKDGKVILLENLRFHIEEEGSAKVDGQKVKADAEAIKKFRASLTTLADIYINDAFGTAHRAHSSMVGVDLSQRAAGFLMQKELEYFAKALENPSRPFLAILGGAKVSDKIQLIENMLDKVNALIICGGMAFTFKKTLDNVKIGKSLFDEPGSKLVQNLVKKAAEKNVKIVFPVDFITADKFAPDASTGYATDDDGIPDGWQGLDCGERSNKLFREEILKSKTIVWNGPSGVFEFDAFSSGTKAVLDAVINATKEGATTIIIGGGDTATAALKWGAEGQVSHISTGGGASLELLEGKELPGVTALSSKN

SEQ ID NO: 55951 - protein, 250 aa, Pseudomonas aeruginosa PAO1
MRAVVELLAGARRLVIFTGAGVSAESGIPTFRDALGGLWARYDPAALATPAAFADDPALVWGWYEWRRLKVLGVQPNPAHRAIAALSGRIANTRLVTQNVDDLHERAGSRDVLHLHGSLHAPRCATCAAAYRDALPDSVEPEEGRRIEPPRCPACGGQVRPGVVWFGEALPEAALREAFAAACECDLLLSVGTSGVVQPAARIPGLALEHGASVVHVNPQPVRTRHPREHCLVGPAGEVLPELLRRAFPG

SEQ ID NO: 55952 - protein, 342 aa, Schizosaccharomyces pombe 972h-
MFGGSFFSSDDDGFSMMSQLRSAFHNNVNQRFDTRYRCYPVAMIPGEERPNVNYGGKVILPPSALEKLSRLNVSYPMLFDFENEAAEKKTHGGVLEFIAEEGRVYLPYWMMTTLSLEPGDLVRVINTDIAQGSYVKLQPQSVNFLDITDHRAVLENALRNFSTLTKSDIFEILYNDQVYQIKVIDVQPDDSRHVVSVVETDLVVDFDPPIGYEESLQKNKQQNIAGVQGTMVTKIGYDELVRQGDSNLMKGTGTKLNGKEVAEVPKINLLDVEKQECPAPLILPLGTYFFGYPYKAPSIEEDSKKDPNLFKFEGAGTSLRASRKTNGTMGKGSSDDPIDIDA

SEQ ID NO: 55953 - protein, 417 aa, Yarrowia lipolytica
MSLTNKLSIKDLDLKNKRVFIRVDFNVPLDGTTITNNQRIVAALPSIKYAIDQGAKAVILASHLGRPNGQRVEKYSLKPVQAELSKLLGKPVTFLDDCVGPKVEEEVSKAKDGEVILLENLRFHPEEEGSHKDADGKKIKADPAKVEEFRKSLTSLADVYVNDAFGTAHRAHSSMVGIELPQRAAGFLVAKELEFFAKALEHPERPFLAILGGAKVSDKIQLIDNLLDKVNALIIGGGMAFTFKKTLENVKIGNSLFDEDGSKIVAGLVEKAKKNNVKLVFPVDYVTADKFSKDAKVGHATDAEGIPDGWQGLDCGPKSIEEFQKVIGESKTILWNGPPGVFEFDNFAKGTKAVLDACVKAVDNGATVIIGGGDTATVAKKYGAEDKLSHVSTGGGASLELLEGKTLPGVAALSEKK

SEQ ID NO: 55954 - protein, 472 aa, Streptomyces avermitilis MA-4680
MAGIRMGEGVLRRKPIEQIEETEAGTQLERTLGLWQLTAIGVGGIIGAGIFTLAGTVANGTAGPAVLVSFLIAGFASAAAALSYAEFAGLIPKAGSAYTYGYAVLGELAGWFIGWDLLLEYTAIVAVVAIGISGYFGFLVGELGADLPAWMLGAPGTGGGHRVDLFAAILCLLIAYLLNLGIKSAARFETVVVALKVLVVLLVIGVGVFHIDTGNYHPFFPYGVGGAFTGAATVFFAVFGYDAMSTAAEESKDAQRHMPKAIIYSLAISMVLYVAACLVLTGMQNYKDIDKESGFSTAFKSVGLGGLADVIAVGAIIGILTVMFTFMLGVTRVWFSMSRDGLLPKWFAKTHPTRHVPTRVTWIVGFASAAIAGFLPIGQAAELTNIGILLAFVVVCVAVIVLRYRQPDLPRTFRTPWMPYVPALGVIFSIWLITFLQWRTWVRFGVWLVIGLVIYFGYSYKRSELAKGVNSP

SEQ ID NO: 55955 - protein, 417 aa, Rhizopus niveus
MSLSNKLSIRDLDLKNKRVLIRVDFNVPMKDGAITNNNRIVQALPTVKYALDNGASAVILMSHLGRPNGEAVAKYSLKPVAAEVEKLLGKPVEFLNDCVGPDVEKACQSATGGKVILLENLRFHIEEEGSAKVRWSKVKADAEAVKKFRASLTALADIYVNDAFGTAHRAHSSMVGVDLSQRAAGFLMQKELEYFAKALENPARPFLAILGGAKVSDKIQLIENMLDKVNALIVCGGMAFTFKKTLDNVKQIGKSLFDEAGSKLVRNLVKKAAEKNVKLVFPVDFVTADKFAPDANTGYATDADGIPDEWEGLDCGKKSSELFREEILKSKTIVWNGPSGVFEFDAFANGTKSVLNAVIEATKEGATTIIGGGDTATAALKWGAEGKVSHISTGGGASLELLEGKELPGVTALSSKN

SEQ ID NO: 55956 - protein, 390 aa, Silicibacter sp. TM1040
MTVFVTGPAARDDVTFVPRHLQYIANTRFERPTLVIDSEAVARQYMGLARGLGRARIHYAVKANPAPEILRRLCALGSNFDAASRAEIEMCRAAGASAARITFGNTIKKPADIAFAHALGITHFAADAVEELEKLAEHAPGAHVCIRILVEASSADWPLSRKFGCAPDMAVGLMDRCVALGLVPHGLSFHVGSQTRKPEMWEPILDQVADVWQAARAAGHDLKLLNIGGGFPAGYRDAVMAPQDYASEVMKRVNARFPDAAEVMAEPGRGLVAEAGAIAAEVMLVSRKHDSDLHRWVYLDIGKFSGLAETMDEAIRYKITTDRDHETMGACVLAGPSCDSADVLYEKQPVQLPLGLTSGDRVVIHSCGAYTTTYASIGFNGFPPLDVVVL

SEQ ID NO: 55957 - protein, 307 aa, Prochlorococcus marinus subsp. marinus str. CCMP1375
MSGIQVLLVAGTHGNEINAPWLFEQWKQKDSLINTHNINIQTVIGNPVALEQGKRYVDRDLNRSFRKDLLLSSDLNAAEHFRALELVSEYGPNGNNPCQIAIDFHSTTSSMGSSLVVYGRRPADLAIVSLIQNHLGLPIYLHEGDNAQSGFLVESWPCGFVVEVGPVPQGLLHFQIINQTLLTLDSCLKEISNVINSKTVYPEQLIVHRHLKNIDFPRDSSGVPSSLVHKDIQGRDWYPIKNGHPLFESLSGDLTLLLEGGLEEEFVPVFINEAAYAEKNIAMSLTKKEMWDVQKDWINDLSKLLNP

SEQ ID NO: 55958 - protein, 352 aa, uncultured bacterium
ITAANNLLAAMLDNHIHQGNELRIDLRAITWKRALDINDRALRNVVVGLGNKSDGFVREDHFVITVASEIMAVLCLADDMEDLKERLGRMVVAYDLDGKAVTAKGLKAVGSMAALLKDAIKPNLIQTLEHTPALVHGGPFANIAHGCNSVRATKAALKMADYCITEAGFGADLGAEKFLDIKCPSANIAPSCIVLVATVRALKYNGGLAKDSLKEENLDALKKGIVNLEKHIENLQKYNVPVVVTLNRFDTDTPDELKFVEEFCTSRGCEFALSEVFAKGGEGGEDLARKVISSIENKEAHFKSIYEKDEPVDVKIEKVATEIYGASKVVYSSKALTSLKKLKDLGYGNLPV

SEQ ID NO: 55959 - protein, 408 aa, Methanococcus maripaludis S2
MENNVNIDEIVEKLLKKEIKVYQLDSKFGERNAVIARRKYVEKLSNVETRHIQEYTLDEKLAMQKNIENMIGAVQIPLGFAGPISINGKYAQGEFNVPLATTEGALVASINRGCSIITKCGGATVRVIDDKMTRAPIIKTNSVVDALKLKEWILDNFAKIKEIAESTTRHGKLIQISPILIVGRNVYPRFTFKTGDAMGMNMVTIATEKACSFIESELKKEGIIIDTVALSGNVCVDKKPAAINLIEGRGKSVVAEVFLKEEYVEKYLKTTSKAIEQVNTYKNLIGSAISSSLGFNAQYANIVGALFLATGQDEAHIVEGSMGITTAECTGDGLYFSVTLPDLPVATIGGGTRVETQRECLEILGCAGAEKAVKFAEIAGAAVLAGELSLIGALAAGHLAKAHSELGR

SEQ ID NO: 55960 - protein, 352 aa, uncultured bacterium
ITSANNLLAAMLDNHIQQGNVLGIDPRQVKWKRCLDMNDRVLRNTVVGLGAKADGMVREDHFVITVASEIMAVLCLADDLAGLKKRLGRMIVAYTFDGKPVTADDLSATGAMAALLKDAIKPNLIQTLEDTPAIVHGGPFANIAHGCNSVRATKMALKLADVVVTEAGFGADLGAEKFFDIKSRAAGLNPECVVLVATVRALKYNGGVAKEDLSNPNLEALKMGIVNLEKHIENLSKYNVPIVVTLNAFVSDTDEEISYVENFCKERGCEFALSEVWEKGGEGGLALAEKVMDTLENKTSNFAPLYDVNLSIKEKIETIAKEIYGADGVTYSAAANREIGKIEQLGLDKVPV

SEQ ID NO: 55961 - protein, 198 aa, Triticum aestivum
MATHHRPLHALLGGGAVADLLLWRRRNASAAAVAGASVVWFLFERAGYSLASVLSNALLLLVVILFFWAKSASLLNRPLPPVPNLEVSDVVVEKAVGRALVWINKVLAVAHDIAIKRDRTVFIQVIMALWVVSCIGMIFNFFTLIYIGVLLALLIPPVYERHQDVIDEKVGLSHSILSRHLNTVVSKTGQPPKQKKAE

SEQ ID NO: 55962 - protein, 552 aa, marine gamma proteobacterium HTCC2143
MYIYNQYDQQLVDERVAQYRGQTERYLAGEISDDQFLPLRLQNGLYIQRLAPMLRVAIPYGTFNSQQMRKLAHISRHYDKGYGHFSTRQNIQLNWPQLEEVPDILAELAEVQMHAIQTSGNCIRNTTTDQFAGAAADELEDPRPYCEIVRKWSTFHPEFAFLPRKFKIAFCASKADRAAIQMHDIGIEVVHNASGETGFRILVGGGLGRTPVIGTEIIEFLPKQHLITYLEAILRVYNQLGRRDNKYKARIKILVRAMGIDAFRDKVEQQWALLKDGPSTLTEEEFERSKSYFHSPEYIEVDDSDADLKLQQQALQDPGFGNWLKRNVDAHQAPGYAIVTLSLKTTGYAPGDISDVQMEAVADMAEQFSFGEIRASHQQNLVLAHVRKEQLFALWEQAKTFGFATPNINYLTDMICCPGGDFCALANAKSLPVADAIQRKFDDIDYMYDLGEIDLNISGCMNACGHHHIGHIGILGVDKKGKEFYQISLGGSQDRDASLGKILGPSFSQAEVPDVIEKILNTYISLRIDGESFLDTYRRAGLAPYKESVYAK

SEQ ID NO: 55963 - protein, 322 aa, uncultured bacterium
HIKQGNELDVDLNNIIWRRCVDMNDRQLRNVVDGLGTAGDGVCREDGFDITVASEVMAVFCLATSLDDLKARLGRMVVAYSRSGKPVTVADIKAEGACTALLKDAIKPNLVQTLENNPAFVHGGPFANIAHGCNSVQATMTAMKMTDYVVTEAGFGADLGAEKFMDIKCRYAGFNPSCVVIVATVRALKHHGGVAKADLNNENLQALEAGLPNLLQHVSNVKEVFGLSPVVAINAFPTDTEAELKLVQDKCAELGVNAVLAEHWAKGGEGATALAEEVVRICDQPNDFKFCYDVEMGIEEKIEAVAKRVYHADGVDYTPKAK

SEQ ID NO: 55964 - protein, 263 aa, Prochlorococcus marinus subsp. marinus str. CCMP1375
MRFRPLLALVLAFCLTFIAAPSSVSASGERGNSRFADVVNTGKANDCPTVSAGSQGSLSIDGGLTDICMHPTEVYVKVAKSRRSKAEFVPAKIISPRNNTTVEQVYGDVSGSTFKEQGGIDFQLITVLAPNGEEFPFVFSAKQMAVDFKGKSIAPGAEASGTTYTPSYRTGDFLDPKSRAKDTGVEYAQGLVALGGDDEELAKENIKRDLDGKGVITLAIDSVDSDTAEFAGSFVAIQPSDNDLGSKEPVDVKIIGELYGRKA

SEQ ID NO: 55965 - protein, 352 aa, uncultured bacterium
ITSANNLVAAVLDNHLQQGNELNIDPKRIILKRCLDMNDRALRNIVIGMGKKVDGVVREDHFIITVASEVMAILCLAEDLEDLKARLSRMIVAYTRDGKAVTPADLKCVGAMTVLLKDAIRPNLIQTLEHTPALVHGGPFANIAHGCNSIRATRTALRSADYVVTEAGFGADLGAEKFLDIKCRMAGLKPDAVVLVATIRALKYNGGVEKQALSEENLDALGKGIVNLGKHIENLKKFGFTPVVTLNRFVSDTNAEIDFVRSFCSGLGCELTVSEVWAKGGEGGMQLAEAVLRQLEAGSSDYHPIYDSSLSLREKIETISREVYGAAGVEYTAEAAKALDIAEQEGFGGLPV

SEQ ID NO: 55966 - protein, 145 aa, Triticum aestivum
MNARGFRSTRTALFDGIEEGGIRASAYSSHEIFLHENERAMDGLQDRFRILKRISGDINEEVEAHNRMLDRMGNDMDSSRGFLSGTVDKFKTVFETKSSRRMGTLVASFVALFMLVYYLTRYKGPWVASSSYLRLCVEGGCPRTC

SEQ ID NO: 55967 - protein, 353 aa, uncultured bacterium
IGAANNLLAAMPDNHIQQGNALGIDVKKITWKRCVDMNDRQLRFVVDGLGGKANGTPREDGFDITVASEIMAVFCLASSMKDLKERLGRIIVAYTYDDKPVTAGDLKATGAMGALVGDALKPNLVQNLEGTPGFVHGGPFANIAHGCNSVMATRMAMRMGDYTVTEAGFGADLGAEKFLDIKCRMAGLTPDAVVIVGTVRALKMHGGLDKKQLASEDLAALEKGIPNLLRHVNNIKNVYQLPCVVAINRFPTDTDAEIDFIIRKCRELGVNTVLSTVWAEGGKGGEDLAREVVRLCEEEKGNFTFSYELDASIEEKLEAVTKKIYGGAGVSLTPNAKKQAERLTELGFDKMPV

SEQ ID NO: 55968 - protein, 459 aa, Arabidopsis thaliana
MLREECTPSSSWWEDVQHHHNDHANSISSTSFYHKSSNNNSHANASCEEDNLSVSTVRASNRLDLTAESSNHHSLSASNQPASSSDELLRDHVVSSHNHLWSLAFLPGRSLGDQMMDHHHHIASRNSSTTSELPSFEPACHNGNGNGWIYDPNQVRYDQSSDQRLSKLTDLVGKHWSIAPPNNPDMNHNLHHHFDHDHSQNDDISMYRQALEVKNEEDLCYNNGSSGGGSLFHDPIESSRSFLDIRLSRPLTDINPSFKPCFKALNVSEFNKKEHQTASLAAVRLGTTNAGKKKRCEEISDEVSKKAKCSEGSTLSPEKELPKAKLRDKITTLQQIVSPFGKFFSLSTFLFKKYNEENETFRLKTFQTDTASVLQEAITYINFYQEQVKLLSTPYMKNSSMKDPWGGWDREDHNKRGPKHLDLRSRGLCLVPISYTPIAYRDNSATDYWNPTYRGSLYR

SEQ ID NO: 55969 - protein, 519 aa, Helicobacter pylori 26695
MLLIVFFKFYFQYSIKKKSFYFIFVIIQAIFIFNLRRCRMDNQKITHQNITQKQGELKRDMKMRHLLMIAFGGAIGTGLFVGTGGNIASAGPLGTLIAYCFGGLVVYCIMLSLGELASVYPTTGSFGDYAAKFIGPGTGYMVFWMYWLGWVITVALEYIAIGMLMQRWFADIPIHYWVILCIALVFLLNFFSVKIFAEGEFFFSLIKVLAVIAFIGIGAIGIIYQIYSHGFGSIFDNFHFGDKGFFPNGSAAVFSAMLAVIFAFTGTEVIGVAVGETKNASEVMPKAIKATLWRIVFFFLGSVFVISVFLPMNDSSITQSPFVSVLERINLPFIGMGIPYVADIMNAVIITAMFSTANSGLYGASRMIYGLSKQKMFFKVFSQLNRQGTPTYAMFFSLSFSLIGLLVQIYAKENVVEALINVISFTVIIVWVSVSVSQYSFRKQYLKAGHSLEDLPYKAPFLPFLQLIGITGCAIGVIGSAMDKDQRIGMILTIVFAVICYIGYYFTQKANENNKKDLI

SEQ ID NO: 55970 - protein, 261 aa, Cryptococcus neoformans var. neoformans JEC21
MRVPTTMSPVIILTGASRGLGLAVLRILLAKHNARVATLSRSLTPELQGAVDEYGADRVLPVQGDVSKPEDNARVVKEAVDKWGQLDGLVLNAGSIDPVDKIGNVQLDALIPYVQTNLLSTIYLLQPALPHLRKSKGRVVLVSSGASSTGYQAWGLYSMAKAGMNSLARTVASEEKENGVAIWSVRPGMVNTDMQSFLRTHGPAEMSPTDMAKFQSAYEKGELLAPEQPGSVLAGMAVNGPIELSGEYINWADERLKAFQA

SEQ ID NO: 55971 - protein, 477 aa, Aspergillus oryzae
MKSTALLTGLGLLASLGLASPVTSEYTSVREAPFGYKPGSKESIENLKDKVENIVWLILENSLWYVKTSTNIWSRSFDNILGGVRRQGLDNPINNGPFCNYKNASDPSSGKYCTQAKDYDSVFNDPDHSVTGNNLEFYGTYTPNNGAIASGKVVADQSGFLNAQLNDYPKLAPEEATRQVMGYYTEEEVPTLVDLVDEFTTFNSWFSCVPGPTNPNRLCALAGTAAGHGKNDDDFLNYGISSKSIFEAANEKGVSWLNYDGTNGEFEPDSLFFTYVNQTSRSNVVPVENFFQDAYLGVLPKFSYINPSCCGTNTNSMHPTGNVSYGEVFVKQIYDAIRQGPQWDKTLLFITYDETGGFYDHVPPPLAVRPDNLTYTETAKNGQKYTLHFDRLGGRMPTWVISPYSKKGYIEQYGTDPVTGKPAPYSATSVLKTLGYLWDIEDFTPRVAHSPSFDHLIGTTLREDAPIALKTPHTFSV

SEQ ID NO: 55972 - protein, 64 aa, Oryza sativa
SIKMLEGIIATSYSEGDKFYIDPMKLLPLSRFLPQPKYDASLIYSLLFPVLNLLVDSGSRANLN

SEQ ID NO: 55973 - protein, 489 aa, Novosphingobium aromaticivorans
MRCDMAICPSRSTGIGKFVCGASGNPLDPTRHAGEMAPRKDAGEVSATAPSSLRYQDTENTPMPIAIKMPALSPTMEEGTLAKWLVKVGDKVSSGDIMAEIETDKATMEFEAVDEGTIVSIDVAEGSEGVKVGTVIATLAGEDEDASAPAPKAVAPAAAPVPVPAPKAEPAPAAVSTPAPAAASASKGDRVIATPLAKRIAADKGIDLKGVAGSGPNGRIIRADVEGAKPAAAAPVSTVAPAVASAAAPARAPAAVPDFGIPYEAQKLNNVRKTIARRLTEAKQTIPHIYLTVDIRLDALLKLRGDLNKALEAQGVKLSVNDLIIKALAKALMQVPKCNVSFAGDELRSFKRADISVAVAAPSGLITPIIVDAGSKSVSAIATEMKALANKAREGKLQPHEYQGGTASLSNLGMFSIKNFDAVINPPQAMIMAVGAGEQRPYVIDGALGIATVMSATGSFDHRAIDGADGAELMQAFKNLIENPLGLVA

SEQ ID NO: 55974 - protein, 332 aa, Salmonella enterica subsp. enterica serovar Typhi str. CT18
MKTLGEFIVEKQHEFSQATGELTALLSAIKLGAKIIHRDINKAGLVDILGASCAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLIYTTGCGVHAFTYDPSLGVFCLCQERMRFPEKGKTYSINEGNYIKFPNGVKKYIKFCQEEDSSTSRPYTSRYIGSLVADFHRNLLKGGIYLYPSTASHPQGKLRLLYECNPMAFLAEQAGGKASDGKERILDIIPESLHQRRSFFVGNRHMVDDVERFIREYPDA

SEQ ID NO: 55975 - protein, 461 aa, Novosphingobium aromaticivorans
MAIELKMPALSPTMEEGTLAKWLVKAGDEVRSGDILAEIETDKATMEFEAVDEGVIAEILVAEGTEGVKVGTVIATIQGEGEDAAPAAATPAVEQKVEMSEAAPSVEARAAPAVAIAPKVDAKPAVDPEIPAGTAMVPTTVREALRDAMAEEMRADDRVFVMGEEVAEYQGAYKVTQGLLDEFGPRRVIDTPITEYGFVGIGAGAAMGGLRPIIEFMTFNFAMQAIDHIINSAAKTNYMSGGQMRCPIVFRGPNGAASRVGAQHSQNYGPWYANVPGLVVIAPYDSADAKGLMKAAIRSEDPVVFLENELVYGRTFDVPQMDDFVLPIGKARIVRQGKDVTIVSYSIGVGLALEAAETLAAEGIDAEVIDLRTLRPLDKDTVLASLAKTNRLVVAEEGFPVCSIASEIMAICMEDGFDHLDAPVLRVCDEDVPLPYAANLEKAALIDAGKIAAAVRKVCYR

SEQ ID NO: 55976 - protein, 562 aa, Photobacterium sp. SKA34
MNNDKRPLYIPYAGPALLETPLLNKGSAFSVEERMYFNLEGLLPEAIESIEEQTERAYQQYLKFDNDMDKHIYLRNIQDTNETLFYRLVENHVTEMMPIIYTPTVGSACEDFSNIYRRGRGLFISYPNRDRIEDMLNNASRQNVKVIVVTDGERILGLGDQGIGGMGIPIGKLSLYTACGGISPAYTLPVVLDVGTNNPQRLSDPMYMGWRHSRITGKEYDAFVDEFIQAVKQRWPEALIQFEDFAQKNAMPLLERYKDKVCCFNDDIQGTAAVTVGSLLAACKAAGNKLSEQRVTFLGAGSAGCGIAEAIIAQMVSEGISDAQARSQVFMVDRWGLLIDGMPNLLNFQQALVQKNTQLADWDVADNNISLLDVMRNAKPTILIGVSGVPGLFSEEVIREMYAHCERPIIFPLSNPTSRVEATPFDIIRWTDGNALVATGSPFEPVVYEGKTYPIAQCNNSYIFPGIGLGVLAVNARRVTNEMLMESSQALAECSPLAIHGHGPLLPPLEEIQKVSRKIAFAVAKKAVEQHKAPKNSDERIREKIDANFWKSEYRRYKRTSF

SEQ ID NO: 55977 - protein, 406 aa, Novosphingobium aromaticivorans
MLNELRIPRMGSVENARLLNWRVQEGEAYEPGQVLYEIETDKTSVEVEAEGPGVLARHLAAVGDEFKVGDRIGLWALPGTAPATLRAALSPQPMRASERAPSPSSTLPAAVSAPGLHALRPVSRDAAGGRRVSPLARRLAAQNGVDLATVTGTGMGGKISGKDVLAASAKPRPAPVPVSPPRPGSDGEIVPHSLRRRTIAQRMVEAAAIPTLTADMEVDLTALFARRRSVEGNGASVLGMIAEAAIAALLQHRRLNAHWREDAMVQFGAVHLGIAVDTPEGLVVPVVRNAESLNARGLTDAIAALADKARAGTLRPQDMEGGTFTISNPGSMGPVVRAEALLNPPQVALLGLPGIVRAPVAIKDGDAWAMAVRPLLRLSLSFDHRALDGGPVIAFLNTLKATLERP

SEQ ID NO: 55978 - protein, 506 aa, Oryza sativa
MAPPQTIPRRGLFIGGAWREPCLGRRLPVVNPATEATIGDIPAGTAEDVEIAVAAARDAFSRDGGRHWSRAPGAVRANFLRAIAAKIKDRKSELALLETLDSGKPLDEASGDMDDVAACFEYYADLAEALDGKQQSPISLPMENFKSYVLKEPIGVVGLITPWNYPLLMATWKVAPALAAGCTTILKPSELASVSCLELGAICMEIGLPPGVLNIITGLGPEAGAPLSSHSHVDKVAFTGSTETGKRIMISAAQMVKPVSLELGGKSPLIVFDDIGDIDKAVEWTMFGIFANAGQVCSATSRLLLHEKIAKKFLDRLVAWAKNIKVSDPLEEGCRLGSVISEGQYEKIKKFISTARSEGATILYGGGRPQHLRRGFFLEPTIITDVSTSMQIWQEEVFGPVICVKEFRTESEAVELANDTHYGLAGAVISNDQERCERISKALHSGIIWINCSQPCFVQAPWGGNKRSGFGRELGEWGLDNYLTVKQVTKYCSDEPWGWYQPPSKL

SEQ ID NO: 55979 - protein, 821 aa, Anabaena variabilis ATCC 29413
MVEIIIDPQTSNSVFKEQALVLPLNQVGIADIPLVGGKNASLGEMIQQLRRKGVKVPTGFATTANAYRYFITSAGLEAKLREIFADLDVEDVQNLRQRGKQARLLMLQTPFPQELQTAIAQAYATLCQEYGDDTDVAVRSSATAEDLPDASFAGQQETYLNVHGLQAVLESCHKCFASIFTDRAISYRQIKGFDHFNIALSVGVQKMVRSDLATSGVMFSIDTETGFKDAALITAAYGLGENVVQGAVNPDEYLVFKPTLKQGYRSIIEKRLGTKEIKMIYDLGGSKLTKNISVTPSERSVFALNDEDILQLAHWACIIEEHYSQVRGVYTPMDIEWAKDGLTNELFIVQARPETVQSQKVNNVLRNYRLSPAPIPNPQPLIPLITGRSVGEMIGQGKARVILDVHQISQFQAGEVLVTNRTDPDWEPIMKRASAIVTNSGGRTCHAAIIAREMGIPAIVGCGNATTFLKTGQEITVSCAEGETGKVYSGLIPYEVQEIPLEKLPSTHTKIMMNVGNPEEAFGLTSIPNDGVGLARMEFIINNHIKAHPLALIHFDELEDELAKYKIAELTAQYEDKTLFFVDKLAQGIATIAAAFYPKPVIVRLSDFKSNEYANLLGGKQFEPKEENPMIGWRGASRYYDPRYREGFALECQAMKRVRDEMGLTNVILMVPFCRTPNEGRRVLDEMIKHGLVQGENGLQVYVMCELPSNVQLADEFSQVFDGFSIGSNDLTQLTLGLDRDSELVAHLFDERDEAVKRMIAKAIATVKQYGRKIGICGQAPSDYPDFARFLVEQKIDSISLNPDSVLKTLLEIAAAEEKEL

SEQ ID NO: 55980 - protein, 207 aa, Colwellia psychrerythraea 34H
MKKIMMLLANGVEPLEMSVFTDVMGWATILGDEAIELTDVALHTEIETTFGLTIKPSKMLQDIDLADYDAIAIPGGFEPSGFYVDALSEPFIKAIKYFNEQGKTIASVCVSSIALGNAGILTGKKATTYHQVGGKRKQQLEESGAIFIDRPIVQDQHIITSTGPGTAIEVAFSLLEQVTSAENVAEIRRKMRVPTPSDDWYLSPQVT

SEQ ID NO: 55981 - protein, 526 aa, Vitis vinifera
MEVGDGSFAPVGVSKQRADQYKGRLTTYVVVACLVAAVGGAIFGYDIGVSGGVTSMDTFLEKFFHTVYLKKRRAEEDHYCKYNDQGLAAFTSSLYLAGLVASIVASPITRKYGRRASIVCGGISFLIGAALNAAAVNLAMLLSGRIMLGIGIGFGDQAVPLYLSEMAPAHLRGALNMMFQLATTTGIFTANMINYGTAKLPSWGWRLSLGLAALPAILMTVGGLFLPETPNSLIERGSREKGRRVLERIRGTNEVDAEFEDIVDASELANSIKHPFRNILERRNRPQLVMAICMPAFQILNGINSILFYAPVLFQTMGFGNATLYSSALTGAVLVLSTVVSIGLVDRLGRRVLLISGGIQMVLCQVTVAIILGVKFGSNDGLSKGYSVLVVIVICLFVIAFGWSWGPLGWTVPSEIFPLETRSAGQSITVVVNLLFTFIIAQCFLSMLCSFKHGIFLFFAGWIVIMTLFVYFFLPETKGVPIEEMIFVWKKHWFWKRMVPGTPDVDDIDGLGSHSMESGGKTKLGS

SEQ ID NO: 55982 - protein, 363 aa, Schizosaccharomyces pombe 972h-
MSKKPVLNLDTSNGFSEEYISHPERNDNQGIVEITDLVFSSESKLTQRKESRDSKTFVPSFLEELDDDHLHELVTNGGILYMNSLGEGVSGSVRKCRIRGTQMIFAMKTVLAAPNTALQKQLLRELKINRSCTSPYIVKYYGACYNNAECQLNIAMEYCGAGSLDAIYKRVRSQGGRTGERPLGKIAFGVLSGLSYLHDRKIIHRDIKPSNILLTSKGQVKLCDFGVSGELVNSLAGTFTGTSYYMAPERISGGSYTISSDIWSLGLTLMEVALNRFPFPPEGSPPPMPIELLSYIINMPPPLLPQEPGIKWSKSFQHFLCVCLDKDKTRRPGPQKMLTHPWVKAFERIHVDMEEFLRQVWSD

SEQ ID NO: 55983 - protein, 1257 aa, Arabidopsis thaliana
MDQAKGYEHVRYTAPDPRDEGLGSINQRFSHDSSTNVNTYVRPPDYGVSTPARPVLNYSIQTGEEFAFEFMRDRVIMKPQFIPNVYGEHSGMPVSVNLSALGMVHPMSESGPNATVLNIEEKRQSFEHERKPPSRIEDKTYHELVQSAPVISSKNDTGQRRHSLVSSRASDSSLNRAKFLCSFGGKVIPRPRDQKLRYVGGETRIIRISKTISFQELMHKMKEIFPEARTIKYQLPGEDLDALVSVSSDEDLQNMMEECIVFGNGGSEKPRMFLFSSSDIEEAQFVMEHAEGDSEVQYVVAVNGMDLSSRRSSLGLSPPGNNLDELLHGNFDRKIDRAATEPAVASLTPLAGNESLPASQTSQPVTGFSTGNEPFSQPYLGQQLQFPGLGNHQIYTSGHMASIGYIDEKRSAPLHVQPQPHYIPYSVNPETPLESLVPHYPQKPEQGFLREEQIFHVQDPETSSKEAKMRRDDSFQKVNDHPISTVESNLSAKEPKMRRESSTPRVNEYPVSSMPSDLIVPDDLPKEEAPIVTQTSSSTPDPSSSTLSEKSLRKSEDHVENNLSAKEPKMRKEHSTTRVNEYSVSSVSSDSMVPDQALKEEAPISMKISNSTPDPKSLVYPEKSLRTSQEKTGAFDTTNEGMKKNQDNQFCLLGGFSVSGHGTSNNSSSNVSNFDQPVTQQRVFHSERTVRDPTETNRLSKSDDSLASQFVMAQTTSDAFLPISESSETSHEANMESQNVHPTAPVIPAPDSIWTAEGSMSQSEKKNVETNTPEHVSQTETSAKAVPQGHNEKGDIVVDINDRFPREFLADILKTKESLNFPGLGPLHADGAGVSLNIQNNDPKTWSYFRNLAQDEFERKDLSLMDQDHPGFPTSMTNTNGVPIDYSYPPLQSEKVASSQIHPQIHFDGNIKPDVSTITIPDLNTVDTQEDYSQSQIKGAESTDATLNAGVPLIDFMAADSGMRSLQVIKNDDLEELKELGSGTFGTVYHGKWRGTDVAIKRIKRSCFIGRSSEQERLTSEFWHEAEILSKLHHPNVMAFYGVVKDGPGGTLATVTEYMVNGSLRHVLLSNRHLDRRKRLIIAMDAAFGMEYLHSKSIVHFDLKCDNLLVNLKDPARPICKVGDFGLSKIKRNTLVTGGVRGTLPWMAPELLSGSSSKVSEKVDVFSFGIVLWEILTGEEPYANMHYGAIIGGIVNNTLRPTVPNYCDPEWRMLMEQCWAPDPFVRPAFPEIARRLRTMSSSAVHTKPHAVNHQIHK

SEQ ID NO: 55984 - protein, 314 aa, uncultured bacterium
GNELDIDPRRITWHRAVDMNDRQLRNAVDGLGGKAQGYVREDHWDITVASEVMAVFCLSTSIDDLKERLARIVIGYSRAGKPITAGDLNAQGAMAALLKDALKPNLVQTLEGTPAFVHGGPFANIAHGCNSVLATQMAMHFADYVVTEAGFGADLGAEKFMDIKCRMAGLKPDAVIIVATVKALKYNGGVPKADVQKENLEALEAGIPNLLKHVENIKNVFGIPAVVALNKFVTDTDAEIELVTRKCKELGVNVKLSEVWGKGGEGGLELAEEVIRLCDQPSELHYAYELDMPITEKIEAIATKVYGADGVDFA

SEQ ID NO: 55985 - protein, 313 aa, Vitis vinifera
VCTTNALGRVMLGRRVFGDGSGGEDPKADEFKEMVVELMVLAGVFNIGDFVPALEWLDLQGVASKMKKLHARFDAFLGAIVEEHKISGSAGSERHVDLLSTLISLKDNADGEGGKLTDVEIKALLLNLFTAGTDTSSSTVEWAIAELIRHPEMMAQAQQELDAVVGRGRLVTDLDLPKLTYLQAIVKETFRLHPSTPLSLPRMAAESCEINGYHIPKNATLLVNVWAIARDPEVWEEPLEFRPNRFLPGGERPNADVRGNDFEVIPFGAGRRICAGMSLGLRMVHLLTATLVHAFNWELPEGQVAEKLNMDEA

SEQ ID NO: 55986 - protein, 417 aa, Oryza sativa (japonica cultivar-group)
MASPAKAQRRPEGASVLETLPALPLAIIIAKAGPRCAAALACASSTLRAAASGEALWRHFCSDDFALDAPLAPGDLPLPSFKDAYKAWFQSFGMYPLPLVKRVKIFWSSFRAWLCEYFPEGLRTLGEGVSEAEIAVAECNLGLVLPMPTKLLYRFCNGQLHIGRGEEVSYGVMGGYDYVHQRYTVRLLPLAHHAVQKNSNYIVVATSCFGEKIFLLDCASGRLYVGTKYWNEEREIMACVPKATIRLAVDDDHGMPQDGFLLWLEEHLSRLQDGLIKVQSCKFPMLARHISLYPVQLPYCSSASMHGIKVRASAVFAPENSAFADYRCRYSYYFSIRLSLPEAFVVDGKWYSSFQLQSCHYTIQIGDEVLPYTCNYGGHGKCPLLRCGEELFVYGCSISAALEPGSVMGNLTLVPWR

SEQ ID NO: 55987 - protein, 240 aa, Crocosphaera watsonii WH 8501
MDDSNWVDEGDELINQRQPTPSTTPTPPLNPKSAKILQTLAMVETAFLASAGSLIWLIYYYFPIGPLIRIFFPIPIALLYLRRGKRAAWMGALVSGLLLTVLMGPTRSIVFLIPYGLMGVQLGAFWRRNLPWEFSMITGALLGTFGFFFRFWLFSILLGEDLWQYIINQITGLAEWIFLRLGILAQPSSVFIQSLAIFIIFFNSIIYLFAVHLVSLLVLDKLGNPIPRPPKWVQVILDYE

SEQ ID NO: 55988 - protein, 355 aa, uncultured bacterium
IGAANNLLAAMIDNHIYQGNALDIDPRRIIWRRCVDMNDRQLRNVVDGLGGKAQGCPREDGYDITVASEVMAIFCLASSITDLKERLSKIIIGYSRKGEPVTAGQLNAQGAMTALLRDALNPNLVQTLEGTPAFVHGGPFANIAHGCNSVIATKTALHFADYVVTEAGFFGADLGAEKFLDIKCRMAGLKPDAVIIVATIRALKYNGGVPKDKTTEENLEALEKGLPNLLKHVENITQVYHLPCVVALNRFVSDTDAEIDLVTKKCKELGVNVKMSEVWGKGGDGGIELANEVVRLCEEESNDKFEFCYDLNKPLKEKIETIAKRVYGAAEVTYDKAASDELANLEKLGFGDKPI

SEQ ID NO: 55989 - protein, 313 aa, Vitis vinifera
VCTTNALGRVMLGRRVFGDGSGGEDPKADEFKEMVVELMVLAGVFNIGDFVPALEWLDLQGVASKMKKLHARFDAFLGAIVEEHKISGSAGSERHVDLLSTLISLKDNADGEGGKLTDVEIKALLLNLFTAGTDTSSSTVEWAIAELIRHPEMMAQAQQEPDAVVGRGRLVTDLDLPKLTYLQAIVKETFRLHPSTPLSLPRMAAESCEINGYHIPKNATLLVNVWAIARDPEVWEEPLEFRPNRFLPGGERPNADVRGNDFEVIPFGAGRRICAGMSLGLRMVHLLTATLVHAFNWELPEGQVAEKLNMDEA

SEQ ID NO: 55990 - protein, 313 aa, Vitis vinifera
VCTTNALGRVMLGRRVFGDGSGGEDPKADEFKEMVVELMVLAGVFNIGDFVPALEWLDLQGVASKMKKLHARFDAFLGAIVEEHKISGSAGSERHVDLLSTLISLKDNADGEGGKLTDVEIKALLLNLFTAGTDTSSSTVEWAIAELIRHPEMMAQAQQELDAVVGRGRLVTDLDLPKLTYLQAIVKETFRLHPSTPLSLPRMAAESCEINGYHIPKNATLLVNVWAIARDPEVWEEPLEFRPNRFLPGGERPNADVRGNDFEVIPFGAGRRICAGMSLGLRMVHLLTATLVHAFNWELPEGQVAEKRNMDEA

SEQ ID NO: 55991 - protein, 357 aa, uncultured bacterium
VTSAHNTISALLDNYIYQHRKDGFSLREIYWKRVLDVNDRALRNVVTGLRGDGVVSETGFDITPASELMAILCLATSEEDLQRRIENIVLGITADGKHFRVKDLGVAGAITVLLRDALNPNLVQTTEHTPAFIHGGPFANIAHGCSSVLATKMAMSYCDYVVTEAGFGADLGAEKFFDIKCRKAGLQPRLVVIVATTQGLKMHGGVSLDRIKEPNSKGLKEGLKNLNRHINNMQGFGQPVIVTLNRFDFDTDEEIDIVRKNCEDLEVGFAVNEAFLKGGEGAVELAQKVVETIDRQQPLPIRFTYKEADCLEDKIEKVCKRIYGASAVEYGQKVKKKLESLRATFSDDDGAIAHYPV

SEQ ID NO: 55992 - protein, 421 aa, Oryza sativa (japonica cultivar-group)
MAAPPQPQPEPEPAAGGAGLEALEGLALDTVIAKAGARQAAALACASTRLRDAAGDDALWRRFCADDLALHAPLAPDGRALPSFKDAYKVWLESFGMYPLPLVRRVKIFWSSLKSWLSENFPEAHKTLNKGVSEAQIQSAEDDLGFKLPLPTKLLYRFCNGQLPLSEHHHENMRMAHLGIIGGYVFYDHLINVHLSPLEQIVEETKEFYREFYDQGVFNMTNLIIVATSWYRPKTFFLNCSDDQLYVGTINLQDGEMLPCVPKSLIRPTNTDMPQDGLLLWLEEHLRRLQNGMIKIRMLKTSRYISLFPEASPSCTSAMTNGVKVRASAVFAPEHPESRRPGAKCLYAYSIRLSVPEACMLGGVYYSSCQLYSRHWIIRWRDRVVSDVNGEGVIGKVCGKQEEHSINYVFLHAHIHFKRKV

SEQ ID NO: 55993 - protein, 352 aa, uncultured bacterium
ITAANNLLAAMLDNHIHQGNELRIDLRAITWKRALDINDRALRNVVVGLGNKSDGFVREDHFVITVASEIMAVLCLADDMEDLKERLGRMVVAYDLDGKAVTAKDLKAVGSMAALLKDAIKPNLIQTLEHTPALVHGGPFANIAHGCNSVRATKAALKMADYCITEAGFGADLGAEKFLDIKCPSANIAPSCIVLVATVRALKYNGGLAKDSLKEENLDALKKGIVNLEKHIENLQKYNVPVVVTLNRFDTDTPDELKFVEEFCTSRGCEFALSEVFAKGGEGGEDLARKVISSIENKEAHFKSIYEKDEPVDVKIEKVATEIYGASKVVYSSKALTSLKKLKDLGYGNLPV

SEQ ID NO: 55994 - protein, 299 aa, Methanococcus maripaludis S2
MKKLGTDLLKRGFAKMVKHGVVMDVTNVEQALIAEEAGATAVMALERVPADIRVQGGVARMSDPEMILEIKDAVSIPVMAKARIGHYVEAQVLESIGVDMVDESEVLTPADEVNHIDKRAFTAPFVCGARNLGEALRRIDEGAAMIRTKGEAGTGNVVEAVKHMRAVNEGIARVIGYKEMGLEAELIQMARNELKVPMELISEVAELKRLPVVNFAAGGIATPADAALMMQMGCDGVFVGSGIFKSGNPAVRAKAIVEATYNFDKPEVIAEVSKNLGEAMVGINIDEIPEEMLLAKRGI

SEQ ID NO: 55995 - protein, 148 aa, Thermoplasma acidophilum DSM 1728
MTERTLVLLKPDAVKRRLIGRIISRLEDKGLKVVALKFMQMTKDQAENHYSVHRSKPFFKDLVTYITSGPIVAMVLEGPKAIEVVRILAGSTDGSKAQPGTIRGDFSMGIEKNIIHASDSPEAYSHEMPIFFNESEIVEWSYGDEIIY

SEQ ID NO: 55996 - protein, 318 aa, uncultured bacterium
IYQGNELDIDPRRITWHRAVDMNDRQLRNAVDGLGGKAQGYVREDHWDITVASEVMAVFCLSTSIDDLKERLARIVIGYSRAGKPITAGDLNAQGAMAALLKDALKPNLVQTLEGTPAFVHGGPFANIAHGCNSVLATQMAMHFADYVVTEAGFGADLGAEKFMDIKCRMAGLKPDAVIIVATVKALKYNGGVPKADVQKENLEALEAGIPNLLKHVENIKNVFGIPAVVALNKFVTDTDAEIELVTRKCKELGVNVKLSEVWGKGGEGGLELAEEVIRLCDQSSELHYAYELDMPITEKIEAIATKVYGADGVDFAA

SEQ ID NO: 55997 - protein, 325 aa, Arabidopsis thaliana
MKYNRDKKNKMGTALKLPIIDLSSPEKLSTSRLIRQACLDHGFFYLTNHGVSEELMEGVLIESKKLFSLPLDEKMVMARHGFRGYSPLYDEKLESSSTSIGDSKEMFTFGSSEGVLGQLYPNKWPLEELLPLWRPTMECYYKNVMDVGKKLFGLVALALNLEENYFEQVGAFNDQAAVVRLLRYSGESNSSGEETCGASAHSDFGMITLLATDGVAGLQVCRDKDKEPKVWEDVAGIKGTFVVNIGDLMERWTNGLFRSTLHRVVSVGKERFSVAVFVDPDPNCVVECLESCCSETSPPKFPPVRARDYFHERFSQTLASYSGSD

SEQ ID NO: 55998 - protein, 90 aa, Chlorobium tepidum TLS
MNIYIGNLPYSVTDEDLRDKFSEFGQVHSANIITDKFSGRSKGFGFVDMPNESEAREAIDAMNDKDFKGRTIKVNEARPREQRPPRREQY

SEQ ID NO: 55999 - protein, 563 aa, Chlamydomonas reinhardtii
MMLTQTPGTATASSRRSQIRSAAHVSAKVAPRPTPFSVASPATAASPATAAARRTLHRTAAAATGAPTASGAGVAKTLDNVYDVIVVGGGLSGLVTGQALAAQHKIQNFLVTEARERVGGNITSMSGDGYVWEEGPNSFQPNDSMLQIAVDSGCEKDLVFGDPTAPRFVWWEGKLRPVPSGLDAFTFDLMSIPGKIRAGLGAIGLINGAMPSFEESVEQFIRRNLGDEVFFRLIEPFCSGVYAGDPSKLSMKAAFNRIWILEKNGGSLVGGAIKLFQERQSNPAPPRDPRLPPKPKGQTVGSFRKGLKMLPDAIERNIPDKIRVNWKLVSLGREADGRYGLVYDTPEGRVKVFARAVALTAPSYVVADLVKEQAPAAAEALGSFDYPPVGAVTLSYPLSAVREERKASDGSVPGFGQLHPRTQGITTLGTIYSSSLFPGRAPEGHMLLLNYIGGTTNRGIVNQTTEQLVEQVDKDLRNMVIKPDAPKPRVVGVRVWPRAIPQFNLGHLEQLDKARKALDAAGLQGVHLGGNYVSGVALGKVVEHGYESAANLAKSVSKAAVKA

SEQ ID NO: 56000 - protein, 314 aa, Zea mays
  misc_feature (202)..(202): Xaa can be any naturally occurring amino acid
  unsure (1)..(314): unsure at all Xaa locations
MDSGYYTNLLVNGIEESQATRGDVRIQHGRATAKSSQGRSKNFRDEEDILLVSAWLNVGMDPIQGVDQTHGTLWRRIHEYFNANKKFDSNRSEVSLMNRWSGIQHDVNLFCGCLSRVEARNHSGWSIDDKIANACVMFKAEDPKDKKFSYLHCWKILKDKPKWMDRRKEIGSAKKSATKKQKTTTNSSPASIANAIVVDAPXWGCYHDEPSCRPDGKKKEKQKLRQRTSMEVVDYLIAKKKDSDLEKDLKKEERCNKAFALQEERMKLDKEKFAFQRQLEEDRIIGLDLSTMNYKQRQYYEDRQNEILARRFNI

SEQ ID NO: 56001 - protein, 379 aa, Arabidopsis thaliana
MSTTGQIIRCKAAVAWEAGKPLVIEEVEVAPPQKHEVRIKILFTSLCHTDVYFWEAKGQTPLFPRIFGHEAGGIVESVGEGVTDLQPGDHVLPIFTGECGDCRHCKSEESNMCDLLRINTERGGMIHDGESRFSINGKPIYHFLGTSTFSEYTLVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 56002 - protein, 893 aa, Oryza sativa
MMVSSRFVAVLLLVALAPAARGQGGGGGNSSAPVPGLQEFGTRRDNILLDCGATGQANDTDGRLWTGDTGSKYLPANLAAAAATAQDPSVPQVPYLTARFSAAPFTYSFPVGAGRKFLRLHFYPANYSNRNAADALFSVSIPDPNITLLSNFSAYQTALALNFDYLVREFSVNVTASTLDLTFTPEKGHPNAFAFVNGIEVVSSPDLFGSSNPMEVTGDGSGTPFPIDAGTAMQTMYRLNVGGNAISPSKDTGGYRSWEDDTPYIPFASFGVSYANDTNVPINYPDSIPQYVAPADVYSTARSMGPDNNVNLQYNLTWAMQVDAGYQYLVRLHFCEIQSGISKINQRTFDIYINNQTAFSGADVIAWSTGLGIPVYKDFVVFPMGSGPMDLWVDLHPNVKNKPQYYNAILNGMEVFKLQLTNGSLAGLNPVPSIVPTASGGNSGKKSSVGPIIGGVIGGLVVLALGCCCFFVICKRRQRAGKDSGMSDGHSGWLPLSLYGNSHTSSSAKSHTTGSHASSLPSNLCRHFSFVEIKAATNNFDESLLLGVGGFGKVYRGEIDGGATKVAIKRGNPLSEQGVHEFQTEIEMLSKLRHRHLVSLIGYCEEKNEMILVYDYMAHGTLREHLYKTQNAPLSWRQRLDICIGAARGLHYLHTGAKHTIIHRDVKTTNILLDEKWVAKVSDFGLSKTGPSMDHTHVSTVVKGSFGYLDPEYFRRQQLTEKSDVYSFGVVLFEVLCARPALNPTLAKEEVSLAEWALHCQKKGILDQIVDPHLKGKIAPQCFKKFAETAEKCVSDQGIDRPSMGDVLWNLEFALQMQESAEESGSLGCGMSDDSTPLVIVGKKDPNDPSIESSTTTTTTTSISMGEQSVASIDSDGLTPSAVFSQIMNPKGR

SEQ ID NO: 56003 - protein, 255 aa, Glycine max
YRSQASLRSQLVLISNIASKISLSLSLWGVCVLFSTTSFGIASCSSFDFARSRSSNPNMEAITASLERSLQNCSLNNTNNNHQQSRRPEEDDGSATDGGIGISSCSDDVPDPDNSHISDTTLELNSHISLPYHWEQCLDLKTGEIYYINWRNGMKAKEDPRSRRADYSVSRDCESEEEEEEESWYDSEESSSESCPSSSKEHYDEGQVEKQNNNVLVVAGCKGCLMYFMVPKQVEDCPKCTGQLLHFDRSENGSP

SEQ ID NO: 56004 - protein, 187 aa, Synechococcus sp. RS9916
MAAMMPALRPPRHPSLDLKPLIRDIPDFPKPGILFRDITPLLRDPEGWRAVMNQMGAICERLQPDLIVGIESRGFIVGTALATDRKLGFVPVRKPGKLPGEILGIDYALEYGTDRLEIHADALQGGAKVLLVDDLLATGGTAAAAAQLISQAGGDLVGCSFVIELAALAGREKLPQATPVESLVIYS

SEQ ID NO: 56005 - protein, 537 aa, Neurospora crassa
MTDNPEEPLIANTQSTERDQDDGSHDVEHAHDSRGGKQHISPPGLFIWLLTFSAGISGLLFGYDTGVISATLVSIGTSLSHRPLTSLDKSVITSCTSLFALLALPFASALADDRGRKRVVLFADTLFIIGALCQAASRTVEVMVIGRSVVGIAIGAASFVTPLYIAELAPATHRGRLVTMNIVFITLGQVVAYVVGWIFGTYGSPETTGWRWMVGLGAVPAVCQVVILLWMPESPRWLVKDGRSQEARAVIAKIAAGDDAQDPSTRREVDAVLKSIEIEVREEATAMRLGGAGAGYANGNAVNAWMEAMRELIRVRRNRRALAIACLLQGLQQLCGFNSLMYFSATIFTMVGFSEPTLTSLVVAVTNFAFTLVALVLIDRVGRRRILLWSLPFMIAGLVLAGYGFSFIELPNSETSSPSTTGGQGGAVIILASIMIYVAGYAIGLGNVPWMQSELFSLSVRSVGSGVATATNWSANFVIGLTFLPLMEALSPSWTFVLYAVICAVGYGLIWTVYPETAGLSLEDAATLLEADDWGVR

SEQ ID NO: 56006 - protein, 198 aa, Anabaena variabilis ATCC 29413
MSFSPQLVNLGNYLAGEFDNREQALGEPIWFVHLRLWQRPVGLFSDDSITLFAEQANIVNLDRPYRQRILRLMPAPDSETGLYVQYYMPKNPSALVGAGRHPELLKTLTPQQLELLPGCVLSVSQKTVAPNSYQFTASPLPDTCCTFSYLGNTVQVSLGFAVTETELHTYDKGIDQETGKATWGAIVGPYRYTKREQY

SEQ ID NO: 56007 - protein, 548 aa, Magnaporthe grisea 70-15
MAQEYKLKSVTSLDLKPGDKQEVEVEGLPDAKVLLVNAAGKIQAIGPKCTHYGAPLVKGVLTTSGRITCPWHGACFSATTGDVEDAPALDALPVFKVVERDGAVYVTGDEATIKAGRRKPKFQCSSVQKGEEGKVVVVGGGSGCIGLIEELRERGFTGPITVISNEGNLPIDRTKLSKALLTDLAKLQWRDEEFYKSGAVEFVQDEVTGVDFKGKSVETKSKKTISYGKLVLATGGTPRNLPLEGFKTLDNIFTLRNVHDAKNIVSAIGESKGKKIVVVGSSFIGMEVANATAKDNSVSVVGMEKVPLERVLGDKVGSAAQKGLEKSGVKFYMEAGVEKATAHESDPAKVGAVLLKSGESLPADIVILGVGVAPATEFLRGNAGVQLLQDGSLEVDTAFAVTGVKDVYALGDIATFPYHGPGAGGKGVRIEHWNVAQKSGREAAKHIVDPAGFKAEFFTPIFWSALSAQLRYCGNTMASGWDDVVIQGSLDEGKWSAFYAKGDEVVAVATMGADPVMVQSAELMRRGKMPKKSELEKGMDVMSLGAPE

SEQ ID NO: 56008 - protein, 175 aa, Oryza sativa (japonica cultivar-group)
MAPTVMASSATSVAPFQGLKSTAGLPVSRRSNSAGLGSVSNGGRISCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 56009 - protein, 444 aa, Pseudomonas aeruginosa PAO1
MNNHNGTLHRGWQSLQRWRIQIFVITWLAYAAFYFTRKAFSVAKLGIAEDPSFELDKSAMADLDALYLAAYAVGQFMWGVFADRFGTRVVVLGGLLTSALAALMMGTFATLPIFAACMVVQGLAQSTGWSGLCKNIGAFFATYERGRVLGLWSTCYAFGGLVATPFAGWCAYRLTHDWRMAFLSSAGVVLAVAVLFFFLQRNRPQDVGLPPVEAEAAPPANAPRPSHSGALLKALRNPHVLVLGIAYFLLKPARYAILLWGPVIIYERMPEIGKVASAIVPSAFEVAGLAGPILIGLASDKLFGARRMPACVLSLAALTLSLALFVPAMQSGSLYLVVSLLFMMGVTLYGPDSMISGAAAIDFGTSEAAGTATGFVNGCGSVGAILGGLLPGYFDTLTVFFVFTATALLASLLLVPFWNSRPGACRVEPKAHASGPLLAAGKPR

SEQ ID NO: 56010 - protein, 393 aa, Prochlorococcus marinus str. MIT 9515
MSEVNLSKRALSLEPSLTLQISAKAKKLSEEGKDICNLSAGEPDFDAPKEILNATSQAIFDGHTKYGPAAGDKELRKAIAKKLQIQNNLNVEFENVMVTNGAKQAIYNLFQVLLNDGDEVIIPAPYWLSYPQMVRLAGGKPIFLNSAPEDGFKINIQDLRSKISSKTKFIIINSPNNPTGRIMAKEELLQIAEVVREHKNINVLSDEIYELILKKEFRHLSLASLATDLKERIFIINGFAKGWAMTGWRVGYLVGKKEVIKASSALQSQSTSNVCSFVQRGALEALKINQEFFLKINSHYDLRREILYEGLRNIEGLVVHQPNGAFYAFPRLPNKSISSVDFCKKILNDYGLVIVPGKPFGDNQSFRISCATSKEKIIDGLSRLKKAVHNYYF

SEQ ID NO: 56011 - protein, 105 aa, Brassica napus
GLSFQETKELWDRADIDGNGVFDYEELKKMWNMTVMVQSENCKESMTETKKEEGEDKEEEAIGLKVKKAVLFPEEAEKGMWPENYNLSDHACLTVQFSPVKVLCS

SEQ ID NO: 56012 - protein, 147 aa, Brassica napus
SIDQHFQSTPFEKNIPVILGLLSVWNVSFLGYPARAILPYSQALEKFAPHIQQVSMESNGKGVSIDGLPLPFETGEIDFGEPGTNGQHSFYQLIHQGRVIPCDFIGTVKSQQPVYLEGEVVSNHDELMSNFFAQPDALAYGKTPEQL

SEQ ID NO: 56013 - protein, 352 aa, uncultured bacterium
ITSANNLLCAMLDNHLMQGNELRIDPKRIVIKRCLDMNDRALRNITVGMGKRLDGVVREDHFCITVATEVMAILCLAEDLEDLKKRLSKIIVAYNYDNEPITAADLKAVGAMTVLLKDAIRPNLIQSLENNPVFVHGGPFANIAHGCNSVRATKVALKVADYVITKAGFGADLGAEKFLDIKCRMAGLKPDAVVLVATARALKYNGGVAKADLSNENVEALNKGIVNLGKHIENLKKYNVPIVVTINRFTADTEAEMQAIKDFVEKAGCRFALSEVWAKGGEGGLALAEQVLDAIGEGSPDFKFLYEDNLSITEKIVTVSKEIYGADGVTYSPEATNAIKRLEGLGFGNMPV

SEQ ID NO: 56014 - protein, 556 aa, Agrobacterium tumefaciens str. C58
MYRYDEFDHAFVEGRVAQFRDQVERRLSGELAEDAFKPLRLMNGVYLQLHAYMLRVAIPYGTLNSQQMRMLAHIARKYDRGYGHFTTRQNIQYNWPRLSDTPDILSELASVEMHALQTSGNCIRNVTADHFAGAAADEVADPRPYAEILRQWSSVHPEFSFLPRKFKIAVTGAERDRAAIQVHDIGLHLKKNDKGEIGFAVYVGGGQGRTPMIAKKIRDFLPEEDLLSYTTAVMRVYNLHGRRDNKYKARIKILVHETGAEELARQVEVEFAELKNTELKLPDADIAAITAYFAPPALKDRPEGWESLARWKRADEGFARFVEQNVAPHKHPDYGMVTISLKPIGGIPGDATDEQMELVADIAAEYAFDEIRISHEQNIILPHVALADLEPVYRALVGAGLATANAGLITDIIACPGLDYCALANARSIPVAQEISTRFGAPERQAEIGELKIKISGCINACGHHHVGHIGLLGVEKKGAELYQITLGGSGDENTSIGEIIGRGFEPEKVTDAVETIVDTYLGLRLSKEETFLEAYRRVGPQPFKDALYGSAAEAA

SEQ ID NO: 56015 - protein, 354 aa, uncultured bacterium
IGAANNLLAAMIDNHIYQGNGLDIDPRRIIWRRCVDMNDRQLRNVVDGLGGKAQGCPREDGYDITVASEVMAIFCLASSITDLKERLSKIIIGYSRKGEPVTAGQLNAQGAMTALLRDALNPNLVQTLEGTPAFVHGGPFANIAHGCNSVIATKTALHFADYVVTEAGFGADLGAEKFLDIKCRMAGLKPDAVIIVATIRALKYNGGVPKDKTTEENLEALEKGLPNLLKHVENITQVYHLPCVVALNRFVSDTDAEIDLVTKKCKELGVNVKMSEVWGKGGDGGIELANEVVRLCEEESNDKFEFCYDLNKPLKEKIETIAKRVYGAAEVTYDKAASDELANLEKLGFGDKPI

SEQ ID NO: 56016 - protein, 352 aa, uncultured bacterium
IGAANNLLAAMIDNHIQQGNSLNIDPKRITWRRAVDMNDRQLRNIVDGLGNRADGTPRQDGFDITVASEVMAILCLSSDIVDLKKRLGNIVIGYTYEDKPVFARELKAEGAMAVLLKDAIKPNLVQTLEGTPALVHGGPFANIAHGCNSLIATRMAMKLGDYAITEAGFGADLGAEKFLDIKCRIGNLKPDAVVVVATIRALKHHGGCKKENLDKEDMECLAAGMPNLLRHVENITKVYKLPCVVAINAFPADTEKELAYVEAQCRKLSVNVALSEVWAKGGEGGIRLAEEVIRLCECENDFTFSYSDDMSIYDKLCAVAKKVYHADGVDLIGTAPKQLNQLEELGYSSLPV

SEQ ID NO: 56017 - protein, 428 aa, Zea mays
MEDEDTGPGDGGEASPPHHVAASSDRARDMVASPTSSRSVTQTVNGSHHFVIQGYSLAKGMGVGKHIASETFTVGGYQWAIYFYPDGKNPEDNSGYVSVFIALASDGTDVRALFELTLLDQSGKGKHKVHSHFDRSLESGPYTLKYRGSMWGYKRFFRRTALELSDYLKDDCLKINCTVGVVVSTIDYSIPHSIHVPDSDIGYDFGSLLDSQEGADVILNVGGERFHAHKLVLAARSHVFGSQFFDDESDGEKSEVNETDELKEFSIDDMEPNVFKAMLHFIYRDTLVDDDELGASSSDGSIFDTPAAKLLAAADKYHLARLKSLCESYLCKGISVASVASTLALADRHHAMELKAVCLKFAAENLSAVMRSEGFIYLKDNCPSLQSEILKTVAGCEDQCSSVGKSQSVCGQLSDGGDSSCRRVRQRT

SEQ ID NO: 56018 - protein, 413 aa, Zea mays
MEAAAAVVGFGLTRWQAAALSAVAGWVWAASFYDLTRRARALVQPWVTRRVHAETAAILRFQRLEHKLLDNIFSVLSCVVSVPFYTGFLPLLFWSGHGRLARQMTLLMAFCDYLGNSVKDIVSAPRPCSPPVRRVTATEDEKENAMEYGLPSSHALNTVCLTGYLLHYVLTFGEHGSVTVAAGLSLAFLLVMLVGIARIYLGMHSLTDVVAGIGFGIVILAFWLSVHDRVDAFVVSGENVATFWAGLSLLLCFAYPKPEFPTPSFEYHTAFNGVAFGIVYGIQQTYFHFHTPDAPVVFSAELPLLTFAGRVLVGIPTILAVKFCSKALSKWLLPVVCSTLGIPTVSSCYVPALRADSGSGKDRQGAGHLQRLLFSHFPRKAYDVDTGIRFVQYASLAWSVVDLVPAMFAHLNL

SEQ ID NO: 56019 - protein, 580 aa, Rhodobacter sphaeroides 2.4.1
MSLDQAIPEALQALRTRFGAAVRAEQATGEAFPVLWLDASVWEAAHRFLREEIAAPFPLLADLWAIDESLRQHRTGQPASRITLCSHLVSLVRNADLRLKLATDGRAPSIAGVYANADWYEREAHDMFGLDFGRETRRILMPPTWEGHPLLKTHYARATEKPPFVLTDRLFEAEERATITDPDLLGLPKLRDGEELMVLNFGPHHPSTHGVLRILLGLDGEEVVWAWPDIGYHHRGAEKMAERQTWHGFIPYCDRIDYLGGVISELPYLLAVERLCGIAVPPRAQMIRVMLCEFYRIMNHLLFYGTMAQDVGAMSPVFYMFTDREKGHEILNAITGARMHPAFFRIGGVAMDLPDGWDAMVRGFLDWMPARLDEYERMVLRSELFRARTVGVGAYDTDTALTWGTTGPGLRATGCDWDLRKLRPYSGYEQFDFEVPLGQRGDIFDRTRVRADEMRESLKIIRQCLENMPEGPVKADHPLTTPPPRGAMQKDIETLIAHFLQSSWGTVVPAGEATGQIEGHRGLTQYAIVSDGGTQSYRTRIRTPSFAHLQMIPKIVPGMTVADLVAHIASIDFVMSDVDR

SEQ ID NO: 56020 - protein, 471 aa, Sulfolobus solfataricus
MPSTAEDVLKFLKENNIKWVDLQFTDVPGRLHHITIPADEFDLESLKTGFGKLDGSSIRGFTSIYESDMVLLPVPETMTLIPWSPGVARVLCKVFWGGGKGRFERDPRFIAEEAEKYQTEQGYTSYYGPELEFFMFDKVKLDVSAPQSGTGYKIYAREAPWTDSGTFVIRFKEGYYPAPPVDQLMDVRVEIVDTLVKYFGYTIEATHHEVATAGQGEIDFRFSTLVDTADKVQTLKYVAKNIAAKHGLVVTFMPKPIYGDNGTGMHTHLSLWTKDGKKNLMYDPNDEYAEISQFGRYVIGGLLTHARALSAIVSPTVNSYRRLIPGFEAPVYIAWSKGNRSAVIRVPAYYRGMEKAKRIEYRPPDPSTNPYLAFAALLMAALDGVNKKIDPGDPVDENIYHLTPEKRRQLGIKELPRSLNEALDELESDKEFLKPVFNSSILDTYIDLKRDEARSLQGYPHPMELYYYLDS

SEQ ID NO: 56021 - protein, 335 aa, uncultured bacterium
LAAMIDNHIYQGNSLDIDPRRIIWRRCVDMNDRQLRNVVDGLGGKAQGCPREDGYDITVASEVMAIFCLASSITDLKERLAKIIIGYSRKGEPVTAGQLNAQGAMTALLRDALNPNLVQTLEGTPAFVHGGPFANIAHGCNSVIATKTALHFGDYVVTEAGFGADLGAEKFLDIKCRMAGLTPDAVIIVATIRALKYNGGVPKDETTKENLDALEKGLPNLLKHVENITQVYKLPCVVALNRFVSDTDAEIDLVTKKCKELGVNVRLSEVWGKGGDGGIELAKEVVRLCEEESNANFEFSYDLDKPLKEKIETIAKRIYGAAEVTYDKAASDELA

SEQ ID NO: 56022 - protein, 450 aa, Rubrobacter xylanophilus DSM 9941
MALRRFLNPPPRYAPWEKPRYRDFEKKVLIVGGGFAGYTAAKTLCELVRDRDDVGVLVLSRENYFTFWPIVPEVVSNDVDAHNVAQPLRRALITAGASFRRARVQRVVPERNVVVAEGDIEFPYDQLVIAVGGQPNFFGIPGVEEHALSMRGLEDAEQIRNRVIERFEEVSLIRGEIPESKLTFVVIGGGATGVEVASQIHTLVHEHLASDYPNIDPNRVRIYLVEALPEILPELDPALRKAARNRLYRQRIEVLTNTLAEEVTADCVRLKGGGEISSENVIWTAGNRPNAVIQRLGLPYDEKNGIRVDEYLRVEGHRDIWAIGDCAAIPDVRQEGKIVPPNAQAAVQEGKTVARNVLAVLDGREDELERFEYKPLGQLVELGSDFAVNEVMGVRFSGFLAALFWRLAYLVRLTSPQSKARVAADWIVSFFLRPAVTQVRGARNNADDRT

SEQ ID NO: 56023 - protein, 411 aa, Arabidopsis thaliana
MLEGAKFNVLAVGNHHNNDNNYYAFTQEFYQKLNEGSNMSMESMQTSNAGGSVSMSVDNSSVGSSDALIGHPGLKPVRHYSLSVGQSVFRPGRVTHALNDDALAQALMDTRYPTEGLTNYDEWTIDLRKLNMGPAFAQGAFGKLYKGTYNGEDVAIKILERPENSPEKAQFMEQQFQQEVSMLANLKHPNIVRFIGACRKPMVWCIVTEYAKGGSVRQFLTRRQNRAVPLKLAVKQALDVARGMAYVHGRNFIHRDLKSDNLLISADKSIKIADFGVARIEVQTEGMTPETGTYRWMAPEMIQHRAYNQKVDVYSFGIVLWELITGLLPFQNMTAVQAAFAVVNRGVRPTVPNDCLPVLSDIMTRCWDANPEVRPCFVEVVKLLEAAETEIMTTARKARFRCCLSQPMTID

SEQ ID NO: 56024 - protein, 352 aa, uncultured bacterium
IGAANNLLAAMVDNHIYQGNELDIDPRRITWHRAVDMNDRQLRDAVDGLGGKAQGYVREDHWDITVASEVMAVFCLSTSIDDLKERLARIVIGYSRAGKPITAGDLNAQGAMAALLKDALKPSLVQTLEGTPAFVHGGPFANIAHGCNSVLATQMAMHFADYVVTEAGFGADLGAEKFMDIKCRMAGLKPDAVIIVATVKALKYNGGVPKADVQKENLEALEAGIPNLLKHVENIKNVFGIPAVVALNKFVTDTDAEIELVTRKCKELGVNVKLSEVWGKGGEGGLELAEEVIRLCDQPSELHYAYELDMPITEKIEAIATKVYGADGVDFAASAKKEIDNLTKMGYDKIPV

SEQ ID NO: 56025 - protein, 164 aa, Rhodobacter sphaeroides 2.4.1
MKGILDSILRVGRMIFAPTKTVQYPEEKLPLAPRTRGRIVLTRDPDGQERCVACNLCAAACPVDCIDVVKAETPDGRWYPESFRINFARCIFCGYCEEACPTSAIQLTPDVELADYRRGFLQYEKEDLLISGEGKHPGYRYWDVAGKAIAGKAQDPVDPKDLCP

SEQ ID NO: 56026 - protein, 301 aa, Escherichia coli W3110
MKKFSGIIPPVSSTFHRDGTLDKKAMREVADFLINKGVDGLFYLGTGGEFSQMNTAQRMALAEEAVTIVDGRVPVLIGVGSPSTDEAVKLAQHAQAYGADGIVAINPYYWKVAPRNLDDYYQQIARSVTLPVILYNFPDLTGQDLTPETVTRLALQNENIVGIKDTIDSVGHLRTMINTVKSVRPSFSVFCGYDDHLLNTMLLGGDGAITASANFAPELSVGIYRAWREGDLATAATLNKKLLQLPAIYALETPFVSLIKYSMQCVGLPVETYCLPPILEASEEAKDKVHVLLTAQGILPV

SEQ ID NO: 56027 - protein, 497 aa, Burkholderia vietnamiensis G4
MLRVADLRAAEAAATATLPPHTLMARAGAAAARWLSERMTDDERPVWFAVGPGNNGGDALVAAAQLQQLGVATHAWMPVTVKPDDAQWALGLARAAGVPLSTEPPASLDEYAWVVDGLFGIGLARALDGPFAAQAERIAAHARSGGRVLALDVPSGLDSDTGRIVGAGAAVVATHTLTFIGAKPGLYTGDGRDLAGAIEIASLDVAPPAAPAVVLNAPARFAAALPARAFASHKGTFGSLAVIGGDTGMCGAPILAARAALFAGAGKVHVGFLGTGAPPYDPPFPELMLHPADGVDLDAMSAIAAGCGLGTRDAAAALVRRVLAHGAATLLDADALNLVATHADLAAAVAARDGACVLTPHPLEAARLLGSDTASVQHDRLAAAQALAARYASIVVLKGSGTVIAAPDGRLTINPTGNAALATGGTGDVLGGLIGALLAQRVAPYEAALAGVYLHGLAADTLTASGTGPAGLTAGELAPMVRTLINRLFYPSPRADI

SEQ ID NO: 56028 - protein, 437 aa, Chlorobium tepidum TLS [sequence omitted]

SEQ ID NO: 56029 - protein, 556 aa, Burkholderia vietnamiensis G4
MRRRGIPPDSRFTRTAMTLNSLPAWTALQSHFAEIRHARLRDWFAPENDRAPTRAERFTIAGGGLAADFSKNRINDDTLRLLVQLARDTRVEARRDAMFAGDVVNPTEGRAALHTALRATDPNAPFHAQVSAERAKMASFARAVRSGAWTGHTGKRIRHVINIGIGGSDLGPKMVTHALHHVATPDISTHFVSNVDGADLARVLEQVDPEETLAIIVSKTFTTLETMTNARSLRDWFIARGCPEDALAKHFVGVSANPSEVVRFGIAADNVFEMWDWVGGRYSLWSAVGLSIMIAVGPDQFDELLAGANDMDRHFREAPLERNLPVLLGMIGIWYRNFFGSQSYLVAPYSEALHYLPSYLQQLEMESNGKSARLDGTFVDYPTSAVTWGEPGTNGQHAFFQMLHQGPTIVPIDFIAVLTPEHPLASHHPKLLANCFAQSEALMLGRTLDEARKIAGPGEEALAPHLTFPGNRPTTTLLVDALTPRTLGALIALYEHKVLVQATVWDINPFDQWGVELGKILGKVVEADLSADSVDPAKHDSSTTALIERARAALKR

SEQ ID NO: 56030 - protein, 265 aa, Chlorobium tepidum TLS
MSFYTLITGASTGIGRRLAEEFASMGDNLVLVARSQDKLETLAAELRRSCGIEVQVCCQDLAEVGAALKVFGFCEERGLPIDKLVNCAGFSIAGNFERMDEETFVQMVLVNMVAVAALTRRFLPAMRARRRGVVINIASLAGFQGVPGMAGYSASKAFVVNLTEALSVELQGTGVRIFAVCPSFLDNDLFYSRAGHDRSRIVTPVSSPEVVVKAVHRGLDGKQVLILPTVLDRLMVFVQRFTPRKIVVLLADIFAGARERGGSNG

SEQ ID NO: 56031 - protein, 249 aa, Glycine max
  misc_feature (58)..(58): Xaa can be any naturally occurring amino acid
  misc_feature (113)..(113): Xaa can be any naturally occurring amino acid
  misc_feature (207)..(207): Xaa can be any naturally occurring amino acid
  unsure (1)..(249): unsure at all Xaa locations
MADAEDIQPLVVDNGTGMVKAGFAGDDAPRAVFPSIIGRPRHTGVMVGMGQKDAYVGXDEAQSKRGILTLKYPIEHGIVSNWDDMEKIWHHTFYNELRVAPEEHPVLLTEAPXNPKANREKMTQIMFETFNVPAMYVAIQAVLSLYASGRTTGIVLDSGDGVSHTVPIYEGYALPHAILRLDLADRMSKEIGALAPSSMKIKVVAPXERKYSVWIGGSILASLSTFQQMWISKGEYDESGPAIVHRKCF

SEQ ID NO: 56032 - protein, 128 aa, Salmonella enterica subsp. enterica serovar Typhi str. CT18
MSKTIATENAPAAIGPYVQGVDLGSMVITSGQIPVDPKTGAVAEDVSAQARQSLENVKAIVEAAGLKVGDIVKTTVFVKDLNDFATVNATYEAFFTEHNATFPARSCVEVARLPKDVKIEIEAIAVRR

SEQ ID NO: 56033 - protein, 408 aa, Streptomyces avermitilis MA-4680
MTVPTPAVRDRIRTLAPGELPAYVYDLAELRAHAAGVRAALPERVELYYAAKANPEPEILAALAPYVDGYEVASGGELAHVAQAVPGRPLAFGGPGKTPDEVAAALAGGVQRFHVESEYELHMLAEQARRVTPGTRVAVLPRFNLPVRDGSLAGSALAMGGRPTPFGLDPAQAGTVLRLLTDGTYPHLELRGVHAHLASGLEAPEQLAVAETVVGWATDMAGEHGVGLGEVNVGGGMTVDYAAPERRFDWVTYGKGLARLAHAHPELTLRIEPGRALTAYCGWYATEVLDVKRSHGEEFAVVRGGTHHLRTPATKGHDQPCSVLPVDGWPHPWPRPAAEAERVTLTGQLCTPKDVLARQVPAGGLRAGDRVAFALAGAYAWNISHHDFLMHPRPGFHFLLPDRGDGEP

SEQ ID NO: 56034 - protein, 1121 aa, Ceratodon purpureus
MSAPKKTYSSTTSAKSKHSVRVAQTTADAALEAVYEMSGDSGDSFDYSKSVGQSAESVPAGAVTAYLQRMQRGGLIQTFGCMVAVEEPNFCVIAYSENASEFLDLMPQAVPSMGEMDVLGIGTDIRTLFTPSSGAALEKAAATQDISLLNPITVHCRRSGKPLYAIAHRIDIGIVIDFEAVKMNDVSVSAAGALQSHKLAAKAITRLQALPGGDIGLLCDTVVEEVRELTGYDRVMAYKFHEDEHGEVVAEIRRMDLEPYLGLHYPATDIPQASRFLFMKNRVRVIADCCASPVKLIQDPDIKQPVSLAGSTLRAPHGCHAQYMGNMGSIASLVMAVIINDNEEDSRGAIQRGRKLWGLVVCHHTSPRTVPFPLRSACEFLMQVFGMQLNMEVELAAQLREKHILRTQTLLCDMLLRDAPIGIVSQTPNIMDLVKCDGAALYYGKRFWLLGTTPTENQIKDIAEWLLEYHKDSTGLSTDSLADANYPGAHLLGDAVCGMAAAKITAKDFLFWFRSHTAKEVKWGGAKHDPAEKDDGRKMHPRSSFKAFLEVVKRRSLPWEDVEMDAIHSLQLILRGSFQDIDDSDTKTMIHARLNDLKLHGMDELSVVANEMVRLIETATAPILAVDSTGMINGWNAKIAHVTGLPVSEAMGRSLVKDLVLDESVVVVERLLYLASQGEEEQNVEIKLKTFGTQTEKEAVILIVNACSSRDVSDSVVGVCFVGQDVTGQKMFMDKFTRIQGDYKTIVKNPHPLIPPIFGGDEYGYCFEWNPAMEALTGWKHDEVVGKLLVGEIFGMEMMCCRLKSQDSMTKFMISLNNAMDGTNTDKFSFSFCNREGKFVEALLSTNKRTNADGVITGVFCFLQIASSELQQALTVQRATEKVAIAKLKELAYIRQEIKNPLCGITFTRQLLEDTDLSDDQKQFLDTSAVCEQQLQKVLNDMDLESIEDGYLELDTAEFEMGTVMDAVISQGMTTSREKGLQIIRETPREISTMRLFGDQIRLQQVLSDFLINAIRFTPSSEGWVKIKVVPTRKRLGGNVHVMHLEFRVSHPGGGLPDELVLEMYDRAKGMTQEGLGLNMCRKLVRLMNGDVQYVRENAQCYFVVYVELPMAQRDDAASQM

SEQ ID NO: 56035 - protein, 1124 aa, Lathyrus sativus
MSTTRPSQSSNNSGRSRNSARIIAQTTVDAKLHATFEESGSSFDYSSWVRVSGSVDGDQQPRSNKVTTAYLNHIQRGKQIQPFGCLLALDEKTCKVVAYSENAPEMLTMVSHAVPSVGDHPALGIGTDIRTVFTAPSASALQKALGFAEVSLLNPILVHCKTSGKPFYAIIHRVTGSLIIDFEPVKPYEVPMTAAGALQSYKLAAKAITRLQSLASGSMERLCDTMVQEVFELTGYDRVMAYKFHEDDHGEVIAEIAKPGLEPYLGLHYPATDIPQAARFLFMKNKVRMIVDCNAKHVKVLQDEKLPFDLTLCGSTLRAPHSCHLQYMANMDSIASLVMAVVVNDSDEDGDSADAVLPQKKKRLWGLVVCHNTTPRFVPFPLRYACEFLAQVFAIHVNKEIELEYQILEKNILRTQTLLCDMLMRDAPLGIVSQSPNIMDLVKCDGAALFYRNKLWLLGATPTEYQIREIALWMSEYHTDSTGLSTDSLLDAGFPGALSLSDTVCGMAAVRITSKDIVFWFRSHTAAEIRWGGAKHEPGEQDDGRKMHPRSSFKAFLEVVKARSVPWKDFEMDAIHSLQLILRNASKDTDIIDLNTKAINTRLNDLKIEGMQELEAVTSEMVRLIETATVPILAVDVDGTVNGWNIKIAELTGLPVGEAIGKHLLTLVEDSSTDIVKKMLNLALQGEEEKNVQFEIKTHGDQVEFGPISLIVNACASRDLRENVVGVCFVAQDITAQKTVMDKFTRIEGDYKAIVQNPNQLIPPIFGTDEFGWCCEWNAAMIKLTGWKREEVMDKMLLGEVFGTQMSCCRLKNQEAFVNFGIVLNKAMTGLETEKVAFGFFSRKGKYVECLLSVSKKIDAEGLVTGVFCFLQLASPELQQALHIQRLSEQTALKRLKVLTYMKRQIRNPLAGIVFSSKMLEGTDLETEQKQIVNTSSQCQRQLSKILDDSDLDGIIDGYLDLEMAEFTLHEVLVTSLSQVMNRSNTKGIRIANDVAEHIAKESLYGDSLRLQQVLADFLLISINSTPNGGQVVIASSLTKEQLGKSVHLVNLELSITHGGSGVPEAALNQMFGNNVLESEEGISLHISRKLLKLMNGDVRYLKEAGKSSFILSVELAAAHKLKG

SEQ ID NO: 56036 - protein, 1136 aa, Picea abies
MSTTRPRAATHSASSGSVSRSSKHSARVITQTPVDAKLQAEFEGSVHSFDYTKSIDISGDSSSVPSETVKAYLQRLQKEMLIQPFGCVLAVEEGSCAVVGYSENAPEMLDVVGGAHAVPSIGGQQQEGGGGGGGLLRIGMDARTLFKPASAAALQKAATFADMHLVNPIFVRCNRSGKPFYAILNRIDAGLVIDFEPVMPSDVPVSAAGALQSYKLAAKAISRLQSLPGGDIRLLCDTVVQEVRELTGYDRVMAYRFHEDEHGEVVAEMRRPDLEPYLGLHYPATDIPQASRFLFMKNRVRMICDCCAPPVNVIQDKRLRQPLSLCGSTLRAPHGCHAQYMANMGSIASLVMSVTTNENGDDSEGGGQQQPQNRRKLWGLVVCHHTSPRVIPFPLRYACEFLMQVFGIQLNKEVELAAQLREKHILRVQPVLCDMLLRDAPVGIVSQTPNIMDLVKCDGAALLYGKRLWLLGTTPTEAQILDIADWLLEHHRDSTGLSTDSLAEAGYPGAASLGDAVCGIAAARITSKDFLFWFRSHTAKEIIWGGAKHDPNDKDDGRRMHPRSSFKAFLEVVKRRSLPWEDVEMDAIHSLQLILRDSFHDIDDSDSKTMIHARLNDLRLQGIDELSAVTNEMVRLIETATVPILAIDSNGLVNGWNTKAAELTGLLADEVIGRPLIDLVQHDSVEIVKKMLYLALQGEEEQNVEIKLKTFGIQEEKGPVVLIVNACSSRDLEENVVGVCFVAQDVTWQRIAMDKFTHLQGDYRAIVQNPNPLIPPIFGADEYGYCSEWNPAMEKLTGWKREEVIGKMLVGEVFGIHRMSCQLKGQDGLTKLRIVLNNAMAGKETEKFPFSFFDRHGKNTEALLSANKRTDAEGIITGVFCFLHVTSTELQQALQVQRMAEQAAMDRLKELAYIRQEIRNPLYGIIFTRKLMESTDLSEEQKQIVQTSALCQRQLVKVLDDADLESIEDGYLELDTIEFTLGTVLDAVVSQGMILSREKGLQLIRDSPEEIKTMCLYGDQLRLQQILSNFLINALRFSTSEGWVGNKVVPTKRHLGSGVNVMHMEFRITHSGQGIPEELIKEMFVHNQDMFQEGLGLYMCQQLVKIMNGDVQYLREAGRSSFIINVEFPLAQTDKQ

SEQ ID NO: 56037 - protein, 377 aa, Zea mays
NPSLPGRFRSTHIRIPLSSVSSPTTNPQIAAISAASSSDSDSSVQDLLALVYFGSLFDVKQQSDFVSLVYTRELERSSCLTYDYVGDDPEDSLAETDLNAVSALASLAALRPPAAAGVSHRDALQACAHHARLWLCRADEPIHPDSTITYAGVRAKLDRIMASGYFTAQLEMRTPLDLAAAVASFGAGGVQVQESMVVSPQAPEAVEESQAVEGHKNEKEDSQATEIYNDHPVVDSEHVEDEVLVHPTDEVPPAETEQEQETFDADVKDQEQKDQQFIQRRSYQNQRGGGRGGSRRGYPNGRGGRGGRGGGYQNGRGGYQNGRGGAGGYYYESGYYQPRNYNRGRGGRSGGGNSYYNSHGGGAQGHHPGSVELGANA

SEQ ID NO: 56038 - protein, 1131 aa, Pinus sylvestris
MASNSRHTQSQSTGSNNRRSSTNTNTTTNKATAMAQYNSDARLLQVFEQSGESGKSFDYTRSIQVHNRAVPEQQITAYLSRIQRGGRIQPFGCVLAVEETTFRIIAYSENEEMLDLGAQSVPSMEKPQQDVLTIGTDVRTLFTAASAHSLEKAAVAQEISLMNPIWVHCKNSRKPFYAIVHRIDVGMVIDLEPLRTGDAFMSAAGAVQSQKLAVRAISRLQSLPCGDVGLLCDTVVENVRELTGYDRVMVYKFHEDEHGEVVAEIRRSDLEPYLGLHYPATDIPQASRFLFMQNRVRMICDCMATPVKVIQSEELMQPLCLVGSTPSAPHGCHAQYMANMGSIRSLLMAVIINGNDDEGGGSGRNSMKLWGLVVCHHTSPRAVPFPLRYACEFLMQALGLQLNMELQLAAQLTEKHILRTQTLLCDMLLRDAPMGIVTQSPSIKDLVKCDGAALYYGGMCWMLGVTPTEAQIKDIADWLLEHHGDSTGLSTDSLADAGYPGAASLGDAVCGMASARITSKDFLFWFRSHTAKEMKWGGAKHHPDDKDDARRMHPRSSFKAFLEVVKRRSLPWDNVEIDAIHSLQLILRCSFRDIDDSGTKTMVHSRLNYLRLQGIDELSSVASEMVRLIETATAPILAVDYNGLVNGWNAKVAELTGLPVGEAMGMSLVQDLVFEQSVERVEKMLHNALRGEEEKNVEMMLKTFGPQKEKEAVILVVNACSSRDFTDNIVGVCFVGQDVTSQKVVMDKFIRIQGDYRSIVQSPNPLIPPIFASDEYACCSEWNAAMEKVTGWTHDEVIGKMLVGEIFGGCCRLKGQDAVTKFTIVLHQCNHGQEIEKFPFAFFDKQGKYVEALLTANKRTDADGRITGSFCFFRIASSELQHALEVQRQQEKKCFARLKELAYIRQEIKNPLYGMMFTRKLLEETDLSDDQKQFVETSAVCERQMQKVMDDMDLESLEDGYMELDTAEFILGTVIDAVVSQGMIVLREKGLQLIREIPGEVKTMRLYGDEVKIQQILADFLLNVLRFTPSPEGWVAIKVFPTLKQLGGGLHVVHLEFRITHPGLGLPAELVQDLFDRSQWATQEGVGLSMCRKLLKLMNGDVRYIRESGICYFLVNVEFPMAQREDAASIK

SEQ ID NO: 56039 - protein, 353 aa, uncultured bacterium
IGAANNLLAAMLDNHIQQGNALGIDVKKITWKRCVDMNDRQLRFVVDGLGGRANGTPREDGFDITVASEIMAVFCLASSMSDLKERLSRIIIAYTYDNQPVTAGDLKATGAMAALLRDALKPNLVQTLEGTPAFVHGGPFANIAHGCNSVMATRMAMRMGDYTVTEAGFGADLGAERFLDIKCRMAGLTPDAVVVVGTVRALKMHGGLDKKQLANEDLAALERGIPNLLRHVNNITNVYQLPCVVAINRFPTDTDAEIDFIVRKCREMGVNTILSTVWAEGGKGGEDLAREVVRLCEEGKGNFTFSYELDATIEEKLEALTKKIYGGAGVALTPAAKKQAEQLTRLGFDKLPV

SEQ ID NO: 56040 - protein, 163 aa, Oryza sativa
  misc_feature (33)..(33): Xaa can be any naturally occurring amino acid
  misc_feature (51)..(51): Xaa can be any naturally occurring amino acid
  misc_feature (76)..(76): Xaa can be any naturally occurring amino acid
  unsure (1)..(163): unsure at all Xaa locations
MAAPLRRSLPSLGRTLLSPSPAPARMLSAAASXDALVEIKPGEIGMVSGIXPEEHLRRKVVIYSPARTASQQGSRXNAVGRWKINFVSTQKWENPLMGWTSTGDPYANVGEAGLTFDSADSAKAFAEKHGWDYVVRKRHTPLLKAKSYAENFKWRGPPKAEQA

SEQ ID NO: 56041 - protein, 352 aa, uncultured bacterium
ITSAHMLLSAMLDNSIQQGNPLNIDPRRIIWKRVVDMNDRALRNIVIGLGGKAHGVPREDGFDITVASEVMAILCLASNLHDLKERLKRIVVAYNYDGKPVTAEDLHAAGAMAALLKDAVKPNLVQTLEHVPAIIHGGPFANIAHGCNSVMATRTALRLADFTITEAGFGADLGAEKFFDIKCRQAGLAPDACVLVATVRALKMHGGVAKADLKEPNVEAVKKGLPNLGKHIENIFKFGVPVVVAINIFAQDTKEELQAVYDYCAGMGVNVALSDVFAKGGEGGVELAREVVALAESGMARLKPIYPLEMSLREKVAAVVKEVYGGDRVEFQTKAAQALDQYEKEGYANLPV

SEQ ID NO: 56042 - protein, 341 aa, uncultured bacterium
ITSANNLLAALIDNHIQQGNELGIDTRQIIWKRAEDMNDRALRNIVVGLGAKADGVPREDHFVITVASEIMAILCLASDMDDLKARLSRIIVAYTRDGEPVTAKDLNAVGSMAALLKDAIKPNLVQTLEHTPVIVHGGPFANIAHGCNSVRATKTALGISDYTVTEAGFGADLGAEKFLDIKCRIAGLKPDAVVLVATIRALKYNGGVAKKDLGEENLEALKKGIVNLEKHIENIQKYGVPVVVTLNAFLTDTDAEMAYVKEFCEERGCKFALSEVWAKGGEGGEALAKEVISTIENKPSNYAPIYSDDLSLTEKITKVATEIYGADGVNFLPAAAKQLAK

SEQ ID NO: 56043 - protein, 460 aa, Triticum aestivum
MDRFKLIKEVGDGTFGSVWRAINKQNGEVVAVKKMKRKYYSFEECMSLREVKSLRRMNHPNIVKLKEVIRENDILYFIMEYMECNLYQLMKDRVKPFAESDVRNWCFQIFQALAYMHHRGYFHRDLKPENLLVSKDVLKLADFGLAREISSAPPYTEYVSTRWYRAPEVLLQSSAYDSAVDMWAMGAIMAELLTLHPLFPGTSEADEILKICNVIGCPDEQTWPQGLSLAEAMKYQFPQIRGSQLSEVMKSASSEAVDLISSLCSWDPCKRPKAAEVLQHAFFKDCTYVPASVRPKAAGPPKTPPGVGARGLSGHIARRYSTGALSTSKPAANISIKPSSLSKIGVQRKLQLDRQAPQKSARPTESNTKQTTSRVPARNSPGNANPILRHSRSLPETGRATVQKVSTITEKLAHMSVTSRTRTAVKPPVPLLKAGHLKSDFLGKSDEIPPAKRLTRKLVS

SEQ ID NO: 56044 - protein, 338 aa, uncultured bacterium
NLLAALLDNHIQQGNQLQIDPRQVIFKRCMDMNDRALRNIVIGLGAKADGTPREDHFVITVATEIMAILCLASDMNDLKDRLSRIVVAYDYSGNPVTAGQLGAVGSMAALLKDAIKPNLIQTIEHTPAIVHGGPFANIAHGCNSVRATKAALKMADLVITEAGFGADLGAEKFLDIKCRKAGLSPDAIVIVATIRALKYNGGIPKDQLADENLDALKKGIVNLEKHIENMQKYGVPVIVTLNQFLTDTDSEIAYVQKFCEDRDCEFALSEVWAKGGEGGIALAEKVLKTLDEKESHFKPIYPDEMPLAEKIRTVATEIYGAKDVDFSASALKQLEKLT

SEQ ID NO: 56045 - protein, 330 aa, uncultured bacterium
LAAMLDNHIQQGNALGIDTKRITWKRCVDMNDRQLRNVVDGLGGRMQGVPREDGFDITVASEVMAIFCLSASITDLKERLGRMVVAYTYDGKPVTAHDLKAEGAMAALLKDALKPNLVQTLEGTPAFIHGGPFANIAHGCNSIMATRMAMRLGDYAVTEAGFGADLGAEKFLDIKCRENGIWPNAVVIVATVRALKLHGGVPKNMLGEENLEAVEKGLPNLLQHIGNIKDVYRLPCVVAINAFPTDTEAELELVQDKCRELGVNAALSEVWAKGSEGGKALAEEIVRLCEEESEPSYAYDTDASIEDKLNAIAKKIYHADGVTLAPAAKK

SEQ ID NO: 56046 - protein, 400 aa, Zea mays
MEAPRPNNGRKRKPTPPAGLGALHDDLLERVLARLPPATYFRLRAVCSRWRAAAASPTFLHACARVPSRDPWFLMLSDSDSGPRPPVAFDAAGRSWNRCHAAPGAAVPVAASAGLVLYRAPATGALTVANPLTGASRALPSPPQQAARQLQAIAMYGAGGPYRVALFAGDLPDDLSMAVYDSSSNSWEGPLPLARKPGDDSCPDAPAPDDTVYFLSKSGDVVATNMQRSASKQYSSSVVVRRDGDGDAAFAYFLSYSGTVVACDTARRTFAELPRILPVYFEYSIDVVACGAAAYAVVLSEYLGTASLRVWEFAGGAWRQVAAMPPAMSHGFHGTRPDINCVGHGDRLMVCVTSAEANACFMCDVASNQWEELPKYVNADGEASEFLAAFSFEPRVEVTV

SEQ ID NO: 56047 - protein, 178 aa, Triticum aestivum
  misc_feature (101)..(101): Xaa can be any naturally occurring amino acid
  misc_feature (120)..(120): Xaa can be any naturally occurring amino acid
  unsure (1)..(178): unsure at all Xaa locations
MASEKDAALAPVPNDNPTIFDKIIKKEIPSTVVYEDEKVLAFRDINPQAPTHIVIIPKVKDGLTGLSKAEERHVEILGCLLYAAKVIAKQEGLEDGYRIVXINDGPSGCQSVYHIHVHLXLGGRQMNWPPRLKKLLVVGQSSWQLCPLHPNRIIPVIDITVCARNICSIYGIGKTILL

SEQ ID NO: 56048 - protein, 335 aa, Arabidopsis thaliana
MTSFCSMISLLLLLSLSSPVFSDDASFQKLPVPETRSGPEAFAFDSTGKGFYTGVSGGKILKYLPETGYVDFAQITESSNSSWCDGTIGTALAGRCGRPAGIAFNEKTGDLYVADAPLGLHVISPAGGLATKITDSVDGKPFKFLDGLDVDPTTGVVYFTSFSSRFSPIQVLIALGLKDATGKLYKYDPSTKVVTVLMEGLSGSAGCAVSSDGSFVLVSQFTKSNIKRYWIKGPKAGSSEDFTNSVSNPDNIKRIGSTGNFWVASVVNKIIVPTNPSAVKVNSNGEVLQTIPLKDKFGDTLLSEVNEFEGNLYIGTLTGPFAGILKIEKGSCPAT

SEQ ID NO: 56049 - protein, 175 aa, Triticum aestivum
  misc_feature (123)..(123): Xaa can be any naturally occurring amino acid
  unsure (1)..(175): unsure at all Xaa locations
PVNPFPSRTLLLHPLSLPGGGETQLSGSYASDIYTYLRTMEVEAPRRPAADYIEAVQTDVTANMRAILIDWLVEVAEEYKLVADTLYLTVSYVDRFLSANPLGRNKLQLLGVAAMLIASKYEXEISPPHVEDFCYITDNTYTRQELLTMESDILKLLNFEIGSPTHQTFPQRFTR

SEQ ID NO: 56050 - protein, 345 aa, Arabidopsis thaliana
MRSFVSLISLLLLLSFSSSVLSTKKSSFQKLPVPGNRTGPEAFAFDSTGKGFLPGVTGGKILKYLPKKGYVDFAQITNSSKSSLCDGALGTTNVEKCGRPAGIAFNTKTGDLYVADAALGLHVIPRRGGLAKKIADSVGGKPFLFLDGLDVDPNTGVVYFTSFSSTFGPRDVLKAVATKDSTGKFFKYDPSKKVVTVLMDGLSGSAGCAVSSDGSFVLVGQFTKSNIKRYWIKGSKAGTSEDFTNSVSNPDNIKRIGSTGNFWVASVVNSATGPTNPSAVKVSSAGKVLQTIPLKDKFGDTLVSEVNDQRTALYRSSFWAFRRNSLSFKVNMVLVWVRIKVIESK

SEQ ID NO: 56051 - protein, 325 aa, Coccidioides immitis RS
MSSALDQLKASGTTVVCDSGDFATIGKYKPQDATTNPSLILAASKKPEYAKLIDNAIQYGKQHSSNLEDQVDSALDRLLVEFGKEILQIIPGKVSTEVDAHYSFDTKASVDKALHIIELYKSVGVPKERVLIKIASTWEGIQAAHILQSQHGVNVNLTLMFSLVQAIAAAEAGTYLISPFVGRILDWYKAATKKEYASHEDPGVQSVQSIFNYYKKHGYKTIVMGASFRNTGEITELAGCDYLTISPNLLEELYNSTAAVPKKLDAAGAAKLDIPKRSYLNNEALFRFDFNEEQMAVEKLREGISKFAADAVTLKNILREKIQAA

SEQ ID NO: 56052 - protein, 460 aa, Zea mays
MAGKKRKSGSEKPTKHRLPLGADADAVAEASKRRRSGATKQHQADEEASIPPSLSAKILREARKQQEEEMRADSSDEQRPSAAEATAGPSTSSSFPVPAADGENEEDDVDEFDGFDALSEYDGGEVEINEEDEKALAAFMSKDKAAERTLGDIILQKIREKDAEVATGEGRPRVKLDNSIIELYKEVGKFLSRYTSGKIPKAFKRIPSLECWADVVQLTEPENWSPNAVYQATRLFSSNMNTKNAERFYEAILLPRVRNDIRKNKRLHFALYQSLKKALYKPAAFNKGILLPLCRERNCTLREAVIIGSIIQKVSIPFLHASVALVKLAEMEYCGTTSYFIKLFLDKKYALPYRALDAVLAHFMRFVDDERIMPVIWHQSLLAFVERYKNELEKKDKEKLARLLDHQKHYLVTPEIRRELRGSCNRGEKDTNLHTYILSVELVMIFTLHTYTILAEPKML

SEQ ID NO: 56053 - protein, 685 aa, Pseudomonas aeruginosa PAO1
MKRRSVLLSGVALSGTALANDSIFFSPLKYLGAEQQRSIDASRSLLDNLIPPSLPQYDNLAGKLARRAVLTSKKLVYVWTENFGNVKGVPMARSVPLGELPNVDWLLKTAGVIVELIVNFVASLPASAAAQFERIATGLSGDLEAARQVHEALLEEAKNDPAAAGSLLLRFTELQTRVIAILTRVGLLVDDILKSASNLVTQRGQGDGLNRFRAVFGTLRLPEVADSFRDDEAFAYWRVAGPNPLLIRRVDALPANFPLGEEQFRRVMGADDSLLEAAASRRLYLLDYAELGKLAPSGAVDKLLTGTGFAYAPIALFALGKDRARLLPVAIQCGQDPATHPMFVRPAESESDLYWGWQMAKTVVQVAEENYHEMFVHLAQTHLVSEAFCLATQRTLAPSHPLHVLLAPHFEGTLFINEGAARILLPSAGFIDVMFAAPIQDTQATAGGNRLGFDFYRGMLPESLKARNVDDPLALPDYPYRDDGLLVWNAIRQWAADYVAVYYASDGDVTADVELAAWVGEVIGSGKVAGFRPITGRSQLVEVLTMVIFTASAQHAAVNFPQPSMMTYAPAICAMSAAPAPDSPSGKSEADWLKMMPPTLVALEKVNIYHLLGSVYHGRLGDYRQTGFPYAPVFSDRRVTASGGPLERFQARLKEVEATIRTRNQARRRPYEYLLPSRIPASTNI

SEQ ID NO: 56054 - protein, 594 aa, Kineococcus radiotolerans SRS30216
MCGLCGEVRFDGRAADVAAVQRMSETMAARGPDGEGVWAQGRVAFGHRRLSVIDLSACGAQPMQDPELGLTAVFNGCIYNYPELRAELAGHGYRFTSTSDTEVIVKGYHRWGVDVVDHLVGMFAVVLHERDSGRVVLMRDRLGIKPLYLAETPGRLRFASTLPALLAGGDVDTTIDPVALHHYLSWHAVVPAPRTVLQGVRKLPPATVRVLEADGTSREHRYWAPDHVRREEFAGFSERDWEDAVLESLRTAVRRRTVSDVPVGVLLSGGLDSSLITALLAEQGQTDLATYSIGFESVGGRGGDEFEYSDVIAERFATDHHRIRVSGDELVGALGHAVGAMSEPMVSHDVAAFDLLSQQVSQSIKVVQSGQGADEVFGGYHWYPPLAGLTPQQGVDVYARAFFDRDHAGMAQVLDPRWLTATDVSREFLAEHFARPGADTAVDAALRLDTEVMLVDDPVKRVDNTTMAWGLEARVPFLDHELVELAAAVPPELQLSGGGKGILKRVGYRVIPREVIDRPKGYFPVPAITHLEGKVLGTVKDALTSRAAQDRGLFRPEYVQGLLRDPNGELTPLRGNKLWQLGLLEMWLQQHGIG

SEQ ID NO: 56055 - protein, 520 aa, Wolbachia endosymbiont strain TRS of Brugia malayi
MSAIAIIDFGSQFTQLIARQIREMDVYCEIFPSNISFETISKFNGFILSGGPQSVHDGCSEASGVAHEIIKFNEATNVPILGICYGQQLICHYFGAKVKKEFKQEFCKTKIKILKESSIVKDVWNVNSEVDVLMNHADSVETAPQGFTVIASGVINQTIAIVANEQRRIYCTQFHPEVKPTANGSKLLSNFLDIANCKRDWTMKSIIEKQKEKIKNVVGEKKVIAAVSGGVDSSVAVALTYKAVGKQLNCIFIDTGLLRKNQTIALLEEIPVNYVDKSNLFLSRLKGITDPEEKRKIIGNTFIEVFEEEAKKIGNADFLMQGTIYSDVVESGHASGNASTIKSHHNVGGLPEKMNLKLVEPLRYLFKDEVRLLGKEIGLSNEIIFQHPFPGPGLAVRVIGEVDEERVRILQEIDEIYINTMKNYDLYDKIWQAFAVLLPIRTVGVMGDGRTYGYVCALRAVTSFDGMTADAFPFENKSQHSLIFWDFLQNVSSIIVNNVSGVNRVVYDLTSKPPATIEWE

SEQ ID NO: 56056 - protein, 121 aa, Kineococcus radiotolerans SRS30216
MSEVSRVQRAPDDLFLRIVAGEVPATIVHSDDLVVAFEDVNPQAPVHVLVIPRERHENVAQLAAAAPATLARLVEVAQRIADERCGGEYRLVFNTGTAVGQSVFHVHGHVLGGRGFTWPPG

SEQ ID NO: 56057 - protein, 352 aa, uncultured bacterium
ITSANNLLAALLDNHIQQGNELQIDTRQIIWKRAEDMNDRALRNIVVGLGAKADGVPREDHFVITVASEIMAILCLASDMDDLKERLSRIIVAYTFDGRPVTAKDLGAVGSMAALLKDAIKPNLVQTLEHTPVIVHGGPFANIAHGCNSVRATKTALAISDYTVTEAGFGADLGAEKFLDIKCRIAGLKPDAVVLVATIRALKYNGGVDKKNLGEENLDALRKGIVNLEKHIENIQKYGVPVVVTLNSFLTDTQAEMDYVREFCEERNCKFALSEVWAKGGEGGEALAKEVISTIENKPSNYAPIYSDDLSLSDKITKVATEIYGADGVNFLPAAARQLAKIEEMGFGKLPV

SEQ ID NO: 56058 - protein, 322 aa, uncultured bacterium
TISALLDNYLYQHRKEGFSLREVYWKRVLDVNDRALRNVVTGLHGDGVVSETGFDITPASELMAILCLATSEDDLRRRIENILLGITSDGKPFRVRDMGVGGAITVLMRDALSPNLVQTTEQTPAFIHGGPFANIAHGCSSVMATKMAMTYSDYVVTEAGFGADLGAEKFFNIKCRKAGLQPRLVVIVATTQGLKMHGGVALDHIKEPNADGLKEGLKNLNRHINNMQGFGQPVIVTLNRFDSDTEEEIELIRKNCEDRGVGFAVNEAFLKGGEGAVELAQKVVDTIDRIQPLPINFTYPETDTIEGKIEKVCKRIYGAAAV

SEQ ID NO: 56059 - protein, 476 aa, Solanum lycopersicum
MNSAPLSTPAPVTLPVRSIPGSYGLPLVGPIADRLDYFWFQKPENFFTKRMEKHKSTVFRTNVPPCFPFFGSVNPNVVAVLDVKSFSHLFDMEIVEKANVLVGDFMPSVVYTGDMRVCAYLDTSEPKHAQIKNFSQDILKRGSKTWVPTLLKELDTMFTTFEADLSKSNTASLLPALQKFLFNFFSLTILGADPSVSPEIANSGYIFLDSWLAIQLAPTVSIGVLQPLEEILVHSFAYPFFLVKGNYEKLVQFVKNEAKEVLSRAQTGFQLTEQEAIHNLLFILGFNAFGGFSIFLPTLLGNLGDEKNADMQEKLRKEVRDKVGVNPENLSFESVKEMELVQSFVYETLRLSPPVPSQYARARKDFKLSSHDSVYEIKKGELLCGYQPLVMKDPKVFDEPEKFVLERFTKEKGKELLNYLFWSNGPQTGRPTESNKQCAAKDMVTLTASLIVAYIFQKYDSVSFSSGSLTSVKKAS

SEQ ID NO: 56060 - protein, 353 aa, uncultured bacterium
IGAANNLLAAMLDNHIQQGNALGIDVKKITWKRCVDMNDRQLRFVVDGLGGKANGTPREDGFDITVASEIMAVFCLASSMADLKERLSRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVIGTVRALKMHGGLDKKQLANEDLAALERGIPNLLRHVNNIKNVYQLPCVVAINRFPTDTDAEIDFIIRKCRELGVNTVLSTVWAEGGKGGEDLAREVVRLCEEEQGNFTFSYELDASIEEKLEAVTKKIYGGAGVVLTPAAKKQAERLTALGFDKVPV

SEQ ID NO: 56061 - protein, 384 aa, Methanococcus maripaludis S2
MDEQDILNELREYRNQDLKYEEGYILGSMCTKPHPMARKISEMFFETNLGDPGLFKGTSKLEKEVVSMIGGILHNKNAFGYLISGGTEANLTAMRAFKNISKSKGKPQNIIIPETAHFSFDKAKDMMDLNVVRPPLTKYFTMDVKFIKDYIEDSKNEVSGIVGIAGCTELGSIDNICELSKIAVENDILLHVDAAFGGFVIPFLDDKYKLDGYNYDFDFSLNGVSSITIDPHKMGLAPISAGGILFRDNMFKKYLDVDAPYLTEKQQATIIGTRSGVGVASTWGIMKLLGIDGYETLVNESMEKTMYLVKKAREYGFETAIDPVMNIVALNDENKHDTCMKLRDENWYVSVCRCVDALRIVVMPHLEIEHIDGFLESLSNTKKY

SEQ ID NO: 56062 - protein, 335 aa, uncultured bacterium
LAAMIDNHIYQGNALDIDPRRIIWRRCVDMNDRQLRNVVDGLGGKAQGCPREDGYDITVASEVMAIFCLASSITDLKERLSKIIIGYSRKGEPVTAGQLNAQGAMTALLRDALNPNLVQTLEGTPAFVHGGPFANIAHGCNSVIATKTALHFADYVVTEAGFGADLGAEKFLDIKCRMAGLKPDAVIIVATIRALKYNGGVPKDKTTEENLEALEKGLPNLLKHVENITQVYHLPCVVALNRFVSDTDAEIDLVTKKCKELGVNVKMSEVWGKGGDGGIELANEVVRLCEEESNDKFEFCYDLNKPLKEKIETIAKRVYGAAEVTYDKAASDELA

SEQ ID NO: 56063 - protein, 382 aa, Triticum aestivum
  misc_feature (218)..(218): Xaa can be any naturally occurring amino acid
  misc_feature (282)..(282): Xaa can be any naturally occurring amino acid
  unsure (1)..(382): unsure at all Xaa locations
MPFQLKAGHHHGAMDGKPPPPPPLAPAPTPPAPPRVSRLRRLLVRVSASERLAVAGDGKEKEREERPAAGGEAEVGSVGLDRMVLSFMEDSAAVERPPRGRCNCFNGSNYEESDDEEGFFLPSGQASAPPPSAAGDTLEALKSLVQSASVAERNLLADASRIAERCGRTCKGKAECRRAVADGLRALGYDAAVCKSRWEKTPSYPAGEHEYIDAVVGXEARLIVEVHFRSEFEVARSTKAYRAALQALPPLFVGTSDRLGKIVSVVAEAARQSMKKKGLHFXPPWRKPEYMRAKWLSPHVRTGDKAAAPSPAASATATATAVSAASFSGEFELLFGMNKSGVSPTPGEKITVVVSPWRPTEEAASKKQQPRAKVVTGLAAVL

SEQ ID NO: 56064 - protein, 352 aa, uncultured bacterium
IGAANNLLAAMLDNHIQQGNSLNIDPRRITWKRAVDMNDRQLRNIVDGLGARTDGTPRQDGFDITVASEVMAVLCLASDIPDLKSRLARIVVGYTYDNQPVTAGDLKAQGAMAALLKDALKPNLVQTLEHTPAFIHGGPFANIAHGCNSVTATRMALKLGEYAVTEAGFGADLGAEKFLDIKCRMAGLKPNAVVIVATVRALKHNGGVNKVDLGKENLEALEKGMPNLLQHVDNITNVYKLPCVVAINRFPTDTEAELKLIEDRCRKLGVNVALSEVWAKGGEGGIKLAEEVVRLCEQPNDFTYSYDLNMSIMEKLETIARRIYRADGVDLVGNASKQLIQLESMGFSDLPI

SEQ ID NO: 56065 - protein, 145 aa, Triticum aestivum
TREAAAWTRRSSGRGQVGSCRVVKVDKEAAWDLFTTQAANEGRTVAAHFGASWCVTSLSMNYKFEELAQTHPDMLFLFVDVDDVPGVSSKLGVKAMPTFFLIKGKEVVKKIVGANSDELHKMVDASDDDSLGSAVTTLPDIVIEK

SEQ ID NO: 56066 - protein, 223 aa, Brassica napus
  misc_feature (190)..(190): Xaa can be any naturally occurring amino acid
  unsure (1)..(223): unsure at all Xaa locations
MGNKGNLGYLIFLWATLVAVVSMATAQRPFERTKGINGLEKIIVRDDRSRSFEVYLYGGQVASWKNEKGEELLVMSSKAIFKPPTPIRGGIPILFPQYANTGPLPSHGFVRQRFWEIDTNPPQLPSNSYYKAWVDLILRSSQDDLKIWPHKFEYRLRVHLGTEGDLILTSRVKNTDVKPFNFTMALHPYXSVSDISEIQVDGLQNLNYLDQLKNRTRFTDHDK

SEQ ID NO: 56067 - protein, 484 aa, Ustilago maydis 521
MGQTLSEPVVKKTTSSGGNDSVLYAISEMQGWRISMEDSHTTILDIKNEDGDIVGNFFGVFDGHGGATVAQYCGRNLHNTLLSEDKFKQGDYTEALQQTFLDVDEELKKDPNYTSDPSGCTAVTAFIKTTAKDPKRVEKIFVANAGDSRCVLSQAGNCIEMSNDHKPTLDSERERIEYAGGYVSWGRVNGNLALSRAIGDFEFKRTFDLPVERQIVTAFPEVLDREVLEAEDEFLVLACDGIWDCLSSVKVVDIVRRSIANGKELADICEDLMDRCLAPDSDTGGIGCDNMTVCIVALLNGRSKDEWYSWIKDNIEVPKFGRTTPKEVPPVFSNTQTSTRGQETGMEGAVSIQSLLSGGLARGENGEQGAAGALQLPGGLAGALSGAGIVFRPGGRSDEGEVVYEAHVVDEEDSGDEQPDQSSSESAPKASTTEKATDGDAAEPRLVESPHTDAKPASSNQESDKMEVDDDTNTSAKSQDASNA

SEQ ID NO: 56068 - protein, 669 aa, Synechococcus sp. WH 7805
MVAAPASLDTLCINSIRFLAVDAVNKSKSGHPGLPMGCAPMGYTLWDKFLRHNPKNPKWFNRDRFVLSAGHGCMLLYSLLHLTGYDSVSIEDIKQFRQWGSKTPGHPETFETPGVEVTTGPLGAGISNAVGLAIAESHLAAKFNKPDAQVVDHYTYVIMGDGCNQEGVASEACSLAGHLKLGKLIALYDDNHITIDGRTDVSFTEDVLKRYEAYGWHVQHVADGNTDVDAIAKAIEAAKAVTDKPSIIKVTTTIGYGSPNKGDTAGVHGAPLGEEEAELTRKQLGWSYGPFEVPQEAYDQYRQAIERGASQEAEWNQTLAAYRNQYPAEAAEFERMLRGELPQGWDKELPTYTPDDKGLATRKHSQICLGALGPNLPELIGGSADLTHSNYTDIKGETGSYQPETPEKRYLHFGVREHAMAAVLNGIAYHNSGLIPYGGTFLVFADYMRGSMRLSALSELGVIYVLTHDSIGVGEDGPTHQPIETIPSLRAIPNMLVFRPGDGNETSGAYKLAIENRHRPSALCLSRQGMANQANSSIDKVAHGGYILEDCDGTPELILIGTGTELDLCVQAAKQLSAEGKKVRVVSMPCVELFDEQSDAYKEQVLPTAVRKRIVVEAAEAFGWHRFIGLDGDSVTMNRFGASAPGGTCMEKFGFTVENVVAKSKALLG

SEQ ID NO: 56069 - protein, 179 aa, Triticum aestivum
  misc_feature (101)..(101): Xaa can be any naturally occurring amino acid
  unsure (1)..(179): unsure at all Xaa locations
MKKLYQGKGRRVHPAPAPAPGQDASAVALAMLPATLLALVAALTAEEQEVLAYLLSGGAGGAAGGAGGGRRRRLNGPHQPEMGCGCFGCYKSFWARWDASXPNRHLIHRIIDAVEEGNGGGEGAAKGVPTRGGQAPGSPPPAPWPREAGGLDAAAEEHGTRGGPRGGPEQAPGPARVAA

SEQ ID NO: 56070 - protein, 480 aa, Capsicum annuum
MIPIMSSAPLSTATPISLPVRKIPGSYGFPLLGPLWDRLDYNWFQKLPDFFSKRVEKYNSTVFRTNVPPCFPFFLGVNPNVVAVLDVKSFAHLFDMEIVEKANVLVGDFMPSVVYTGDMRVCAYLDTSEPKHTQIKNFSLDILKRSSKTWVPTLVKELDTLFGTFESDLSKSKSASLLPALQKFLFNFFSLTFLGADPSASPEIANSGFAYLDAWLAIQLAPTVSIGVLQPLEEIFVHSFSYPYFLVRGGYEKLIKFVKSEAKEVLTRAQTDFQLTEQEAIHNLLFILGFNAFGGFTIFLPTLLGNLGDEKNAEMQEKLRKEVREKVGTNQENLSFESVKEMELVQSFVYESLRLSPPVPSQYARARKDFMLSSHDSVYEIKKGELLCGYQPLVMKDPKVFDEPEKFMLERFTKEKGKELLNYLFWSNGPQTGRPTESNKQCAAKDAVTLTASLIVAYIFQKYDSVSFSSGSLTSVKKAC

SEQ ID NO: 56071 - protein, 1165 aa, Streptococcus pyogenes M1 GAS
MKKKVNQGSKRYQYLLKKWGIGFVIAATGTVVLGCTPSILTHQVAAKTIVGLARDEAQQGDGNAKSGDGLQSSSKEAKPVLDSSSANPASIAEHHLRMHFKTLPAGESLGSLGLWVWGDVDQPSKDWPNGAITMTKAKKDDYGYYLDVPLAAKHRQQVSYLINNKAGENLSKDQHISLLTPKMNEVWIDENYHAHAYRPLKKGYLRINYHNQSGHYDNLAVWTFKDVKTPTTDWPNGLDLSHKGHYGAYVDVPLKEGANEIGFLILDKSKTGDAIKVQPKDYLFKELDNHTQVFVKDTDPKVYNNPYYIDQVSLKGAEQTTPNEIKAIFTTLDGLDEDAVKQNIKITDKAGKTVAIDELTLDRDKSVMTLKGDFKAQGAVYTVTFGEVSQVARQSWQLKDKLYAYDGELGATLAKDGSVDLALWSPSADTVKVVVYDKQDQTRVVGQADLTKSDKGVWRAHLTSDSVKGISDYTGYYYLYEITRGQEKVMVLDPYAKSLAAWNDATATDDIKTAKAAFIDPSKLGPTGLDFAKINNFKKREDAIIYEAHVRDFTSDKALEGKLTHPFGTFSAFVEQLDYLKDLGVTHVQLLPVLSYFYANELDKSRSTAYTSSDNNYNWGYDPQHYFALSGMYSANPNDPALRIAELKNLVNEIHKRGMGVIFDVVYNHTARTYLFEDLEPNYYHFMNADGTARESFGGGRLGTTHAMSRRILVDSITYLTREFKVDGFRFDMMGDHDAAAIEQAFKAAKAINPNTIMIGEGWRTYQGDEGKKEIAADQDWMKATNTVGVFSDDIRNTLKSGFPNEGTAAFITGGAKNLEGLFKTIKAQPGNFEADAPGDVVQYIAAHDNLTLHDVIAKSINKDPKVAEEEIHKRIRLGNTMILTAQGTAFIHSGQEYGRTKQLLNPDYKTKASDDKVPNKATLIDAVAQYPYFIHDSYDSSDAVNHFDWAKATDSIAHPISNQTKAYTQGLIALRRSTDAFTKATKAEVDRDVTLITQAGQDGIQQEDLIMGYQTVASNGDRYAVFVNADNKTRKVVLPQAYRYLLGAQVLVDAEQAGVTAIAKPKGVQFTKEGLTIEGLTALVLKVSSKTANPSQQKSQTDNHQTKTPDGSKDLDKSLMTRPKRAKTNQKLPKTGEASSKGLLAAGIALLLLAISLLMKRQKD

SEQ ID NO: 56072 - protein, 559 aa, Chromobacterium violaceum ATCC 12472
MDKVWLKNYQPGVAHEIDINQFQSVTEVFDRSVKKFSGRPAMACMDKVLSYAELDALSGRFASFLQHRLGLKKGDRVAVMMPNLLQYPIAVFGTLRAGGAVVNVNPLYTPRELEHQLKDSGAETIVILENFAGVLEQVLPRTQVKNVVVASIGEMLGILKGTLVNFVVRKVKKMVPPWRIPGHVRFSDALSIGAAKPYDKVALTHEDVAFLQYTGGTTGVAKGAVLLHKNIVANMLQASAWVGTLVREGQEVIVTALPLYHIFSLTANLMVFTEIGALNVLITNPRDIPGFVKELRKYPITCITGVNTLFNALLNHPEFSKLNFSTWRLTLGGGMAVQKAVADKWKAVTGVPLVEAYGLTETSPAACINPMDLKEYNGTIGLPVPSTEIEIRDAEGRPVAPGEQGELCIRGPQVMRGYWNRPDETAKVLGADGFLATGDMAVLTPEGYVKLVDRKKDMILVSGFNVYPNEIEDVVAGHPDVLEVACIGVPDDKSGEVVKVFVVKKNPALTDKDIIRYCRENLTGYKVPKLVEFRSELPKTNVGKILRRALRDQETAKQA

SEQ ID NO: 56073 - protein, 292 aa, Thermoplasma acidophilum DSM 1728
MYKGIVTPMITPMGQNGEIDYRATEILIDNLADFGVDGLFPMGSTGLFPMFSTDEKKKFLGFVRDHSKKIEVYAGVGSSSTQESVELSKYTEDIGIKVRVLMPTYYIKPDEDWMYRHFSTVISAASNDLFIYNIPQLSGSWISESLIEKLTREFSNVKGIKDSSGDMRFFSRIIRHKNEKFDIFQGQDDLLFLSLSIGASGGVCGLSNISPYITNLYHEFSAGNLEKARKIQIDEVNPLMYAINEATFPAGYYYAFYKMNGIKGGYRAPMVEPTTDQKKKIDQELTKIPKKQ

SEQ ID NO: 56074 - protein, 234 aa, Crocosphaera watsonii WH 8501
MLSESPSFLNALLSLRYPISLVILYLGVIIALAEGLNRLWGTNSEFTRKIVHIGSGNVVLIAWWLQLPSWTLIGASFIASIIALVSYFLPILPSINSVGRKSLGTFFYAVSIGVLAQLFWSKGEPQYLAIGILIMAWGDGMAAIIGQKFGKHCYEVLGVKKSWEGSLTMMGVSFLVTSIILSWVSVPILTVVIVSLMIAIVAMALEAFSKLGIDNLTVPLGSAFVAFYLINQLL

SEQ ID NO: 56075 - protein, 792 aa, Wolbachia endosymbiont strain TRS of Brugia malayi
MRFTLSWLLEHLETNASLEEITDKLTHIGLEVKDVVDNTKLAGFIVAKVLEVTPHPNVDKLKLCKVDNGSKILQIVCGANNVREGLKTVLASLGSTLPESNFTIKPTKIRGVLSEGILCSASELMLAQEKSKGIIELSDDYKVGNKFFNCDPVIDINVTTNRGDCLSVHGIARDLAATGIGTLNSLIYSSAIPAHDTGIQDRSKSGMTRSSSINVKVIDGESFISGVYISNVRNKESPRWLKDRLESVGMRSISAIVDITNYIMMSFGRPMHAYDAKKIEGKLIVRKANNGEKFTGLNGKEYLLNNDISVISDNNNIHAIAGIIGGKCSKCTLETTDVFLESAWFNPISVTKSSRQLNISTDSSYRFARSVDPGFILDGLHFAAQMIVDLCGGKASNVVFAGSLDEADTKVSFDYQDVNKFGSVSVLPDEMFDILTKLGFSTDKKTENNWNVKVPSWRSDVTIPADLVEEVVRIYGYDKIKEEPLIDNVEVEINTHDNLRVLMISRGFHEVFTWSFMSESIAEKFGYSNKLFIIDNPFNNNFNIMRPSIVPNLLQVTADNIVHGMSDLAIFEIGPVYDSLDQPKYSLSGIRTGNNLPRNHYNTDRKIDVFDAKADLIAALELFNVSYGNLTIERAEKEYYHPGKSGTLSFKNKATGYFGELHPNILDLFDIKQKVVGFEMILENMGNLPVSREKFIDYKHQSVKRDFAFIVNRDVEVGKIINMVKKSSELITEVFVFDVYHGNNMEPNKMSIALSVTFCSPTHTLIEEEIQKESSAIVNLVHKNTGGILRYT

SEQ ID NO: 56076 - protein, 223 aa, Enterobacter cloacae
  misc_feature (25)..(25): Xaa can be any naturally occurring amino acid
  unsure (1)..(223): unsure at all Xaa locations
IWYNNFFGAETEAILPYDQYMHRFXAYFQQGNMESNGKYVDRNGNAVDYQTGPIIWGEPGTNGQHAFYQLIHQGTKMVPCDFIAPAITHNPLSDHHPKLLSNFFAQTEALAFGKSRDVVEQEYRDQGKDPATLDHVVPFKVFEGNRPTNSILLREITPFSLGALIALYEHKIFTQGAILNIFTFDQWGVELGKQLANRILPELGDDNAINSHDSSTNGLINRY

SEQ ID NO: 56077 - protein, 223 aa, Enterobacter cloacae
IWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSRDVVEQEYRDQGKDPATLDHVVPFKVFEGNRPTNSILLREITPFSLGALIALYEHKIFTQGAILNIFTFDQWGVELGKQLANRILPELGDDNAINSHDSSTNGLINRY

SEQ ID NO: 56078 - protein, 116 aa, Brassica napus
MGSLPPTHLDFSSANHQDISKDNLVSLFKSQQDLLNHFFKHLDLSQTLSFSRPPPLRLFFGPNPAFCSPPKLLPRLFLFTTENRYGAPPGGPSASFKARWKLPIGGKKPAAGGNFR

SEQ ID NO: 56079 - protein, 223 aa, Escherichia coli
IWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQEYRDQGKDPATLDYVVPFKVFEGNRPTNSILLREITPFSLGALIALYEHKIFTQGVILNIFTFDQWGVELGKQLANRILPELKDGKEISSHDSSTNGLINRY

SEQ ID NO: 56080 - protein, 521 aa, Oryza sativa (japonica cultivar-group)
MEEAHAMPVTSFFPVAGIHKLIAIFLVVLSWILVHKWSLRNQKGPRSWPIIGATVEQLKNYHRMHDWLVEYLSKDRTVTVDMPFTSYTYIADPVNVEHVLKTNFTNYPKGEVYRSYMDVLLGDGIFNADGEMWRKQRKTASFEFASKNLRDFSTVVFREYSLKLSSILSQACKAGRVVDMQELFMRMTLDSICKVGFGVEIGTLSPDLPENSFAQAFDAANIIVTLRFIDPLWRLKKFLHVGSEALLEQSMKLVDDFTYSVIRRRKAEILQARASGKQEKIKHDILSRFIELGEAGGDEGGGSFGDDKSLRDVVLNFVIAGRDTTATTLSWFTYMAMTHPAVADKLRRELAAFEDERAREEGVALADAAGEASFAARVAQFASLLSYDAVGKLDPKGIVEDDVLPDGTKVRAGGMVTYVPYSMGRMEYNWGPDAASFRPERWLSGDGGAFRNASPFKFTAFQAGPRICLGKDSAYLQMKMALAILFRFYTFDLVEDHPVKYRMMTILSMAHGLKVRVSTSV

SEQ ID NO: 56081 - protein, 739 aa, Zea mays
MRLLVPDGARRQRLLQCEAPPSPSPPSPSPYPSSSPSRTVVVGIRRDAASRELLTWALVKVANAGDRVVALHVATAAAADGLLVRLDERSRAADSLASVLAVYDGFCNLKQINLELKVCGGSSIRKTLVKEAAACGAAHLILGVTNNSRSFGSSLTSVAKYCSKRVPASCSVLAVNNGKVVYHKDAGHGLQHELYQSNTTIPETPRRSYRKLLSTMIGDKLWDENGKDRRCVSRAVTMPMRSPARPKEFSLALVPVKGCQHESPAVATGWPLLRKKFLPDRKASAPDKSKMSVVQWAMRLPSRYSAVSPVHSEYRTTKPDSTSASHILRDRVIVPSRSNSGKSCVVIEELEKETPEELTLLKEKFSSIYSSFSYSELAKITSDFSPECVVGQGGTSQVYRGCLANGKELAVKILKYSDEVLKEFVSEIEIVSSLSHKNVISLVGFCFKNDDLLLVYEYLQRGSLEEILHGKKECKSIFGWTERFSVAMGVARALDYLHSDNNSRPVIHRDVKSSNILISKCFEPKLSDFGLAVWAADVTSQMTCNDVAGTFGYLAPEYFMHGKVGNKIDVYAFGVVLLELISGRKPLCTGCPKGQESLVMWANSIIQGGKLRQLVDPNLPTEGHVDEVERMTLAASLCIRQTPQNRPEIDAVLKLLHGDNDTLKWARSQVGLSCESSDIDEFVMTPPAPRSNTNIQSYINLAFDVDDDSASVSSNDFIAANTSLEEYLKGRWSRSSSFD

SEQ ID NO: 56082 - protein, 514 aa, Escherichia coli K12
MLVSKKPMVLVILDGYGYREEQQDNAIFSAKTPVMDALWANRPHTLIDASGLEVGLPDRQMGNSEVGHVNLGAGRIVYQDLTRLDVEIKDRAFFANPVLTGAVDKAKNAGKAVHIMGLLSAGGVHSHEDHIMAMVELAAERGAEKIYLHAFLDGRDTPPRSAESSLKKFEEKFAALGKGRVASIIGRYYAMDRDNRWDRVEKAYDLLTLAQGEFQADTAVAGLQAAYARDENDEFVKATVIRAEGQPDAAMEDGDALIFMNFRADRAREITRAFVNADFDGFARKKVVNVDFVMLTEYAADIKTAVAYPPASLVNTFGEWMAKNDKTQLRISETEKYAHVTFFFNGGVEESFKGEDRILINSPKVATYDLQPEMSSAELTEKLVAAIKSGKYDTIICNYPNGDMVGHTGVMEAAVKAVEALDHCVEEVAKAVESVGGQLLITADHGNAEQMRDPATGQAHTAHTNLPVPLIYVGDKNVKAVEGGKLSDIAPTMLSLMGMEIPQEMTGKPLFIVE

SEQ ID NO: 56083 - protein, 468 aa, Escherichia coli W3110
MIREPPEHILNRLPSSASALACSAHALNLIEKRTLDHEEMKALNREVIEYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRKPFMPLLPGFRHVPFGNIEAMRTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALAAMRVSVEEA

SEQ ID NO: 56084 - protein, 345 aa, Oryza sativa
MSSAASASAAGGAGEEGAAAAAQPQQEGPVVTCKGVNGLDKVVLREVRGSSAEVYLYGGHVTSWKDEHGEELLFVSNKAIFKPPKAIRGGIPICFPQVLFNFGNLDPHGFARNRTWSVENDPPPFPVPTSNKAYVDLILTHTEEDLKIWPHSYEFRLRVALGPGGDLMLTSRIRNTNADGKPFSFTFAYHTYFSISDISEVRVEGLETLDYLDNLQERNRYTEQGDAIVFESELDRIYLGTPSKIAIIDHEKKRTFVVRKGGLPDAVVWNPWDKKAKAMSDFGDDEYKRMVCVEAAAIEKPITLKPGEEWTGKLELSAVPSSYYSGQLDPDRVLQDSSVPEDSIS

SEQ ID NO: 56085 - protein, 341 aa, Escherichia coli K12
MKALSKLKAEEGIWMTDVPVPELGHNDLLIKIRKTAICGTDVHIYNWDEWSQKTIPVPMVVGHEYVGEVVGIGQEVKGFKIGDRVSGEGHITCGHCRNCRGGRTHLCRNTIGVGVNRPGCFAEYLVIPAFNAFKIPDNISDDLAAIFDPFGNAVHTALSFDLVGEDVLVSGAGPIGIMAAAVAKHVGARNVVITDVNEYRLELARKMGITRAVNVAKENLNDVMAELGMTEGFDVGLEMSGAPPAFRTMLDTMNHGGRIAMLGIPPSDMSIDWTKVIFKGLFIKGIYGREMFETWYKMAALIQSGLDLSPIITHRFSIDDFQKGFDAMRSGQSGKVILSWD

SEQ ID NO: 56086 - protein, 219 aa, Oryza sativa
  misc_feature (208)..(209): Xaa can be any naturally occurring amino acid
  unsure (1)..(219): unsure at all Xaa locations
MAEYKQKLYEIQRRPENRTCFDCNAPNPQWASVSHGIFICLDCSGVHRSFGVHISFVRSISMDKWFDDQLKKMDIGGNKNAKDFFESQPDYSPNMAPLQKYSSRFAALYREKLSAEAEGKSWTPSATSSPVAATPKRAATAATRSLGSQRSNNSSGRSSPAFGNNNYNGSSNGFGSNEPAGLVSEKEKNEQYFATLGQANSNRDASLXXNQGGKFTGFR

SEQ ID NO: 56087 - protein, 210 aa, Prochlorococcus marinus subsp. marinus str. CCMP1375
MNLQRQAEIHRVTNETEVSVRLGLDGSGRCKVSSGIAFLDHMLHQLSSHGLLDLELVAKGDTHIDDHHTNEDVGIALGQALSKALGNRKGIYRFGQFTAPLDEALVQVILDCSGRPHINYELEIPTQKIGTYDTELVREFFVALANNSGLTLHIRQLNGSNSHHIVEACFKAFAKSLRMAIEADPRRGGSIPSSKGVLEQAGDNNTEKSK

SEQ ID NO: 56088 - protein, 101 aa, Zea mays
  misc_feature (13)..(13): Xaa can be any naturally occurring amino acid
  misc_feature (23)..(23): Xaa can be any naturally occurring amino acid
  unsure (1)..(101): unsure at all Xaa locations
MVRMNGLADALKXSIYSAEYRGXRQVLIRPCSKVIVRFLTVMMKHGYIGEFESIDDHRAGKIVVNLTGRLNKCGVISPRFDVQLKDLEKWQNNLLASRQFG

SEQ ID NO: 56089 - protein, 160 aa, Wolbachia endosymbiont strain TRS of Brugia malayi
MLKKLAWYWSFVELIKGFIITLRYAFKPKVTLKYPMEKGPLSPRFRGEHALRRYSNGEERCIACKLCEVICPAQAIVIEAEEREDGSRRTTRYDIDMTKCIYCGLCQEACPVDAIVEGPNFEFATETREELMYNKEKLLRNGEIWEEAIALRLKKDVSYH

SEQ ID NO: 56090 - protein, 256 aa, Clostridium tetani E88
MKYTGLLGKNISYSQSPKIHNEYYEKNNIPFKYKIFDVNEDELFYFIDTLYRKNIVGFNVTIPYKTKILKYIEKLVYPADKIGAVNTVVVLKDKLIGFNTDYYGFTESLKRRNVELRDKNALIIGNGGSALCVYYALMDIGCKNLDVLCRNKDKNIEKLKEIRCFYDFYDIIKYEQYDIIINCTPLGGNNYIKNLPINLEKIKLKKDVIIYDLNYKTQDTIFINQAKSMNIMAINGEDMLRLQAYKAIDIWGIYIY

SEQ ID NO: 56091 - protein, 223 aa, Escherichia coli
IWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQEYRDQGKDPATLDYVVPFKVFEGNRPTNSILLREITPFSLGALIALYEHKIFTQGVILNIFTFDQWGVELGKQLANRILPELKDDKEISSHDSSTNGLINRY

SEQ ID NO: 56092 - protein, 476 aa, Burkholderia vietnamiensis G4
MSKEFDVVVIGAGPGGYIAAIRAAQLGKTVACIEKWKNPAGALKLGGTCLNVGCIPSKALLASSEEFENTSHHLADHGITVDGVKIDVAKMLGRKDAIVEKMTSGIEFLFKKNKITWLKGHGKFTGKTDAGVQIEVSGEGEAEVVTAKNVIIATGSKARHLPNIPVDNKIVSDNEGALRFDSVPKKLAVIGAGVIGLELGSVWRRLGADVTVLEALPAFLGAADEALAKEAAKLFKKQGLDIHLGVKIGDVKTTENGVSIAYTDKDGNAQTLDADRLIVSVGRVPNTDNLGLEAIGLKANERGFIDVDDHCRTAVPNVYAIGDVVRGPMLAHKAEDEGVLVAEVIDGQKPHIDYNCIPWVIYTYPEIAWVGKTEQQLKAEGREIKSGKFPFSINGRALGMNAPDGFVKMIADAKTDELLGVHVIGANASDLIAEAVVAMEFKAASEDIARICHPHPSMSEVMREAALAVDKRSLNS

SEQ ID NO: 56093 - protein, 292 aa, Photobacterium sp. SKA34
MFKGSMVALLTPLDSAGEVDYVGLKTLVDYHINAGTSAIIAVGTTGESATLTVDEHIKVVLKTLEYVDGRVPVIAGTGANATHEAITITKLFSGTGVAACLSVTPYYNKPTQEGLFQHYKAIAEATDIPQILYNVPGRTAVDLLPETVARLAKIDNIIGIKDATADLSRVKKTRELCGEDFIQLSGDDATAVDFVAEGGHGVISVTANIAAADMAQMFSLALSGQIDAAREINQRLMPLHSHLFVEANPIPVKWAAHQLGLIDNGELRLPLTVLSESQQPIVKQALLDAGVL

SEQ ID NO: 56094 - protein, 126 aa, Fragaria x ananassa
VEKIDICEIDKMVVDVSKQFFPRVAVGYEDPRVTLHIGDGVAFLKAVPAGTYDAVIVDSSDPIGPAQELFEKPFFQSVANALLPGGVVCTQAESIWLHMHIIEDIVSNCHQIFKGSVDYAWTTVPT

SEQ ID NO: 56095 - protein, 266 aa, Rhodopirellula baltica SH 1
MKRILITGATDGIGLETAKALVSRGHHVLIHGRNADKLKQVEQSLNSLSSEASIESHLADLSDINEVESLAGSVAAKHDHLDALINNAGVLSTSDPMTPDGLDVRFVVNTIAPYVLAKRLRSRMDSSGRIVNVSSAAQKPVDMAAFRGELQLDDLEAYSQSKLALTMWSRGLADKLGTDGPAIIAVNPGSLLSSKMVHQAFGVPGKDITIGANILVRAALDEEFADASGQYFNNDAGEFGTPHADALDAEKNAAIIDHLESVLATV

SEQ ID NO: 56096 - protein, 183 aa, Escherichia coli
DRNGNVVDYQTGPIIWGEPGTNGQHAFYQLIHQGTKMVPCDFIAPAITHNPLSDHHQKLLSNFFAQTEALAFGKSREVVEQEYRDQGKDPATLDYVVPFKVFEGNRPTNSILLREITPFSLGALIALYEHKIFTQGVILNIFTFDQWGVELGKQLANRILPELKDGKEISSHDSSTNGLINRY

SEQ ID NO: 56097 - protein, 1935 aa, Ustilago maydis 521
MSEPSQEDRDAGPSSSIAAPSPHVQATILEQDEQQEQEQEQEQEQVQEQEQEQEHEQVEHQQPSIINSHPESSLSSPSKRRGVSFSLHEPHDSIVEEPHQTDTDTAPTVEDSPTQQRIPAAGLGTRTQPRRAPRSSSSLRHVTTTRTRTTSLSQPLPEDRDLSNDPNYFDHPTTSLVARQVNVEKRRAERQRRQDAALLADSDDDQDDDDDLYASNSSADEAVEARRRRNAQAAASTDEYDYFSRSGSSYDQAKAKASIPPPSNRATLNWSSASASEDSDDWDGEPCLQLATASSLVERALGPPLDPTALPVDSGAGITATPGPSFPLDLHTPADPNEHETPILNPQHRMEWQSMLGSVLNSEVLKSETKRINSVDTPDLSRQELSYQRWLDIKATLRGRGMHRDATDEEEKRLKEGFGKMLKDLVQEIRDCRSHHIALADGSSLHASSASPVTTPSESAQVASPERDPSAQDASRGFEPEKADSDAEAAVLAEKNKVLAEIGQLLERIDSAEEQFPSTKRAIEIVPEWGDADVQAKLAAIYSWYNTTTSLRLQISILRKWTGSESLELTSHNARDYDTQLKKGESQSHNHRDQQSTARAAADDDSTFVERIQKEGSLQSTFEKRTLASLYQLITKAKETILKYHKEFKRMALPPFEPELITLISFPTRLMQGALRLRLDYAGKLAEPSVLIVDSLTDDLRTALAMACRVKLHYTSIIVADPERGWDLSPCIAEGYDDVLRSALKFFFKLLRLKLKASVYFKETEILEPEWRFLSTAVESIEGGDIIVAINITRFVNKLFDRIARYFNRELTATIAHQDPHARRLPNPASGPVGLAKSDPPPTAGRAGQEKNFITLEDRAKWIHSVFDNVRIRSRKLLGFARDIRNRLDNAAEYDLGNLRPSSDYLDADDRSVAEYSDVANNGGMSLSSFMQTLIDHDYFLVYTEALEENGIYLVAEPSLQDKPDLIQELVCKCLHRVRPGEEGSAMAAEATTTALNAEGDDGDDATGIAGVGNANTLREQIEKQPGANASTVGANAPGTGDDADDDRPRYILLLSPRDPFMWTGKVMHHIMPRVDIALADRRVRLIADGAKGRLELAKRHFQRIFDNTGNGEDVDDGSEDGQAGFPLETLNDQMAHMSRVQSGLEEINKGVYMLSDTIIRKVPEIRRRLRGLGVRARGQSGTPRSTTTDTAAGAFGVSCDELIQNCYSMAAEHGRRALPFIESARLRDQMTLALGRLAIDWIAFICDDCVPSERKTFKWAVTALGNANHITSNENIFRLNEQDFALLRAKVASCMALLISHFDILGARSSVAKAQEEQERLEREKAERNRITIGGTDAVQNVSEDFQHLRVQSNGDSASLLERTKPALVGPGIGAQNLFNKLDTAMQSTEERWISKVLEWDAARHELDLEQRLIGRVLDDTRLEDRNLQFLAQSASKITIRWQQGQFIGGGTFGTVYLAVNLDSGGLMAVKEIRFQDISSTPSLYQQIKDEMEVMSMLSHPNIVEYYGIEVHRDRVYIFEEYCQGGSLAALLEHGRIEDETVIQVYTLQMLEGLIYLHSQGIIHRDIKPDNILLDHMGVLKYVDFGAAKILAKNSRTIQRSRKTGGLGNIGMVAQGMEGGKQGGPAGAMASLQGTPMYMSPEVIKGTPDVPHAAADIWSLGCVVLEFATGKRPWSNFDNEWAIMFHIGMAEQHPALPDANQLSPMGIEFIRQCLTINARQRPTAAQLKEDPWMRSLIEELDAANEAEAAAELAGVSPAGDVYDGLDSSSSGSSVTNSLDGVHGVAGGDQALFKSLDRNVSSLNSARSRWSSEAGARTSSSGTSMTTLYNPSMSLKASLGFRQQQQMREQQLQQPPKSHQELGERDECETRPEQPMHVDQNSDADHRPLHVPGHPNHSHPGSSAIVADLQYHKENVQRQAMLRHDSSLSTLPDES

SEQ ID NO: 56098 - protein, 223 aa, Klebsiella oxytoca
IWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSREVVEQEYRDQGKDPATLEHVVPFKVFEGNRPTNSILLREITPFSLGALIALYEHKIFTQGVIMNIFTFDQWGVELGKQLANRILPELKDGSEVSSHDSSTNGLINRY

SEQ ID NO: 56099 - protein, 448 aa, Psychrobacter arcticus 273-4
MSISQAIEKIEARYAHQPEFIQAVKEVAITIAPLYDSHPEYDTFKVFERLVEPDRVIAFRINWENDKGEVQVNRGWRVQFSNALGPYKGGIRFHPTVNQSVLKFLGFEQIFKNALTGLPMGGAKGGSDFDPKGKSDNEIRRFCYAFMRELHPYINKDTDVPAGDIGVGGREISYMFAMYKNLTREYGGVLTGKGVGFGGSLMRTEATGYGAVYFLENMLTAQNEHIAGKRVLISGAGNVSLHAAEKVHMLGGVVVTVSDSQGTLYDEKGLNQEKINWLKEQKAKSQPLADYVAVYGGEWFAGQKPWHIKGDIAIPSATQNEVNEGDAKLMVENGIKYVVEGANMPLTAEAIDHIRLHRVHYAPGKAANAGGVAVSGLEMSQNSVRQYKSFEQIDARLKCIMKNIHDSAAEASGKYHQTDKGYIDYMTGANIVGFERVADALVAYGILN

SEQ ID NO: 56100 - protein, 156 aa, Nicotiana glutinosa
MAEVEYRCFVGGLAWATTDQTLGDAFSQYGEILDSKIINDRETGRSRGFGFVTFKDEQAMRDAIEGMNGQDLDGRNITVNEAQSRGSGGGGGGYRGGRGGGGGGYGGGGRREGGYGGGGGGYGGGRREGGYGGGGGYGGGRREGGYGGGSEGNWRN

SEQ ID NO: 56101 - protein, 376 aa, Psychrobacter arcticus 273-4
MSDKFIKSKAAIAWGPNQPLSIEEVDVMLPRKGEVLVKIIASGVCHTDAFTLSGEDPEGVFPAILGHEGGGIVEQIGEGVTSVQVGDHVIPLYTAECGECKFCTSGKTNLCSAVRETQGKGLMPDGTTRFYKDGQPIYHYMGCSTFSEYTVLPEISLAKVSKEAPLEKVCLLGCGVTTGMGAVMNTAKVEEGATVAVFGLGGIGLAAVIGAKMAKASRIIGVDINEDKFELAKKLGATDCINSKDYDKPIQEVIVEMTDGGVDYSFECIGNVDVMRSALECCHKGWGESVIIGVAGAGKEISTRPFQLVTGRVWKGSAFGGVKGRTELPGYVERYLEGEIPLNDFITHTMPLENINEAFDLMHKGESIRTVIHFDM

SEQ ID NO: 56102 - protein, 474 aa, Nocardioides sp. JS614
MFQNSDELLKYVKDEGVEMIDVRFCDLPGIMQHFTVPVSSFDQSVFDDGLGFDGSSIRGFQAIHESDMSLFPDPTTAYLDPFRTAKTLVVNFFIHDPLTGEAYSRDPRNIARKAMAYLGTTGIGDKAYFAPEAEFYVFDNVRFETKANAGYYEIDSSAGAWNTGAAFENDNRGYKVKYKGGYFPVAPTDHFGELRDEMVIELERAGLQVERAHHEVGTAGQAEINYRFDELLKAADDVMKFKYIIKNVAWRNGKTATFMPKPIFGDNGSGMHCHQSIWNAGEPLFYDETGYGGLSDTARWYIGGLLKHAPSLLAFTNPTVNSYHRLVPGFEAPVSLVYSQRNRSACVRIPITGSNPKAKRIEFRCPDPSANPYLAFSALLLAGLDGIKNKIEPAAPIDKDIYELPPDEMADIEQVPASLDAVLNNLETDHEFLTAGNVFTSDLIETWIDYKRQNEILPVQQRPHPHEFELYYDI

SEQ ID NO: 56103 - protein, 377 aa, Candida albicans
MSADGEFTRTQIFGTVFEITNRYTELNPVGMGAFGLVCSAVDRLTGQNVAVKKVMKPFSTSVLAKRTYRELKLLKHLKHENLITLDDIFISPLEDIYFVNELQGTDLHRLLNSRPLEKQFIQYFTYQIMRGLKYIHSAGVIHRDLKPSNILINENCDLKICDFGLARLQDPQMTGYVSTRYYRAPEIMLTWQKYDTEVDLWSVGCILAEMIEGKPLFPGKDHVHQFSIITELLGSPPADVIDTICSENTLRFVQSLPHRDPIPFSERFASCTHVEPEAIDLLAKLLVFDPKKRISAVQGLTHPYMEAYHDPTDEPVCESKFDWSFNDADLPVDTWRVMMYSEILDFHQTVGVANETEGSEQPDSQVEQNNLDSANGA

SEQ ID NO: 56104 - protein, 256 aa, Pseudomonas aeruginosa PAO1
MDSHSPIATVAQALRRAERILVITGAGLSADSGMPTYRGLGGLYNGRTEEGLPIEAALSGPMLRRDPALCWKYLAELGKACLAARPNAGHEAIAELQKHKPECWVLTQNIDGFHRQAGSPAERLIEIHGELAPLYCQSCGAESGGLEEHLHGQLPPRCAACGGVLRPPVVLFEEMLPEEAIDTLYRELRKGFDAVLVVGTTASFPYIVEPVLRTRQAGGFTAEVNPGVTDLSERVDVKMTGRALDIMPQVVSHIYR

SEQ ID NO: 56105 - protein, 612 aa, Arabidopsis thaliana
MDFFTSSKAKKDSKKSSGLFGKKTVSKSTPGSPAHPPGARSPPPSYLSNKRAETEYDFPMSNEQRPYWKQPASERVPNSHPRPPVYGYGTPDHRRDHGRERMEAMSYEPETNAPSSPYHPAGNRTPERPRKSTEYRREHQDRMYEADTRSNASPFHPFRSPSPSPFHTPDRRRDHYDMYEPEANTMLQNSAPGSPFHPAGSRSPPPYRTPDRRSNYDKEQFEDLYEQDGDVTPRNSSPPSPFHPAAYKTSDQRSNHGKEQIEDFYEQDDDVTPRNSSPPSPLHPAASHSPPPPQPYRTPDHRRSHQDNEDFEAMYELDGDLIHQKSAPPSPVHGPYYSSSDDDNHSTYLYPEIRSPLRSRIVSESSTPVHHNYQIVAAETYEQDKQFEPPELPDESQSFTMQEITKMRGLKNYESGKEESQSMISEAYVSVANYRVRQSVSETLQAIIDKHGDIAASSKLQAMATRSYYLESLAAVVMELKKTVLRDLTKTRVAEIAAVVKDMESVKINVSWLKTAVTELAEAVEYFGQYDTAKVEKEVCERDLTAKKGEMEEMTAELVKREKEIKECREKVTVVAGRLGQLEMKGSKLNKNLDLFQSKVHKFQGEAVLLHL

SEQ ID NO: 56106 - protein, 284 aa, Oryza sativa (japonica cultivar-group)
MRAVSMAATHRRHRRTDGRLQHNTVTVTEEAGATIPAANMLAAAASVKLSTAGTATAPKMALFKPLHLPPLFAAAAAAAGPRPLSLSARPLYRQQDPLFLASRVASPAPPPPSATADGARPVEAAPAGAAPEEAARRAKIGVYFATWWALNVIFNIYNKKVLNAFPYPWLTSTLSLAAGSAIMLASWATRIAEAPATDLDFWKALSPVAIAHTIGHVAATVSMAKVAVSFTHIIKSGEPAFSVLVSRFFLGEHFPAPVYFSLLPIIGGCALAAITELNFNMIGE

SEQ ID NO: 56107 - protein, 285 aa, Arabidopsis thaliana
  misc_feature (230)..(230): Xaa can be any naturally occurring amino acid
  unsure (1)..(285): unsure at all Xaa locations
RPRANSARGIIISIYSKKKQKKMNSCQQKAMEKLLHGHGCANQLLIMDQTESDSSMEREDLAKSVLHCFSDALSILIDTNDHQDDQSNNSSPQDSSPVLESSRKPLHKRGRKTSMAESSDYHRHESSTPIYHDGFLWRKYGQKQIKESEYQRSYYKCAYTKDQNCEAKKQVQKIQHNPPLYSTTYLGQHICQLHQAYATFPIDTSDFEEHEGSHMIRFGHPNISFSSSTXNLRQHQNHQDRIKDEYMKPVIAEDWSPSQWMSSEVALAVEAFEFNPFWASHDLSS

SEQ ID NO: 56108 - protein, 181 aa, Prochlorococcus marinus subsp. marinus str. CCMP1375
MNEELDKKITEETNQEVLEPQRGPISELLCKEGLEHTVNEVDHIGIEIISVKPEFLLDIIVSLKNNGFNYLECQGGYDEGPGLNIVCFYHLIAIENYKDSDKPREVRVKVFLNRDGDLKVPSLYKIFRGSDWQERETYDMFGVNFVDHPHPKRLLMPEDWKGWPLRKDYIQPDFYEMQDAY

SEQ ID NO: 56109 - protein, 652 aa, Brucella abortus
MDAVEKANSGHPGLADGRSRYSDDALYPFPLARARKNPHLGRTRDRFRAFPAGQRLDAALFRCSIFAGYEDITIDEIKKFRQLGSAPRATLNMAMPLASKRRPARSDRVLPMPSAWRISERILEWPSSVTSLQSIHYTYALVGDGCLMEGISQEAIALAGHLKLNKLIVLWDDNNISIDGPITLSDNTDQPARFAASGWNTMAVDGHDQDAIAKAIVTGPVSDRPTLIACKTTIGFGAPNKAGTNKVHGSTLGAEEIAATARALGLSSEPFVVPAEFLNAWRVAGGFNAAKKRLEWEKRLSSVEAETRAEFERRMRGELPSGFDAAIVEYKKKLSADKPKVATRKSSEMALEVINGVVPETVGGSADLTGSNNTKTSQTKAVTPENYDGRYIHYGIRELGMAAAMNGITLEWRPDPLFRHLLVFSDYGVRPMRLSSLMGIRVVYVMTHDSIGLGEDGPTHQPVEHLAALRAIPNHNVFRPADAVETAECWQLALHSRKTPSTLALTRQNLPTVRTEHREENLCAFGAYELAAASSDAKVTIFATGSEVEIALKARDLLEGKGIATRVVSVPCFELFEQQSDAYKEATIGDAPVKLAIEAAISLGWERFIGGNGIFIGMKGFGASGEINDLYKHFGITAEHAVEAAEKKLNAA

SEQ ID NO: 56110 - protein, 227 aa, Streptococcus pneumoniae TIGR4
MENLKKMAGITAAEFIKDGMVVGLGTGSTAYYFVEEIGRRIKEEGLQITAVTTSSVTSKQAEGLNIPLKSIDQVDFVDVTVDGADEVDSQFNGIKGGGGALLMEKVVATPSKEYIWVVDESKLVEKLGAFKLPVEVVQYGAEQVFRHFERAGYKPSFREKDGQRFVTDMQNFIIDLALDVIENPIAFGQELDHVVGVVEHGLFNQMVDKVIVAGRDGVQISTSKKGK

SEQ ID NO: 56111 - protein, 198 aa, Klebsiella oxytoca
AYFQQGNMESNGKYVDRNGNAVDYQTGPIIWGEPGTNGQHAFYQLIHQGTKMVPCDFIAPAITHNPLSDHHPKLLSNFFAQTEALAFGKSREVVEQEYRDQGKDPATLEHVVPFKVFEGNRPTNSILLREITPFSLGALIALYEHKIFTQGVIMNIFTFDQWGVELGKQLANRILPELKGGSEVSSHDSSTNGLINRY

SEQ ID NO: 56112 - protein, 223 aa, Klebsiella pneumoniae
IWYNNFFGAETEAILPYDQYMHRFAAYFQQGNMESNGKYVDRNGHAVDYQTGPIIWGEPGTNGQHAFYQLIHQGTKMVPCDFIAPAITHNPLSDHHQKLLSNFFAQTEALAFGKSREVVEQEYRDQGKDPATLEHVVPFKVFEGNRPTNSILLREITPFSLGALIALYEHKIFTQGAILNIFTFDQWGVELGKQLANRILPELKDGSEVSSHDSSTNGLINRY

SEQ ID NO: 56113 - protein, 223 aa, Klebsiella pneumoniae
IWYNNFFGAETEAILPYDQYMHRFAAYFQQGNMESNGKYVDRNGHAVDYQTGPIIWGEPGTNGQHAFYQLIHQGTKMVPCDFIAPAITHNPLSDHHPKLLSNFFAQTEALAFGKSREVVEQEYRDQGKDPATLEHVVPFKVFEGNRPTNSILLREITPFSLGALIALYEHKIFTQGAILNIFTFDQWGVELGKQLANRILPELKDGSEVSSHDSSTNGLINRY

SEQ ID NO: 56114 - protein, 280 aa, Burkholderia vietnamiensis G4
MLEDGSLDLPAFRKLIDWHIEEGTDALVVVGTSGESATLNVEEHVLMIRTAVEHAAKRIPIIAGAGGNSTAEAIELTKQAKAVGADATLQVVPYYNKPTQEGMYRHFKAIAEAVDLPVILYNVPGRTVADMAHDTTLRLAQVPGIIGIKEATGNIDRAAHLIKAAPKDFAIYSGDDPTAIALMLLGGHGNISVTANVAPRAMSDLCRAALAGDVATARTLHMKLLSLHKNLFIEANPIPVKWALQAMGKMQGGIRLPLTPLDERCHDAVRSALVEAGILA

SEQ ID NO: 56115 - protein, 513 aa, Arabidopsis thaliana
MAGGSFGPTGVAKERAEQYQGKVTSYVIIACLVAAIGGSIFGYDIGISGGVTSMDEFLEEFFHTVYEKKKQAHESNYCKYDNQGLAAFTSSLYLAGLVSTLVASPITRNYGRRASIVCGGISFLIGSGLNAGAVNLAMLLAGRIMLGVGIGFGNQAVPLYLSEVAPTHLRGGLNMMFQLATTIGIFTANMVNYGTQQLKPWGWRLSLGLAAFPALLMTLGGYFLPETPNSLVERGLTERGRRVLVKLRGTENVNAELQDMVDASELANSIKHPFRNILQKRHRPQLVMAICMPMFQILTGINSILFYAPVLFQTMGFGGNASLYSSALTGAVLVLSTFISIGLVDRLGRRALLITGGIQMIICQVIVAVILGVKFGDNQELSKGYSVIVVIFICLFVVAFGWSWGPLGWTIPSEIFPLETRSAGQSITVAVNLLFTFIIAQAFLGLLCAFKFGIFLFFAGWVTVMTIFVYFLLPETKGVPIEEMTLLWSKHWFWKKVLPDATNLEDESKNVSV

SEQ ID NO: 56116 - protein, 275 aa, Oryza sativa (japonica cultivar-group)
YNKKVLNAFPYPWLTSTLSLAAGSAIMLASWATRIAEAPATDLDFWKALSPVAIAHTIGHVAATVSMAKVAVSFTHIIKSGEPAFSVLVSRFFLGEHFPAPVYFSLLPIIGGCALAAITELNFNMIGFMGAMISNLAFVFRNIFSKKGMKGKSVSGMNYYACLSMLSLVILLPFAFAMEGPKVWAAGWQKAVAEIGPNFVWWVAAQSVFYHLYNQVSYMSLDEISPLTFSIGNTMKRISVIVASIIIFHTPVQPINALGAAIAILGTFIYSQAKQ

SEQ ID NO: 56117 - protein, 597 aa, Nocardioides sp. JS614
MATEVNLPALGESVTEGTVTRWLKQVGDSVAVDEPLLEVSTDKVDTEIPSPIAGTLLEIRANEDDTVEVGAVLAVIGDAGESSGDSGGAQAEAQPDPEPEPEAQPEPEPAQEQAQQEAQQPAAEQPAPAAEAKPSGGSGTAVTLPALGESVTEGTVTRWLKSVGDEVAVDEPLLEVSTDKVDTEIPSPVAGTLLEIKVAEDETVEVGAELAVIGSGQAAPAESKPEPTPEPEPEPTPEPEPEPEAAPEPEPAPAPQEQAAPPAPAPAAAAQPTAQPAAQPVASGDGPGYVTPLVRKMAAQHGVDLASVTGTGVGGRIRKQDVLDAAKAQQQAQQQAQQPAQAAPAAPAAPSAPVSSGAPSPLRGTTVKMSRLRKIIATRMVDSLQTSAQLTQVVEVDVTNIARLRDEAKADFLSREGVKLSYLPFFAKAAIDALKHHPALNATIDTEAGEVTYYDRENLAIAVDTEKGLITPVIKDAGDLSIAGLAKKIADVAQRTRTNKIGPDELSGGTFTITNLGSVGALWDTPIVNKPQVAILGPGAVVKRPVVIDDPNLGETIAVRYMVYLALTYDHQLVDGADAGRFLTDVKQRLESGQFEV

SEQ ID NO: 56118 - protein, 432 aa, Leptospira interrogans serovar Lai str. 56601 [sequence omitted]

SEQ ID NO: 56119 - protein, 459 aa, Nocardioides sp. JS614
MADADFDVLILGAGSGGYACALRSAQLGLSVGLVEKSHLGGTCLHIGCIPTKALLHAAEVADQAREAETFGVRATLEGIDMAGVNAYKDGVVSRLFKGLTGLIKGRGITVIEGAGRLTGPRTVTVGETAYTGKHVVLASGSYARTLPGLEIDGERVITSDHALRLDRVPASVVVLGGGVIGCEFASVWRSFGADVTIVEALPRLVAVEDEASSKALERAFRKRGIVFRTGTPFQSVKHTDTGVAVTVEGGDVIEADLLLVAVGRGPVTEGLGYDEQGVTMDRGFVLTDERCRTNLDGVYAVGDIVPGPQLAHRGFQQGIFVAEDIAGLDPSPIDEAGIPRVTYSHPEVASVGLDEARAAETYGADGIETLTYDLGGNGKSQILKTQGFVKLIRRKDGPVVGVHMVGDRVGELIGEAQMIYNWEGYPEDVAPLVHAHPTQNEALGEAHLALAGKPLHAHS

SEQ ID NO: 56120 - protein, 306 aa, Zea mays
HASGSARLSAGGRSLLELYKPPASAILTYHNGAVLQGRIPVSIIWYGRFTPAQKAVVTDFLGSLTTAAASPLAPSPSVSQWWSTIDQLYLSKARGRGSGGGGGGARVALVGQATDEGCSLGKRLTLAQLPQLAARAGPRKGGIALVLTAQAVGVDGFCTSRCGLHGSDARAPGTAYVWVGNSATQCPGQCAWPFHRPLYGPQTPALVPPSGDVGADGMVINIASMVAGAVTNPFRDGFYQGDKDAPLEAATACTGVYGSGAYPGFAGNLAVDPATGASYNANGANGRKYLLPALFDPATSTCSTLV

SEQ ID NO: 56121 - protein, 473 aa, Bacillus thuringiensis serovar konkukian str. 97-27
MQQPTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVITILAFVVLGGSALLGFISYDGKEAAPLFSNFVSEGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPTSFQKVNKRGIPITALVVTIAVAGLSLFTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYINKKRQKPMKVETTNETNNQTR

SEQ ID NO: 56122 - protein, 906 aa, Bacteroides fragilis NCTC 9343
MDKKRVYTFGNGLAEGKAGMRNLLGGKGANLAEMNLIGVPVPPGFTITTDVCTEYYEMGQEKVVSLLKEEVEKAIANIENLMRSKFGDVENPLLVSVRSGARASMPGMMDTILNLGLNDEVVEGLTRKTGNARFAWDSYRRFVQMYGDVVLGMKPVNKEDQDPFEAIIEEVKHAKGVKLDNELEVEDLKELVKKFKAAVKAQTGKDFPTCAYEQLWGAICAVFNSWMNERAILYRKMEGIPDEWGTAVSVQAMVFGNMGDTSATGVCFSRDAATGEDLFNGEYLINAQGEDVVAGIRTPQQITKIGSQRWAQLAGVSEEERASKYPSMEEAMPEIYKQLDELQTKLENHYKDMQDMEFTVQEGKLWFLQTRNGKRTGAAMVKIAMDLFRQGMIDEKTALMRVEPNKLDELLHPVFDKSALKQAKVLTRGLPASPGAATGQIVFFADDAAEWHAAGKRVVMVRIETSPEDLAGMAVAEGILTARGGMTSHAAVVARGMGKCCVSGAGALNIDYKARTVEVDGVLLKEGDFISLNGSTGEVYQGKVETKAAELSGDFADLMKLADKYTRLQVRTNADTPHDAEVARNFGAVGIGLCRTEHMFFEGEKIKAMREMILAENAEGRRKALAKILPYQQADFKGIFKAMAGCPVTVRLLDPPLHEFVPHDLKGQQEMADTMGVSLQYIQQRVESLCEHNPMLGHRGCRLGNTYPEITQMQTRAILGAALELKKEGIETHPEIMVPLTGILYEFQQQESVIRAEADKLFEEVGDRIDFKVGTMIEIPRAALTADRIASSAEFFSFGTNDLTQMTFGYSRDDIASFLPVYLEKKILKVDPFQVLDQNGVGQLVRMATEKGRAIRPDLKCGICGEHGGEPSSVKFCHKVGLNYVSCSPFRVPIARLAAAQAAIEE

SEQ ID NO: 56123 - protein, 243 aa, Carboxydothermus hydrogenoformans Z-2901
MASFLASLLTGLATGLGSFLLLFKKEFPKSTIGVLLGFAAGIMLAASFFSLLLPALETGGIFLTALGFLTGSLFVYFLDRLIPHFHPASGTEGPKSDLNKIWLFILAITIHNFPEGMAVGIGFLEKDITKALSLALGIGLQNIPEGLSVAVSLLGFSFSTWKIIGITFLTGLAEPVGGVIGAFLGSLSGSILPFALSLAAGAMIYVISDEIIPETHAKGGESLATFGVIFGFLLMMVFDNLSF

SEQ ID NO: 56124 - protein, 291 aa, Arabidopsis halleri subsp. gemmifera
MTNNFQRALGEGGFGIVYHGHLNDSEEVAVKVELLLRVHHTNLVSLVGYCDERGHLALIYEYMSNVDLKHHLSGKHDVSILKWSTRLRIAIDAALGLEYLHIGCRPSMVYRDVKSTNILLDERFTAKIADFGLSRSFQLGDESHISTVVAGTPGYLDPETGRLAEMSDVYSFGIVLLEMMTNQRVIDQNREKRHITEWVALVLNRGDITKIMDPNLYGDYNSNSVWKALELAMSCANSSSEKRPSMSQVISVLKECLTSENLMRNKNHDMESDSSLELTKSFDTEVVPRAR

SEQ ID NO: 56125 - protein, 129 aa, Arabidopsis thaliana
MLDADVTDSVIGEGCVIKNCKIHHSVVGLRSCISEGAIIEDSLLMGADYYETATEKSLLSAKGSVPIGIGKNSHIKRAIIDKNARIGDNVKIINSDNVQEAARETDGYFIKSGIVTVIKDALIPTGTVI

SEQ ID NO: 56126 - protein, 119 aa, Zea mays
DNSFHTQPFRIKYARQDIYLSVMVSFNIFNSEEEGPAASDVMMKFELIYAPTLDNGSRSELHASSATSSAAVHEFRIPHRALLGLHSYCPVHFDAFHSVLVDLTLHIVYLKARVATLPK

SEQ ID NO: 56127 - protein, 223 aa, Citrobacter freundii
IWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSREVVEQEYRDQGKDPATLDHVVPFKVFEGNRPTNSILLREITPFSLGALIALYEHKIFTQGAILNIFTFDQWGVELGKQLANRILPELNDDKEITSHDCSTNGLINRY

SEQ ID NO: 56128 - protein, 396 aa, Legionella pneumophila str. Paris
MNLIKMSDIDLSGKRVLIREDLNVPIKDGMITSDQRLQAALPTIKSALDNGAAVIVLSHLGRPEEGKYEKKFSLEPVADYLRKNLEYPVRFVKDYLSGVDVKPGELVVCENVRFNPGEKANDEALAKKLANLCDVFVMDAFGTAHRAQASTYGVAQYAPVAVAGPLLIRELEALNQVLKAPKKPIVAIVGGAKVSSKLSLLKQLVGMVDVLIPGGGIANTFLKAQGFEIGISLYEPDLLDEARHILILAKEKGCQIPLPTDVVVGKTFSETCPAFNKSLSNVAEDDMILDIGPETIRDYVDLIHEANTIIWNGPVGVFEFPQFAYGTRAIAIAIAESDAFSIAGGGDTLAAVDLYDLNQQISYISTGGGAFLECLEGKTLPAVAILQERAKHVKTN

SEQ ID NO: 56129 - protein, 330 aa, Legionella pneumophila str. Paris
MTIRVAINGYGRIGRCILRSIFEYNRQNEFEVVAINDLSGIDVTAHLTRYDSTHGPFRSDVSIEGNMLIVDGHGIQVIAERDPAKLPWKQLDIDIVFECTGFFTSRDAAMGHINAGAKKVLISAPAKGVDTTVVYGVNHSVIKASDVIVSNASCTTNCLAPVVKVLNDAIGIESGLVNTVHAYTKDQMLLDGSHKDLRRARSATQSIIPTKTGAAAAVGLVLPELAGKLDGFAMRVPVLNVSVVDLTFQAKRATSVEEVNDIMRKAKSRILQINEDPLVSCDFNHNPASAIFDTTETKVIGSLVKVVAWYDNEWGFSNRMIDTAHQMMNC

SEQ ID NO: 56130 - protein, 668 aa, Legionella pneumophila str. Paris
MNSFTELANAVRMLSIDAVNQAQSGHPGMPLGMADIATVLWKKFLKFNPKNPHWFNRDRFVLSNGHGSMLLYSLLHLTGYNLDINELKNFRQLHSKTPGHPEHGHTPGVETTTGPLGQGLANSVGMALAERVLASHFNHDHYNLVDHYTYTFAGDGCLMEGISHEACSLAGTLGLGKLIVFYDDNGISIDGKVESWFTDDTTSRFKAYNWQVIGPIDGHDADQIEQAISAARENTTQPSLIICKTVIGLGSSVAGSEKAHGSPLSAQDINNVREFFNWKHAPFEIPDSIYKQWDHREQGDKEEQQWLQLLHEYRLQYPSEHDEFLRRANGDLPDDWQEISAGFLKQCLNNEKAIATRKASQQCIEFFAPILPEMFGGSADLTGSNNTDWSGSKAITAHNFSGNYLYYGVREFAMAAIMNGLAVHGGFIPYGGTFLVFADYARNAIRLSALMKQRVIYVLTHDSIGLGEDGPTHQPIEHIAMLRMTPGMTVWRPADLMETAVAWQQSLEHHNGPSALLLSRQNLPALAHGTDAADLIKKGGYIIADCEGKPDAILIATGSEVQLAITAAEKAKARGLQVRVVSMPCAERFLAQSDAYKNQVLPGQVRTRIAIEAASSAYWHQFVGFDGAVIGLDCFGVSAPATDAFNYLGITVEKIINTLDTLTKQTMV

SEQ ID NO: 56131 - protein, 223 aa, Citrobacter freundii
IWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSREVVEQEYRDQGKDPATLEHVVPFKVFEGNRPTNSILLREITPFSLGALIALYEHKIFTQGAILNIFTFDQWGVELGKQLANRILPELNDDKEITSHDCSTNGLINRY

SEQ ID NO: 56132 - protein, 581 aa, Silene latifolia
MDRLLKAARTSGSLNLSNRSLRDVPIEVYKNFDGAPEGENWWETVDLQKLILAHNNIEVLKEDLKNLPLLTVLNVSHNKLTQLPAAIGELPSLKSLDVSFNLLTNIPAEIGSATSLVKMDCSNNQLKELPSSLGQCLDLAELKASNNLIGSLPDDLAYCTKLLKVDIEGNKLTTLLDPVVGSWSMLSELNASKNLLTGLPETIGTLVRLIRLDLHQNRIKSIPSSIKGCSSLVEFFIGSNLLSSLPSELGELSQLSVLDLRSNQLTEYPAEACKLRLSVLDLSNNSLSGLPAEIGLMTSLRKLVLIGNPMRTIRSTLVTGPTAALLKYLRGRLPSAEEAQVMTPSKDNMVAMASRLSITTKELSLVGMGLIAVPPEVCESNEITKVDLSKNSIQELPVTLSACSSLEVLILSRNKIKDWPEDALKSLPNLTCLRLDNNPLNKVPLNGFDAVPRLQILDLSGCVSSLVDNPAFASLQHLVELYLRRVKLQEVPSDILMLRKLQILDLSQNSLHSIPQGFQNLTSLTELDLSDNSIGTLPPELGLLEPSLQALRLDGNPLRSIRRTILDRGTKAVLQYLKDKI

SEQ ID NO: 56133 - protein, 214 aa, Enterobacter cloacae
IWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSRDVVEQEYRDQGKDPATLDHVVPFKVFEGNRPTNSILLREITPFSLGALIALYEHKIFTQGAILNIFTFDQWGVELGKQLANRILPELGDDNAINSHDS

SEQ ID NO: 56134 - protein, 330 aa, Rhodopirellula baltica SH 1
MTHTDQSVAPAASPEAESQARDAVSEVEPYEFTEIAMPIIAMHVLALFAFIPEFITGTNVLLLMISLVVFSNGITLGYHRLLTHKSLRVPKWLEYGYVGLALCCLQESPAKWVSTHRRHHSHSDEPDDPHSPTASFWWSHVGWLLWKRKGQHEFRTDDRYCADIIADPFYALMEKYPDLPAGIYILHAGVIWLLASALFLVDNSFVSAVWQGAGLVLWCVVLRTVMIWHFSWSVNSLTHCFGYQNHKTSDQSRNNWLVAIVSNGEGWHNNHHHDPASASVQHKWWEFDATYLQIRVLKRLGLATHVIEPRQFRKGSVEPDNPSRLNKQTG

SEQ ID NO: 56135 - protein, 209 aa, Klebsiella oxytoca
IWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSREVVEQEYRDQGKDPATLEHVVPFKVFEGNRPTNSILLREITPFSLGALIALYEHKIFTQGVIMNIFTFDQWGVELGKQLANRILPELKDGSEV

SEQ ID NO: 56136 - protein, 221 aa, Triticum aestivum
  misc_feature (62)..(62): Xaa can be any naturally occurring amino acid
  unsure (1)..(221): unsure at all Xaa locations
MDVERSSSDAARDTPSSSSSQADLKTVKTRRRLPGRPKSFVPAVCVLAATVLTVVVFSADSXWSFVQDAPPSDLTADQLLDGLLTAEFSKRSCRSRYEFASYHEKKKNASHKPSPYLLGKLRRHEALQKRCGPGTAPYRAAVWQLKSGKGAAATDCRYLVSISYRGLGNRMLATASAFLYAVLTDRVLLVHQYKHDVDALFCEPFPGTTWLLPSGWSFPLG

SEQ ID NO: 56137 - protein, 375 aa, Zea mays
IRTLFFRLAPRHLPVSHGLLPPLTLGPNALLRVRTRLRLRLLSLPFHLLLLPPLNLADRLRPPTSEALVAAGTALPARRSSAPSVPGFLDAPTAPMDAPAPAVEIREVWASNLEEEFEVIRDVVDAYPYVGMDTEFPGFVVQPIAEYRFTCDRIYAGLEGNVNVLKLIQLGLTFSNEAGTLPPCGTGGQCCIWQFNFRGFNPHTDPYSPDSIDLLRRSGIDFDLFAVEGVDSTRFAELMMSSGIVLNDDVQWVTFHGSHDFGYLLRLLTGREMPNTLDEFLKLTKIFFPVMYDVKHLMKFCGPGLYGGLSRLGKLLKVERVGTGHQAGSDCLLTLQCFMKLKQLYLKESVKLYDGLLFGLIPGEVEIKTAPPPIG

SEQ ID NO: 56138 - protein, 451 aa, Psychrobacter arcticus 273-4
MTKHYDYIAIGGGSGGIASINRAASYGKKCAIIEANQLGGTCVNLGCVPKKVMWYGAQVAEAIHKYAPDYGFDVEFKGFDFQKLVNSRQQYIENIHRSYDNNLAKNGVEVIKGFAKFVDTNTVEVNGELITADHILIATGGHPIRPDIKGTEHGIDSDGFFALNELPKRVAIVGAGYIAVEIAGVLNSLGAEVHQYVRQHSPLRSFDHSIVETLLIEMEQDGIQLHTNTTLTEVVKNDDGSLTLCTESGSLDTVDCLIWAIGRAPSTDNINLQVTGVETTEFGKIKVDKFQNTNVKGIYAVGDIIENSVDLTPVAIAAGRRLSERLFNNKPDEHLNYELIPTVVFTHPAIGTIGLSEIDAVNQFGKDNIKCYSSTFTPMYSAVTQHRQKCMMKLVCLGDDEKVIGLHGIGFGIDEMIQGFAVAIKMGATKADFDNTIAIHPTGAEEFVTMR

SEQ ID NO: 56139 - protein, 298 aa, Nocardioides sp. JS614
MTSAPAAPFGRVLTAMATAFHDDGSVDLEGTARIAAYLVDHGHDGVVVSGTTGESPTTTTAEDGAILAAVKDAVGGRAVVVAGVGTNSTAHSVELAEQAAKLGADGLLLVTPYYNKPGQAGVLHHFTAVAEASDVPVMLYDVPGRTGTQIALETYEAAIRLETVVAVKDAVGDFTRGVKIMQLGYALYSGDDANNLGWLAHGAAGFVSVVGHAAGEQFKAMADTFQAGDHAGALEIFTRLLPAIDAVMGVPNYGATTAKAALQLLGVLDNRNVRAPLVPLDDDEVAALRAGLAASGLL

SEQ ID NO: 56140 - protein, 298 aa, Bacillus thuringiensis serovar konkukian str. 97-27
MPNIAVVGSISMDLVAVSKKRPKAGETVIGEAFHTIPGGKGANQAVAAARLGANVAMVGAVGDDNYGTVVKKNLENERVFIDYVVPVTDAATGIAHIVLAEEDNSIVVVQGANALVNESVVNRSKDLLIKADMVVLQLEIPLETVKYVLAICEEHKIPVMLNPAPAQVLSEDILEKATYITPNEHECRVVLDDFTSPIEDLLAKYPNKLLMTEGSNGVRFHNGTEIVHVPSIAVDVVDTTGAGDTFNGALAVALSEGETLQKAIRFANIAGGLSVTKLGAQGGMPTRDRVREVQVIVG

SEQ ID NO: 56141 - protein, 139 aa, Xanthomonas campestris pv. campestris str. ATCC 33913
MNRTEHAAPPATIVFDGVCLLCNGWVRFLLRHDHRRRYRYAAMQGTAGRALLVQHGLDPDDPLSFLLVDAAGAWTDTDAIVRVLSGLGGLWRVAAVLRLVPRSLRDIGYRVVARNRYRWFGRSTHCMLPTPEQRALFLD

SEQ ID NO: 56142 - protein, 369 aa, Arabidopsis thaliana
  misc_feature (178)..(178): Xaa can be any naturally occurring amino acid
  unsure (1)..(369): unsure at all Xaa locations
MAKNSVEFDRYIERKAFDNTKEGVKGLIDAKITEIPRIFHVPQDTLPDKKRSVSDLEIPTIDFASVNVDTPSREAIVEKVKYAVENWGFFQVINHGVPLNVLEEIKDGVRRFHEEEDPEVKKSYYSLDFTKNKFAYSSNFDLYSSSPSLTWRDSISCYMAPDPPTPEELPETCSIDLXRDAMIEYSKHVLSLGDLLFELLSEALGLKSEILKSMDCLKSLLMICHYYPPCPQPDLTLGISKHSDNSFLTVLLQDNIGGLQILHQDSWVDVSPLPGALVVNVGDFLQLITNDKFISVEHRVLANTRGPRISVASFFSSSIRENSTVYGPMKELVSEENPPKYRDTTLREYSEGYFKKGLDGTSHLSNFRI

SEQ ID NO: 56143 - protein, 391 aa, Chromobacterium violaceum ATCC 12472
MVPNYGPAGFIPVRGEGSRIWDQDGREFVDLAGGIAVNSLGHCHPELVAALTEQANKLWHVSNVFTNEPALKLASLLVEKTFAERVFFCNSGAEANEAAFKLARKYAHDNFGADKNQILSCVNSFHGRTLFTVSVGGQPKYTEGFGPVPGGIDHFEFNNIESLKAAISDRTCAVVIEPIQGESGVLPADPAFLKAARELCDQHNALLIFDEVQSGMGRTGALYAYQQYGVTPDILSSAKGIGGGFPIGAMLTTEKVAKSFGIGSHGSTYGGNPLACAVAHKVVSIVSSPEVLAGVEARHKRLVAGLEAINAKYKVFKQVRGKGLLIGCVLTDEYNGRAREFLKAAEKQQLMILVAGLSVLRLAPSLVISDADIAEGLKRLDAAIADLQSAK

SEQ ID NO: 56144 - protein, 195 aa, Prochlorococcus marinus subsp. marinus str. CCMP1375
MSFKESQSKVLFAKILCGKYSNKDQAYHQPKLYAYMNIYFRPLPWNLFRGIGIYSEQSYDYSPWSPYRQAVHRLIVKENYFILENYKIINAIRIAGAGFNLKLLDEIKKENLSIRKSCEMHFQKTEEGNYRGSLKKDEKFLIERGGIQTYLVSNVEFNKYNFNSTDQGLDIQTDSIVWGAKNGPLKFKKIFEEAK

SEQ ID NO: 56145 - protein, 364 aa, Bartonella vinsonii subsp. berkhoffii
MLAVFLLKHCYMLRKCLLKRNMAFETLGISIAKSKLNLDQMMAHKKAVVTANTSGVSFLMKKNKVDTFFGTAKILAAGQIEVVARDGNKQTIATKNIIIATGSESSSIPGVNVEIDEKVVVSSTGALALEKVPTRMIIVGAGIIGSELSSVWSRLGAKVTIIEYLNKVLGSMDGEVSRQFQKIMEKQGIEYKTGVKVTAITQSGSGAQVSFEAVKGGESETLEADVVLIATGRSPYTEGLGLVETGVKVDERGFIDIDAYWQTNIPGIYAIGDVVKGPMLAHKAEEEGVAVAEILAGQKGHVNFDVIPSVVYTQPEIASVGKTEEELKAAGIDYNVGKFPFMANGRARAMQKSDGFVKILADKK

SEQ ID NO: 56146 - protein, 376 aa, Arabidopsis thaliana
KKGRRPDPAFFACVLSPTRELAIQIAEQFEALGADISLRCAVLVGGIDRMQQTIALGKRPHVIVATPGRLWDHMSDTKGFSLKSLKYLVLDEADRLLNEDFEKSLNQILEEIPLERKTFLFSATMTKKVRKLQRACLRNPVKIEAASKYSTVDTLKQQYRFVAAKYKDCYLVYILSEMPESTSMIFTRTCDGTRFLALVLRSLGFRAIPISGQMTQSKRLGALNKFKAGECNILVCTDVASRGLDIPSVDVVINYDIPTNSKDYIHRVGRTARAGRSGVGISLVNQYELEWYIQIEKLIGKKLPEYPAEEDEVLSLLERVAEAKKLSAMNMKESGGRKRRGEDDEESERFLGGNKDRGNKERGGNKDKKSSKKFKR

SEQ ID NO: 56147 - protein, 88 aa, Triticum aestivum
  misc_feature (17)..(17): Xaa can be any naturally occurring amino acid
  unsure (1)..(88): unsure at all Xaa locations
MPATPTIIGALLGLGTXMYSNALRKLPYMRHPWEHVLGMGLGVVFVNQLVKFDEKVKVDLDKMLERAKHANEQRYFGLCLFAPNILES

SEQ ID NO: 56148 - protein, 907 aa, Arabidopsis thaliana
MAVKKNIEDSQGKDNYPCGQQLLIHNGKVLKDETSLVENKVTEEGFLVVMLSKSKSGGSAGQASVQTSSVSQPVSATTSSTKPAAPSTTQSSPVPASPIPAQEQPAAQTDTYGQAASTLVSGSSLEQMVQQIMEMGGGSWDKETVTRALRAAYNNPERAVDYLYSGIPQTAEVAVPVPEAQIAGSGAAPVAPASGGPNSSPLDLFPQETVAAAGSGDLGTLEFLRNNDQFQQLRTMVHSNPQILQPMLQELGKQNPQLLRLIQENQAEFLQLVNEPYEGSDGEGDMFDQPEQEMPHAINVTPAEQEAIQRIYSTVTSCVFVSASQFQTMEKKKYPIGPEHYTLYEFIGQGVSALVHRALCIPFDEVVAIKILDFERDNCDLNNISREAQTMMLVDHPNVLKSHCSFVSDHNLWVIMPYMSGGSCLHILKAAYPDGFEEAIIATILREALKGLDYLHQHGHIHRDVKAGNILLGARGAVKLGDFGVSACLFDSGDRQRTRNTFVGTPCWMAPEVMEQLHVYLIWSISFRADIWSFGITGLELAHGHAPFSKYPPMKVLLMTLQNAPPGLDYERDKKFSRSFKQMIASCLVKDPSKRPSAKKLLKHSFFKQARSSDYIARKLLDGLPDLVNRVQAIKRKEEDMLAQEKMADGEKEELSQNEYKRGISGWNFNLDDMKAQASLIQDMDCGFSDSLSGSATSLQALDSQDTQSEIQEDTGQITNKYLQPLIHRSLSIARDKSDDDSSLASPSYDSYVYSSPRHEDLSLNNTHVGSTHANNGKPTDATSIPTNQPTEIIAGSSVLADGNGAPNKGESDKTQEQLQNGSNCNGTHPTVGGDDVPTEMAVKPPKAASSLDESDDKSKPPVVQQVGRFKVTSENLDIEKVVAPSPNSEKEAQYVMLLLPTIPLLL

SEQ ID NO: 56149 - protein, 162 aa, Rhodomonas salina
MSYFNFNVRILFLSELFRGLWMVLQYFFRRKVTLNYPFEKAVLSPRFRGEHALRRYFSGEERCIACKLCEAVCPAQAITIETESRADNSRKTSRYDIDMTKCIFCGLCQEACPVDAIVEGPNYEYSVFKRQNLIYNKEKLLKNGDQWELEIRENRLSESMYR

SEQ ID NO: 56150 - protein, 175 aa, Citrobacter freundii
IWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSRDVVEQEYRDQGKDPATLDHVVPFKVFEGNRPTNSILLREITPFSLGALIALYEHKIFTQ

SEQ ID NO: 56151 - protein, 312 aa, Pseudomonas aeruginosa
MTDTAKRPLYVPHAGPSLLEMPLLNKGSAFSTQERIDFNLQGLLPHNIETIEEQTERAYSQYNLCNTDLDRHIFLRSIQYNNETMFFRLLEEHLEEMMPIIYTPTVGQACQEFSKIYRTHRGLFISYPDRERIDDILRSATKNNVKIVVVTDSERNLGLGDQGIGGMGIPIASCPCTCGGISPAYTLPVVLDVGTNKPDLLNDPMYMAWRHERVSGAQYEEFVDLFIQAIKRCWPNVLLQFEDFAQTNAMPLLERYKDELCCFNDDIQGTAAVAVGTLLAACKAKGEKLSEQTVTFVGWPPPVAASPNRSSR

SEQ ID NO: 56152 - protein, 120 aa, Citrobacter freundii
IWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSREVVE

SEQ ID NO: 56153 - protein, 291 aa, Oryza sativa
MLMQDSLWGMHRVDMCALNVFCFTGKTHLEIHGVFRIAPQGGQVDQQLDGQYCLYTEPSGTDSINCSSICNAVLPIDIHRLIDRDQKQKTLSRIGEVKRVTKETNVHVKINLDGTGVADCSTGIPFLDHMLDQLASHGLFDVCVKAKGDTHIDDHHSNEDIALAIGTALLEALGDRKGINRFGHFTAPLDEAAVEVILDLSGRPHLSCGLSIPTERVGTYDTQLAGKNSHHIIEATFKAFARALRQATEYDLRRRGTVPRLQYSKETNGMASTAPRFLLTLGISVGCDNRT

SEQ ID NO: 56154 - protein, 135 aa, Hafnia alvei
DRNGNPVTYQTGPIIWGEPGTNGQHAFYQLIHQGTKLVPCDFIAPAISHNALGDHHSKLLSNFFAQTEALAFGKSREEVEEEFAKAGKTAAEVAHIVPFKVFEGNRPTNSILLREITPYSLGLLIALYEHKIFTQ

SEQ ID NO: 56155 - protein, 125 aa, Hevea brasiliensis
METQEQQAKSRVVKVDSVESWDFYVTQANNQGCPIVVHFTASWCIPSVAMNPFFEELASAYPDVLFLAVDVDEVKEVASKLEVKAMPTFVLMKDGAQIDRLVGANPEEIRKRIGGFAQSIRVAVA

SEQ ID NO: 56156 - protein, 553 aa, Oryza sativa (japonica cultivar-group)
MAEGSVVGLGMAMSATSSNLIVYLVHKYNVKAIHAAQISNVVRGCMQLAPVLAAALSDAFFGPYPIAVAGLVFSLLSFVLFTLTAALPSLLPPPCQRGAGGGGATATSCEPPNAAQSAVLYAALCLLAAGNGGTRYNMAALGADQFAGEGQPRRRRQGGGFFSCYFAFLYASYATGDTVLVYVQDGVSWALGFGVCVATTGLALAALLLGSRHYRRPVPKGSPFTAMARVAVAAARKATVDLGSRVQYYHGCNRDDAVPRADQAPSDRFRFLNRAAMVVAGETREEDGSVAKPWRLCTVQQVEDVKSVVRVLPLWSSGILVSVTVNAQVSLTVLQALTMDRAVGPRFAVPAASITVTVLAAFVLAAALFDRVAAPLCAAAGKLAITPLRRVGLGHALNVASMAVAALVERRRIGAARGRAAAAAAVVPMSVLWLVPQLALTGAEEALHLPGNTALFYGELPASLRGTATAMPPLFIAAGSYLSAAAVDAVKRGTTWLPDDLNASRLDCVYWTLAVLAAVNLGYFLLCATTYKYNNYGGDDGNVKAQTQTDDVS

SEQ ID NO: 56157 - protein, 338 aa, Burkholderia thailandensis E264
MSTPVNRQLRLKARPDGRVGQEHFTLAEAPLPALRPGEMLVRVLYLSMDPTNRVWMSDIPQYLPPVAIGDVMRALGIGRVVASNAPGFAEGDLVQGLVGWQDYAHVRADEAAHYTKLPAALGLPLPRLLGACGMSGLTAYYGLTEIAPVQPGETLVVSAAAGSVGSVAGQIGKIHGARVVGIAGGADKCRYLTDELGFDAAVDYKADDWKRALKDATPDGVHVNFENVGGEIMRAVLSRMVIGGRVALCGVIANYNSGRPADDVSVLIAKRLTMRGFLILDYRKSREAIATLAGWLRDGRLKAEETVADGLTNAPDVLNRLFDGSHRGKLVLRVDPQA

SEQ ID NO: 56158 - protein, 258 aa, Triticum aestivum
  misc_feature (141)..(141): Xaa can be any naturally occurring amino acid
  misc_feature (186)..(186): Xaa can be any naturally occurring amino acid
  unsure (1)..(258): unsure at all Xaa locations
ISCRRAPRDGERGPRETPGPRPAGAGRPPPLAPGNRGTARAGGEPFFAPGRVAPAPKNAIRIAATGERPGVFRGRGGNRGARLAGGGRFAGGGRGGGGRGRFGGGGGGFRDEGPPAEVVEVSTFVHACEGDAVTKLTNEKXPYFNAPIYLQNKTQIGKVDEIFGPINESYFSVKMFEGVIATSYNXGDKFFIDPMKLLPLSRFLPQPKGSTPRGGGRGGRGGGRGGCGGRGGFRGRGAPRGRGPPRGGGRGFRGRGRF

SEQ ID NO: 56159 - protein, 820 aa, Bacteroides fragilis NCTC 9343
MNISYNWLKEYVNFDLTPDEVAAALTSIGLETGGVEEVQTIKGGLEGLVIGEVLTCVEHPNSDHLHITTVNLGNGEPTQIVCGAPNVAAGQKVVVATLGTKLYDGDECFTIKKSKIRGVESIGMICAEDEIGIGTSHDGIIVLPEDAVPGTLAKDYYNVKSDYVLEVDITPNRADACSHYGVARDLYAYLVQNGKQAALTRPSVDAFAVENHDLDIKVTVENSEACPRYAGVTVKGVTVKESPEWLQNKLRIIGLRPINNVVDITNYIVHAFGQPLHCFDANKIKGGEVIVKTMPEGTTFVTLDGVERKLNERDLMICNKEDAMCIAGVFGGLDSGSTEATTDVFLESAYFHPTWVRKTARRHGLNTDASFRFERGIDPNITIYCLKLAAMMVKELAGGTISSEIKDVCAAPAQDFIVELTYEKVHSLIGKVIPVETIKSIVTSLEMKIMDETAEGLTLAVPPYRVDVQRDCDVIEDILRIYGYNNVEIPSTLKSSLTTKGDCDKSNKLQNLVAEQLVGCGFNEILNNSLTRAAYYDGLESYPSKNLVMLLNPLSADLNCMRQTLLFGGLESIAHNANRKNADLKFFEFGNCYHFDAEKKNPEKVLAPYSEDYHLGLWVTGKMVSNSWAHADENTSVYELKAYVENIFKRLGLDLHSLVVGNLSDDIYSTALTVNTKGGKRLATFGVVTKKMLKAFDVDNEVYYADLNWKELMKAIRSVKVSYKEISKFPAVKRDLALLLDKKVQFAEIEKIAYETEKKLLKEVSLFDVYEGKNLEAGKKSYAVSFLLQDESQTLNDKMIDKIMSKLVKNLEDKLGAKLR

SEQ ID NO: 56160 - protein, 340 aa, Streptococcus pneumoniae TIGR4
MTVTIDWENLGFSYMKLPYRYLAHFKNGQWDQGELTEDATLHISESSPSLHYGQQAFEGLKAYRTKDGSVQLFRPDENAKRLQRTCDRLLMPQVPTDMFVEACKAVVRANEEYVPPYGTGGTLYLRPLLIGVGDIIGVKPAEEYIFTIFAMPVGNYFKGGLVPTNFLIQDEYDRAAPNGTGAAKVGGNYAASLLPGKMAKSRHFSDVIYLDPSTHTKIEEVGSANFFGITADNEFVTPLSPSILPSITKYSLLYLAEHRLGLTPIEGDVPIDNLDRFVEAGACGTAAVISPIGGIQHGDDFHVFYSETEVGPVTRKLYNELTGIQFGDIEAPEGWIVKVD

SEQ ID NO: 56161 - protein, 98 aa, Zea mays
  misc_feature (55)..(55): Xaa can be any naturally occurring amino acid
  misc_feature (58)..(58): Xaa can be any naturally occurring amino acid
  unsure (1)..(98): unsure at all Xaa locations
EEADKDKNIKYVENASKAIDFRPMVSIKEQLKNDKDHESLLLWKEQILGVVDLNXLVXKLKPDIKIMSLSILSTRRIDILLSLAVDLNEIGVWFTLKE

SEQ ID NO: 56162 - protein, 1096 aa, Wolbachia endosymbiont strain TRS of Brugia malayi
MVTLPREIIIIIMPKRTDIESILVIGAGPIIIGQACEFDYSGTQSCKVLKNENYKVILVNSNPATIMTDPEFSDATYIEPILPEIIEEIIIKEKPDAILPTMGGQTALNCAMKLADDGVLDKYNVKLIGVNREAIKKAEDRELFRQSMDKIGLKYPRSIIIKNREQIKEALDYVGLPAIIRSSFTLGGAGSGIAYNKKEFFNIVENALKVSPINEVQVDESIIGWKEYEMEVIRDCKDNCIIVCSIENVDPMGVHTGDSITVAPALTLRDAEYQQMRNASIAVLREIDVSAGGANVQFAVNPKEDGSLVVIEMNPRVSRSSALASKATGYPIAKVATKLAIGYSLDEIRNDCAPTIPAAFEPVVDYVVTKVPRFEFEKFKETDCELSTSMKSVGEVMSIGRTFNESLQKAFRSLETGLTGLDEVFPEDTDVDHIKSQLAKLLPNRLLIAADAMRHGISIEEINSITGYDLWFLQNIQQIILAEQKIKETGLPETAYEILELKKMGFSDARLAKLSNKSIPASCTVDQIEQIEKMRKKFGVSPVYKCVDTCAAEFESSTAYMYGCYEGDVVNKTECEADVSNRKKVVILGSGPNRIGQGIEFDYACVHAVSAAKEMGYETIMINCNPETVSTDYDTADRLYFAPLTIEDVLEILSKEQENGTLVGAIVQIGGQTPLRLAKVLNKRGFNILGTSFDSIDLAEDRMRFKNLALQLNLKQPENSICHSVEEALANAEKVGFPLVVRPSYVLGGQSMSIKHDIESFKEYVLGQTKIFEHGPLLLDKFLVNAVEVDVDAICDGEKVFIAAVMEHIEEAGIHSGDSTCSIPTNTLNDEVVKEIELQTERVALELKVRGLINIQFAIQENDIYILEVNLRASRTVPFISKVINVPIAKLATQVILGKKLDQEKKSLNHFAVKAAVFPFTRFSGIDTLLGPEMKSTGEVMGIDLSFEAALAKVHMAAGYKLPTKGTALISVKDDDKEYILPIARMLKEMNFGIYATKGTASYLNNNGIAAKAVNKVREGRPHIVDMLKDGKINLVINTSKGVKSVSDSRDIRRTAILQNIAYSTTASGSKALVLAIQYVKNSEMEVKSLQQIQNV

SEQ ID NO: 56163 - protein, 517 aa, Triticum aestivum
LAWRTDEEFAREMLAGLNPHIITRLNVFPPRSTLEGYGDQTSKITVEHIQHNLGKLNVDKAIDAKRLFILDHHDNFMPHLLKINSLPNTFVYATRTLLFLQDDGTLKPIAIELSKPLLNDLGTKVVGADSKVYTPPSCGSESEWAVQDTIWQLAKAYAAVNDSAWHGLISHWLHTHAVIEPFVIATNRQLSVTHPIHKLLQPHYRDTMTINALARQVLISAGGFFEMTVCPGEHALRISSEVYRNWNFTEQALPVDLIKRGVAKADTESPCGVSLHIKDYPYAVDGLAVWSAIETWVDEYCRIYYPCDDVLRSDVELQAWWKEVREVGHGDIKDQPWWPKMTTVNELVRSCATIIWIASALHAAVNFGQYSYAGYLPNRPTVSRRQMPEPGTKEYKEVETDPDLAFIHTITSQLQSIIGVSVIEVLSNHSSDEVYLGQRDEPKWTSDVKAKKAFEDFSQKLIDIEKRIMNMNANRQLKNRNGPAKFPYMLLYPNTSDIDGESATGITAKGIPNSISI

SEQ ID NO: 56164 - protein, 399 aa, Rhodomonas salina
MVLRNQLDHSKNIKNFTVNFGPQHPAAHGVLRLILELNGETIIKADPHIGLLHRGTEKLIENKTYIQGLPYFDRLDYVSMMINEHAFCLAIERLLNIEVPLRAQFIRVIFSEITRILNHLLAICCHAMDVGALTPILWGFEEREKLMEFYERVSGARMHAAYFRPGGVSQDLPLGLCADIFKFCEQFSSRIDELEELLTENRIWKQRLVDVGVITFEQALNLGLTGPLLRSTGFSWDLRRTHPYEIYDKLDFDIPIGKNGDSYDRYCIRIEEMRQSLSIIVQCLNNMPQGSFKVNNMKISPPSRVDMKRSMESLIHHFKYFSEGFTIPKGIVYAAVEHPKGEFGVSLVTDGTNKPYRCKIKAPGFIHLQALDFLSRGHLLADLVTIIGTLDIVFGEIDR

SEQ ID NO: 56165 - protein, 219 aa, Triticum aestivum
MALVNKLGNLLKKATSSNPTLYQAIRCMSSSKLFVGGLSFNTDEGSLRDAFSHYGEIIDAKIIVDRDTGRSRGFGFITYAAEEQASSAIMALDGKDLHGRNLRVSAATERTAGFRNGAGYGGGGGGFGGGGYGGGGYGGGGYGSNSGGGGDNFAAGNFGGASGFGGNPAGNHGAPAGSTGGDEFSLGTPGSTFESTKNDDVMDDLFKDDEPDKYASKNV

SEQ ID NO: 56166 - protein, 101 aa, Serratia plymuthica
DRNGNPVDYQTGPIIWGEPGTNGQHAFYQLIHQGTKLVPCDFIAPAISHNPLGDHHAKLLSNFFAQTEALAFGKSLETVEAEFAAQGKTPEQVKHVAPFKV

SEQ ID NO: 56167 - protein, 309 aa, Myxococcus xanthus DK 1622
MAETGNTRWGTARLDGGKVLRWSLLHVGALVGGTCFFSWSAVAVFAGMTAVTMCLGVSVGLHRGLIHRAFRASAPVERALALLGTLAGLGGPIAMSRMHDLRDFHQNQPEADCPPYFGYREGFTRAMAYALFHTWHPRSGAADVPAAPHVTQDVFFRGLERAGLWLQVPLALALYALGGAPWVAWGILVRLALTQDGFWCVHYVSHVEGEQPYELPGCAEQGRNAGWLALLSMGESWHNTHHVYPASAQMGLGWRQPDPGWWAVRGLAALRLVHDVKSLAHLPPRPGARTRRPEPHRTRRLCVLALRRA

SEQ ID NO: 56168 - protein, 322 aa, Zea mays
MAKKRKRTDAPAEAAGAEKPDDSAPARPERTLFGFKDLVPDAEPASAGAEAAVAPFRNREKVLITCSRRITYRYRHLMQDVLSLLPHAKKDSKVESKQSKGNALNELLELRSCSSCLFFECRKQKDLYLWMVKSPGGPSVKFLVNAVHTMEELKLTGNHLKGSRPLLTFSTNFDEQPHWKLVKEMITQIFATPKDHRKAKPFHDHVFVFSIVDGHVWFRNYQISVPHNEIDKVDKGGLDKMTLIEVGPRFCLNPIKIFGGSFGGPTWYENPYYISPNQIRALEKRQKAGKYAKKVKAKVRRKMHEMENTLEPDEFAELWKGE

SEQ ID NO: 56169 - protein, 486 aa, Zea mays
MAPPRISFLELCLSFLCFVVFYYFHMRSKRKKPFRAAGLAAGPPRSGMQFFVTADPANVRHVFTSNFANYPKGPEFEEIFDVLGGGIFNADGESWRRQRAKAQLLMSSAPFRALVSRYSRAKVDTALLPLLSHMAATGEAFDLQDVFLRLTFDTTTTLVFGVDPGCLSVGLPEVPFARAMDDAMGVLLLRHVVPMTWWKLARRLRIGHERKMAEAWRTIDQFVADTIAKRRAEKARHGNGQVSADLLSSYINDDEDEEGGVDAFLRDTTINLMLAGRDTTGSALSWFFYLLTRNPRVVGKIRQELECVKSKSSGSGGGMASFDPDELSRLTYLHAALCESLRLYPPVPQELKEAAAADVLPCGHEVRAGDKILVSLYAMGRMEEVWGSDCREFRPERWIPELEDGRRVVQVRYVPSYKFMSFNSGPRTCLGKDMAFVQLKAAAAAVVSNFDVEAVPGHVVEPKLSIILHMKNGFMATVKRRRQTFA

SEQ ID NO: 56170 - protein, 283 aa, Oryza sativa (japonica cultivar-group)
MPSPPPAAAAGRLVKVGLLGGAAIYAAFNSLYNVEGGHRAIVFNRLEGIKDKVYPEGTHFMIPWFERPIIYDVRARPNLVESTSGSRDLQMVRIGLRVLTRPLPEKLPTIYRSLGENFNERVLPSIIHETLKAVVAQYNASQLITQREAVSREIRKILTERASNFNIALDDVSITSLSFGKEFTHAIEAKQVAAQEAERAKFIVEKAEQDKRSAIIRAQGEAKSAQLIGEAINNNPAFLALRQIEAAREISHTMASSNNKVYLDSKDLLLGLQQLNVDNKNKK

SEQ ID NO: 56171 - protein, 470 aa, Burkholderia thailandensis E264
MLINGLCIEGSGEPLSIVDPATGEPLASPAAASAADVERAVAAAEAAFPAWRATTPATRASLLLALADEIERHAHALAQIESRNTGKPLHLVVQDEMPAVADCFRFYAGAARTASGPSAGEYVEGHTSMVRRDPVGVVAQIAPWNYPLMMAAWKLAPALAAGNTIVFKPSEWTPLSIVALEAALARIFPAGVVNVVLGDGANVGRALATHPRVRMISLTGSVEAGKSVLAAAARNLKRTHLELGGKAPVLVFDDADLDAAVAGIRYAGFYNAGQDCTAATRIYAQRGVYDALAQRLADAASTLRIGPPDRADAEMGPLVSAAHRARVDRFVREAAALPHASVLTGGAPLPGPGCYYAPTVIAGVRHDDAPMRREAFGPVVTLTPFDTESQALRWANDSEYGLASSVWTRDAARGMRLAACIEAGVTWVNAHFTYTADMPHGGTKQSGYGSDLSTLGLADYTQPRHVMWRH

SEQ ID NO: 56172 - protein, 463 aa, Bacillus thuringiensis serovar konkukian str. 97-27
MQHSNKSGTLNRGLKERHITLMSLGSAIGVGLFLGSASAIKLAGPSILLGYMIAGLVIFFIMRALGEMAIEQPVAGSFSKYAYDYLGPLAGYITGWNYWFLWVVTCMAEITAAGIYMQYWFPDIPRWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFWRILLFYVGALFVMMAIYPWNELGEKGSPFVLTFQQIGIAKAAGIINFVVLTAALSSCNGGLFSTGRMLYTLAQQKKAPERFGRLNKNGIPSQGIVATAIVLLIGVILNYLVPAKVFTWLTSISTFGAIWTWGIILVAQIKFRKSLPTQKRQKLSYKMPLYPLSSYFSLAFLVLVLGIMAYSEDTRIALIVGPIWLIGLAIVYYMKGFHKIDETPNSKIS

SEQ ID NO: 56173 - protein, 391 aa, Kineococcus radiotolerans SRS30216
MTTPLDTPTREPLPLAPAGPGKLVMSAPRRGKPPRHFVDLEPAERGPAMVELGEKAFRGKQLATQWFERLEDDPARMTDLPAASRTRIAEALLPTLLTPIRTLTADGGTTIKSLYRLHDGALVESVLMRYKNRDTICISSQAGCGMNCPFCATGQAGLTRNLSTAEIVEQVTAASRALARDEVPGGPGRVSNVVFMGMGEALANYKSAVAAVRRLVSPAPDGLGISARGVTMSTVGLVPAIDKFAQEGIAATLALSLHAPDDELRDELVPINQRWKVGEALDAARRYFEATGRRVSIEYALIKDINDQAWRADRLGKLLNARGRGWVHVNPIPLNPTPGSKWTASDPAVERAFVAALENRGIPTTVRDTRGSDIDGACGQLAAIGPEQPRA

SEQ ID NO: 56174 - protein, 517 aa, Carboxydothermus hydrogenoformans Z-2901
MKGAFAEIPYGSGRKGLGLCRTGIGLSPVLAGGALPCWELRYFLAIAACQLRVFGEIPRARNILLFIRGRDGMRFTGTMRVNEKGHLEIGGVDTVDLAREFGTPLYILDEEEFRKNCREYYQNFTQKHPGSLAIYAGKTLLTTAICRLVEEEGLGLDVVSGGELYTAIKADFPLHKVYFHGNNKSPEEIRLGVEAGVGRFVVDNLYELYLLNDIAKSYKVRQPILLRVSPGIEAHTHEYIKTGQIDSKFGFPIETGQAMDAAQRALELDGIELKGFHCHIGSQIFELESFAHTVEVMTAFMAEVFKATGFMTEELDLGGGLGIYYAEGDNPPTVAAMAETIFTTLESQCQKLGLKVPKVIVEPGRSIAGPAGSTLYTIGAIKDIPGIRTYVAVDGGMGDNPRPALYQAKYEAIVANKANDQPVKLVSIAGKCCESGDMLIWDIELAEIKPGDLLLVSNTGAYNYSMAMNYNRLPRPAMVLVGGGKAELIVRRETYDDLLSHDLIPAHLKTRKVVTMY

SEQ ID NO: 56175 - protein, 149 aa, Canavalia lineata
MGAFSEKQESLVKSSWEAFKQNVPHHSAVFYTLILEKAPAAQNMFSFLSNGVDPNNPKLKAHAEKVFKMTVDSAVQLRAKGEVVLADPTLGSVHVQKGVLDPHFLVVKEALLKTFKEAVGDKWNDELGNAWEVAYDELAAAIKKAMGSA

SEQ ID NO: 56176 - protein, 709 aa, Xanthomonas campestris pv. campestris str. ATCC 33913
MRHPASAAYATPSRIRQGRPFPRGAIFDGKGTNFALFSAHATRVELCLFDEQGNESRVDLPEYTNEIWHGYLPDVKPGQRYGYRVHGPYAPTEGHRFNHNKLLLDPYARELDGDLVWADELYGYTVGHPDGDLSFDERDSAPFMPKCVVVEDTYDWEDDARLLKPWNETVIYETHVRGYTMRNAQVPEAVRGTFAGLAQPSVLQYIKDLGITAVELLPVHAYLDDQHLLDKGLRNYWGYNTISFFALKSRYLSSGHRDEFRDMVKAMHKQGLEVILDVVYNHTAEGSELGPTLSFKGIDNASYYRLAEDKRYYINDTGTGNTLNLSNSRVIQFVNDSLRYWAGEMHVDGFRFDLATILGREPSGFDQRGGFLDACNQDPLLSEVKLIAEPWDCGPGGYQVGHFPPGWSEWNDKFRDNAREFWKGEDGKLAEFATRFTGSADLFDRSGRRPWASVNFITAHDGFTLRDLVSYNEKHNIDNGEDNRDGSSNDGSCNYGEEGETDNAEILQLRERQMKNLLATLLLSQGTPMILAGDERAQSQGGNNNTYCQDNEITWLEWENDPTDGRLTDFVKSLTALRKRYPILSRGRFLNGQYNEEAGLRDLTWLNPGGTEMDDAHWTDAGARSVGLLLEGKAQTSGVKERGNDATLLIVINAYHEGVTFTLPSSDEPVHWKLALSTDEALEVDSMPAGASEFLAPPRSITVFECKVG

SEQ ID NO: 56177 - protein, 794 aa, Oryza sativa (japonica cultivar-group)
MSVSAAARHLESLLPRLASLRHYLQFHARLLTSGHLGAHPGLRARFLDRLALSPHPAALPHALLLLRSLPTPATNDLNAALRGLAASPHPARSLLLLAGRLLPALLPRPDALSLSFALKASARCSDAHTTVQLHALVLRLGVAADVRLLTTLLDSYAKCGDLASARKVFDEMTVRDVATWNSLLAGLAQGTEPNLALALFHRLANSFQELPSREEPNEVTIVAALSACAQIGLLKDGMYVHEFAKRFGLDRNVRVCNSLIDMYSKCGSLSRALDVFHSIKPEDQTLVSYNAAIQAHSMHGHGGDALRLFDEMPTRIEPDGVTYLAVLCGCNHSGLVDDGLRVFNSMRVAPNMKHYGTIVDLLGRAGRLTEAYDTVISMPFPADIVLWQTLLGAAKMHGVVELAELAANKLAELGSNVDGDYVLLSNVYASKARWMDVGRVRDTMRSNDVRKVPGFSYTEIDGVMHKFINGDKEHPRWQEIYRALEDIVSRISELGYEPETSNVLHDIGEEEKQYALCYHSEKLAIAFGLIATPPGETLRVIKNLRICGDCHVVAKLISKAYGRVIVIRDRARFHRFEDGQCSCRDYCGVWAIWFCVKLLGFQKHFIERCHVASSQGFVTFATVEGHDADFVFYTRQEIQDVDGEKDAGRAGETGMISYKIAAHAADLAKCHPYAQAWDDTLSKARFEFRWLDQFALYLDPVTTMSFHDETLPSEGAKVAHFCSMCGPKSCSMKITEDIRKYADEHGYRIVEEAVIPGMNAMSAEFLAARKTISGEQHGEAGGEIYVPESYTARK

SEQ ID NO: 56178 - protein, 110 aa, Salmonella enterica
MSLAKNGTNLFSGDKYAGLSEQALYYIGGVIKHAKAINALANPTTNSYKRLVPGYEAPVMLAYSARNRSASIRIPVVASPKARRIEVRFPDPAANPYMCFAALLMAGLDG

SEQ ID NO: 56179 - protein, 310 aa, Triticum aestivum
MGHASAALPVIDLASPDIGAATKSIRQALVDYGFFYVINHGIDDALMKSVYAESASFFQQPMEEKMALHKNSSHRGYIPPDFEGFEADAGGKGDLLECFHIGSGVDGDSKNPVNQWPPAERFPYWKETMKSYYQCAMGTSKRILSLIALSLDLDAEFFKPDGSETILRPIHYSGRAIESKHGSDHGANAHTDYGMLTLLSTDGTPGLQICRDKDGRPQLWEDVHHIDGALVVNIGDLLERWTNNVYRSTLHRVLMVGKERYSVAFFVWPSPDMMVTCIECCCSEANPPRYPPIRSDEYLEQRLTSTYKYK

SEQ ID NO: 56180 - protein, 140 aa, Salmonella enterica
PKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 56181 - protein, 372 aa, Wolbachia endosymbiont of Drosophila melanogaster
MSKKDYYDLLEVGRNASIDEIKKAYKKLALRYHPDRNPGNQEAEEKFKEVTAAYEVLSDSEKRAGYDRYGHEGASGGFQGFSSAGDFSDIFNDFFGGGFGGGASRSRAKRSTTGVSGADLRYDLEITLEDAFKGIQAPIHYVTNVKCDTCQGTGGEGAIKPVQCHTCQGSGRIRTQQGFFTIERTCTTCYGEGEIIQNKCKKCGGSGRRRDEVNISVSIPKGIEEGAKVRISGKGEAGTKGGKSGDLYVYVKIIFHKIFARNKADLHCKVPIRMTLAVLGGEIDIQSIDGAKIKVKVPEGTQTGTKLRCREKGMPYMNSHARGDLYVQVIVETLNPKNLTKKQIELLKALEEEENASVQQQSEGFFSKVKKK

SEQ ID NO: 56182 - protein, 289 aa, Arabidopsis thaliana
MPSGFPPQKQETQPGIQHVMEPTPEFSSSNYKPSNKLHGKVALVTGGDSGIGKAVCHCYALEGASVAFTYVKGREDKDAEETLRLLHEVKTREAKEPIMIATDLGFEENCKRVVEEVVNSFGRIDVLVNCAAEQHEVSIEDIDEARLERVFRTNIFSQFFLVKYALKHMKEGSSIINTTSVVAYAGNSSLLEYTATKGAIVSFTRGLALQLAPKGIRVNGVAPGPVWTPLIPASFSEEAIKQFGSETPMKRAAQPVEVAPSYVFLACNHCSSYYTGQILHPNGGLIVNA

SEQ ID NO: 56183 - protein, 263 aa, Calystegia sepium
MSFGQGKWSLQGMTALVTGGTRGIGYGIVEELAGFGAEVYICSRKQNEVDECVGKWREKGFKVAGSACDISSRTQREELIKNVAHHFNGKLNILVNNAGTILPKDATEFKAEDYTLIMGTNFEASFHLCQLAHPFLKASSMGTIVFNSSVAGIIPVFKTTLYAASKGAINQVTKNLACEWAKDNIRVNSVAPWVIRTKLVNDFDSESEGSEEIERMIRRTPISRPGEVGEVSSLVAFLCLPAASYITGQTICVDGGYTITGFP

SEQ ID NO: 56184 - protein, 117 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDG

SEQ ID NO: 56185 - protein, 140 aa, Salmonella enterica
KPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 56186 - protein, 542 aa, Cryptococcus neoformans var. neoformans JEC21
MKSSIIFCFFAAFGGWVFGYDIGYISGCLIMPNFIQYMGEQDPATGEWILSSQRQSIITSLLSAGTFFGALLQSFTSDRLGRRGSIIFWSIIFSVGIIIQVSSFGLAQITVGRFVAGLGVGALSAIVPLYVGEAAPKKLRGALLVLYQVQIASGLFLAYIVDLGTHHLKSSASWRIPVGLQLVWGAFLIVGGLLLPESPRLLLGRGDEKGALKAIARLNDCEVDDPLTRDVIKDLEEAIREENEGGKAGWLECFSTRSMMWKRTLNGCMVQFLQQLNGQNFYYYYGPVFFESADVPLSAYSIQAILGGISLATVIPAMWTIEHLGRRKSLLFGAAIQAACALIAGLVGHYYTDVAGVTDSMVKTGGNVLIAFAVIHVSMYSLFWGPTPWVILGETYPLRVRPKAIALAAAVNWLWNFLLSYFSPLIADDIGPLILLIFFGCLIFAFVYVFFMLPETRGITLEEVDELYRSKIPPWKSNSWKPSSHHAALDALEGESRKPVEVPAQAPGTLDETKPADEHLENAPAAKARIEGERGAREKSIV

SEQ ID NO: 56187 - protein, 130 aa, Salmonella enterica
MSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLPP

SEQ ID NO: 56188 - protein, 467 aa, Cryptococcus neoformans var. neoformans JEC21
MKSSIIFCFFAAFGGWVFGYDIGYISGCLIMPNFIQYMGEQDPATGEWILSSQRQSIITSLLSAGTFFGALLQSFTSDRLGRRGSIIFWSIIFSVGIIIQVSSFGLAQITVGRFVAGLGVGALSAIVPLYVGEAAPKKLRGALLVLYQVQIASGLFLAYIVDLGTHHLKSSASWRIPVGLQLVWGAFLIVGGLLLPESPRLLLGRGDEKGALKAIARLNDCEVDDPLTRDVIKDLEEAIREENEGGKAGWLECFSTRSMMWKRTLNGCMVQFLQQLNGQNFYYYYGPVFFESADVPLSAYSIQAILGGISLATVIPAMWTIEHLGRRKSLLFGAAIQAACALIAGLVGHYYTDVAGVTDSMVKTGGNVLIAFAVIHVSMYSLFWGPTPWVILGETYPLRVRPKAIALAAAVNWLWNFLLSYFSPLIADDIGPLILLIFFGCLIFAFVYVFFMLPEVSNLRDTFRFTR

SEQ ID NO: 56189 - protein, 392 aa, Arabidopsis thaliana
MRTLRRNVTENRLTISRRRTEKKTSPNKTEKSVQIPVDIIIEILLRLPAKSIATCRCVSKLWISVICRQDFTELFLTRSLHRPQLLFCCKKDGNLFFFSSPQLQNPYENSSAISLKNFSLCYKISRPVNGLICFKRKEMNETVTVICNPSTGHTLSLPKPMKTSIGPSRFFVYEPIQKQFKVLLSYKSDEHQVLTLGTGELSWRIIECSMPHILGMSEICINGVLYYPAINLSSGDYIIVCFDVRSEKFRFITVMEEFIKAAHDGTLINYNGKLASLVSERYCFVDGRSKSIELWVLQDAEKKEWSKHTYVLPAWWQHRIGTLNLRFVGVTRTNEIMLSPCYQTVPFDVYYFNIERKTMMSVAIQGMEAFQGHLVFTYLDHVENVKLLHNMF

SEQ ID NO: 56190 - protein, 208 aa, Zea mays
  misc_feature (56)..(56): Xaa can be any naturally occurring amino acid
  misc_feature (77)..(77): Xaa can be any naturally occurring amino acid
  misc_feature (90)..(90): Xaa can be any naturally occurring amino acid
  misc_feature (98)..(98): Xaa can be any naturally occurring amino acid
  misc_feature (110)..(110): Xaa can be any naturally occurring amino acid
  misc_feature (145)..(145): Xaa can be any naturally occurring amino acid
  misc_feature (158)..(158): Xaa can be any naturally occurring amino acid
  misc_feature (171)..(171): Xaa can be any naturally occurring amino acid
  unsure (1)..(208): unsure at all Xaa locations
ERKCLIWCETHAGSAGTECTREILLGWDPKYEHDQTSCTGRPVIHTTLRCPHLKTXGTHPTHANPTTIGRFSPNGKXVTYGDASGCVRVXRRYGHRAXKAELSPLSRRVXDLRWTSDGLHIGDSGDGKGTAFGQEFVWDSATTAXEIDDHVRRVVLSXDVHPTPPLHIPTXNEDCLANYYEGPAFKDKHSLKDRSNFVNCIREAPEWQ

SEQ ID NO: 56191 - protein, 458 aa, Triticum aestivum
  misc_feature (354)..(354): Xaa can be any naturally occurring amino acid
  unsure (1)..(458): unsure at all Xaa locations
MPSGSTQFRYTQTPSKVLHLRNMPWESTEEELVELCKTFGRVVNTMCNVGANRNQAFVEFADQNQAISMVSYYASSSEPAQVRGKTVYIQYSNRQEITNNKGTGDSSGNVLLVTFEGVQPNDVSIDVIHLVFSAFGFVHKIATFEKAAGFQALIQYTDAPTALEAKNSLDGRSIPRYLLAEHVSICHLRITFSAHKDLNIKFQSHRSRDYTNPYLPVNPTAIEGITQPILGSDGKIKEPESNVLLASIENMQYAVGVDVLHTVFSSFGAVRKIAMFEKNGGMQALIQYPDITTAGVAKQALEGHCIYDGGYCKLHLSYSRHTDLNVKAHDERSRDYTVSDPSAQVQAAGQAPGXSTPGAAWQSTTPAAFYGSSARAASIGQVPAWNPNMQRGAFAPASTSYPTQLLMANPGPHFPAVGSSSGAPPMLYQASQQMAQYGTAPAALPHAALSGEPMYFPK

SEQ ID NO: 56192 - protein, 50 aa, Clostridium perfringens
TSSDGMTSNWAHIPYEVIDKVSRRIVNEVKGVNRIVYDVTSKPPATIEWE

SEQ ID NO: 56193 - protein, 503 aa, Burkholderia thailandensis E264
MQFNDILAALDVDLARWQGSALTARSPVDGATLATLAADSPADTERKIDAAHQAFLKWRTVPAPVRGELVRVFGNVLREHKAALGRLVTLEAGKIASEGLGEVQEMIDICDFAVGLSRQLYGLTIASERPGHRMMETWHPLGVCGVISAFNFPVAVWSWNAALAFVCGDPVVWKPSEKTPLTAIACHALFAKAVREFDKTHPGVVPNGLHQLVLGGRDVGEALCASPKVPLVSATGSVRMGVEVAQVLSRRLARSILELGGNNGMIVAPSADLDLVVRAVTFAAVGTAGQRCTTLRRLIVHRSVADRLLPRLEKAFASVKVGDPLEAGTLVGPLIDRASFDAMQKALGDAREQGGEVKGGERVELGHADAYYVRPALVRMPRQTAVVTRETFAPILYVLVYDDFDDALAIHNGVPQGLSSAIFTNDMREAEQFMSAAGSDCGIVNVNIGTSGAEIGGAFGGEKETGGGRESGSDAWKSYMRRATNTINYSRELPLAQGVKFDV

SEQ ID NO: 56194 - protein, 617 aa, Triticum turgidum
MASWFETYHHPSKGKGKRRILRVQTRDTREQLCAHLCLLPLLLTAGENSYPVIVMIGTRVLAHSRVDPAIRWGAAAHGFVVIAPKKREAGQETSTSERKKTKRKWRRNFCGWTSHEAKEPSTSETKKTKRKWGRNFCGWTSHEAEEPLTSETKKTKRKWGRNFCGWTSHEAEEPSTSETKKKRKNGASSSEPDKKRWFKTKIWRKKKAKNKQLATLVKEISLPNSPKARAAAGEILRIGNHNIPSRVFTYSQLSDATNSFSQENLLGEGGFGRVYKGYIPETMEVISIPSPSFLFYVSLSWHLKMLCYIQQQHLPDVNYVIAVKQLDKDGLQGNREFLVEVLMLSLLHHPNLVTLLGYCTECDQKILVYEYMPLGSLQDHLLDLTPKSQPLSWHMRMKIAVDAARGLEYLHEVANPPVVYRDLKASNILLDGNLSAKLADFGLAKLGPVGDKTHVTTRVMGTYGYCAPEYAMSGKLTKMSDIYCFGVVFLELITGRRAIDTTKPTREQILVHWAAPLFKDKKKFTKMADPKLDSKYPLKGLYHALAISSMCLQEEASSRPLISDVVTALTFLADPNYDPPDDIEPLPITVPDFDRGISLGEPEEVKEKFEGKQVEDS

SEQ ID NO: 56195 - protein, 394 aa, Oryza sativa (indica cultivar-group)
MTTRNGQIKNFTSNSGPQHPAAHGVSRSVLEMNGEVVERAEPHIGSLHRGTEKLIEYKTYLQALPYFDRSDYVSTMAQEHAHSSAVERLLNCEVPLRAQYIRVLFCEITRISNHSLASTTHAMDVGASTPFLWAFEEREKLLEFYERVPGARMHASFIRPGGVAQDLPLGLCRDIDSSTQQFASRIDELEEMSTGNRIWKQRLVDIGTVTAQQAKDWGFSGVMLRGPGVCWDSRRAAPYDVHDQSDLDVPVGTRGDRYDRYCIRIEEMRQSVRIIVQCPNQMPSGMIKADDRKLCPPSRSRMKLSMESSIHHFELYTEGFSVPAPSTYTAVEAPKGEFGVFLVSNGSNRPYRCKIRAPGFAHSQGLDSMSKHHMPADVVTIIGTQDIVFGEVDR

SEQ ID NO: 56196 - protein, 515 aa, Leptospira interrogans serovar Copenhageni str. Fiocruz L1-130
MFLRFSFRFGSNSKPTPGESMEPVQKLQIPYKSIRLSDGTEYQSYHTEGALSGKQPADYKNGIPAFRKEWIQKRFNHSNHSQMYFAKKGIITEEMRYAAFRENMEPEFVRSEIACGRAILPSNRNHPELEPMVIGKNFLVKINANIGNSTFSSSIEEEVEKLHWAIKWGADTVMDLSTGKNIHETREWILRNSPVPIGTVPIYQALEKVKGKTENLNIQIFLETLEEQAEQGVDYFTIHAGVLLRYIPLTTNRITGIVSRGGSILAKWCQAHHKENFLYTHFDEILKVMKKYGVSISLGDGLRPGSIADANDKAQFSELETLGELTQLAWKEDIQVMIEGPGHVPMNLIKENVDLQTKICQEAPFYTLGPIVTDIAPGYDHITSAIGAAMIGWYGTAMLCYVTPKEHLGLPNKEDVKQGVIAYKIAAHAADLAKGHPGAIDRDNLLSKARFEFRWEDQFSLSLDPETAKTFHDEMLPQDRMKTAHFCSMCGPHFCSMNLTQELRKFAQEKEIQES

SEQ ID NO: 56197 - protein, 372 aa, Oryza sativa (japonica cultivar-group)
GRAAPPTRRAPGVCSVVSPSKPGVAAVDVPAATIPDAAATGVGVAERISVSSLLEVVADDLLKLNNNLKSLVGAENPVLVSAAEQIFGAGGKRLRPALVFLVSRATAELAGLLELTTEHQRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTRSAAIFSGVSTAICEQMYEYGRNLGLSFQVVDDILDFTQSAEQLGKPAGSDLAKGNLTAPVIFALQDEPQLREIIDSEFSETNSLATAIELVHRSGGIKRAHELAREKGEIAIQSLQCLPRSEFRSTLENMVKYNLERID

SEQ ID NO: 56198 - protein, 573 aa, Nocardioides sp. JS614
MTDLRYTVQPASSTEIPRPKRAEGQWALGLREPLNANEQQKKDDSPLNVRDRIVNVYSKRGFDSIDPADLRGRFRWYGIYTQRRPGLDGGKTGALEPHELDDRYFMMRVRSDGALLGAEQLRTLGGISTDFARDTADITDRQNIQYHWIDIVDVPEIWDRLARVGLTTEEACGDSPRGFLGSPVAGVAKDEIIDGTPALLEIGRRRAGNPDYANLPRKFKTSVSGHPSLDATPEINDVAFVGVVHPELGAGFDLWVGGSLSTNPFLSAKMGVWIPLDEVADVWEGVISIFRDYGYRRLRSRARLKFLVQDWGIEKFREVLENEYLHRRLPDCASPEVAAGNGDHIGVHEQKDGRFYVGASATVGRVSGSLLSRLGDLVEKYGVDGVRLTAYQKLVILGVDGARVDELLDDLELIGLSARPSPWRRSTMACTGIEFCKLAIVETKHRASALVDELERRFPDLDTPITVNVNGCPNACARTQVADIGLKGQLVLHEGEQVEGFQVHLGGGIGLTQRLGRKLRAHKVTSAGLDDYITSVVTNYLTDRTDGEAFAAWVERADEELLRGDKTLEAVAT

SEQ ID NO: 56199 - protein, 571 aa, Clostridium tetani E88
MEGYAMSKKYLIVGGVAGGASTAARLRRLSEEDEIIMFERGPHVSFSNCCLPYHLAGLIKTANQLVLMSPEQFKKQYNIEARVNSEVIDIDRAKKEITIKDTLTGKEYTENYDKLILSPGAKPIVPPIKGIEDINLFTVRNVIDIDKLNKFVSTMKTKNATVVGGGFIGIEVAENLKEAGFNVTLVEAMPQVMKIFDYDMVQILHKELHDKGINLIVNDKVASFEKDTVVLESGKRVEAEAVVMAIGVTPETDLAVKAGLELGELGGIKVDQNYRTKDEDVYAVGDAIEVYHALTGKMTKLPLAGPAQKQAREVADHIHGRLVPNTGYIGSSVVKCFEYNGASTGLNEGMIKALNLDIQYETVKVIPGDKVGLMPGCEPLHFKLLFEIPTGKILGAQAIGRGNVDKRVDVIATAIKFGATINDLRDLEFCYAPPFGTAKDVVNFAGYVGSNLLHDEFKQVHEYDVRDLVESGACIIDVREKHEYELSHIIGAKNIPLSEIRDRVAEIPKDQPVYLHCRSAQRSYNAAKALKHLGFDNIYNVSGGFMGISFYEYFNDQTTGREKIVTDYNFL

SEQ ID NO: 56200 - protein, 143 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 56201 - protein, 141 aa, Salmonella enterica
PKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 56202 - protein, 129 aa, Salmonella enterica
NGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAM

SEQ ID NO: 56203 - protein, 328 aa, Wolbachia endosymbiont strain TRS of Brugia malayi
MLNTGLTNNDILDDIVSSDLSAMKNFIFRDVNNGDVKLAADIISHLVRSGGKKVRPKLVFIICKMLNYSGEDRVKVAASVEFIHNATLLHDDVLDESEARHGVKTANKIWGNKSSILVGDLLLTLAFRWLIECGNLNILSILSGASHSLVNGEIKQMAARFNSHTIRKNYFDIIGKKTASLFSACCEAASVISNATSNETERLKNFGLNFGMAFQIIDDTLDYTADQRTSGKQVGKDFFEGKVTLPAIIAYEKGSPAEQKFWEKCFSLAERNFDQALHYINHHNAIQLSIEKARHYVNMAQNNINTFSDSSYKIALIDFLNASIERQA

SEQ ID NO: 56204 - protein, 600 aa, Cryptococcus neoformans var. neoformans JEC21
MLRTPFTLSSRSTDSVFKIRQSLSIVLSHASTKIISRGYITIPTTSTVASHRPTIQRFKMTIAVPARTLSSSQPLKRSTSPLPAITPAQNLLRLKAHLQNLPTPLLKHVHLSKIRREDPNLFFSVMRDELTELAPIVYTPTVGEACQKYSQIYSGPEGLYLNIEDKDRIPEILHQYASKLVAPPQILVVTDGSRILGLGDLGIGGMGISVGKLNLYVAGGGVNPHGCLPVVLDMGTNNEAVRNDPLYIGLKQPRVGLEEATEFMDAFMAAASEAFPKAVIQHEDFYSEAAFDFLARYKEKYRMFNDDIEGTGSVILAGFLAAAKHASEASGKPLRDHKVVFLGGGSAAVGVAKEMMNFFMMQGLTEDEARERFWLIDTKGLITSTRADVVSGKVASHKKFFIRNDTEGKEYPSLESVIEYVQPTALVGLSTTFGAFSESAVRRMAELNQSPIIFPLSNPTSKCELAFSDALEWTDGRVLFASGSPYAPQQFKGTFREPGQGNNFLVFPGIGFGALQAGCKRITTGMITASAIALSEALTPEEKQKGLLYPRLERIRAVSARVAAGVVKQAQEDGVDTNEKLRGLDIETLTEEMNKAQWWP

SEQ ID NO: 56205 - protein, 144 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDL

SEQ ID NO: 56206 - protein, 143 aa, Salmonella enterica
FMPKPMFGDNGSGMHCHMSLAKNGTNLFSGDKYAGLSEQALHYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 56207 - protein, 594 aa, Neisseria gonorrhoeae FA 1090
MALVELKVPDIGGHENVDIIAVEVNVGDTIAVDDTLITLETDKATMDVPAEVAGVIKEVKVKVGDKISEGGLIVVVEAEGAAAAPKAEAAAAPAQEAPKAAAPAPQAAQFGGAADAEYDVVVLGGGPGGYSAAFAAADEGLKVAIVERYKTLGGVCLNVGCIPSKALLHNAAVIDEVRHLAANGIKYPKPELDIDMLRAYKDGVVSRLTGGLAGMAKSRKVDVIQGDGQFLDPHHLEVSLTAGDAYEQAAPTGEKKIVAFKNCIIAAGSRVTKLPFIPEDPRIIDSSGALALKEVPGKLLIIGGGIIGLEMGTVYSTLGSRLDVVEMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCAGHKAYFDARVIPGVAYTSPEVAWVGETELSAKASGRKITKANFPWAASGRAIANGCDNGFTKLIFDAETGRIIGGGIVGPNGGDMIGEVCLAIEMGCDAADIGKTIHPHPTLGESIGMAAEVALGVCTDLPPQKKK

SEQ ID NO: 56208 - protein, 496 aa, Cucurbita maxima
MESTWAVAAVVTAVVAVATVFSVLKWAAKSLNEWIYEAKLGDRRLALPPGDLGWPLIGNMLGFLRAFKSKNPETFIDGYVSRYGKTGVYKVHLFGNPSVVVTTPETCRKVLTDDEAFQPGWPRAAVELIGEKSFIQMPQEEHKRLRRLTSAPVNGFEALSNYIPYIEKNVLESLEKWSKMGPIEFLTQLRKLTFTVIMYIFLSSESEPVMEMLEKEYTRLNYGVRDMRINLPGFAYHKALKARKNLVAALKGIVTERRRQKLDKWAPKRKDMMDQLIDIVDENGRKLDDEEIIDILIMYLNAGHESSGHTMMWATILLNQHPEVLKKAREEQEAIVRNRPAGQTGLTLKECRDMEYLSKVVDETLRYVSFSLVVFREAQMDVNLNGYLIPKGWKVLAWFRSIHYDSEVYPDPKKFEPSRWDGFVPKAGEFLPFGAGSRLCPGNDLAKLEICIFVHYFLLNYNLEWLTPDCEILYLPHSRPKDNCMAKITKKSSVAA

SEQ ID NO: 56209 - protein, 728 aa, Psychrobacter arcticus 273-4
MIQNLPKLSHPLVDDAQYNLLRSVGYLTGAERRDIVDACEFGDVAHIKDKRKSGEPYITHPIAVAEILAGFRLDRDTIIAAILHDTVEDTEVSDEQIETRYGKVVSRLVDGVTKLKSSTHNKQENKAATFHKILTATLADPRVLIIKLADRLHNMSTLDAVRPEKQRATAQETLDFYVPFARLMGLNDIADYIEVLCYRNLDSEMYNKISDKLLQHGLGRNFQREAIHRYLSIVLNNLDLDGMVKVLDNRVVIFRQFFRNRGEINALLRHYAFEIVLDNIEACDKLAYYLIKKYQIADSHIADNIRRPLPGGNQSLTLIYERDNDFVKVTILTKQMQSAARLGVIGAEHASDVSQSVIQASLRNMKDLVDEDCLSEGNPDFATAVSTINELMDYLHSSKIICYSPQGRAYELPQGATALDFAYAVGPMVGNVAVGANIDKKPAKLGTVVKNGQLVEIEVNSHSEPKAEWLGFVVTNKARVEILRWFKDLSVADKQHHGRQALDRALKTYQKSLDDLTDSDWKNLTEWRGLTEKSALFEQISSGTLLPQLVVTRLFSDEVCDIQSQERIDDMTQPQQLIVNASGVELDFANCCHPIYGDPIVGHLSRHGLVVHRHKCFSLDDIRKDNPYQVIQLRWHNDKAIKQSDSEDHGNKIRFPAYLKLSIAMSDEQISKVIYNLRQLNIGVEKVDVRGSDTIIHIVVRSRNHLAQGIRELRSLLGFPNIMRLYQL

SEQ ID NO: 56210 - protein, 887 aa, Neisseria gonorrhoeae FA 1090
MSTQLHDVDPIETQEWLDALSSVLEYEGGERAQYLLENLLKYCRDKGVRMPHGTTTPYLNTVSVENEKGIPGDQNIEHRIRAFVRWNAAAIVLRAGKKDLELGGHIASFQSAATMYEVGFNHFWKAKGEGEEGDLVFFQGHVAPGIYARAFVEGRLTEDQLNNFRQEVDGHGLPSYPHPHLLPDFWQFPTVSMGLGPIMAIYQARFLKYLESRGLAKTKGRKVWCFCGDGEMDEPESQGAIALAAREGLDNLIFVINCNLQRLDGPVRGNGKIIQELEGNFAGAGWNVVKVIWGRRWDRLLAKDKDGILRQRMEECLDGDYQTYKSKDGAYVREHFFNTPELKALVADMTDEQLWALNRGGHDPQKVYNAYDRAANHADGKPTVILAKTIKGYGMGASGEGQNVAHQAKKMDKASLKQFRDRFDIPVTDEQIESGDLPYLTFAPDTEEYKYLHARRDALGGYLPQRKPTQEVLEVPELSAFDAQLKSSGEREFSTTMAFVRILSTLLKDKKIGKRVVPIVPDESRTFGMEGMFRQYGIWNPKGQQYTPQDKDQLMFYKESVDGQILQEGINEPGAMADWIAAATSYANSDFAMIPFYIYYSMFGFQRIGDLAWAAGDMHARGFLLGGTAGRTTLNGEGLQHEDGHSHIQADLIPNCVSYDPTFQYEVAVIVQDGLRRMYANNEDVFYYITLMNENYTHPDMPEGAEQDILKGMYLLKAGGKGDKKVQLMGSGTILQEVIAGAELLKADFGVEADIWSCPSFNLLHRDAIETERFNRLHPLEAEKVPFVTSQLQGHDGPVIAATDYIRSYADRIRAYIPNDYHVLGTDGFGRSDSRANLRRFFEVDRYNVAVAALAALAEQGKVSKETVQQAIEKYGIKADSAPSWKR

SEQ ID NO: 56211 - protein, 126 aa, Psychrobacter arcticus 273-4
MTRQTIQTDKAPAAVGTYSQAVKVGNTVYISGQLGFDPTTMELKEGFDAQAKQVFKNIKAICEAAGGSLNDVVKFNVSLTDLNDFAALNEVFMANLTEPYPARAAVQVAALPKGGVVEIESILYIE

SEQ ID NO: 56212 - protein, 500 aa, Vicia villosa
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSLVAMVPFGPYWKFVRKLIMNDLLNATTVNKLRPLRTQQIRKFLRVMAQGAEAQKPLDLTEELLKWTNSTISMMMLGEAEEIRDIAREVLKIYGEYSLTDFIWPLKHLKVGKYEKRIDDILNKFDPVVERVIKKRREIVRRRKNGEVVEGEVSGVFLDTLLEFAEDETTEIKITKDHIKGLVVDFFSAGIDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRGMCPGVNLATSGMATLLASLIQCFDLQVLGPQGQILKGGDAKVSMEERAGLTVPRAHSLVCVPLARIG

SEQ ID NO: 56213 - protein, 222 aa, Triticum aestivum
  misc_feature (77)..(77): Xaa can be any naturally occurring amino acid
  unsure (1)..(222): unsure at all Xaa locations
IPIPYAHRTAAPIHTPALAPRITAAPPRGTAHHSLRRTERARAARIQEPVVAAPEYCHANFSRYFTPAFWSDPALGXRVFAGRRRPPCYFNTGVMVVDLRRWRAGNYRRRIERWMEIQKERRIYELGSLPPFLLVFAGEVEAVDLRWNQHGLGGDNVRGSCRPLHDGPVSLMHWSGKGKPWDRLDAGRPCPLDHTWKSYDLYIAGDGGSAASPASGPAFSAW

SEQ ID NO: 56214 - protein, 500 aa, Lens culinaris
FLHLRPTPTAKSKALRHLPNPPSPKPRLPFIGHPHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQSAEAQKPLDVTEELLKWTNSTISMMMLGEAEEIRDIAREVLKIFGEYSLTDFIWPLKYLKVGKYEKRIDDILNKFDPVVERVIKKRREIVRRRKNGEVVEGEASGVFLDTLLEFAEDETMEIKITKEQIKGLVVDFFSAGTDSTAVATEWALAELINNPRVLQKAREEVYSVVGKDILVDEVDTQNLPYIRAIVKETFRMHPPLPVVKRKCTEECEINGHVIPEGALVLFNVWQVGRDPKYWDRPSEFRPERFLETGAEGEAGPLDLRGQHFQLLPFGSGRRMCPGVNLATSGMATLLASLIQCFDLQVLGPQGQILKGDDAKVSMEERAGLTVPRAHSLVCVPLARIG

SEQ ID NO: 56215 - protein, 500 aa, Lens culinaris
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMVLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGCVTPEGALILFNVWQVGRDPKYWDRPSEFRPERFLETGAEGEARPLDLRGRHFQLLPFGSGRRMCPGVNLATSGMATLLASLIQCFDLQVLGPQGQILKGGDAKVSMEERAGLTVPRAHSLVCVPLARIG

SEQ ID NO: 56216 - protein, 127 aa, marine gamma proteobacterium HTCC2080
MSNRAIISTEAAPAAIGPYSQAIKVGNTVWISGQIPLDPKTMTCVSGGIEAETQQVFANLAAIAEASGGELNDAVKINISVTDLGNFAAVNAIMEQHFDEPYPARACVEVAALPKGVAVEIEAILSL

SEQ ID NO: 56217 - protein, 467 aa, Bacillus thuringiensis serovar konkukian str. 97-27
MKSLLRKKALSTESPRQLQRTLTALDLTFLGIGAVIGTGIFVLTGIVAAKHSGPGIMLSFLIAAFTCACVAFCYAEFASSIPVSGSVYTYAYMTVGEVVAFIVGWCLMLEYLLAVAAVAVGWSGYLQSLLQGFNIHLPAIIASAPGVGKDGLIDLPAVCILLIITGLLSFGIRESARINNIMVLIKLAVIIAFIVAGAKYVKPENWTPFIPFGYDGIITGAATVFFAFLGFDAIATAAEETKKPQRDLPIGIIGSLLICTVLYMIVSFVLTGMVPYTQLDVSDPVAFALHFVGEDTIAGLLAVGAMTGMTTVLLVVMYGQVRVSYAMSRDGLLPKALARVNKRVKIPLLNTWITGVVAALLAGLLDLHVLANLVNIGTLTAFTFVCCAVLILRKTHPDLKRGFRTPFVPVLPVVAILCCLYLMINLSKTTWISFAVWLIVGLCFYFFYSRKHSHLATEKTNDEQKKA

SEQ ID NO: 56218 - protein, 380 aa, Pisum sativum
MAIECITSSAKLMTQKSDKNENEESSKLVFDASFLKNQLNLPKQFIWPDDEKPCMNVPELDVPLIDFKNFLSGDPFAAMEASKTIGEACEKHGFFLVVNHGIDTKLIEHAHSYMNDFFEVPLSQKQRCQRKTGEHCGYASSFTGRFSSNLPWKETLSFQFSDEKNSSNIVKDYLSNTLGEDFQQFGEVYQEYCEAMSKLSLGIMELLGMSLGVGKECFRDFFEENKSIMRLNYYPPCQKPDLTLGTGPHCDPTSLTILHQDQVGGLQVFVDNEWHSIRPNFNAFVVNIGDTFMALSNGRYKSCLHRAVVNNKTTRKSLAFFLCPKGDKVVSPPSELVNDLTPRIYPDFTWPMLLEFTQKHYRADMRTLEAFTKWIQQKQN

SEQ ID NO: 56219 - protein, 500 aa, Oryza sativa
MDTGMRVALHRQVSSGSLKESGELRRQSSLESPRTGRAATRFLFGRQSSMDPNRRRGRSQSPVGLAEDLTVPDNLDATMQLLFLACHGDAAGVEALLRGGVDVNSINLDGRTALHIASCEGHPDVVRVLLTWKANIDARDRWGSTAVADAKCYGHTEVYNLLKARGAKIPRNRRTPMMVSNPGDVPEYELNPSELQFKKGDEVVKGVYQVAKWNGTKVHVKILDRECYCDQEVINSFRHELTVLEKVRHPNVVQFVGAVTQNIPMMIISEYLPNGDLSSCIPRKGKLHGQKVLKYGLEIARGMTYLHQCKPDPIIHCDLKPKNIFLDSGGQLKIAGFGLTRLSKISPGRVKLADHESMVDSFSHYTAPELYRNEIFDASVDAFSFGFILYEMVEGTHTVHGKSSEESGHTIRYDGMRPSLKNKLRGYPPDFKALIEECWDTQGIARPTFSEIIIRLDKIYAQCMKQGTWKDSLKIWSVSRRFKNIRSKHFRTKKRVHVPM

SEQ ID NO: 56220 - protein, 124 aa, Salmonella enterica
MSLAKNGTNLFSGDKYAGLSEQALHYIGGVIKHAKAINALANPTTNSYKRLVPGYEAPVMLAYSARNRSASIRIPVVASPKARRIEVRFPDPAANPYLCFAALLMAGLDGIKNKIHPGEAMDKN

SEQ ID NO: 56221 - protein, 1046 aa, Wolbachia endosymbiont strain TRS of Brugia malayi
MISSIQEPNELRKRLQGFYRTDEKSYARYLVEKIELSADSKNRIYNIAKQVVEKIKGSKLDVIDSFMQQYSLSSDEGVALMCLAESLLRIPDDYTIDELIKDKIANQEWSKHLGRSSSLFVNASTWSLMIGSSVLRGNEEGPRFYHVISKLLKNFGEPIIRKAVKQAMLMLGKHFIVGETIEEALESIRSDSHSKFLCSFSILGEAAHTAENAEEYFNSYMHAIKAIGESTDTSDCFKSHGISIKFSSLHPRYEFCQFGNIAGELKTKVLELCHEAKKYNISLCIDAEESERLEMSLVLFEQLRLDESLSQWEGLGLAVQAYQKRALSVLDFVEDVAIRSKHKIMVRLVKGAYWDSEIKRTQELGLSSYPVFTRKSYTDVCYLACARKLLSKASHFYPCFGTHNAYTFATIVELADKNHPGFEFQRLHGIGKNLYDYAMSELATSIDCRIYAPVGKHSDLLPYLIRRLLENGANSSFVNQINGSDVKIEELISDPLEKAKSLGYEPHSSIPLPQDIFGEERKNSLGMDIGDSVTVSQFANDIKELSGKKWQVGPIINGESLFDSAKFIEVVNPAHLENVIGEVSNTTSDQALNALEVAHSAFIKWQNVSAEKRTVYLEKAADLLEEKMKELIYILIVEAGKVLSDAITEVREAVDFLRYYAIIARNELSNWKKLQGPTGEDNFIFFEGRGVFLCISPWNFPLAIFIGQVSAALAAGNAVLAKPAEQTPIIAYEAVKILHEAGIPKDVLHLIPGDGQYLGKALVPDNRISGVAFTGSTQTAQMINRMLASRNGPIVPFIAETGGLNAMIVDSSALLEQVTVDVLLSAFRSAGQRCSALKVLFIQEDIAEKQIKMICDAAQELKVGDPIQLSTDIGPIIDKASIDMLTKYTEKMSGDRDSSLLSKVPMDTNSHNGHFFSPYIYEIQKISQLKQEVFGPILHIIRFNKSQLNGVISDINNTGYGLTFSLQSRIQNQIDSISRKISVGNVYINRDQVGATVGVQPFGGRGLSGTGPKAGGPNYLQRFSTEKVVSVNTAAFGGNTKLMCLD

SEQ ID NO: 56222 - protein, 132 aa, Salmonella enterica
FGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAM

SEQ ID NO: 56223 - protein, 413 aa, Cucumis sativus
GDDVEDVRREVQIMHHLTGHPHIVELKEVYEDRHYVNLIMELCAGGELFDRIIAKGHYSECTAASLCRQIVTVVHNCHSMGVMHRDLKPENFLFLSADENSPLKATDFGLSVFFKPGDVFKDLVGSAYYVAPEVLRRRYGPEAAVWSAGVILYILLSGVPPFWAENDQGIFDAVLRGHIDFSSDPWPSISSGAKDLIRKLLHSDPKERLSAIEALNHPWMKEDGEASDKPLDIAVLTRMKQFRAMNKLKKVALKVIAENLSEEEIVGLKEMFKSMDTDNSGTITFEELKAGLPKLGTKLSESEVRQLMEAADVDGNGSIDYIEFITAAMHMNRVEREDHLFKAFEYFDKDKSGYITMEELETALKKYNMGDETTIKEIIAEVDTDNDGRINYDEVVAMMRKGNQELTTTSRQK

SEQ ID NO: 56224 - protein, 125 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 56225 - protein, 133 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 56226 - protein, 144 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 56227 - protein, 335 aa, Streptococcus pneumoniae TIGR4
MKRIAVLTSGGDAPGMNAAIRAVVRQAISEGMEVFGIYDGYAGMVAGEIHPLDAASVGDIISRGGTFLHSARYPEFAQLEGQLKGIEQLKKHGIEGVVVIGGDGSYHGAMRLTEHGFPAIGLPGTIDNDIVGTDFTIGFDTAVTTAMDAIDKIRDTSSSHRRTFVIEVMGRNAGDIALWAGIATGADEIIIPEAGFKMEDIVASIKAGYECGKKHNIIVLAEGVMSAAEFGQKLKEAGDTSDLRVTELGHIQRGGSPTARDRVLASRMGAHAVKLLKEGIGGVAVGIRNEKMVENPILGTAEEGALFSLTAEGKIVVNNPHKADIELSSLNKSLS

SEQ ID NO: 56228 - protein, 436 aa, Zea mays
MPPSLFTPRFRFSSAPVPEPLLGLIDLGASRDLSGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 56229 - protein, 307 aa, Pseudomonas putida
MTGMPQVLALGEAMIEFNQSTKGAPNYLQGFGGDVSNFLIAASRQGASSGFVSAVGNDHFGQLLLDLWRAENVDTSTVRVDANAPTGVYFVSHGESGHRFDYLRAGSAASRYAVSDLPLDAIAAAQVVHLSGISLAIGVPACDASLAAIDHAKRHGVKVSFDTNLRLKLWPLARARAVMLEAIRATDICLPSWDDVTELTGLADKDAIVDFLLALGPKVVALKLGKEGAYVATPAERRVVAGRVVKAVDATGAGDCFGGAFIARIVAGDDPFAAARYANVAAALSTQGFGAVAPIPDRATVEKALAE

SEQ ID NO: 56230 - protein, 130 aa, Pseudoalteromonas tunicata D2
MTKAIIKTDQAPAAIGTYSQAVKVGTAVYLSGQIPLVPATMTVISEDFTEQTHQVFKNLVAVCEAAGGSIQDMVKVNIFLTDLSNFATVNEVMSQYFTTPYPARAAIGVSALPRAVQIEIDGIMELPSTN

SEQ ID NO: 56231 - protein, 385 aa, Phaseolus vulgaris
MAIDMHPIPIMPQPSNQEIKEQDQHPLVFDASLLRHQLHIPSQFVWPDEEKACLNEPELPVPFIDLGGFLSGDPLAATEASRLVGEACQKHGFFLVVNHGIQQQLISDAHLYMDHFFALPLSHKQRAQRMPGEHCGYASSFTGRFSSKLPWKETLSFQYSPRNDSQTLVKDYLCDKMGKEFEKFGNVYQDYCEAMSNLSLGIMELLGLSLGVGRGYFREFFEENNSIMRLNYYPPCQKPDLTLGTGPHCDPTSLTILHQDQVGGLQVCVDNEWHSIKPDVNAFVVNVGDTFMALSNGRYKSCLHRAVVNSETTRKSLAFFLCPRSDKVVSPPCELVDKLSPRLYPDFTWPMLLEFTQKHYRADMKTLEAFTNWLQRRSNFDNHIM

SEQ ID NO: 56232 - protein, 192 aa, Aspergillus nidulans FGSC A4
MVVATIKCVVVGDGAVGKTCLLISYTTNKFPSEYVPTVFDNYAVTVMIGDEPYTLGLFDTAGQEDYDRLRPLSYPQTDVFLVCFSVTSPASFENVREKWFPEVHHHCPGVPCLIVGTQVDLRDDPAVRDKLARQKMQPIRKEDGDRMAKDLGAVKYVECSALTQYKLKDVFDEAIVAALEPAPKKRSRCVLL

SEQ ID NO: 56233 - protein, 421 aa, Arabidopsis thaliana
MLRLSSKSVARFRCVSKQWASMFASPYFRKLFQTRSSAKPSLLFAIADYGIEEDYSMKFFSSPQLENPYEKSSPTLVAAAEFHVKFSPDKLIPINHSYDPRYFSIGYASGLIYIYGDRYVARPLICNPNTGRYVILPNRYTYRKAYSFFGFDPIGKQYKALSIAYPSDPGRHKILTLGDGDLTWRKIKCPVPRPGIKGDGICINGVLYFLAERNELESDYVIVCFDVRSEKFTYIDVERICRLINYKGKLAMIYWEDDVDIYEINHMAGKNLDKYLEENLDVDATNELHVWVLEDVEKQEWSKYAYTWTDDTFFRRHLSIAGATVSGEIVFSIRKYTSKQPFYVFYFNPESNTLQRVETQGFGEAFKAETCSVRTFVNHVENLDVNDLKQLKSGHPPLVQPENYCLSDSDSESDGQGDEKR

SEQ ID NO: 56234 - protein, 309 aa, Salmonella enterica subsp. enterica serovar Paratyphi A str.
MKTAGNLIVLGSINADHILNLESFPTPGETVTGSHYQVAFGGKGANQAVAAGRSGANIAFIACTGDDDIGDSIRKQLVSDRIDIAPVSVIKGESTGVALIFVNGEGENVIGIHAGANAALSPALVDAQRERIAQADALLMQLESPLESVLAAAKIAHQHHTTVALNPAPARELPDELLALVDIITPNETEAEKLTGVRVENDDDAAKAAQVLHDKGIRTVLITLGSRGVWASVNGEGRRVPGFSVEAVDTIAAGDTFNGAFITAILEETPLPEAIRFAHAAAAIAVTRKGAQPSVPWREEIEAFLHQQG

SEQ ID NO: 56235 - protein, 128 aa, Salmonella enterica
FGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHP

SEQ ID NO: 56236 - protein, 194 aa, Glycine max
  misc_feature (110)..(111): Xaa can be any naturally occurring amino acid
  unsure (1)..(194): unsure at all Xaa locations
MLGRIRSGAIFQRFQGNGILSLNKIYSNCVTSSPRMQQKGLENVTVSEVLMTKGEENVGSWLWCRADDAVVNAMKNMADNNIGSLVVLKPEGQHIAGIVTERDCLKKIVXXGRSPLHTQVGQIMTDENNLITVTSDTNILKAMKIMTENHIRHVPVIDGKIVGMISIVDVVRAVMEQQSGELKRLNDYIRGQYY

SEQ ID NO: 56237 - protein, 108 aa, Brassica napus
MESSMSQKFTLVYASLLGVGGLMGYLKRGSKISVVAGGGSAALFYYVYKELPENPVLASSIGIVGSAALTGMMGSRYLRTRKVVPAGVVSMVSLVMTGAYLHGLIRSS

SEQ ID NO: 56238 - protein, 559 aa, Apium graveolens
MGSSGVSWKLADHPKLPKGKVVAMIVLDGWGEAHDNQYNCISVAETPTMDSLKNGAPDRWRLVRAHGTAVGLPTEDDMGNSEVGHNALGAGRIFAQGAKLCDLALESGKIYDGEGFNYIKESFESGTLHLIGLLSDGGVHSRIDQVLLLVKGASERGAKRIRVHALTDGRDVLDGSSVAFVETLQNYLSELREQGIDAQIASGGGRMYVTMDRYENDWDVVKRGWDAQVLGEAPYKFKSALEAVKTLRAEPKANDQYLPPFVIVDESGKAVGPIVDGDAVVTFNFRADRMVMAAKAFEYEDFDKFDRVRVPKIRYAGMLQYDGELKLPNHYLVSPPEIDRTSGEYLTHNGVRTFACSETVKFGHVTFFWNGNRSGYFDSEMEEYVEVPSDSGITFNVQPKMKALEIAEKARDAILSGKFHQVRVNLPNSDMVGHTGDIAATVVACKAADEAVKMILDTIEQVGGIYVVTADHGNAEDMVKRNKKGEPALDKDGKIQILTSHTLEPVPIAIGGPGLLPGVRYRKDVPSGGLANVAATVMNLHGFVAPDDYETTLIEVVDN

SEQ ID NO: 56239 - protein, 570 aa, Apium graveolens
MATGGDQDVYGEDCAAEDQLVTPWTISVASGYTLLRDPHHNKGLAFTEKERDAHYLRGLLPPAIISQQQQEKKLMQNLRSYEVPLHRYMAMMELQERNERLFYKLLIDNVEELLPVVYTPTVGEACQKYGSIFRRPQGLYISLKEKGKILEVLKNWPEKNIQVIVVTDGERILGLGDLGCQGMGIPVGKLALYTALGGVRPSACLPITIDVGTNNESLLNNEFYIGLKQRRATGKEYADLLQEFMTAVKQNYGEKVLVQFEDFANHNAFELLSKYSTTHLVFNDDIQGTASVVLSGIVSSLKLIGGMLADHTFLFLGAGEAGTGIAELIALEMSKQTKIHLEETRKKIWLVDSKGLIVSHRKESLQHFKKPWAHEHEPCTTLIDAVKAIKPTVLIGTSGQGKTFTKEVVEAMASFNKKPLIMALSNPTSQAECTAEEAYNWSEGRAVFASGSPFDPVKYNNQLYIPGQANNAYIFPGLGLGLVMSGAIRMHDEMLLAASEALACQVTQEHYDKGMTFPPFSNIRTISANIAAKVAAKAYDLGLATRLPRPEDLVKFAESCMYSPNYRIYR

SEQ ID NO: 56240 - protein, 500 aa, Lupinus albus
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVARVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVLLDTLLEFAEDETMEIKITKDHIKGLVVDFFSAGTDSTAVATEWALAELINNPKVLERAREEVYSVVGKDRLVDEVDTQNLPYIRAIVKETFRMHPPLPVVKRKCTEECEINGYVIPEGALILFNVWQVGRDPKYWDRPSEFRPERFLETEAEGEARPLDLRGQHFQLLPFGSGRRMCPGVILATSGMATLLASLIQCFDLQVLGPQGQILKGGDAKVSMEERAGLTVPRAHSLVCVPLARIG

SEQ ID NO: 56241 - protein, 472 aa, Rhodococcus sp. RHA1
MSETATPVPAQMHRGLQNRHIRMIGLGSAIGTGLFLVSGSTIQTAGPAVLLAYVLAGAVIFLIMRMLGEMAVHSPVAGSFSEYAREHCGPLVGFIAGWNWWMTCIVVSMLELTAVGTFMDFWFPGIPHWVTAAVALVLITGVNLIHVSAFGEFEFWFTLIKVAAVVAMIVFGVAIVFGAGHYDTAALSNLWNSGGFAPHGITGILLSLVAVTFTFGGIESLGTTAGEAKDPARSIPKAVNGVIVRILIFYVGAIGVMLMIWPWARVGVDGSPFVLMLDGLGVGGAATLLNIVVLVAALSVYNTMVYSNARVLHGMAAKKQAPALLAKTNHRGVPVTGIVINSAITAIVVLLNYLFPGQLLMILVAIILSAEIITWSTIAISHLRFRRTVGAGVFRSPLYPYTNYLVLAYLAGVVVLMTQLPDFRAGAIALPLWLAGLLAAALLYRRIRRNRDHASADTAAEAGRPLIDHTPT

SEQ ID NO: 56242 - protein, 499 aa, Trifolium repens
SHLRPTPSAISKALRHLPNPPSPRPRLPFIGHLHLLKDKLLHYAPIDLSKKHGPLFSLSFGSMPTVVASTPELFKLFLQTHEATSFNTRFQTSAIRHLTYDNSVAMVPFGPYWKFVRKLIMNDLLNATTVNKLRPLRTQQIRKFLRVMAQSAEAQKPLDVTEELLKWTNSTISMMMLGEAEEIRDIAREVLKIFGEYSLTDFIWPLKYLKVGKYEKRIDDILNKFDPVVERVIKKRREIVRRRKNGEVVEGEASGVFLDTLLEFAEDETMEIKITKEQIKGLVVDFFSAGTDSTAVVTEWALAELINNPRVLQKAREEVYSVVGKDRLVDEVDTQNLPYIRAIVKETFRMHPPLPVVKRKCTEECEINGYVIPEGALVLFNVWQVGRDPKYWDRPSESRPERFLETGAEGEAGPLDLRGQHFQLLPFGSGRRMCPGVSLATSGMATLLASLIQCFDLQVLGPQGQILKGDDAKVSMEERAGLTVPRAHSLVCVPLARIG

SEQ ID NO: 56243 - protein, 500 aa, Trifolium repens
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDNSVAMVPFGPYWKFVRKLIMNDLLNATTVNKLRPLRTQQIRKFLRVMAQSAEAQKPLDVTEELLKWTNSTISMMMLGEAEEIRDIAREVLKIFGEYSLTDFIWPLKYLKVGKYEKRIDDILNKFDPVVERVIKKRREIVRRRKNGEVVEGEASGVFLDTLLEFAEDETMEIKITKEQIKGLVVDFFSAGTDSTAVATEWALAELINNPKVLQKAREEAYSVVGKDRLVDEVDTQNLPYIRAIVKETFRMHPPLPVVKRKCTEECGINGYVIPEGALVLFNVWQVGRDPKYWDRPSEFRPERFLETGAEGEAGPLDLRGQHFQLLPFGSGRRMCPGVNLATSGMATLLASLIQCFDLQVLGPQGQILKGDDAKVSMEERAGLTVPRAHSLVCVPLARIG

SEQ ID NO: 56244 - protein, 499 aa, Beta vulgaris
LHLRPTPTAKSKALRHLPNPPSPKPRLPFIGHLHLLKDKLLHYALIDLSKKHGPLFSHYFGSMPTVVASTPELFKLFLQTNEATSFNTRFQTSAIRRLTYDSSVAMVPFGPYWKFVRKLIMNDLLNATTVNKLRPLRTQQIRKFLRAMAQGAEARKPLDLTEELLKWANSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHTKGLVVDFFSAGTDSTAVATEWALAELINNPKVLEKAREEVYSVVGKDRLVDEVDTQNLPYIRAIVKETFRMHPPLPVVKRKCTEECEINGYVIPEGALIPFNVWQVGRDPKYWDRPSEFRPERFLETGAEGEARPLDLRGQHFQLLPFGSGRRMCPGVNLATSGTATLLASLIQCFDLQVLGPQGQILKGGDAKVSMEERAGLTVPRAHSLVCVPLARIG

SEQ ID NO: 56245 - protein, 385 aa, Oryza sativa (japonica cultivar-group)
MGEEEKKEAAKAKEEEKPKQEEKPKEQEEGKKEEKPKEEGEKGKDGGGGEEKKDGEAAAAADAPPPPPPPEEVVMRVYMHCEGCARKVRKILKGFDGVEDVIADSKAHKVLVKGKKAAADPMKVVERVQKKTGRKVELLSPMPPPPEEKKEEEKKEEPEPPKPEEKKEPPVIAVVLKVHMHCEACAQGIRKRILKMKGVQSAEPDLKASEVTVKGVFEEAKLAEYVHKRTGKHAAIIKSEPVAPPEKVAAEGGDEKKAAEGGDEKKDEKEEKKDGKEEGGNGGGDEKKEEKEKEKEGGNADGEEKDKDKEKDPAAIAAANLYLHYPRFAFPAGYYPPGPGYAYPPPYPPSYPPPYQPSYPPYPSHPSHHPSQIFSDENPNACSVM

SEQ ID NO: 56246 - protein, 394 aa, Prochlorococcus marinus str. MIT 9313
MSQLETRTEPMVVNFGPHHPSMHGVLRLVVTLDGEDVVDCEPVIGYLHRGMEKIAENRTSVMFVPYVSRMDYAAGMFYEAIVVNAPERLANISVPKRASYIRVLMLELNRIANHLLWLGPFLADVGAQTPFFYIFREREMIYDLWEAATGQRLINNNYFRIGGVACDLPWGWLEKCQDFCDWFGPKIDEYEKLITNNPIFRRRIEGLGAIGRDEAINWSLSGPMLRASGVPWDLRKVDHYECYDDFDWDVAWEKEGDCYARYRVRIEEMRQSLKILRQACDMIPGGPTENLEAQRMAEGKTSPFMGFDYQYVAKKVAPTFKIPNGELYTRLESGKGEIGVFLQGNNDVTPWRFKIRAADLNNLQILPHILKGAKVADIMAILGSIDVIMGSVDR

SEQ ID NO: 56247 - protein, 365 aa, Saccharomyces cerevisiae
MVLAKQWVLKNLPTPGEPFNFHFHDPACTFELIEKELSSEQLKDGELLLETTYLSNDPAQKFWISSMDKNYAKGVQPGEIIPARGIGKVLASRNKAFSPGDYVSAVTGWTTHAIISQENVQGLRKLDKNKVGKLWWYLSVLGGTSLTAYFIFFTYAQLQEREEDYGKVYLISGAAGAVGTVCIQLALNVFKASKVIAIAGGPEKVAFVESFGDNVVGVDYKDPSFKQKLIEAAGGENTADYFIDNVGSNVLEAGVLLLKQRAMLIACGAISAYNDPSKFVFKGYSFILTKRLVVKGVLVTDNIDDFPKALDKLGSLVKHGKIDLLKSATLEDGTGDKFKNVPLIWKGLFSGVNKGKLITKVNNEE

SEQ ID NO: 56248 - protein, 500 aa, Beta vulgaris
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEDVEGEVSGVFLDTLLEFAEDETMEIKITKDHIKGLVVDFFSAGTDSTAVATEWALAELINNPKVLEKAREEVYSVVGKDRLVDEVDTQNLPYIRAIVKETFRMHPPLPVVKRKCIEECEINGYVIPEGALILFNVWQVGRDPKYWDRPSEFRPERFLETGAEGEARLLDLRGQHFQLLPFGSGRRMCPGVNLATSGMATLLASLIQCFDLQVLGPQGQILKGGDAKVSMEERAGLTVPRAHSLVCVPLARIG

SEQ ID NO: 56249 - protein, 358 aa, Arabidopsis thaliana
MGNHQADKKFAWVIKNFNSLDTTRVYSDTFKAGRCKWRLVAYPKRRDRYTTSFSLFLCVPDSESLPSGWRRRAKLIGYNKKYSSSRTMGNHQADKKFTWVIKNYNSLGSGSVYSDTFKAGRCKWRLLAFPKGNNIYDYFFLYICVPNSESLPSGWRRRAKVSFTMVNQIPGGLSQQREAVYWFDEKDTTHGFESMFLLSEIQSSDKGFLVNGEVKIVAEVDVLEVIGELDVPEEPERIDINGFQVPASQVESMNSLFEKYRGFASKIFPKNQHLRKTFLDVVLSMTEILCKFPEELSSGDLAEAYSALRFVTKAGFKLDWLEKKLKETGKSRLQEIEEDLKDLKVKCADMDALLDFLR

SEQ ID NO: 56250 - protein, 211 aa, Erythrobacter sp. NAP1
MDAMTDSVSQRLSRFDTAQRVPHPRIEQFQVKGFISPELCAELIRLIDLGRRPSTIADANGDDYFRTSETCDLDANETAVKELEARFFSLNGIDPKYGEPVQGQRYDVGQEFKAHTDYFTPGGADFEKFCAESGQRTWTFMIYLNEVEAGGATRFKVIKKSFQPETGKLVCWNNARPDGSVNPATLHHGMKVRKGVKYVITKWYREREWPW

SEQ ID NO: 56251 - protein, 171 aa, Triticum aestivum
LRERSPLAFCGIDAKMGMLLRYVKASSAYLGKSEDSIDFDITYYRSYTRGEPNPHSDVLDELQQMALRKYGAIPHWGKNRNFAFEGVIDKYPKADKFLEVKSRYDADGIFSSEWSDQVLGISGSPIIVEKGCAIEGLCVCSEHLHCAPEQGYYCRPGKVYTEARVCSFQPN

SEQ ID NO: 56252 - protein, 409 aa, Yarrowia lipolytica CLIB122
MATAEAVKASGVAGESSSASQRVAKSAPSTDPVIPVDIPLAVPTTNKELPPPRHSKPSQVLRGVIAVFYFLCACLSIVLTQWIGYPLKYQSKMAWVVWVEYTKQQFIVVMLCLVQALTSTEMRVSGDETMKGVFSVDGNGYLSSRFEERAIVIANHQLYTDWIYLWWFALTSGFGGCIYILLKKSLRSIPILGSGMANYNFIFLSRKWADDEQNMKEHFQGLNKLQAPVWLTMFPEGTNTSHNGTNNSNKFAAKIGVKPMKHVLLPRTTGLRFAIENLAQTVDYLYDCTLAYEGVGRGEYGQDFYTLGNVFLRGQGPVYVKAHWTKFVIKEIPYKDEKKFEKWLYDLWYDKDQMMDNFIETGKFFPDNEESEKIAKLQLAHPLQGLQVFVIPAAAALILRLGWKYWQTI

SEQ ID NO: 56253 - protein, 1251 aa, Oryza sativa (indica cultivar-group)
MIDALYNGGLNLVAQSWWTGAVWPVLWNLLKIVAIVAPLMGAVAYLTLWERKLLGFMQVRHGPNRVGPFGLLQPLADGLKLLTKEIIQPAAASKGLFVLGPVMAIMPALAACVAIPFGPDVALANGNAGLLLIMAITSIEVYGVIIAGWASNSKYAFLGALRASAQMVSYEIAMGFCFLVVIMVSGSMNLTQIVLSQGQGTMANAGLSFLSWNWLPLLPIFVVYLISGVAETNRHPFDVVEGEAEIVAGHMVEYSGMGFAIFFLAEYASMWLVSILGVTMFLGGWLSPVAALDFIPGWIWLGLKTFLVVSMFIWIRATFPRFRYDQIMRLGWKIFIPVTLDFFKSFMLVELVKGMALTGRYAFRRKVTVQFPEEKTPLSPRFRGLHALRRYENGEERCIACKLCEAVCPALAITIESDVRADGSRRTTRYDIDLTKCIFCGFCEESCPIRFMDAKTGFFYLFSVVLLYAAFRVITARNPVHAVLHLILAFSQAAAIWLLLKAEFLAIALVLVYLGAVMVLFLFVVMMLDIHIDTVRQGFWRHFPLAAFIGALIALEMAAVLMGGFRGMDEPKAVAAMVDAAGNVVQYSNTKALGKLLYTEYLYPVEIAAVILLVAMIAAIALTLRQRKDTKVTKVSEQPPRRRRHDVDPGPFPVAGRDAVRAVGDRHLPEPQEPHRAAHGHRADAPGREHELRRVLPLPGRHARAASTRKISTPSRADPPVLARSSRMSQTLSASMLLAVPLAPLAGSALAGILGTAFGGNRIGRRASHTLTILGVFVAFVLSALTFKSVALDGARFNETLYTWMVVGGLKMEVGFLIDTLTAMMMCVVTFVSLMVHIYTIGYMEEDDGYNRFFSYISLFTFSMLMLVMSNNLLQLFFGWEAVGLVSYLLIGFWFNKPTAIFANMKAFLVNRVGDFGFILGIGLIAAYTGTLNYGEIFAKSGELGTIGFPGTNWMLITVICICLFIGAMGKSAQFPLHVWLPDSMEGPTPISALIHAATMVTAGIFMVSRMSPLFELSDTALNFILVIGAITALFMGFLGMIQNDIKRVVAYSTLSQLGYMTVALGASAYSVAVFHLMTHAFFKALLFLGAGSVIMGMHHNQDIRWMASCASHAHHLDHLAAGFPWPLIGHAPCFRGFYSQGTAFIERPCTATHRCPAAGLSRTFARAWPGRVSSPAVLFRFPHVRSWGPSHGQGAATDPEPGYAANTDRSTYAAQTTHGHRPMDTTPQARTESPLGGDGAAGAAGDPPRW

SEQ ID NO: 56254 - protein, 370 aa, Saccharomyces cerevisiae
MNIQSNNSPNLSNNIVSKQVYYAHPPPTIDPNDPVQISFPTTEVVGHGSFGVVFATVIQETNEKVAIKKVLQDKRFKNRELEIMKMLSHINIIDLKYFFYERDSQDEIYLNLILEYMPQSLYQRLRHFVHQRTPMSRLEIKYYMFQLFKSLNYLHHFANVCHRDIKPQNLLVDPETWSLKLCDFGSAKQLKPTEPNVSYICSRYYRAPELIFGATNYTNQIDIWSSGCVMAELLLGQPMFPGESGIDQLVEIIKILGTPSKQEICSMNPNYMEHKFPQIKPIPLSRVFKKEDDQTVEFLADVLKYDPLERFNALQCLCSPYFDELKLDDGRINQITTDLKLLEFDENVELGHLSPDELSSVKKKLYPKSK

SEQ ID NO: 56255 - protein, 236 aa, Oryza sativa (indica cultivar-group)
MVEILWTMEAKREFFFCSGRLGFTNVALVLFTTWFYSYEWCGGFSINEHVPKTNGDIPSVDEAFSDHQRLLHRLELYDLAELKVEGDGNCQHVSYTQFRALSDQFYRTTEHHRFVRQQIVKQLESYPEIYAGYVPMDYREYLKKMIKHFHFVATKSTRNGEWGDHVTLQAAADSYGVKIFILTSFRDTCYIEILPVVQKSERVICLSFWAEVHYNSIYPEGELPVMENKRKRWWHF

SEQ ID NO: 56256 - protein, 436 aa, Actinobacillus pleuropneumoniae serovar 1 str. 4074
MAKIVKVIGREIIDSRGNPTVEAEVHLEGGFVGLAAAPSGASTGSREALELRDGDKSRFLGKGVLKAVSAVNNEIAQAILGKDGSAQAEIDQIMIDLDGTDNKSKFGANAILAVSLATAKAAAASKGLPLYAYIAELNGTPGVYSMPLPMMNIINGGEHADNNVDIQEFMIQPVGASTLKEALRIGAEVFHNLAKVLKSKGLNTAVGDEGGFAPNLASNADALACIKEAVEKAGYVLGKDVTLAMDCASSEFYNKENGLYEMKGEGKSFTSQEFTHYLEGLCNEYPIKSIEDGQDESDWEGFAYQTKVLGGKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALAAAGTPAPFNGLKEVKGQA

SEQ ID NO: 56257 - protein, 309 aa, Salmonella enterica subsp. enterica serovar Paratyphi A str.
MTTKKADYIWFNGEMVRWEDAKVHVMSHALHYGTSVFEGIRCYDSHKGPVVFRHREHMQRLRDSAKIYRFPVSQSIDELMEACRDVIRKNNLTSAYIRPLVFVGDVGMGVNPPPGYTTDVIIAAFPWGAYLGAEALDQGIDAMVSSWNRAAPNTIPTAAKAGGNYLSSLLVGSEARRHGYQEGIALDVNGYISEGAGENLFEVKDGVLFTPPFTSSALPGITRDAIIKLAKELGIEVREQVLSRESLYLADEVFMSGTAAEITPVRSVDGIQVGEGRCGPVTKRIQQAFFGLFTGETEDKWGWLDPVIS

SEQ ID NO: 56258 - protein, 336 aa, Triticum aestivum
AYLGDFQNKFVQKSRLLPVRNSRDIVDPRVRQELIKELSVPPPGYEDLSFPTKYSQNFYNQCVANFWKQYKSYWKNPAHNAMRFLMTLIYALVFGTVFWQKGTKINSQQDLANLLGATYAAVFFLGSANCITVQPVVAIERTVFYREKAAGMYSPLAYAFTQTCVEVMHNIVQGIEYTLIIYSMIGYEWKAAKFFYFLFFIISCFNYFTLFGMMLVALSSSAMLANIIIAFVLPLWNLFSGFLVMRPLIPIWWRWYYWANPVSWTIYGVIGSQFGDNTSPVSVTGGSLVVVKQFLEDGMGIKHDFLGYVVLAHFAYVIGFFLVFAYSIKVLNFQKR

SEQ ID NO: 56259 - protein, 538 aa, Acidovorax sp. JS42
MQHDKILILDFGSQVTQLIARRVRETHVYCEVHPCDVSSDWVRQFAADGKLKGVILSGSHASVYEVDDRAPDAVFELGVPVLGICYGMQTMAAQLGGKVEGSHSREFGYAEVRAHGHTALLKGIEDFSTPEGHGMLKVWMSHGDKVTELPPGFKLMCSTGSCPIAGMADETRRFYAVQFHPEVTHTVQGAALLNRFVREICGAQADWIMRDHIEEAVQKIREQVGDEEVILGLSGGVDSSVAAALIHRAIGDQLTCVFVDHGLLRLNEGDMVMDMFAGKLHAKVVRVDASDLFLGELAGVSEPEQKRKIIGRLFVDVFKAEAEKLKASGQGHKGATFLAQGTIYPDVIESGGAKSKKAVTIKSHHNVGGLPEQLGLKLLEPLRDLFKDEVRELGVALGLPREMVYRHPFPGPGLGVRILGEVKKEYADLLRRADAIFIEELRNFTDEATGKTWYDLTSQAFTVFLPVKSVGVMGDGRTYDYVVALRAVQTSDFMTADWAELPYALLKKVSSRIINEVRGINRVTYDVSSKPPATIEWE

SEQ ID NO: 56260 - protein, 776 aa, Oryza sativa (japonica cultivar-group)
MPRSLLTGWLRECFISQVHKQPCHIVYTDYRPTPLQHYVFPSGGDGLYLVVDEKSKFREDSFQKGLNALVPASENDKKRENGKWQKGLLTGKPSEDSDIFKMVKMIIQRQYDPVILFSFSKRECEFLAMQMAKMDLNDDDEKANIETIFWSAMDLLSDDDKKLPQVSNMLPLLKRGIGVHHSGLLPILKEVIEILFQEGLIKCLFATETFSIGLNMPAKTVVFTNVRKFDGDRFRWLSSGEYIQMSGRAGRRGIDQRGICILMVDEKMEPSTAKMILKGSADSLNSAFHLSYNMLLNQIRCEDGDPEKLLRHSFYQFQADRVLPDLEKQVKELELERNSMIIEEEENLKSYYDLLQQYKNLKKDVRDIVHSPKYVLPFLQPGRLARVQYSTDEQSTFSIDENITWGVTINFEKVKTHSEDRRPEDSDYTVDVLTRCSVSKDKSGKKTMKIIPLKDRGEPVVISLPLSQIDGLSSIRMHIPKDLLPVEARENTLRKVDEVISRFAKDGIPLLDPEEDMKVQSSSFRKASRRIEALESLFEKHDVHNSPHIKQKLKVLHAKQELSTKIKAIKRTMRSSTALAFKDELKARKRVLRRLGYITSEDVVEVKGKVACEISSADELTLTELMFSGTLKDATVEQMVALLSCFVWQEKLQDAPKPREELDLLFFQLQETARRVANLQLDCKIQIDVESFVNSFRPDIMEAVYSWAKGSKFYQIMEMTQVFEGSLIRAIRRLEEVLQQLILASKSIGETQLEAKLEEAVSKIKRDIVFAASLYL

SEQ ID NO: 56261 - protein, 326 aa, Zea mays
MAPALSFPIIDMGLLAGEERPAAMERLQDACENWGFFEILNHGISTELMDEVEKLTKEHYKRVREQRFLEFASKTLGDGRDIAQGVKAENLDWESTFFVRHLPEPNIAEIPDLDDEYRRVMKRFAGELEALAERLLDLLCENLGLDRGYLARAFRGPSKGAPTFGTKVSSYPPCPRPDLVSGLRAHTDAGGIILLFQDDRVGGLQLLKDGEWVDVPPMRHAVVVNLGDQLEVITNGRYKSVMHRVVAQPSGNRMSIASFYNPGSDAVIFPAPALVKAEEAAAGVYPSFVFEDYMKLYVRHKFEAKEPRFEAFKSMETDSSNRIAIA

SEQ ID NO: 56262 - protein, 286 aa, Streptococcus pneumoniae TIGR4
MDLWFSEVHTPDVKLSLRTAKQLYAGKSEWQDIEVLDTPAFGKILILNGHVLFSDADDFVYNEMTVHVPMAVHPNPKKVLVIGGGDGGVAQVLTLYPELEQIDIVEPDEMLVEVCREYFPDFAAGLDDPRVTIYYQNGLRFLRNCEDDYDIIINDATDPFGHTEGLFTKEFYGNSYRALKEDGIMIYQHGSPFFDEDESACRSMHRKVNQAFPISRVYQAHIPTSPAGYWLFGFASKKYHPVKDFDKEGWKKRQLFTEYYTANLHVGAFMLPKYVEDILEEEEGKK

SEQ ID NO: 56263 - protein, 378 aa, Oryza sativa
  misc_feature (231)..(231): Xaa can be any naturally occurring amino acid
  misc_feature (255)..(255): Xaa can be any naturally occurring amino acid
  unsure (1)..(378): unsure at all Xaa locations
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPILLTEAPLNPKANREKMTQIMFETFNAPAMYVAIQAVLSLYASGRTTGIVLDSGDGVTHTVPIYEGYALPHAILRLDLAGRDLTDCLMKILTERGYSFTTTAEREIVRDIKEKLAYIALDYEQELEXAKSSSSVEKSYELPDGQVITIGAXERFRCPEVLFQPSLIGMEAPGIHETTYNSIMKCDVDIRKDLYGNIVLSGGTTMFPGIADRMSKEITALAPSSMKIKVVAPPERKYSVWIGGSILASLSTFQQMWISKGEYDESGPSIVHRKCF

SEQ ID NO: 56264 - protein, 368 aa, Oryza sativa (japonica cultivar-group)
METLSMLKVGYTLLRSETPATDLVNAFMDWAARRSLLLLAVFVPPYLAYRLASSALAAASPEDVAGKVVLVTGASSGIGEQVAYRYARRGARLALVARREASLGEVAARARALGSPDVLAVPGDVARPDDCRRFVQATVEHFGRLDHLVNNAGLANVCWFEEVPDVANFKQVLDVNFWGTVHPTHAALPHLKASRGKIFVNSSASAVLAMPRMSFYNASKAAVHNFAETLRMELHGEVGVTVATPGWVDSEMTKGKHLSSHGAMEVDQDTRDAQVGVFPVERGERCAEAIVDAVARGRRRVTSPAWYGALFLWRTMAPEVADACQRVFYHRRSSAAGGGGRARAALEATGAKAVLQPPSLRSSEIKVE

SEQ ID NO: 56265 - protein, 334 aa, Xylella fastidiosa 9a5c
MAIKVGINGFGRIGRNILRSAVQNFGSNIDIVAINDLLEPDYLAYMLQYDSVHGRFKGEIAIEGTALILNGKKIRLTAERDPGNLQWADAGAEIVIESTGLFLTQESAGKHLAAGAKKVIISAPSKDETPMFVYGVNHNSYNGEPIVSNASCTTNCLAPLAKVINDKWGITRGLMTTVHAATATQKTVDGPSNKDWRGGRGILENIIPSSTGAAKAVGKVIPSLNGKFTGMSFRVPTSDVSVVDLTVQLNTPATYKEICTEVKQQSEGPLRGILGYTEDKVVATDFRGETCTCVFDADAGIALDPTFIKLIAWYDNEWGYSNKCLEIAKVIAAK

SEQ ID NO: 56266 - protein, 312 aa, Leptospira interrogans serovar Copenhageni str. Fiocruz L1-130
MTFHHKEFHILSSSDKSKLYCQSWTKSNSNRLLIFHHGFGEHSGRYTNLIRYFSKSDINFYSFDMRGHGNSDGKRGHSDSFDLYVRDLADFVSEVLKREQKERFFLLGHSLGGAITLRYSQEGINQDNILGLILGSPALRVRMDFRKKLKKFAAGILSKISPSSVVDAELDLQYLSHDPEVIESYKQDPLVHGKVSLKMGTELLEIGPQLIKKANVLRCPVLILHGQEDGLVDVNGSTELYKNLIYRNKRIKIYPGFYHELMNEFPEHREIVLNDIQTFLETIQREKIDFESLKLQRKEVVSRKKRNPVSNP

SEQ ID NO: 56267 - protein, 221 aa, Aspergillus nidulans FGSC A4
MSFMRAGNIACSRVGRLVTYRNTRMLSATAFRAETSVKPSSSVADAPTTPLSESTLIQKETPAEAMTRHQPDYDATVDHGTSKFSPVPKRVMDGSEPGETVPAAVLSGAPTDLQARTVRIFRPSKPATQSGEWHSHHWRMDWDILQKGHRWENPLMGWQSSADAMQGTHLNFKTKEDAILFAQKQGYEYFVQEPNERKFVPKAYANNFVHEPKKLKHIRTK

SEQ ID NO: 56268 - protein, 420 aa, Zygosaccharomyces rouxii
MATHEEFIRTQVFGTVFEITNRYTDLNPVGMGAFGLVCSATDTLVGQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFSEMIEGKPLFPGKDHVHQFSIITDLLGSPPRDVINTICSENTLKFVTSLPHRDPVPFQERFKTVEPDAVDLLRRMLVFVPKKRITAADALVHPYLAPYHDPTDEPTAEAQFDWDFNDADLPVDTWRVMMYSEILDFHKIGGGDGQIDTNAAFDDQVAAAHAAAMAQHHHQTQQQSSGKHTNPTTSSSAATITVTVPIAITMPSLIMVIKRFTT

SEQ ID NO: 56269 - protein, 800 aa, Yarrowia lipolytica CLIB122
MPPTKTQTHPDIQPVTEDRRSLTVKSLDDRYVLLKNIGKGSFGHVSLARVRSKAAMENEDMRAGSMVAIKTMKKKLAAIDDYNLLREVEFIREVRPHRFLVNVHDMFVDSVNHHFHMSMEVMEMNLYNLMKAQEKVPFQPHAVRSMLWQIICGIDHIHRHNFFHRDIKPENILVSRYLPYHNENSSSPHSGFRIKIADFGLSRHIEDRDPYTAYVSTRWYRAPEILLRCEYYSAPVDIWAFGAMAAEVANLKPLFPGTNELDQFSLQVALLGTPGQNSLGGRWSRHPELCSKLNINIDAQTGQSSNSIMCNPEHASLTDVVLMCLTWDPDARCSARDIMYHRYFAQESSIEVPRTLKRSPLRITKQAAMNPHGDPPILMDPSLRHNNSNANNSAIVPTLASSLKQNQGLQMNKSHLSGVNGSTKRNSLSGAAAAAAMSMSLSLASKNSSVNSGGAGFLAGAAPAKKKFGHWANIFKRDSDVASSELERVGPNKENVPSIVPTQTPNRGAGGVGIVPKIPLPQLPPLETIAASIESLSIEARSTNTTLTERMTSGPPTGGTSDSEWSTTNASISESVGHDSGAGSSGAVDKGSTGTTNFEVEALMESTEARVTVKTLPQTPDSASSYDQMPPPPLPLPKVRVTAKPLNAIKPESPTQVQVSLSPQPCIKPPSPASSHYEPPACLDEHSDSQLTAYERSVRDSVLLMSFTLPPSSQESCTSLEGASESPSVNDSPLVDQFGGSSSDIRIETTSFLTPDLDKGNVWVRSEELECPVYPGLQTNSFRDRKIGAGAISSNNIEVE

SEQ ID NO: 56270 - protein, 601 aa, Aspergillus nidulans FGSC A4
MSSAAVIAFFIYDATTYRESSSAEDIPVSELALNPRRGGPKNLPIAEVLIGDDDSEAMQAQKDKPRLVILGTGWGSIALLKELNPGDYHVTVVSPTNYFLFTPMLPSATVGTLGLRSLVEPVRRIVQRVHGHFLKGEAVDVDFSEKLVEITQINHKGEKEQFYLPYDKLVIGVGCVTNPHGVKGLEHCHFLKSIDDARRIKNQVLDNMELACLPTTTDEERKRLLSFVVCGGGPTGVEFASELFDLLNEDLLYSFPKILRNEISVHIIQSRSHILNTYDEALSKFAESRFARDDVDVLTNARVKEVREDKVVFTQLEDGKTVTKEIPMGFCLWSTGVGRSDFCSRLSDKLEAQNNKHALETDSHLRLIGAPLGDVYAIGDCATVQNKVADHIVSFLRTIAWEKGKDPQKVHLTFREWRDVAARVKKRFPQASNHLRRLDRLFEQYDKDHSGTLDFEELSELLHQIDTKLTSLPATAQRANQQGQYLGRKLTKIAAAMPGMQANQIDYGDLDEAVYKAFNYKHLGSLAYISNAAIFDFGGLNFGGGVLAMYLWRSVYFAESVSLRTRVMLAMDWAKRALFGRVYCSMGMQSAISHRLCQSSY

SEQ ID NO: 56271 - protein, 365 aa, Synechococcus elongatus PCC 7942
MTRSYRITLLPGDGIGPEIMAVTVDILRAIGRQFDLNFEFEEALIGGSAIDATGEPLPEATLATCRNSDAVLLAAIGGYKWDSLPRSQRPETGLLGLRAGLGLFANLRPAAILPQLVDASSLKREVIEGVDLMVVRELTGGIYFGEPKGCFADEQGRQRAFNTMVYREDEIDRIGRVAFDIARKRGKRLCSVDKANVLEVSQLWRDRMTLLGSDYADVELSHLYVDNAAMQLVRWPKQFDTIVTGNLFGDILSDIAAMLTGSIGMLPSASLGAEGPGVFEPVHGSAPDIAGQDKANPLAQVLSAAMMLRYGLDEPEAAARIEAAVNQVLDQGYRTGDLYSEGMTLVGCKGMGDALLAALESPVSA

SEQ ID NO: 56272 - protein, 1118 aa, Solanum lycopersicum
MSSSSTTNKTNCSRGSSARSRRSARVIAQTPVDAKLHVEFEESEQQFDYSSSVNLSNSTSNVPSSTVSDYLQKMQRGSLIQPFGCMIAIDAQNFAVIAYSENAPEMLDLTPHAVPSIEQQEALTFGTDVRKLFRSSGASALEKAVSFGELSLLNPILVHCKNSGKPFYAILHRIEVGLVIDLEPVDPHEVPVTTAGAIKSYKLAAKAIRKLQSLPSGDISLLCDVLVREVSHLTGYDRVMVYKFHEDEHGEVVAECRTPELEPYLGLHYPATDIPQASRFLFMKNKVRMICDCLAPPIRVIQDPRLAQSLSLGGSTLRAPHGCHAQYMTNMGTVASMAMSVMINEQDDELDSDQQVGRKLWGLVVCHHTCPRFLSFPLRYASEFLLQVFSVQVNKEVEMAAQLKEKQILQIQTVLCDMLLRDAPMGIVTQSPNVMDLVKCDGAALYYRNKLWLHGVTPAESQIRDIAEWLNESHGDSTGLNTDSLMEAGFPGASVLGDAVCGMAAVKITSKDFLFWFRSHTAKEIKWGGAKHLPGDKDDGRKMHPRSSFKAFLEVVKRRSLPWEDVEMDAIHSLQLILRGSLQDEAADCSKMIVNVPAVDTIIDRVDTLHINDMVRLVETASMPVLAVDTSGRINGWNSKVSELTGLPVENVIGVPLVDLVIGGTTNTIKRVLSLALQGKEEKNVEIKLRTLGPQEKVGSISIVVNACCSRDFKQNIVGVCFTGKDVTGLKLIKDKYSRVQGDYVGIIHSPSPLIPPIFVMDEQGRCVEWNDAMHKLTGSKREEVIDQMLLGEVFTVNSFGCRVKDQDTLTQLTILLNRVIAGGEGEKLFFGLFNKQDKYIEALISANKKVDDDGRVTGVLCFLHVPSPELQYAMHVQKLSEQAAKNSLKKLAYVRLELKNPLNGINCIQNLLKSSDLSKDQRQLLKTSTMCQKQLAKIIDDTDIESIEECYTEMNSCEFNLGEVVTVVINQVMILSQERKVQVTWDSPVEVSQLYLIGDNLRLQQVLSDFLTTAILFTPFEDSSVHFRVIPRKERIGTKMYIMHLEFRITHPSPGIPDDLIQHMFHYSRSISREGFGLYISQKLVKIMDGTVQYLREADRSSFIILVEFPLMEKKNN

SEQ ID NO: 56273 - protein, 141 aa, Xylella fastidiosa 9a5c
MVLERTLSIIKPDAVAKNVIGDIYSRFEKAGLKVVAAKYKQLSRREAEGFYAVHRDRPFFNALVEFMISGPVMIQVLESENAVARHRELLGATNPKDAALGTIRADFAESIEANAAHGSDSVENAAIEVAYFFAATEIILR

SEQ ID NO: 56274 - protein, 406 aa, Xylella fastidiosa 9a5c
MNGFAVIPSVTTTTTSGEPIAGDVARKQNLLELNREGLERFFENVLGEKRYRAHQVMKWIHHRYVSDFEQMTDVGKALRARLQACAEVRVPCVVFDKHSADGTHKWLLAMDTDSKNAIETVYIPDKGRGTLCVSSQIGCGLNCTFCSTATQGFNRNLTTAEIIGQVWVAARHLGNVPHQQRRLTNVVMMGMGEPLMNFDNVVRAMSVMRDDLGYGLSNKRVTLSTSGLVPMIDRLSTESDVSLAVSLHAPNDKLREQLVPLNKKYPIAELMASCERYLSVNRKRDSVTFEYTLMKGVNDKQEHAHELVKLMRQFDCAMQVKGAAKVNLIPFNPFPGTYYERSTEVDIRAFQKILLDAQILAMVRRTRGDDIDAACGQLKGQVVDRTRRQAEFRRTIEDRVGRDVAA

SEQ ID NO: 56275 - protein, 357 aa, Oryza sativa (japonica cultivar-group)
MAARSCRFLYSSSSSPIATTSPLLSPTPSAATRRKLLLSSTCGTIASAAAASAMEGQGAPAAPGGKGSAIVVVDSHLHVWASPQQAAERYPYFPGQEPPIRGDVDLLLQCMDEAGVDGALIVQPINHMFDHSLVTSVLKKYPSKFIGCCLANPADDGSGIKQLEHLIVQEKYRAVRFNPNLWPSGQKMTNEVGRSLFAKAGELGAPVGIMVMKGISTYIQEIEELCTDYPKTTVIFDHMAFCKPPMNIEEEKAFTSFLELSRFPQIYVKYSALFRISREAYPYEDTSQLLSRVISSYGANRIMWGSDFPFVVPECGYKGAKEAISHVAGKIPVSSSDLEWILGKTVTQLFQGAWVSA

SEQ ID NO: 56276 - protein, 647 aa, Oryza sativa (japonica cultivar-group)
MVSPNIDNLTANTFSITMPAHYPAVEFYYNGVGGEQNIEEFYYNGASTEQNMAFPTMDTHAANIFSFDASINHSAEEFRQISAGGELNTVCPNIDTPLAANAFSFVAPVHYSDANADLHLHVVDAGGEQDTVAAIVDVIGIPASPPSPAPASITNATVKSVWRENYREQFKLVVDALHQPRRHLYIAVDMEFAADATTNIRRRPVTSTGCYHHLREFVNRGDIVQMGLAFVFVGGGEQSSSSSSPPPITLEINFKINIKARKYNKKSIAFLSRQGHDLREHRRRGVSPRRFYEGLLRHLPFGDGRSVTWLAYHSDYDLGFLLRLLQCGGRRRGGGDLPRQLAAFLRRLRENFPAFYDVRVIRQMLEDHGFSGKLTGLAEHLGIRRTGGAAHHAGSDALLTLSCFFKIFRSLSGQQLHQLDARRGLLAGLEEWNMAIKCARHIDDHTRNIKVIEVVAENLDEEARRIGELVASNFSIIGVDVNQVVIHPRLGRKGYEMIIAFMNPEGMLAYGRAWKFCISRFTSDNNGNVLNLKQLVELMQSCGATNNPDVSWVTFQGSDVIYRLIRSANGGVIPSLISGESYFPSLYDVALIVGGFHGIGTLATTDRKVGIFDVARALKLKAIKADKEAERVLLTLRCFMRLAELIP

SEQ ID NO: 56277 - protein, 514 aa, Magnetospirillum magnetotacticum MS-1
TDSPSRVWARFIAEERNSPEAAEAITGVDPQEIRKAARLYATGGNAAIYYGLGVTEHSQGSTMVMGMANIAMATGNIGKVGAGVNPLRGQNNVQGSCDMGSFPHELTGYRHVSDDATRESFEAIWGAKLDSAPGLRITNMLDEAVGGSFKGMYIQGEDIAQSDPDTHHVTSGLKAMECIVIQDIFLNETAKYAHVFLPGASFLEKDGTFTNAERRISRVRKVMAPLGGYGDWEGTIMLARALGYEMNYSHPSEIMDEIARLTPSFTGVSYQKLEELGSIQWPCNEKAPLGTPMMHVDRFVRGKGRFMITEYVATDERTTGKFPLILTTGRILSQYNVGAQTRRTENSRWHEEDVLEIHPFDAEMRGIVDGDLVSLESRSGDIALKAKVTERMQPGIVYTTFHHAKTGANVITTDYSDWATNCPEYKVTAVQVRRTNRPSDWAGQVLRGRLLAHPHRASRGVIFGERRRDIRSGSPTHPPHPEAPERSGGLEGGLQTALQVLKPSFEARQGGHLG

SEQ ID NO: 56278 - protein, 527 aa, Gibberella zeae PH-1
MKFFSSKRQEHAAEGEHLERRKTPDTDGRITFLACFMGLVASMGGMIFGYSSGQISGYFMMKDYGERFGVPNGDGTYEFSAARQGTITGLLSVGCLFGSLIAGNLCDTIGRRTTISISALWTCVGTVIEVASQHAWYQHAIGRLVTGLGVGALSVAVPMYQSESAPAIIRGIIVSCYQLFVTLGIWCAEMVNWGTNHYDGSASWRIPNGLNFLWALLLGVGILFLPESPRFAYRKGKEEEARKTIANLAGLDINSPSVNRQIDEIREKLEEERSLPETRWVEIFTGPRMMYRTLLGITLQAGQQLTGINFFFYFGTTVFASTGLKDSYVTQLILGSVNCACTFGGLYVVQKCGRRISLMIGAAWMMMCFFIYAFVGHFALDRADPLNTPAAGTVLVTFSCLAIVAFATTWGPLVWAVVAEMYPSQYRSRCMAIATATNWLFNFLIGFFTRFITDAIDYYYGLVYAGCCAALVAIVFFFVIESKDRTLEEIDTMYVQKVNPITSSKWVGHNHASKAAREGVTDEEVSS

SEQ ID NO: 56279 - protein, 240 aa, Triticum aestivum
  misc_feature (225)..(226): Xaa can be any naturally occurring amino acid
  misc_feature (231)..(231): Xaa can be any naturally occurring amino acid
  unsure (1)..(240): unsure at all Xaa locations
MSKLFHSACKAARSLIASSSAPAPRAASSLLADGRNAALATLANLGRNSTLPAAYAHHLHTNASSHGYAWIAAIPAAAYMLQDQDVHAAEMERTFIAIKPDGVQRGLISEIVSRFERKGYKLVAIKLVVPSKQFAEKHYHDLKERPFFSGLCDFLSSGPVLAMVWEGEGVIKYGRKLIGATDPSKSEPGTIRGDLAVVVGRNIIHGSDGPETAKDEIALWFQPKXXVSYTXNEEKWITCD

SEQ ID NO: 56280 - protein, 1434 aa, Gibberella zeae PH-1
MIHQPLPNLISHIHHGRIQQIAMKLSRLTLYMTLTAGCRGAYVQFQDCSEAHDSSSLIPESFRASVERGRDTFDWKFDFIAGLTNRNSCEVDLSNIVPRFSIVDHGNDTPYISGQIVNVSCLTSQRIGSRSKFTIITSFNRSTLLETYKTTFELTNSNNTALSCIKAVLTPAVPGPIRILGLWFPIITFALACVAACWPVRRGPGPNSSKNSLVARAIDVLAYIQFIFFSGSMSLKYPGFFQPLVGLSGWSTLMLPAGVVESRSPYARQGVNDGIYEHNGTITGAPGLELLTQMTGSAVKPQSWMNTFVLSLFVFVSLYIFSFIIHRLGNTNSNARSASANLESSFRTPYWAVSTVGFLPGGTGHSGKILVAYIALCGHVIVLVCIFLIPTLFDLSKLAFGREPAVLSDIESDMQSTTADTLFGGNNELVKFSSSKSSVSNKTLWDMILSRETKMFGDKTVSRIQPEVLSLFMRKVQGEDEHTNVCEISRGFNGSSNTLVGSTQSDEEIKSAVDVSPDALASYLVCKGNLALPTAPTYQDLDRPINEYFISTSHNTYLLGRQVATRSKLEGYIEALSKGCRSVEIDCWDGLNGQPVVKHGYSLTTSVSFRSVINAIKEYAFVSSDMPLWLSLEVHCCSSQRDIMAQVMIEVFGSSLITEPLQGCLDTLPSPSQLRGKILIKAKMPQDMNTKDSDKEGRDTVKLDQTHNDAGSMPEKGDESAAVTNQLQRKGLQEDALQKLAIYGAGKRLPHPDAIDSHRNFIYSMSETKLSKRISKEKPLGLIGTQHMVRVYPDPNRVDSSNFNPIKCWQHGVQMAALNYQTPDFNMRLNDAMFTGSLGYVIKAQPEPKQIRIAVDVLLVGGIHGLGADSPVYVELELILPDMPSQRVRTTAVSTHGAGTVFDQNLDISIGTKYPHLAFLHWSIKSLSNSRPMSTQSGIAKVSNLKKGYRILPLGVTEETGGFIFCTVTKTTVAVTEFTRDCREARSDLTSINGELSQLQLVLELLRDDTAVSDDQILPESLQEQILSIIDNCSAVVSKINLVLDNHSGKVGVLKWATFGKSEVAGLRMSLEAHRGSLNLALELVSVSLSKAIKSDTAAIRTDVHDIKQDTSQIPQIMDELNRLRVIVAGGDVPAATIGQNYILQQYLDDLTSYAETVCNDVEWETDSSVHALSRSSSPSGPRIESSAPSAPVIQLETSADAGSQVASLPNTDTQVCNEGDKTYLQPTKIVSTLDTSKTTSQAKKKIVLVGDSACGKTALCRRFLEGTFLATEFQTIFETYAAHIDGVDLSLWDTSGMDDNDRLRPLSYPDADAVLICFSFDYPDSLENVVEKWIGEVMYFLPGVPCILVGLKKDLHYDEKTIKELRKYDQQPVTWDQVNDTAKRINAFRYVECSAKTGDGVKEVFDILVGPFFPAVKKRSNALKSMFKRWSSK

SEQ ID NO: 56281 - protein, 1064 aa, Arabidopsis thaliana
MNSNGHEEEKKLGNGVVGILAETVNKWERRTPLTPSHCARLLHGGKDRTGISRIVVQPSAKRIHHDALYEDVGCEISDDLSDCGLILGIKQPELEMILPERAYAFFSHTHKAQKENMPLLDKILSERVTLCDYELIVGDHGKRLLAFGKYAGRAGLVDFLHGLGQRKLILGYSTPFLSLGASYMYSSLAAAKAAVISVGEEIASQGLPLGICPLVFVFTGTGNVSLGAQEIFKLLPHTFVEPSKLPELFVKDKGISQNGISTKRVYQVYGCIITSQDMVEHKDPSKSFDKADYYAHPEHYNPVFHEKISPYTSVLVNCMYWEKRFPCLLSTKQLQDLTKKGLPLVGICDITCDIGGSIEFVNRATLIDSPFFRFNPSNNSYYDDMDGDGVLCMAVDILPTEFAKEASQHFGDILSGFVGSLASMTEISDLPAHLKRACISYRGELTSLYEYIPRMRKSNPEEAQDNIIANGVSSQRTFNILVSLSGHLFDKFLINEALDMIEAAGGSFHLAKCELGQSADAESYSELEVGADDKRVLDQIIDSLTRLANPNEDYISPHREANKISLKIGKVQQENEIKEKPEMTKKSGVLILGAGRVCRPAADFLASVRTISSQQWYKTYFGADSEEKTDVHVIVASLYLKDAKETVEGISDVEAVRLDVSDSESLLKYVSQVDVVLSLLPASCHAVVAKTCIELKKHLVTASYVDDETSMLHEKAKSAGITILGEMGLDPGIDHMMAMKMINDAHIKKGKVKSFTSYCGGLPSPAAANNPLAYKFSWNPAGAIRAGQNPAKYKSNGDIIHVDGKNLYDSAARFRVPNLPAFALECFPNRDSLVYGEHYGIESEATTIFRGTLRYEGFSMIMATLSKLGFFDSEANQVLSTGKRITFGALLSNILNKDADNESEPLAGEEEISKRIIKLGHSKETAAKAAKTIVFLGFNEEREVPSLCKSVFDATCYLMEEKLAYSGNEQDMVLLHHEVEVEFLESKRIEKHTATLLEFGDIKNGQTTTAMAKTVGIPAAIGALLLIEDKIKTRGVLRPLEAEVYLPALDILQAYGIKLMEKAE

SEQ ID NO: 56282 - protein, 535 aa, Oryza sativa (indica cultivar-group)
MESTSKCNGAEAAQPLDTEDDVEPFLQAPAVATCIGATGTRPEFGAQQGPGPGINFAPIVTPRLGPGEPISERGQGRSCPTRPVATPSDEVVSLDDDRQLHRAAGANARESEEEHLYGLGIFRGKDGGVVVNGLDLENPLCSTLVTGFKLLRIVEAEALGAPFIHLLWREALEARLGIGYRRKGQRLLVRGGRRPGLDRGWCSCRRDQVWGKAGLVLRFGRHERNALVLVLLPLLVYGFVGVVQRFRCPTSLPSISLHWLAPNSSTLTQIQCYSLTGLFNVGLMSDSPGSTWPGTSLWVMISRCVGNGHWLCCLQWGDGRERTDDEEELILRFTFKFHFKGGRCTMILSVLSSPALVSGLMVVRAKNPQNSGIYTVGDFMTKREELHVVKSTTSVDEALEMLVEHRITGFPVIDDEWNLVGVVSDYDLLALDSISGNGLAEVDIFPEVDSTWKTFNEIQKLLSKTNGKVIGDVMTSAPLVVRETTNLEDAARLLLETKYRRLPVVDSSGKLVGIITRGNVVRAALKIKKKFEGEL

SEQ ID NO: 56283 - protein, 177 aa, Polytomella sp. Pringsheim 198.80
MSSRLYVGNLSWNAKEEDLRTYFGKFGEVEEASIALDRESGRSRGFGFVTLPADVAKDAIEKTNGAEFMGRNIKVNEASPPGERPPRTNNYGGGYGDFNGNGGGRDYGRGGYGRGNGGYGGRNAGYGGRGNFGGQGGYGDNRFGNDNFGGSYGGRGGYRGPRGPSAEENNSNNYGGY

SEQ ID NO: 56284 - protein, 522 aa, Candida intermedia
MGLEDNRMVKRFVNVGEKKAGSTAMAIIVGLFAASGGVLFGYDTGTISGVMTMDYVLARYPSNKHSFTADESSLIVSILSVGTFFGALCAPFLNDTLGRRWCLILSALIVFNIGAILQVISTAIPLLCAGRVIAGFGVGLISATIPLYQSETAPKWIRGAIVSCYQWAITIGLFLASCVNKGTEHMTNSGSYRIPLAIQCLWGLILGIGMIFLPETPRFWISKGNQEKAAESLARLRKLPIDHPDSLEELRDITAAYEFETVYGKSSWSQVFSHKNHQLKRLFTGVAIQAFQQLTGVNFIFYYGTTFFKRAGVNGFTISLATNIVNVGSTIPGILLMEVLGRRNMLMGGATGMSLSQLIVAIVGVATSENNKSSQSVLVAFSCIFIAFFAATWGPCAWVVVGELFPLRTRAKSVSLCTASNWLWNWGIAYATPYMVDEDKGNLGSNVFFIWGGFNLACVFFAWYFIYETKGLSLEQVDELYEHVSKAWKSKGFVPSKHSFREQVDQQMDSKTEAIMSEEASV

SEQ ID NO: 56285 - protein, 396 aa, Oryza sativa (japonica cultivar-group)
MAPLRGAKRRKRQPEKALPAAGQAMPAPAPGGDWWDGFARRLAAGQFSKDCQNFESVFKMSRKTFDYLCSLISGDFTRKTQSFRNFRFGDKAILGVEDQVGVALLRLTTGESLLSIGNRFGMNHSAISNITWKFIEALEERAANHLKWPTPEEMATVKSKFEKIQGLPNCCGAIDTTHILMCSSAQPNSNVWLDGENRNSMVLQAIVDADMRFRDVVSGWPGSLNDSCILRTSGFYRLCEKGARLDGQTELPGEPAGSVVRDYILGDASYPLLPWLMTPYREKDLSPAKADFNKRHAATIMVVQGALAKLKERWQVLKGELWRPDKHRLPRIIYVCCLLTNIMIDLEDAARGGMPPSHNHDDGYRQQFSDVADVGAAALRDQLCQYVSRIGSSLPA

SEQ ID NO: 56286 - protein, 262 aa, Glycine max
MGEEKKDEGNKEEAKEEKKEEEKKEEPPPEIVLKVDMHCEACARKVAKALKGFQGVEEVSADSRTSKVVVKGKAADPIKVCERLQKKSGKKVELISPLPKPPEEKKEETKEEPPKEEKKDEPPPVVTVVLKVRMHCEACAQVIQKRIRKIKGVESVETDLANDQVIVKGVVDPAKLVDHVYKRTKKQASIVKDGEKKEEEKKEEEKKEEKEEEKRGEEENKGGEDNKTEIKRSEYWPSKNYIDYAYDPEIFSDENPNACSVM

SEQ ID NO: 56287 - protein, 196 aa, Thermosynechococcus elongatus BP-1
MTHATDVLTLGRWMAADFSNQAQAFENPPFYAHIRVCMRPLPRGVLEGIALYVEQAYDYLLSVPYRTRVLELMPANDHIVIKNYVLKDEKRFFGAARDRQRLQAMTADDLELLCGCNMLTYWTGHSFRGEVEPGKACKVVRKGRETYLDSTFEIDGDRFISHDRGRDPETDEHVWGSVAGPFHFVRWQSFADEVMA

SEQ ID NO: 56288 - protein, 346 aa, Rhodococcus sp. RHA1
MSTEGAAHTAADAVVGTTVAGIDLGDPQLAATVREGLKQVEELLVSELSDGEDFLTEAALHLAKAGGKRFRPLFTVLTAQLGPKASDPSVVTAATVVELVHLATLYHDDVMDEASMRRGAPSANSRWGNSVAILAGDYLFAHASRLVSTLGPEAVRIIAETFAELVTGQMRETIGLRGEQDPVEHYLKVVWEKTGSLIAACGRFGGTFSGADADHVKRLERLGDAVGTAFQISDDIIDISSVSAQSGKTPGTDLREGVHTLPVLYALRDEGPDADRLRVLLDGPVTNDDDVAEALALLERSPGMAAAKAKLEEFAVQARAQLAELPQGPANDALVKLVDYTIERVG

SEQ ID NO: 56289 - protein, 442 aa, Ralstonia solanacearum GMI1000
MFRLPALPRIPTAPFCPSEVRGCVAIPPDLPLWKKLLRFAGPGLLVSVGYMDPGNWATDIEAGSRYGYSLLFVVLLSSLAAMVLQCLSARLGIVTGKDLARLSRERYRPGAVRVQWLLAELSIVACDLAEVLGCALAFHLLLGVPILGGVALTALDTLIVLGLKGKNFRQLEAIVLGLILTIGLCYFVELALIRPHWPSVAGALVPSWQALSAREPLYLAIGILGATVMPHNLYLHSSIVQTRVVSETEPARREAVGLSRLDTIVSLSLALLVNGAILVLAAAAFHANGHQDVADIQDAHRLLEPIVGTAVAGVLFGIALLAAGQSSTFTGTIAGQILMEGFLELRIPCWQRRLATRALALIPAFVGVAMLGDHAIGRLLVISQVVLGFQLPFAMFPLIRMTGDRALMGTFANGRLTSAVAWCLFAVISVANLWLVWQVLAG

SEQ ID NO: 56290 - protein, 116 aa, Glycine max
VFMQLFSVREEKKLLKASQCYLSTTSGPIAGLLFISTDKVAFCSDRSIKISSPNGDDVRVHYKVSIPLTKLKSVNKSQNVEKPSQKYIEIVTVDNFDFWFMGFFNYQPFCRLLAAV

SEQ ID NO: 56291 - protein, 891 aa, Pseudomonas putida
MVAMMNLVPGDGVPGDSDPGETAEWLEALESTLAHCGPARARFLLEQLEAHARELGLERGAQPYSAYRNTLSLEHQGAYPGDLELDERITSILRWNALAMVVRANHAYGDLGGHIASYASAAEIFEVGFQHFFRGEEGGEQRTADLVFFQPHSAPGIYARAFLEGRLSEAQLASYRQEVAGDGLCSYPHPWLMPDFWQFPTGSMGIGPLNAVYQARFMRYLQHRAWPYRAHVWGVFGDGEMDEPESIAGLTLAARKQLDNLTFIVNCNLQRLDGPVRGNGQIIQELESLFSGAGWNVIKVLWGSEWDALFARDSEHVLLRQLAATPDGQFQTLGANDGAYNLEHFFNQHPALQRLVEHMSSAEINALNAGGHDFRKLYAAFAAAKACKGRPTVILAKTKKGYGMSAAGESRMTAHQAKKLDVQALLAFRDRFHLPLSDAQVEQLQFYRPDENSREMRYLRERRNGLGGSLPSRRPQARTLPVPALEVMGGFALHAEGKEMSTTMAAVRMLGAWLKAPELGPRVVPIVADEARTFGMASLFRQIGIYSPHGQRYEPEDASSLLSYRESRDGQLLEEGITEAGALSSWVAAATSYAVHGEPMLPVYIYYSMFGFQRVGDLIWAAADQRARGLLLGATAGRTTLGGEGLQHQDGSSLVMAAMVPNCRAWEPCFAGRLAVILEHAARRMLVEQCDEFHYVAVMNESYPHPSLPPEAHAAVLRGMYRFAEQPVEHALGRVRLLGSGAILREVIAASELLAADWGIASEVFSVTSFSELARDARDVQRGQRLGLGGSSHVAQCLVGDAPVIAATDYVRAWPQLIAEYVPAPYVTLGTDGFGRSDTRQRLRQFFEVDRFSVVLASLQALVDDGLLEVDVMAQARARYPALDAAGPWYR

SEQ ID NO: 56292 - protein, 440 aa, Pyrococcus abyssi GE5
MRVVVIGSGTAGSNFALFLRKLDRKAEIIVIGKEPTMQYSPCALPHVISGTIEKPEDVIVFPNEFYEKQKIKMMLGVEAKKIDRERKVVITDKGEVPYDKLVLATGSKAFIPPIKGVENEGVFTLKSLDDVRRIKEYIGKRNPKKAVVIGAGLIGLEGAEAFAKLGMEVLVVELLEHLLPTMLDKDMASIVQKNMEEHGVKFRFGVGVSEIIGNPVEAVKIGDETVEADLVLVATGVRANVDLAKDAGLEVNRGIVVNEYLQTSDPDIYAIGDCAEVIDAVTGKRTLSQLGTSAVRMAKVAAEHIAGKDVKFRPVFNTAITELFDLEIGTFGMTEERAKREGIDVVVGKFRGSTKPEYYPGGKPITVKLIFRKEEGRLIGAQIVGGERVWGRIMTLSALAQMGAKVEDIAYLETAYAPPISPTIDPITVAADMALRKMKR

SEQ ID NO: 56293 - protein, 429 aa, Pyrococcus abyssi GE5
MTQMEDAKKGVITDEMLYIANREGISPDKLRKLVAKGYTVIFRNKVHDWVKPVAVGSGVRVKVNANIGTSRDIINVEEEIEKAKVAVKYGADTIMDLSTGGDLDEIRRKIMKAVDVPIGTVPIYQAAEEMLAKGKAIIEMTEDDMWRAIEKHFKDGVDFATVHVGVTKEVVEKMKRIKRVVGMVSRGGTFLAAWILHWNQENPLYKDYDYLLELAKEYDVVLSLGDGLRPGGLPDAGDELQIAELYTLGRLVKRARKAGVQTMVEGPGHVPIDQIPAQIKLMKVATDNAPVYVLGPLVTDIFPGYDHIAGAIGGAIAALNGADFLCYVTPAEHLGLPNVEHVREGVIAAKLAAHAVNLLRFEDEYRKDYEMSLARGNLNWARQFEIAFDKDKFIEIRKERPTKTEACSMCGDLCAIKIIQEMLTKKQTS

SEQ ID NO: 56294 - protein, 269 aa, Sulfolobus solfataricus P2
MLEEINYDTKLFGLIGKNIKYTLSPYIHNFSFRTLGINAVYLVFDLDEMKFKRSISGILEIAEGLNVTIPYKDEVMKYLDNTDTHSTRIQAVNTIYKKSGYNTDYLAIKNLVRKKIKNVSGYECYIYGAGGAAKAAAFALSELGCSSISIVNRTKSRAYELAELLNKNGYNASIKENCNITNNILIVNSTPNSSVVPEDCVKKSDLVIEFVYRPVETELIKNAKKYGIQYINGLEILVNQAVEAEKIWFNKSVADEKIIEYLYARELVW

SEQ ID NO: 56295 - protein, 447 aa, Klebsiella aerogenes
MDQTCTLEGFLTRVQQRDPHQTEFAQAVREVMTTLWPFLEENPRYRQLALLERLVEPERVIQFRVVWVDDRNQVQVNRAWRVQFNSAIGPYKGGMRFHPSVNLSILKFLGFEQTFKNALTTLPMGGGKGGSDFDPKGKSDGEVMRFCQALMTELYRHLGPDTDVPAGDIGVGGREVGFMAGMMRKLSNNSACVFTGKGLSFGGSLIRPEATGYGLIYFTEAMLKRHGLGFEGARVAVSGSGNVAQYAIEKAMELGARVVTASDSNGTVVDEAGFTKKKLARLIDIKERAHGRVADYAREFGLTYLEGQQPWSVPVDIALPCATQNELDVDAARQLIANGVKAVAEGANMPTTIAATDLFLEAGVLFAPGKAANAGGVATSGLEMAQNAARMGWKAEKVDARLHHIMLDIHHACVQYGGEAKQTNYVRGANIAGFVKVADAMLAQGVI

SEQ ID NO: 56296 - protein, 323 aa, Pseudoalteromonas tunicata D2
MLQPEFIASATRVLAIEKQAIEQLNQYIDAHFAHACQIMFNCQGRIIVIGMGKSGHIGNKIAATLASTGSPAFFVHPGEASHGDLGMITKDDVVLLISNSGETSEVLGIVPVLKRLGAKMIAMTGNTQSSLATHSDVHICIKVEQEACPLGLAPTASTTATLVMGDALAVALLEAKGFTADDFALSHPGGSLGRRLLLTLKDIMHTGDAMPKVSSDAIIRDALIEMSAKGLGMTTIVDSDNRLLGLFTDGDLRRILEQKIDIHTTSIQAVMTKNCTTASCDMLAAEALNIMERKRINGLLIVNQQNQAIGALNMQDLLRAGVI

SEQ ID NO: 56297 - protein, 431 aa, Prochlorococcus marinus str. MIT 9313
MIDSLDLVIDTIVAREVLDSRGNPTVEAEVLLEAGAIGRAIVPSGASTGAHEAHELRDGDSRYLGKGVTKAVNHIEDRIAPALCGISSLDQASVDGTMQELDGSDNKSSLGANAILAVSMATARAAANGLGLPLYRYLGGPMASLLPVPLMNVINGGAHAANNLDFQEFMLVPHGASSFRESLRMGAEVFHTLKGLLSAQGLSTAVGDEGGFAPNLANNDAAGDLLIQAIEKAGYSPGKDISLALDVASTEFYQDGCYAFGGGRYTSTEMVNELEKLVDRYPIISIEDGLAEDDWQGWALLTKKLGKRIQLIGDDIFVTSTKRLQQGIDQNVANSILIKVNQIGSLTETLQAIDLAGRSGYTSVISHRSGETEDTTIADLAVATRAGQIKTGSLSRSERVAKYNQLLRIEDELGSQAVYAGATGQGPRGRS

SEQ ID NO: 56298 - protein, 178 aa, Leptospira interrogans serovar Copenhageni str. Fiocruz L1-130
MKEKVESFLKEKFPHFLDFQEEVISNVPVFFLKVEGIVPVLTALKNDPTLHYNFLNDLTAVDWLGKKEPRFEVNYLLRSENKASSKIRIKVRLEDGESVPSITSVFKGANWPEREVYDLFGISFIGHPNLDRILMPDNFQGHPLRKDFPLEGFGQDYLIEDLLHIHVNEDITKEGGKK

SEQ ID NO: 56299 - protein, 425 aa, Glycine max
MMGGVSGGGDDDVVHIQQPNKPGDPFIITVNCPDKTGLACDICRIILDFGLCIAKGDVSTDGVWCYIVLWVIPYSVLLPMSCSYLILKERLQKICPPCLASFYVIQQPSRSSPVYLLKFCCLDRKGLLHDVTKVLSELELTIQKVKVTTTPDGRVLDLFFVTDNKELLHTRNRQDETCERLNAVLRDSCISCELQLAGPEYEYNQGISSLSPALAEELFRCELSDNEVRAQALSPDMTKLKKTNVTMDNSLSPAHTLVQIRCADHKGLLYDIMRTLKDLNMKISYGRFSPNSMGYCDLDIFIQQKDGKKILDPEKQSALCSRLKQEMLHPLRVIIANRGPDTELLVANPVELSGMGRPRVFYDVTFALKTVGICVFSAEVGRHSTSEREWEVYRFLLDENCEFQLTGVAARNKIVNRVRRTLMGW

SEQ ID NO: 56300 - protein, 396 aa, Oryza sativa (japonica cultivar-group)
MTSAMAMSFLSTTAASSSQPPLPARRLPRRNPSLPFPLRPPHRLSPFSAPPPEPHRLTYRTHSTSSSSRTPTAAGLLSPVISTSRTLIFLLVASLLSLSGVRPLPSLASPPPPTQQPQETEEQEQQQESEEKQQQQQEEEGVEAEVEEAWLRQDEEEEVEEKEEEEEEADDEVQMYMEILSRDPGDVDALKCALFAKMRRAEWGGALGFARRLREAEPGEVEWRLMEALLHELKGDLAEAERLFNEVLAEKPLLVRALHGLALCMHKRSEGPTVFEMLEKALQLAISGERVPEERNIKLLIAQMHVVKGQLDVASEKLQNLINEDPRDFRPHLCQGIVYALLDKKEEADELFDTYRSLVPDEFPDKSFISDVIQAARVESKDRLQKDFGSEFLSKK

SEQ ID NO: 56301 - protein, 175 aa, Oryza sativa
  misc_feature (107)..(107): Xaa can be any naturally occurring amino acid
  misc_feature (112)..(112): Xaa can be any naturally occurring amino acid
  unsure (1)..(175): unsure at all Xaa locations
MAPSVMASSATTVAPFQGLKSTAGMPVARRSGKSSFGNVSNGGRIRCMQVWPIEGIKKLETLSYLPPFTVEDLLKQIEYLLRSKWVPCLEFSKVGFVYRENHRSPGXYDGRXWTMWKLPMLGCTDATQVLKELEEAKKAYHDALVRIIGFDKVRQVQLISFIAYKPPGWEESGGN

SEQ ID NO: 56302 - protein, 410 aa, Oryza sativa (indica cultivar-group)
METVAAASYTRGAATRSPACCAAMSFSQSYRPKAARPPSTFYGESLRVNTARSLPSGRQSKAASRAALSTRCEIGDSLEEFLTKATPDKNLIRLLICMGEAMRTISFKVRTASCGGTACVNSFGDEQLAVDMLADKLLFEALEYSHVCKYACSEEVPELQDMGGPVDGGFSVAFDPLDGSSIVDTNFTVGTIFGVWPGDKLTGVTGGDQVAAAMGIYGPRTTYIIALKDCPGTHEFLLLDEGKWQHVKDTTTIGEGKMFSPGNLRATFDNPEYDKLINYYVKEKYTLRYTGGMVPDVNQNCYEKYEMPTLMGSFMMQIIVKEKGIFTNVTSPTAKAKLRLLFEVAPLGFLIEKAGGYSSDGKQSVLDKVINNLDERTQVAYGSKNEIIRFEETLYGSSRLTAGATVGAAA

SEQ ID NO: 56303 - protein, 345 aa, Triticum aestivum
MADELDELIEFLSNGSPQVRGAAADIVRGLTGDSDGLRSLAARADRALPALLRLLASVGAGCAGEAAADSLVNLSQDGDLAARLVVLGAVAAAMDVMVKRGGEQPKLARSLVMLLVNLTQVESGISALLQVGDEKVQGLYVAKLVRSFCRSSCDSEDEDIFEHIASILVNISKVEAGRRILMEPKRGLLKQIIGQFDSTNQLRKKGVAGTIRNCCFEADTQIQNLLSIAEYLWPALLLPVAGKKIYSEEDRSKMPPELANALSHEREAVDDSEIRERALEAIYMIVMQDDGRKAFWSVNGPRILQVGYEDEEDLKVMGAYELIGSLLVGKGEIEQDQEQGEDKPQ

SEQ ID NO: 56304 - protein, 315 aa, Actinobacillus pleuropneumoniae serovar 1 str. 4074
MSQLDALREMTVVVADTGDIEAIKQYQPQDATTNPSLILSASALPQYASLIDDAVAYAKARSDDKAQQLIDAEDKLAVNIGLEILKIVPGRISTEVDARLSYDTKATIEKARQIMKLYNDAGISNDRILIKIASTWQGIRAAEVLEKEGINCNLTLLFSQAQARACAEAGVYLISPFVGRILDWYKAAEKKEYAPAEDPGVISVTNIYNYYKQYGYQTVVMGASFRNVGEITEIAGCDRLTIAPPLLKELAESNAPLVRKLEYKGEVKTRPAPLTEAEFYWQHNQDPMAVEKLAEGIRKFAVDIEKLEAMLAAKL

SEQ ID NO: 56305 - protein, 611 aa, Candida glabrata
MENKEHHHHHHHHHHHHSNGSYVSNKVSSLADGSRVGNYQIVKTLGEGSFGKVKLAYHVTTGQKVALKSINKKVLAKSDMQGRIDREISYLRLLRHPHIIKLYDVIKSKDEIIMVIEYAGNELFDYIVQRNKMSEQEARRFFQQIISAVEYCHRHKIVHRDLKPENLLLDEHLNVKIADFGLSNIMTDGNFLKTSCGSPNYAAPEVISGKLYAGPEVDVWSCGVILYVMLCRRLPFDDESIPVLFKNISNGVYTLPKFLSPGASDLIKRMLIVNPLNRISIHEIMQDEWFKVDLAEYLVPQDLKQQEQFNKKSGNEENVEEIDDEMVVTLSKTMGYDKDEIYEALESSEDTPAYNEIRNAYILIKDNKSLIKDMKQDNNVTQELDTFLSQSPPTFQQNGDGMKASEDQKKKHSGRRLASSVTQQRTFHQPPFMDQSKEEDSTISIPTSLPQIHRANMLAQGLPAASKISPLVTKKSKTRWHFGIRSRSYPLDVMGHIYIALKNLGAEWANPSEEDLWTIRVRWKYDSDESRLIEDGVKKIPNLMKIVIQLFQIETNNYLVDFKFDGWESTYGDSTISTNMSEDEMSTFSAYPFLHLTTKLIMELAVNSQGN

SEQ ID NO: 56306 - protein, 279 aa, Pseudoalteromonas tunicata D2
MQLPTVDYQADNAAAQFVESLRNTGFGVLKNHPIPKELVESIYNNWQQFFNSDEKNSFLFNKETQDGYFPPSVSEVAKGHQVKDIKEYFHVYPNGRVPAQLEAEIREYYRLASEFAAQLLSWVQQYAPAEVSQHFSIDLKDMIAQSEKTLLRILHYPPMKGDEEPGAIRAAAHGDINLLTVLPAANEPGLQVQTKEGGWLDVPCDFGNLIINIGDMLQEASGGYFPSTIHRVINPTGKASDKSRISLPLFLHPRPDVVLSERYTAQSYLDERLRELGVK

SEQ ID NO: 56307 - protein, 431 aa, Pyrococcus abyssi GE5
MKAIDVIERYSKIIAPANRMHYFPLVPVRAENAKIWDIEGKEYIDFLSNAAVQNVGHNNPRVVKAIKEQVEKLTHASYIYSYPVEPLLLAEKLAEIAPVDDPKISFGLTGADANDGAIKYARAYTKRQAILSYMKSFYGSTYGAMSLTGLDFQVRAMVGELSEIHYIPYPNCYRCPFGKEPGSCKMECVEYLKEKFEGEVYAEGVAALFAEPIQGDSGIVVPPKDYFRKVVKILREHGILFVVDEVQSGMGRTGKWFAIEHFGVRPDIITVGKSLGGGLPISATIGRREIIDSLPPLSHAFTLSGNPTASRAALAVIEEIEEKNLLRRAEKLGNHAMKRLKKMMDEHELIGDVRGIGLMIGVELVKDRETKERAIEETQKVIERAFELGLIVTHFNGNVLRIEPPLTIEEETLDEGLDILERAISEVEEEK

SEQ ID NO: 56308 - protein, 361 aa, Sulfolobus solfataricus P2
MVSAIVLAGGYATRLRPLSLTKPKALFPILNKPILGYILESLINSDVSDIYLSLRVMADKIIDYLKDTSMLDKVKIEVESEPLGDAGPLKLISQKYNLDDDVLVIYGDIYSEINIKSLLDFYYKKSCDAVVVGTEVEDPRRYGVLYTENDVLVELIEKPKKPISNLINGGVYIFKKDLFKLVETPSSISKDFLPKLLRTKSISVYKYHGIWADIGVPDDYLRLNFEVLVQKYPKGYINSSAKVSEKSTLIPPYYIGSKNVIGEDAYITSNTILGNDVEIGKGTYISESILMNKVQVKEYTYISGSIIADKTKIGRWNHILDGSILGEEVITSDGVLINRRTIILPNKEVKEHVYDKGKIIL

SEQ ID NO: 56309 - protein, 166 aa, Triticum aestivum
MGAVSATADVVVALFSLIMAVAAPLFDSQVVLPRDLYPAPLVDIHRWFAVAFGHYLVAYPPPFFLGLVWLDLALLWPVCVANLYGILARRRWSATTSLMAGVYMLTYLSAILGDMLGSGKATLRLLQLYVPFIVVAVIAVLRGLCSWSAPLAAATSVASSAQKKKA

SEQ ID NO: 56310 - protein, 523 aa, Polytomella sp. Pringsheim 198.80
MIRKALMNARAKLPFARFARSASTSAPVVDIASETIQFARNLPNKLFINNKWVDAKSGKTMGVEDPRNGEEILRVAEGDSADVDLAVKAARKAFDEGAWPRMTGKERGRLIYKLADALEANAEAFARLETLDNGKPLNISRIADVPLSVDHFRYYAGWADKIHGKTIPVDGPHMAYTLHEPLGVVGAIIPWNFPLLMAAWKLGPALAAGNTIVLKPAEQTPLSALLIAKLAAEVGFPEGVINVVTGFGPTVGGPLASHKLVDKTAFTGSTEVGKIVARLAAEQIKPCTLELGGKSPIIVCPDVDVDRAVADAHMALFFNHGQCCAAGSRVYVHEKIYDEFVEKATKAAANHSVGDPFSGQYDQGPQVDNAQFSKILSYVEHGKAEGAKLNVGGCRVGNKGYYVAPTVFSNVTDNMKIAREEIFGPVQSILKYSTFDEVIRRANASDYGLASGVFSKDLDTVNTLVRGLHAGTVWVNCYNLFDSAVPFGGFKTSGIGREKGEYALSNYTKVKAVYMPLVNPAWR

SEQ ID NO: 56311 - protein, 196 aa, Brassica rapa
MARLLFRLLGESNSPSPVQDPSTAAVTSDLVVTLAALLCAMVCVLGLIAVSRCVWLRRLAAGNRTHAGSQGGSVQSPPPPVAAANKGLKKKVLQSLPKLTFSPDSPSSEKFTECAICLTEFSNGDELRVLPQCGHGFHVSCIDTWLGSHSSCPSCRQILVVARCHKCGGLPGSSSSEPEIEIRIKQGADVPNSYLP

SEQ ID NO: 56312 - protein, 245 aa, Zea mays
ESEANEDKTSGDFKEMGSRLAGEVVAFLKKKMDKLSRYGGCKELKLSFVGHSIGNVIIRSALAEPALQPYLKNLYTYMSISGPHLGYWYSSNSLFNSGLWLLKKLKGAQCIHQLTFSDDQDPQNTYFYKLCKLKTLENFQNIILLSSPQDGYVPYHSARIELCPAASSDTSKKGQVFTEMLNNCLDQIRAPSSDTRTFMRCDVNFDQSNQGRSLNTMIGRAAHIEFLETDLYAKFIMWSFPDLFR

SEQ ID NO: 56313 - protein, 205 aa, Zea mays
MQRAVQAVRSHGNVLKYAVLQHISAPKPAMLPAAFSRFMSVSSARLEDRGFETATVADVLKSKGKSADGSWLWCTTEDSVYDAVKSMTQHNVGALVVVKPGQNKSIAGIVTERDYLRKIIVQGRSSKSTKVGDIMTEENKLITVNPDTKVLQAMQLMTENRVRHIPVIDGTGMLGMVSIGDVVRAVVAEHREELNRLNDYIQGGY

SEQ ID NO: 56314 - protein, 549 aa, Shewanella sp. MR-7
MTQKLPRQAIASEDSLMRIFTVPEDAESTLSIIEQKLSEDLAGFLGDSIAALEKPLSEIETDFQAFEIPSQPRFVSDYTDEIMQNLVAHSVHTAAPSFIGHMTSALPYFVLPLSKMMVGLNQNLVKIETSKAFTPLERQVLGMMHHLIYAQHDDFYRNWMHSANHSLGAFCSGGTVANITALWIARNQLLKADGDFKGVTREGLIKALRHYGFDDLAILVSERGHYSLGKAVDLLGIGRDNIISIPTDGNNKVDVAKMREVAAELANKRIKIMAIVGVAGTTETGNIDPLRELAALASELNCHFHVDAAWGGASLLSNKYRHLLDGIELADSVTIDAHKQMYVPMGAGMVLFKNPEFAHAIAHHAEYILRRGSKDLGSQTLEGSRPGMAMLVHACLQIIGRDGYEILINNSLEKARYFAEQIDAHPDFELVTAPELCLLTYRYVPANVQAAMQLAIEQGYKTKLARFNELLDGLTQFIQKHQREQGKSFVSRTRIQPARYFRQPTVVFRVVLANPLTSHEILNQVLIEQGEIAALDKEFLPALLAMVNE

SEQ ID NO: 56315 - protein, 57 aa, Zea mays
MAMQAAKRANMLLPPEVNRILYIRDFPYKITAEDMYDIFGRYGPIRQIRVGNTPDTR

SEQ ID NO: 56316 - protein, 246 aa, Zea mays
MSRFGRSGPPPPIRDTYSLLVLNITFRTTADDLFPLFDKYGEIVDIYIPRDRRTGDSRGFAFVRYKYEDEAQKAVERLDGRLVDGREIMVQFAKYGPNAERINKGRIVEPVPRPGGRSRSHSPRRRYRDDYRDDHDRDYRRRSRSRSRDRYTRDRYRDRDYRHRSPSRSYSPDDYKKRGRDSLSPERRSPRRSRSPDDYKRRGRDSASPASKSPSRSPPRKMSPSPERSPVRRNNDRSPRSRSPST

SEQ ID NO: 56317 - protein, 248 aa, Saccharomyces cerevisiae
  misc_feature (168)..(168): Xaa can be any naturally occurring amino acid
  unsure (1)..(248): unsure at all Xaa locations
MARTFFVGGNFKLNGSKQSIKEIVERLNTASIPENVEVVICPPATYLDYSVSLVKKPQVTVGAQNAYLKASGAFTGENSVDQIKDVGAKYVILGHSERRSYFHEDDKFIADKTKFALGQGVGVILCIGETLEEKKAGKTLDVVERQLNAVLEEVKDFTNVVVAYEPVXAIGTGLAATPEDAQDIHASIRKFLASKLGDKAASELRILYGGSANGSNAVTFKDKADVDGFLVGGASLKPEFVDIINSRN

SEQ ID NO: 56318 - protein, 408 aa, Arabidopsis thaliana
MDRGKMNVSLPTDLIREIFARLPSKSVARFRTLSKQWASILRSTDFTKLFLSRSSNRPRLLFAVERYKCNEWQFFSSPQSQNRYEKSAHLEFHSKFSGDVSHYICSYASGLLYFPAVHIVDTETIVICNPITGMYTGLPVIMKDRRSRGFLVFDPVDKRFKAFDTHFILTLGSGELKWREKNIPCPLYERCSSNQGICINGVLYYLAKTVLVETVFGLTFLIVRFDVSSEEFKFIDAARFNDRLKDPTRLSLVNYMGKLGVTDCNCVDAGGRRTVELCLWVLEDVEKLEWVKYVYTLPENEVLASCEFSVAGVTATGDIVLCMKYTCKPYYVFYFNPEKKTLQTVEIQGFGAKLEEVENRGEVFAYVDYVEDLSLNDAKQLKSSISHVKSLCPCCQKLVQPENIGEVV

SEQ ID NO: 56319 - protein, 410 aa, Sulfolobus solfataricus P2
MTSQPQNEIQEQLLAATGMSVEFIPVQGELNVGPQHPGSGHMRIFVKLNGDIIEDVDLDVGYVHRAVEKLSENRNYMHLIPLVERPAILDSIHMNLGYIIAVEKILGVDVPERAQYLRSFAAEVNRIASHLYGLGILAIFLGHSTGFMWGFGDREVWVTILEALTGARVTNSYVIPGGVRKDITQEIKEMTIKAIAYQRKRLEDWKKIFFYNPSIRARLENVGVMSRENAIKWGAVGPNLRASGVYYDVRKIEPYGAYDKLDFEIPVYKEGDGLARGLVRLEEIEQSMRILEQIIKNIPEGNILSDRFFKQIPPIRLKKYWETYRRIVLPGYYASFRPPKGEAISRVEAGRGELAYYVVSDGSPKPYRLRMITPSYRLIYVFKELCKGSRYADLVSIYGSLDYFPPEADR

SEQ ID NO: 56320 - protein, 149 aa, Triticum aestivum
  misc_feature (38)..(38): Xaa can be any naturally occurring amino acid
  misc_feature (98)..(98): Xaa can be any naturally occurring amino acid
  misc_feature (110)..(110): Xaa can be any naturally occurring amino acid
  misc_feature (117)..(118): Xaa can be any naturally occurring amino acid
  misc_feature (127)..(127): Xaa can be any naturally occurring amino acid
  misc_feature (133)..(133): Xaa can be any naturally occurring amino acid
  misc_feature (136)..(136): Xaa can be any naturally occurring amino acid
  unsure (1)..(149): unsure at all Xaa locations
SGIGFLDHMLHALAKHAGWSLALHCKGDLHIDDHHTAXEDVCLALGEAFNVALGTKMGIARFGSAYAPLDEALSRAVVDISNRPYCVSELKLQREKIXDLSTEMIPHCMXSFAQNAXXTLHVHCLHXDNDHQXAKXAFKGLANSFTGQN

SEQ ID NO: 56321 - protein, 188 aa, Sulfolobus solfataricus P2
MEIFLSLSFSFLIIRCGGGLFMDKVKEYKKENIASLFAEHIQSIVTGIKYFVKPQRITLQYPEDSLTLPTGYRGMIRLYKDVCIGCTLCALICPADAMKMVTESGKKFPQINYGRCVFCGFCVDVCPVDALKETKVHDLVFNNRKQLIFDPDRFNVDIDDVPMQDKPVRKVKAIIDEKRGIKYVPADE

SEQ ID NO: 56322 - protein, 206 aa, Triticum aestivum
MSQGEQAQTRAMKSLAAVLLVAILLQLAGCSPPPDPVTCTDGTSNCTVTNTYGSFTDRTICHAANVVYPSTEQELVAAVAAAASAKRKMKVATKHSHSGPKLACPGGSEGTIISTTRLNRTVSIDAERQLITVESGMVLRDLIQAAAAAGLSLPHSPYWYGLTIGGLLATGAHGSGLWGKGGAVHEYVVGLRIVTPAPACDGFAMV

SEQ ID NO: 56323 - protein, 279 aa, Xanthomonas campestris pv. campestris str. ATCC 33913
MPQCGFSAKAIGVLDGLGIDYAHVNVLADQEIREGIKAYGDWPTIPQLYVDGELIGGSDIIVQMADSGELSSMLGLQAPDRSPPKITITPAAVEMLKGALADAPDASLTLAIDANFQPNFQLAPTNPNAIAAESNGLRVQFDLASARRADGITIDWVDDIRGRGLAIDNPNAPKPVQELAVRDADDRLKAGTLTVVDVRPADERALATVAAPFRTLDAHERLEIEQLPKDTPLAFLCHRGGRSLQAAEHFRGLGFTNVYNVTGGIDAWSDAVDNGVPKY

SEQ ID NO: 56324 - protein, 303 aa, Oryza sativa (japonica cultivar-group)
MEKYEKLEKVGEGTYGKVYKAQDRATGQLVALKKTRLEMDEEGIPPTALREISILRLLSQSLYVVRLLSVEQATKNGKPVLYLVFEFLDTDLKKFVDAYRKGPNPRPLPTNVIKSFLYQLCKGVAHCHGHGVLHRDLKPQNLLVDKEKGILKIADLGLGRAFTVPMKSYTHEIVTLWYRAPEVLLGSTHYSTGVDIWSVGCIFGMMVRRQALFPGDSELQQLLHIFRLLGTPTEEQWPGVTDLRDWHEFPQWKPQILERQVPSLEPEGVDLLSKMLQYNPANRISAKAAMEHPYFDSLDKSQF

SEQ ID NO: 56325 - protein, 513 aa, Symbiobacterium thermophilum IAM 14863
MSQQRDLIVVVDFGGQYSHLIARRVREAQVYCEIWPFTAPVQRYREAGVKGIIFSGGPASVEQADAPRIDPAIYELGIPILGICYGMQLMALQLGGEVRRGQQGEYGRATLRLADAEHPLLRGLGRESLVWMSHFDSVTRVPSGFRVLGATENTAVAVMGDDARRLYGVQFHPEVVHTAQGREILRNFLFNIAGCRGDWTTESFITRQVEEIRRQVGSGRVLCALSGGVDSSVAAVLVHKAVGDQLTCIFVDHGLMRKGEPEQVVRTFRDHFHIHLVHVDASERFLSKLRGVTDPEQKRKIIGNEFIRLFEDEARKLGQIDFLVQGTVYPDVIESGTETARVIKSHHNVGGLPEDMRFQLIEPFRQLFKDEVRAVGRALGVPEEIVGRHPFPGPGLGVRVLGEVTPEKLEILREADRIFVEEIRKAGLYDELWQAFTVLPDVRSVGVMGDERTYAYPVVLRAVTSEDAMTADFYRLPWDLLERIASRIVNEVPHVNRVVYDVTSKPPGTIEWE

SEQ ID NO: 56326 - protein, 400 aa, Agrobacterium tumefaciens str. C58
MPAFKTIDDLNDIAGKRVLVRVDLNVPVADGKVTDATRIERVAPTILELSSKGAKVILLAHFGRPKGEPVAEMSLSQIVPTVEDVLDHAISFATDCIGAPAADAVAKMNDGDILLLENTRFHKGEEKNDPAFVEELAANGDIYVNDAFSAAHRAHASTEGLARHLPAYAGRTMQAELEALEKGLGQPVRPVVAIVGGAKVSSKIDLLMNLVKKVDALVIGGGMANTFLAARGTNVGKSLCEHDLAETAKQIMIEAATSGCAIVLPEDGVVAREFTAGAANEIVDINAIPADAMVLDVGPKSVESIKAWISRAETLVWNGPLGAFEIEPFDAATVAAAKHAAECTKAGKLVSVAGGGDTVAALNHAGVSDDFTYISTAGGAFLEWMEGKELPGVAILTTAK

SEQ ID NO: 56327 - protein, 371 aa, Ipomoea nil
MVSTITATVPSRVERLASSGIERIPKEYIRPEEERRSIGDIFEEEKIAGGPQVPTVDLKGINSEDLEVREKCREELRKAAVDWGVMHLVNHGISEELTGRVKAAGEGFFGQPIEEKEKYANDQAAGNVQGYGSKLANNASGQLEWEDYFFHCIFPEDKTDLSIWPKTPSDYIDATKEYAKQLRALATKVLAVLSLGLGLEEGRLEKEVGGMEELLLQMKINYYPKCPQPELALGVEAHTDVSALTFILHNMVPGLQLFYGGKWVTAKCVPNSIIMHVGDTVEILSNGKYKSILHRGVVNREKVRVSWAVFCEPPKDKILLQPLPETVSEAEPPRFPPRTFAQHIKHKLFRQSDQEAADTPKPDNDDHHQSN

SEQ ID NO: 56328 - protein, 249 aa, Azoarcus sp. EbN1
MYKIVLLRHGESTWNKDNRFTGWTDVDLTEKGVEEARGAGHLLKREGYTFDLAYTSVLKRANKTLNIVLEELDSLWLPVEHSWRLNERHYGDLQGLNKAETAAKFGDDQVLVWRRSYDTPPPPLPEGDERLTSGDPRYASLPRAQFPRTECLKDTVARFVPYWETVIVPNILAGRRILIAAHGNSLRALIKYLDNISDSEIVGLNIPTAQPLVYELDANLRPIRSYYLADADTIRAAEAAVAGQGKAKG

SEQ ID NO: 56329 - protein, 504 aa, Pseudoalteromonas tunicata D2
MRLCFFWIRNHHAETPAGQKLRLALEHLGPVWIKFGQMLSTRQDLLPVDVAQELALLQDKVPPFEGALAKQIIETALGLNDISECFSEFDSTPLASASIAQVHSAKIITANGQVEEIVIKVIRPDIEPIIHSDLYLMQDLAKLASQFLPDGKRLRPVEVIKEYRKTLLDELDLMREGANAIQLKRNFENSEALYIPYIYSDLSRKNVLVMERIYGIPVSDLTALKAQGTNLELLAERGVQVFFTQVFRDSFFHADMHPGNIFVSYNTPHNPQYIGIDCGIVGTLNKEDKRYLAENFIAFFNRDYRKVAELHVDSGWVPAETNVEEFEFAIRTVCEPIFQKPLAEISFGHVLVNLFNTARRFNMQVQPQLVLLQKTLLYVEGLGRQLYPQLDLWKTAKPFLEQWVKDQVGPMAVLKNIQANLPFWGEKLPELPDLIYNSLKNQHKNANQPIIRNEIELKPLLLGLLACSSLVIASIFYVSANQPFAIGSFIFAAICFVCAWNKAK

SEQ ID NO: 56330 - protein, 401 aa, Prochlorococcus marinus str. MIT 9313
MAKRSLSNLSAADLRSKRVLVRVDFNVPLNENGAITDDTRIRAALPTINDLIDKGARVILSAHFGRPKGQINEGMRLTPVAKRLSELLGKNVTKTESCVGSDAEAKVNAMADGDVVLLENVRFFSEEEKNDANFAQKLAALADAYVNDAFGAAHRAHASTEGVTKFLNPSVAGHLMEKELQYLQGAIDDPKRPLAAIVGGSKVSSKIGVLEALIDKCDKVLIGGGMIFTFYKARGLSVGKSLVEEDKLELAKELEAKAKAKGVQLLLPTDVVLADDFAPAANSQTVSIDAIPDGWMGLDIGPDSINLFQDALADCQTVIWNGPMGVFEFDKFAAGTNAIATTLADLSGKGCCTIIGGGDSVAAVEKAGLAEKMSHISTGGGASLELLEGKVLPGVAALDDA

SEQ ID NO: 56331 - protein, 346 aa, Neisseria meningitidis Z2491
MQAVVVNKNVAGDVEVVEREVRPLEYGEALVEVEYCGVCHTDLHVAAGDYGEKPGRVLGHEGIGLVKEVADGVKHLKVGDRVSIAWLFQSCGSCEYCNTGRETLCRSVLNAGYTADGGMATHCIVSADYAVKVPEGLDPAQASSITCAGVTTYKAIKVSSVRPGQWIAIYGAGGLGNLGVQYAKKVFGAHVVAIDINDDKLAFAKETGADLVVNAAKEDAAKVIQEKTGGAHAAVVTAVSAAAFNSAVNCVRAGGRVVAIGLPPESMDLSIPRLVLDGIEVVGSLVGTRKDLEEAFQFGAEGLVVPKVQLRALDEAPAIFQEMREGKITGRMVIDMKKECGCGHHR

SEQ ID NO: 56332 - protein, 178 aa, Zea mays
  misc_feature (65)..(65): Xaa can be any naturally occurring amino acid
  misc_feature (91)..(91): Xaa can be any naturally occurring amino acid
  unsure (1)..(178): unsure at all Xaa locations
LLAAWWPSSRLLKPAAIKGPPGSSISGRKLAVARAARRSIRRPRADAAEDTYGDDSVYFDLDHIXDTPERGTLYRSDAAAAYNPLQRTFFXVRGIRVTKRELVRKFLVLEGGSLLAYDSAEAAPDLLSIQKGPHEASQPVPLGKIEAQRLHLDGLEIWLALRSVGRSVTDVMDDLSIL

SEQ ID NO: 56333 - protein, 386 aa, Symbiobacterium thermophilum IAM 14863
MDRLAKRDYYEILGVPRNATEAEIKKAFRNLARKYHPDANKDDPDAAEKFKEINEAYQVLSDPEKRARYDQFGHAAEQMGGAGGNPFEGFGGFGDFGGFSDIFEMFFGGAGRQRNPRGPVRGADLEYELELTLKEAAFGCTKELRVPRVEDCDTCHGSGARPGTQPVTCPKCGGTGQVQMTQHTVFGRFVNVMTCDRCRGEGKIVESPCPTCRGRGRVQKTQRVEVKVPGGVETGTRLRMPGYGEAGERGGPPGDLFIVMRVRPDRRFRREGDDLFTTTEISFIQAALGTEIEVETLDGPELIKIPEGTQPGDTIRLKGKGTHRLRGSGRGDLHVVISVKTPGRLSERERELLLEVAALRGERVAGMTENKEKSFLKKMKDALGGR

SEQ ID NO: 56334 - protein, 231 aa, Triticum aestivum
  misc_feature (6)..(6): Xaa can be any naturally occurring amino acid
  unsure (1)..(231): unsure at all Xaa locations
WYSKRXQDLFNAVGSMYAAVLYLGIQNSGTVQPVVAVERTVFYRERAAGMYSAFPYAFGQVAIEFPYILVQTVIYGVLVYSMIGFEWSVAKFFWYLYFMYFTLLYFTFYGMTAVGLTPNESVAAIISGAVYTAWNLFSGYLIPRPKIPVWWRWYSWICPVAWTLYSSGRPGRCDIQTKLVTKDQTVAQFIAEFYGFDRDLLWVVAVVHVAFTVAFAFMFSFAIMRFNFQRR

SEQ ID NO: 56335 - protein, 447 aa, Desulfotalea psychrophila LSv54
MEKSMKKSDIIIIGGGAAGIVAVNTIHALNPGLSLTLIKDEEALVNRCSIPYGMGREKGIENYIVPNSHITATGADLVIGRVEEIDTRKKEVILQTGESYAYGQLLLATGSRPILPQLPGIESERILVVRSLGDLERLRVSVRSGRRALVVGGGYVGVELATELQQLGLRVSLVEMRERILLATTEPEFITEVEQMLEGRGIHLMTGRQVTAFEDDGRERVGVRLDDGTVLEVDLVVFSAGVVPNMELAQRAGIATSSLGIITDKSLRTSVRDVFAAGDCAEKQAFVTGQPTRGDFGTNAVFMGSVAGQNMAGMAASFMGTINANVSMVYDTSFGSAGLTEAGARQAGIDVVVGFSETLDKYPMIDGAAPLRTKLIFTRSNGVLIGGSVMKEGRGVAPHIDLISLAIQKRTTIEEFLCHQYATHPQLAAVPTENSCLLATMAAMASR

SEQ ID NO: 56336 - protein, 539 aa, Mycobacterium avium 104
MPRTAHTSVVLLDGSAQLPRETLGNKGYGLNIMRRNGLPVPPAFCITTEICAQWLDDPGTTIDGLSETLTQMIHCLEEQTSRTFGRGPRPLLVSVRSGAALSMPGMMDTVLNLGMNDTVEQALAQTFSARFAMDTRARFADMYRRIVLDGDASAAVPDDPFLQLLGAIEAVFASWNSPRAVAYRKHHGRDDLGGTAVVVQAMVFGNMESNSGTGVLFSRNPITGADEPFGEWLSSGQGEDVVSGTFDARPISVLAEEQPHVYDELVAAARTLERLGSDVQDIEYTVEEGKLWLLQTRAAKRSAQAAVRLALKLRDEGLIDDMETLRRVTPAHIETLLMPSLQPETRLAAPLLAKGLPACPGVVSGRAVTDVYDAIDAAEDGQDVILVRRSTSPDDVQGMIAALGIVTGIGGTTSHAAVVSRELGRPSVVGCGADVTDALAGKLITVDGTEGEVREGILELTAWSEDDSSDLAELTRIALAVSPLRAHTTGDYPPLDAGSDDAVRAALAAGHTDVLSSTPLITMLTAVRLAGTDTRELSR

SEQ ID NO: 56337 - protein, 121 aa, Triticum aestivum
  misc_feature (40)..(40): Xaa can be any naturally occurring amino acid
  misc_feature (78)..(78): Xaa can be any naturally occurring amino acid
  unsure (1)..(121): unsure at all Xaa locations
PLSPKFRGEHALRRYPTGEERCIACKLCAAACPANAITIXSEPRPDGSRRTTRYDIDMTKCIYCGFCQEACPVDAIVXGPNYENATINHEELFYNKEKLLSNGDRWEPQLARNIESQIRQF

SEQ ID NO: 56338 - protein, 563 aa, uncultured crenarchaeote
MCGIVGILSKKERNVAPLIGKMLSCMKNRGPDGMGLSTENQIVYSDTFDNPLFSQVEGHDVLGHSRLAIVGGSCGQQPFVSCDKKLILEHNGEIYNYKEIRKNLSAHHTFTTSTDSEVIVHLLEDHYQNTKGDLIEAIRRTVTQLDGIYVLAIREQSTGDIVLVRDGIGVRQIYYGESSDFIAFASERKALWKIAMSDQIKRLLPGYALVISRKEGSSNFKTTLFPISVNTKKSICEKYSILYTDIDSAVNAYGDTLVESMRKRVSDFKKIGIVFSGGIDSVIVAYLAKQMAPEVICYTSGIKGSSDILNSLEIAEKLDLKLEIEQMTESDVESTIPKIISIIEDDNMGQVEVAIPIYGAVKLAHEQGIRVMLTGQGADELFGGYSWYSKIVKKHGYEKIQGYLIEDIKLLYKETLEREDKITMSQSIELREPFLDTNLIDTVLRIDPRLNIQNNGNNYDNLGKRVHRKLAEKLGIPKEIAYRIKEAAQHGSGIHNTLNTLAMKNGFTESKVNSSYLDKLKKRELIGSSQRYGHLFEKEQIWSLEPHIQMYLENISKNILPRN

SEQ ID NO: 56339 - protein, 324 aa, Dendrobium cv. 'Sonia'
MESRSFPVINMELLEGSQRSDAMAVLRDACENWGFFELLNHGISHDLMNRVETVNKEHYRRFREQRFKEFAAKTLDSGENVVADNLDWESTFFLRHLPTSNISQIPDLDEDCRSTMKEFALELEKLAERLLDLLCEDLGLEKGYLKRVFCGGSDGLPTFGTKVSNYPPCPKPELIKGLRAHTDAGGIILLFQDDKVSGLQLLKDGEWVDVPPMRHSIVVNIGDQLEVITNGRYKSVMHRVVAQTNGNRMSIASFYNPGSDAVIFPAPELVEKEAEEKKKEVYPKFVFEDYMKLYVRQKFEAKEPRFEAMKTMDTVISSQLIPTA

SEQ ID NO: 56340 - protein, 133 aa, Brassica napus
  misc_feature (7)..(7): Xaa can be any naturally occurring amino acid
  misc_feature (9)..(10): Xaa can be any naturally occurring amino acid
  misc_feature (12)..(12): Xaa can be any naturally occurring amino acid
  misc_feature (16)..(18): Xaa can be any naturally occurring amino acid
  misc_feature (21)..(22): Xaa can be any naturally occurring amino acid
  misc_feature (29)..(29): Xaa can be any naturally occurring amino acid
  misc_feature (34)..(38): Xaa can be any naturally occurring amino acid
  misc_feature (45)..(49): Xaa can be any naturally occurring amino acid
  misc_feature (51)..(52): Xaa can be any naturally occurring amino acid
  misc_feature (54)..(54): Xaa can be any naturally occurring amino acid
  misc_feature (58)..(60): Xaa can be any naturally occurring amino acid
  misc_feature (62)..(63): Xaa can be any naturally occurring amino acid
  misc_feature (65)..(65): Xaa can be any naturally occurring amino acid
  misc_feature (82)..(82): Xaa can be any naturally occurring amino acid
  misc_feature (85)..(87): Xaa can be any naturally occurring amino acid
  misc_feature (91)..(91): Xaa can be any naturally occurring amino acid
  misc_feature (101)..(101): Xaa can be any naturally occurring amino acid
  misc_feature (103)..(103): Xaa can be any naturally occurring amino acid
  misc_feature (112)..(112): Xaa can be any naturally occurring amino acid
  misc_feature (116)..(116): Xaa can be any naturally occurring amino acid
  misc_feature (119)..(123): Xaa can be any naturally occurring amino acid
  misc_feature (127)..(127): Xaa can be any naturally occurring amino acid
  misc_feature (132)..(132): Xaa can be any naturally occurring amino acid
  unsure (1)..(133): unsure at all Xaa locations
MASSMLXSXXGXTSPXXXTMXXPFSGLKXSAAFXXXXXGNNDITXXXXXGXXVXCMKXXXPXXKXKFETLSYLPDLTEVELXKEXXXLLRXKWIPCVEFEXAXMDLRTVSTXAHPXTMXXXXXPCGXFPCSXA

SEQ ID NO: 56341 - protein, 114 aa, Symbiobacterium thermophilum IAM 14863
MAHDCVFCKIAAGEIPSSKVYEDEHVLAFRDINPVAPVHVLVIPKQHVPSVAEFGPEHDELLSRLFAAVRKVAAETGVAETGYRVVTNVGKDAGQQVFHVHLHVLGGRPLGPVA

SEQ ID NO: 56342 - protein, 537 aa, Oryza sativa (japonica cultivar-group)
MELAMDFALRLRDAANHHLSRYEPLVLLAAPLLALLAARTLHAAAAAVADRGLRTVLLALAMTAIKLLPGVSAYINAEKRKVVDQLQSGGTSTKSTLRTELPTVGLSNQVINDLETLKARDVNWQGKCSGTVYIAGSESEGHFALINKAYSMFSHTNPLHQDVFKSVAQLEAEVVAMTAALLGIKEKSSGGQICGNMTSGGTESILLAVKTSRDYMRTKKGITKPEMIIAESAHSAYDKAAQYFNIKVRRVPVNKEFLADVKGFKRCINGNTIMMVGSAPGFPHGLIDPIEELGELASRYDICLHVDLCLGGFVLPFARTLFLHSTSVSRELHQSQLMFINILTLFPPSIWHWHLGYYHQIQHQFVAVTEWTGGLYVSPTIAGSRPGGLIAGAWAAMTSLGLNGYMENTGHIMEVSKKIQRGIEDIPGLFVIGKPDMTVVAFGSDSVDIFEVNDIMSSKGWHLNALQRPNSLHICVTLQHTVIYEEFLKDLKDSVDTVKANPGPISGGRAPIYGAAGKMPDRGMVRELLVEFMDASC

SEQ ID NO: 56343 - protein, 135 aa, Brassica napus
  misc_feature (2)..(2): Xaa can be any naturally occurring amino acid
  misc_feature (12)..(12): Xaa can be any naturally occurring amino acid
  misc_feature (26)..(28): Xaa can be any naturally occurring amino acid
  misc_feature (33)..(33): Xaa can be any naturally occurring amino acid
  misc_feature (43)..(43): Xaa can be any naturally occurring amino acid
  misc_feature (45)..(45): Xaa can be any naturally occurring amino acid
  misc_feature (49)..(50): Xaa can be any naturally occurring amino acid
  misc_feature (55)..(55): Xaa can be any naturally occurring amino acid
  misc_feature (58)..(60): Xaa can be any naturally occurring amino acid
  misc_feature (62)..(62): Xaa can be any naturally occurring amino acid
  misc_feature (64)..(64): Xaa can be any naturally occurring amino acid
  misc_feature (67)..(67): Xaa can be any naturally occurring amino acid
  misc_feature (71)..(73): Xaa can be any naturally occurring amino acid
  misc_feature (79)..(80): Xaa can be any naturally occurring amino acid
  misc_feature (82)..(83): Xaa can be any naturally occurring amino acid
  misc_feature (85)..(85): Xaa can be any naturally occurring amino acid
  misc_feature (93)..(93): Xaa can be any naturally occurring amino acid
  misc_feature (99)..(100): Xaa can be any naturally occurring amino acid
  misc_feature (104)..(104): Xaa can be any naturally occurring amino acid
  misc_feature (107)..(109): Xaa can be any naturally occurring amino acid
  misc_feature (122)..(122): Xaa can be any naturally occurring amino acid
  misc_feature (125)..(125): Xaa can be any naturally occurring amino acid
  misc_feature (130)..(130): Xaa can be any naturally occurring amino acid
  misc_feature (133)..(134): Xaa can be any naturally occurring amino acid
  unsure (1)..(135): unsure at all Xaa locations
MXSSMLSSAAVXTSPAQATMVAPFTXXXSSAAXPVTRKANNDXTXIASXXGRVSXMKXXXPXAXKKXETLXXXPDLTEXXLXXEXDYLLRNKXIPCVEXXLEHXLVXXXHGSTPGYYDGRDXTMXKLPLXFGXXD

SEQ ID NO: 56344 - protein, 353 aa, Brassica napus
  misc_feature (168)..(168): Xaa can be any naturally occurring amino acid
  unsure (1)..(353): unsure at all Xaa locations
MMSGSRLIIFAIISTTVFTVGSIRLLPEDASSDFMEAPAYINGPECSVLPQNRLLLACDPSAVHIAMTLDPAYLRGTVSAVHSILKHTSCPQNIFFHFIASGSSHVKTLSSVFPSLSFKVYTFDETLVKDLISSSIRQALDSPLNYARSYLSEILSSCVHRVIYLDSXVIVVDDIKKLWKTSLTGSRTIGAPEYCHANFTKYFSDSFWSDRNLSRVFDSKSPCYFNTGVMVIDLERWREGDYTRKIENWMRIQKEERIYELGSLPPFILVFSGEIEAIDHQWNQHGLGGDNVVSSCRSLHPGPVSLIHWSGKGKPWVRLDDGKPCPVDYLWAPYDLHKSQRQYLQYNQELEIL

SEQ ID NO: 56345 - protein, 1149 aa, Candida albicans SC5314
MITLKAAITQQFKITKKSISFVHKHSFSSSSLLKQKEQLRYAGADLLKNFTDEHAHKLVDVSKVLVIGSGGLSIGQAGEFDYSGSQAIKALKEANKQSILINPNIATNQTSHALADEIYYLPVTPEYITYIIERERPDGILLTFGGQTGLNVGVKLDKMGVFERYGVKVLGTPIKTLETSEDRDLFAQALKEIDIPIAESIAVETVDDALNAAKEVGYPIIVRSAYSLGGLGSGFAANEEELRNLAAQSLSLAPQILVEKSLKGWKEVEYEVVRDRVGNCITVCNMENFDPLGIHTGDSIVVAPSQTLSDEEYHMLRTAAIKIIRHLGVVGECNVQYALQPDGLDFRVIEVNARLSRSSALASKATGYPLAYTAAKIALGHTLPELPNPVTKTTTANFEPSLDYLVTKIPRWDLSKFQHVKRDIGSAMKSVGEVMAIGRNFEESFQKAIRQIDPSYIGFQGDHFDNLDEALANPTDRRWLAVGQALLHENYTVDQVHELTKIDRWFLHKLMNIVNMYRELEANGHLSIINHDLMSRAKKLGFSDKQIGLCVGADELEVRRVRKELGIIPFVKKIDTLAAEFPANTNYLYTTYNATSSDIDFNDKGTMVLGSGVYRIGSSVEFDWCAVSTARALRENGHKTIMINYNPETVSTDFDEVDRLYFEELSLERVLDIYELEHAQGVVVSVGGQLPQNIALSLQNQGCNVLGTNPEDIDKAEDRHKFSQILDSIGVDQPAWKELTSVKEAEEFANEVGFPVLVRPSYVLSGAAMSVINNKSELDAKLSNAAKVSRDYPVVISKFIQGAQEIDVDGVANDGEVLVHAISEHVENAGVHSGDATLVLPPQGLSPILLDRLKVIADKVAAAWKITGPFNMQIIKNDQNGTLNDETCELKVIECNIRASRSFPFVSKVLGINFIDVAVKALIKQNVPQPVNLMNEKYDHVATKVPQFSFTRLAGADPFLGVEMASTGEIACFGKDLLEAYWTSIQSTMNFHLPKPGQGLLFGGDLTNDKLGKVAANLTGLGYKFYTASEPVAQYLKQNNFVNEPVEIIEFPKTDKRALREIFQDKEIGAVFNLAKARAEDLLDEDYVMRRNAIDFAIPLFNEPNTSLLFSQCLKEKIGHKVSFDEIPHKVEIPDEVKRWSEFIGGKPV

SEQ ID NO: 56346 - protein, 449 aa, Frankia sp. EAN1pec
MVVPSTAPASDDLFRRAQRVVPGGVNSPVRAFRAVGGTPRFMTSGSGPRLVDADGRTYVDLVCSWGPMILGHAHPDVVQAITAAAARGTSFGTPTPGEVELAELIVERVAPVEQVRLVNSGTEATMSAIRLARGFTGRPTIVKFAGCYHGHVDALLASAGSGVATLGLPDTPGVTGAATADTIVLPYNDLALVEATFAERGDTIAAVITESVAANMGVVPPLPGFNAGLRRLCDAHGALLVFDEVMTGFRVSRTGWWGLEGAVEGWAPDLFTFGKVMGGGLPAAAFGGRADVMARLAPAGPVYQAGTLSGNPLAVAAGLATLRACTDEVYATVDARAADVAGIVSTALNEQGVPHLLNSAGSLFSVFFTDATAVIDYAGAKRQASERYAAFFHSMLDAGVYLPPSAFEAWFVSAAHDDEAVERIAAAAPAAARAAAAVGAPVAVGGGAV

SEQ ID NO: 56347 - protein, 246 aa, Glycine max
MEKEKEKESKLKNKIFKILPKAAAAAVSMTFQNPPFSPGRDHKFKHHGGKGFFSGPMIPVEARRKSKDGCVETQEPTSPKISCMGQIKHKKKKNQIKKAAKTMSMPTEEKKQASKFQRMMSFHSGKPKRPAARKQQSDADLESERSPAPPLGHMRRFASGRETFSNFDWKAQIAPEERDCYSYYDDRLESDAEDEIIIPFSAPLTVGGAASALNLNAQPRKEINLWKRRTMAPPRPLQLNPVLTAK

SEQ ID NO: 56348 - protein, 588 aa, Malus x domestica
MKVKVVDHENDVGVVGAKASDALPLPLYLTNAVFFTLFFSVVYFLLTRWREKIRTSTPLHVVNLSEIVAILAFVASFIYLLGFFGIDFVQSLILRPSNDVWAADDDEEEHERLILKDDARKVPCGAGLDCSPIPQIAPVAAAAPKAVAQKVFDKEVVLSTPCDFTAQPLTEEDEEVVKSVVAGTIPSYSLESKLGDCRRAAAIRREALQRITGKSLGGLPLEGFDYESILGQCCEMPVGYVQIPVGIAGPLMLDGREFSVPMATTEGCLVASTNRGFKAINLSGGATSVLLRDGMTRAPCVRFNSAKRAAELKFYLEEPKNYDTLSTVFNRSSRFGRLQTIKCAIAGKNLYMRFTCSTGDAMGMNMVSKGVQNVLDFLQNDFPDMDVIGISGNYCSDKKPAAVNWIEGRGKSVVCEAVIKGDVVQKVLKTNVASLCELNMLKNLTGSAMAGALGGFNAHASNIVSAIYIATGQDPAQNVESSHCITMMEPINDGQDLHVSVTMPSIEVGTVGGGTQLASQSACLNLLGVKGANREAPGSNARLLATVVAGSVLAGELSLMSAISAGQLVNSHMKYNRSSKDVSAVASA

SEQ ID NO: 56349 - protein, 309 aa, Agrobacterium tumefaciens str. C58
MERAGLAALEDALRNGLSEPFCKAIETIGQSNGRLIITGVGKSGHIGAKLAATFASTGTPAFFVHAAEANHGDLGMIGGDDVVLAISKGGESAELRSIINYSRRFSIPLIALTCSENSSLARASDIVLLVPNEQEACPLGLAPTTSTLMQLALGDALAVALLEARNFTAGDFKVFHPGGKLGASLTLVSDIMHTGDRVPLVNKGTAMPEAVGVLSRKHFGCVGILDEDGRLCGIVTEGDMARNLSRNLAELVVDDIMTRSPKTVKKSVLATSALATLEKFHIGALIVVDDDNRPIGLVHFHDLLRIGVA

SEQ ID NO: 56350 - protein, 100 aa, Malus x domestica
EPIDGKDLHVSVTMPSIEVGTVGGGTQLASQAACLNLLGVKGASRDSPGSNSRKLATIVAGSVLAGELSLMSAIAAGQLVNSHMKYNRSSKDVSKLAGPR

SEQ ID NO: 56351 - protein, 916 aa, Candidatus Desulfococcus oleovorans Hxd3
MKTTKWVYLFDELDQAMANVGNDWDAVRGLFGGKGANLADMQRLGVPVPPGFTVTTEACNAYLEGGGVFPDDMWDQELRALLAIEKNTGKIFGDSENPLLVSCRSGAKFSMPGMMDTVLNIGLTDETAQGMIRLTQDPRFVYDAYRRLIQMFGAVVMGVPDEPFESAIDRAKQKAGVSADTELTAEQWHLLTEQFKTIFHSHTQIDFPQDPVEQLKMSTEAVFKSWNGRRAVDYRNAAGIAHDLGTAVNIVTMVFGNMGDDCATGVAMTRNGATGEPGLEGDYLINAQGEDVVAGIRMTRNIDQLATEMPESYRQLQEIARILENHYRDMQDMEFTIEKGKLWMLQTRDGKRTAQAAVRIAVDMVEEGRITKEEAVARVSPGQVDFFLHPQFDNQAVAEARAGGKVLARGLNVSPGAAVGKVVFEADLAATWAREQGRQVLLVRPETKPDDVHGMLAANGILTSRGGRTSHAALVARQFGKPAVVGVSDLQINLVKRCMTVGDLTIQEGDWLSLDGNTGEVFIGQIKTMEPDIKDPWLIKLLEWADRIRSLDVMANADYPVDAGRAREYGAQGIGLCRTEHMFFESERLPHVQKMIMATLPFDRREALAALLPFQREDFAGLFRVMDGLPVIIRLIDPPLHEFMPDLVELINELADLKMRVNHATNMADIDSLLQQIRGKERIRQRTVQLQEQNPMLGLRGVRLGIQIPELTGMQVRALFEAACEVTREGIRVFPKIMIPLTTHANELKRQREVLEETAKKVMAEQGITIDYKFGTMIELPRAALTADRIAAHAEFFSFGTNDLTQTTFGISRDDAESGFLMSYLNQDILPDNPFATLDRDGVGELMRIGVTKGRSVRPDLECGICGEHGGDPESIALCHELGLDYVSCSPFRVPVARLAAAHAALKSKNRKPAGA

SEQ ID NO: 56352 - protein, 385 aa, Cupriavidus necator
MSEAQPLVTPKPKKSVALSGVTAGNTALCTVGRTGNDLHYRGYDILDIAETCEFEEIAHLLVHGKLPTKSELAAYKAKLKSLRGLPANVKAALEWVPASAHPMDVMRTGVSVLGTVLPEKEDHNTPGARDIADRLMASLGSMLLYWYHYSHNGRRIEVETDDDSIGGHFLHLLHGEKPSALWERAMNTSLNLYAEHEFNASTFTARVIAGTGSDMYSSISGAIGALRGPKHGGANEVAFEIQKRYDNPDEAQADITRRVENKEVVIGFGHPVYTTGDPRNQVIKEVAKKLSKDAGSMKMFDIAEALETVMWDIKKMFPNLDWFSAVSYHMMGVPTAMFTALFVIARTSGWAAHIIEQRIDNKIIRQSANYTGPENLKFVPLKDRK

SEQ ID NO: 56353 - protein, 504 aa, Arabidopsis thaliana
MIYDLMMIANSIIFHMRSGSRMILKRTYNTSDAGSIFLCSTSSNNSKRCRTFISFDVLEYLIREAKEIFDSERVASGWVEAGTGKSRLRDFFSSLLTSLGGALLQITEEDQQQGSDIMASSRVSDLPHQRGIAGEIKPKNVAGHGRQNRKVLGDIGNLVTGRDVATGKDVAKKAKQPQQQTKAEVIVISPDENEKCKPHFSRRTHIRGTKTFTATLRARSKAASGLKDAVIDIDAVDANNELAAVEYVEDIFKFYRTVEEEGGIKDYIGSQPEINEKMRSILIDWLVDVHRKFELMPETLYLTINLVDRFLSLTMVHRRELQLLGLGAMLIACKYEEIWAPEVNDFVCISDNAYNRKQVLAMEKSILGQVEWYITVPTPYVFLARYVKAAVPCDAEMEKLVFYLAELGLMQYPIVVLNRPSMLAASAVYAARQILKKTPFWTETLKHHTGYSEDEIMEHAKMLMKLRDSASESKLIAVFKKYSVSENAEVALLPSLDDFSVSCA

SEQ ID NO: 56354 - protein, 157 aa, Vibrio parahaemolyticus RIMD 2210633
MSKFLFPIIIFVLAAFFIYRTWTNHKVADENFAKGQAFLLENAKKEGVITTESGLQYLVLEKGTGDVHPTATSKVKVHYHGTLIDGTVFDSSVNRGEPITFGLNQVIKGWQEGLQYMVVGEKIRLFVPSTLGYGKNGTGPIPPASVLIFDVELLEIQ

SEQ ID NO: 56355 - protein, 237 aa, Oryza sativa (japonica cultivar-group)
MASRATSVSRAGTLALALAGDDDCFPDGLNSTAAAAAAADDDARDAMDMGAMSDPERMFFFDLACQNAKVTYEQNPHDADNLTRWGGALLELSQMRNGPESLKCLEDAESKLEEALKIDPMKADALWCLGNAQTSHGFFTSDTVKANEFFEKATQCFQKAVDVAPELHMEIHRQMASQASQAASSTSNTRQSRKKKKDSDFWYDVFGWVVLGVGMVVWVGLAKSNAPPQAPSVNWSG

SEQ ID NO: 56356 - protein, 472 aa, Triticum aestivum
MAFFRGLAAVSRLRSRMGQDATTLGGVRWLQMQSASDLDLRSQLQEMIPEQQDRLKKLKSEHGKVQLGNITVDMVLGGMRGMTGMLWETSLLDPEEGIRFRGLSIPECQKVLPAAVKDGEPLPEGLLWLLLTGKVPTKEQVDALSKELLSRSIVPGYVYKAIDALPVTAHPMTQFTTGVMALQVESEFQKAYDKGMPKTKFWEPTYEDCLNLIARLPQVASYVYRRIFKDGKAIAADNTLDYAANFSHMLGFDDPKMLELMRLYITIHTDHEGGNVSAHTGHLVGSALSDPYLSFAAALNGLAGPLHGLANQEVLLWIKSVMEETGSNITTDQLKEYVWKTLKSGKVVPGYGHGVLRNTDPRYSCQREFALKYLPEDPLFQLVSKLYEVVPPILTELGKVKNPWPNVDAHSGVLLNHFGLTEARYYTVLFGVSRSIGIGSQLIWDRALGLPLERPKSVTMEWLENHCKKVAA

SEQ ID NO: 56357 - protein, 325 aa, Mycobacterium avium 104
MDFGDPAFAATVRDGVGRIEQLMDTELRSADDIMTELLTHLFKAGGKRFRPLFTVLSAQIGPDPDAAEVTIAGAVIELVHLATLYHDDVMDEAEVRRGTPTANVRWGNNVAILAGDYLFATASRLVSRLGPEAVQLIAETFAQLVTGQMRETRGRKEGSDPIEHYLKVVYEKTACLIAAAGRFGAMFSGADADQVERLSRLGGIVGTAFQISDDIIDIDSDSHESGKLPGTDVREGVHTLPMVYALREPGPDAARLRELLVGPIDDDEVVAEALTLLRASPGMAKAKQSLREYAAQAHRELDQLPDVPGRRALQTLVDFTISRHG

SEQ ID NO: 56358 - protein, 357 aa, Glycine max
  misc_feature (190)..(190): Xaa can be any naturally occurring amino acid
  unsure (1)..(357): unsure at all Xaa locations
MARYGEGDKRWIVEDRPDGTNVHNWHWSETNCLDWSKTFFTSLLTNLPILDGEGNLFLKTTSLRSLDGEAYINVRKGKIIPGYEISLTLNWQGEAKDTLGTSLLKVDGTVEIPYISDENADEDPEVRVTVNDEGPVGMRIKDAMLSKGKPLILEKVRVWVQSMAKGGPVKDELEPKKVAPSSLAPSPAAXQRQTTTPTTTKTTAAAPKKEEKKEKVKKGRKSISMTERFNCRAKDLFEILMDENRWKGFTQSNARISKEVGGEFSIFDGSVTGTNLELQEGKLIVQRWRFGSWNDGVQSTVRLEFEEPESGVTVVKLTHTDVPEEDRYGNATVVENTERGWRDLIFQRIRAVFGFGI

SEQ ID NO: 56359 - protein, 465 aa, Zea mays
MEVSSVEFGHAAAASKCFDDDGRLKRTGTMWTASAHIITAVIGSGVLSLAWAIAQLGWVAGPTVMLLFSFVTYYTSALLADCYRSGDACTGKRNYTYMDAVNANLSGVKVWFCGFLQYANIVGVAIGYTIAASISMLAIQRANCFHVEGHGDPCNISSTPYMIIFGVVQIFFSQIPDFDQISWLSILAAVMSFTYSTIGLGLGIAQVVSNKGVQGSLTGISVGLAFGDIAFAYSYSLILIEIQDTIRAPPPSESKVMRRATVVSVAVTTFFYMLCGCMGYAAFGDNAPGNLLTGFGFYEPFWLLDVANAAIAVHLVGAYQVYCQPLFAFVEKWARQRWPKSRYITGEVDVPLPLGTAAGRCYKLSLFRLTWRTAFVVATTVVSMLLPFFNDVVGLLGALGFWPLTVYFPVEMYIVQKKVPRWSTRWVCLQLLSVACLVITVASAAGSVAGIVSDLKVYKPFVTTS

SEQ ID NO: 56360 - protein, 412 aa, Medicago sativa
MMASGGVAPASGFIDKNASSVGVEKLPEEMNDMKIRDDKEMEAATIVDGNGTETGHIIVTTIGGKNGQPKQTISYMAERVVGHGSFGVVFQAKCLETGETVAIKKVLQDKRYKNRELQTMRLLDHPNVVSLKHCFFSTTEKDELYLNLVLEYVPETVSRVIRHYNKMNQRMPMIYVKLYSYQICRALAYIHNSIGVCHRDIKPQNLLVNPHTHQLKICDFGSAKVLVKGEPNISYICSRYYRAPELIFGATEYTTAIDIWSAGCVLGELLLGQPLFPGESGVDQLVEIIKVLGTPTREEIKCMNPNYTEFKFPQIKAHPWHKIFHKRMPPEAVDLVSRLLQYSPNLRSTALEALVHPFYDDVRDPNTRLPNGRFLPPLFNFKVNELKGVPAEMLVKLVPPHARKQCALFGSS

SEQ ID NO: 56361 - protein, 370 aa, Oryza sativa (japonica cultivar-group)
MASGTDEKAKMEGLTSAAAFVEGGIQDACDDACSICLEAFCESDPSTLTGCKHEFHLQCILEWCQRSSQCPMCWQPISLKDPTSQELLEAVERERNLPVVGNDAELEERILQHLAAAAAMGRSHHLGRREGHRGRSGSHGRPQFLVFSSHPNMPSAGSVSSSSVQGEVDNESSPVHTTGELSLHANTHEEAGNQSPGMLTYDADQDAVVSSGNSTPVSSPRFFNRRHSTGQSTPVNNDRAGPSDLQSFSDSLKSRLNAVSMKYKESITKSTRGWKERLFSRHSSVADLGSEVRREVNAGIASVSRMMERLETRGSNGRTSDGPAISTSEVIPSTESSNERVTENNPTTAATSSGNTSASSAPCVTTTGSN

SEQ ID NO: 56362 - protein, 494 aa, Solanum lycopersicum
MSSVSSKYPAIASSSDNESCKPLLQVREIPGDYGFPFFGAIKDRYDYYYSLGADEFFRTKSLKYNSTIFRTNMPPGPFIAKDPKVIVLLDAISFPILFDCSKVEKKNVLDGTYMPSTDFFGGYRPCAFLDPSEPSHATHKGFYLSIISKLHTQFIPIFENSVSLLFQNLEIQISKDGKANFNDISDAMSFDFVFRLLCNNTNPLDTKLGTTGPKCFDLWMLPQLAPLVTLGLKFVPNFLEDLMLHTFQLPFFIIKSKYQKLYDAFNEHAGSTLDDAEKSGIKGDEACHNLVFLAGFNAYGGMKILFPSLMKWVASGGKSLHTPLANEIRTIIKEEGGSITLSAINKMSLVKSTVYEVLRIEPPIPFQYGKAKEDIMVQSHDSNFLIKKGEMIFGYQTFATKDAKIFENPEEFIAERFMGSEGEKLLKYVYWSNARETDSPTVDNKQCAGRDLAVLLCRLLLVEFFMRYDTFTVESSKYLAGPLITFKTLEKKAI

SEQ ID NO: 56363 - protein, 249 aa, Oryza sativa (japonica cultivar-group)
MASGTDEKAKMEGLTSAAAFVEGGIQDACDDACSICLEAFCESDPSTLTGCKHEFHLQCILEWCQRSSQCPMCWQPISLKDPTSQELLEAVERERNVRTNQTRNTTIFHHPALGDFEVQHLPVVGNDAELEERILQHLAAAAAMGRSHHLGRREGHRGRSGSHGRPQFLVFSSHPNMPSAGSVSSSSVQGEVDNESSPVHTTGELSLHANTHEEAGNQSPGMLTYDADQDAVVSSGNSTPVSSPRFFNR

SEQ ID NO: 56364 - protein, 380 aa, Zea mays
MGCCGAAMSARPRGIHEETLLRVPGASVHLLAGSSDGPVELARGDLAVVRLTKDDVALATAVRVGRDLGWPLARDEPVVRLDPLHYLFTLPAADKDGTFLNYGVSFNAGAGADASALASLDGLLRSNACFSAPSSGAVVPPSKGSSRARPQPGPVVASGDGYWNEFAPRVEGYNGVLAKAIAAGTGQLVKGIFMCSEAYASQVQRGADLFRPQAAGSARSRFGDAAGGANRNTKPGAVNKSLKRVRKLSEMTEKMSQSLLDTVISVTGSMAAPLIRSKQGRAFLATVPGEVILASLDAINKVMDAVENAEKKSLAATSNVVAGAVSRRYGENAGEATQDAFATAGHAVGTAWNLFKIRKAVTPSSSMPGNMVKSAIKNRN

SEQ ID NO: 56365 - protein, 259 aa, Lactobacillus reuteri
MRKPFIIANWKMNKNVHESVAFVKAIKEKLPANKEIGIAAQAVSLYNMKKVAGSSNLQIIAQNASAELEGPYTGEISMRSLADAGVTYVMLGHLERRRLFNENNDSINQKVLAALNAGIIPIICTDEEMVQTEVNGQIHYVFRQLKSVLKGVPANKLSQIVISYEPSWAVGSTHQANPDIAEEGCLAIRQSLVEMYGNEIGEQVRILYGGSVNPENIGQIMSKPNVDGALIGRASLEIESFLQMINYIELASKQKSQVI

SEQ ID NO: 56366 - protein, 376 aa, Zea mays
MAISCFNGGAGWPEPVVRVQAVSDTCGDTIPERYVKPLSERPRLSPASDGSGPNIPVVDLSMLDVDATSSAVAAACREWGFFQAVNHGVRPELLRGARAAWRGFFRQPAEVRERYANSPATYEGYGSRLGTAKGGPLDWGDYYFLHLLPASLKSHEKWPSLPSSLRGATEEYGEEVLQLCRRVMRLLSSGLGLEAGRLQAAFGGEGGEGACLRVNFYPQCPQPELTLGVAGHSDPGGMTMLLVDDHVKGLQVRSPDGQWIVVEPVPDAFIVNVGDQIQVLSNAAYKSVEHRVTVSAAEDRLSMAFFYNPRSDLPIAPMAELVGPDRPALYPEMTFDEYRVFIRQRGLAGKAQLESLQVKAAAGGGGCSAAAASSTS

SEQ ID NO: 56367 - protein, 481 aa, Medicago truncatula
MGIQCSSLVPCCVDSQVKASVPEVPDAENENRIETNDGPSFREFTLEQLNNATSGFNVENIVSEHGEKAPNVVYKGKMENQTRIVVKRFNRSAWPDARQFLEEARSVGQLRSERLANLLGCCCEDDERLLVAEYMPNETLAKHLFHWDSQPMKWAMRLRVVLHLAEALEYCTSNGRALYHDLNAYRVLFDEDGNPRLSSFGLMKNSRDGKSYSTNLAFTPPEYLRTGRVTPESVIYSFGTLLLDLLSGKHIPPSHALDLIRDRNIQMLTDSCLEGQFSEDDGTELVRLASRCLQYEPRERPNTKSLVAALAPLQKETEVPSHSLMGIQHSATISASLSPLGDACSRKDLTAIHEVLENIGYKDDDGVANEDSLNCKQKGDAAFRHKDFKLAIECYTQFIDVGTMVSPTVHARRSLCYLINDMPQEAMNDAMQAQVISPLWHIASYLQSVSLSGLGMVNEAQVALMEGTTLEEKRNTPTGKK

SEQ ID NO: 56368 - protein, 645 aa, Sinorhizobium meliloti 1021
MCGFGGYLGSIRDGKPLLERMTAAIGHRGPDERGIFTAPGAGLGHVRLSIVGLGDGQQPMSNPSGELTIAFNGEIFNYVELRDELRARGRQFRTSSDTEVILHLYEEMGEDCLSLLNGDFAFAIWDARRRRMMLARDRMGVRPLFHTLKGGTLYFASEVKALLEVPGVSAEIDPIALDQIFTLWAPIAPRTPFRDIHELEPGHLMIADQNGTTTRPYWQLDYPDRDERPAYAEESRAAEELRALLTDATRIRMRADVPVGAYLSGGLDSSIISALAAGMTSQGLRTFSVTFDSAEHDESAFQEEMAAALGTEHRAVACRAGDIARDFPDVIRFTEKPIIRTAPAPLYKLSGLVREAGLKVVLTGEGADEVFAGYDIFKEARVRRFCGRQPGSRIRPHLFRKLYPYLPGLQQQSAEYLAAFFGAGDVALDDPLFSHRPRLKGTAATKMFFSSDLRAELTGYDAAEELVSRLPAAFGRWHPLHQAQYLESRFLLPGYILSSQGDRMAMAHGIEGRFPFLDHRLVEFAAKLPPEMKLRGLVEKHILREATKDLLPPAIGRRTKQPYRAPDSHSFSGAGELDYVRSAMSEDAVAAGGLFNAKAVTKLYEKCQSRPASGFRDNAAFVGVLSTQLWLQTFTGTSLRKAEAA

SEQ ID NO: 56369 - protein, 194 aa, Triticum aestivum
  misc_feature (145)..(145): Xaa can be any naturally occurring amino acid
  misc_feature (163)..(163): Xaa can be any naturally occurring amino acid
  unsure (1)..(194): unsure at all Xaa locations
MSSRRENGSEGDGLGAEGGVPPSPLYAAPVVCLLRSAGDFGAGAFVGGVVGYGQGLITKKGFKGSLSNAGSAAKTFAVLSGVQSFIVCLLKKLRGKDDLVNSGIAGCCTGLALSFPGTPQALIQSCATFAAFSCIMEGLNKQQAXAMAHTVRRKRSDLWAREXGGVLPPFTLPPILDASDALASCCQTLVKPKH

SEQ ID NO: 56370 - protein, 569 aa, Saccharomyces cerevisiae
MNSTPDLISPQKSNSSNSYELESGRSKAMNTPEGKNESFHDNLSESQVQPAVAPPNTGKGVYVTVSICCMVAFGGFIFGWDTGTISGFVAQTDFLRRFGMKHHDGSHYLSKVRTGLIVSIFNIGCAIGGIVLAKLGDMYGRRIGLIVVVVIYTIGIIIQIASINKWYQYFIGRIISGLGVGGITVLSPMLISEVAPSEMRGTLVSCYQVMITLGIFLGYCTNFGTKNYSNSVQWRVPLGLCFAWALFMIGGMMFVPESPRYLVEAGRIDEARASLAKVNKCPPDHPYIQYELETIEASVEEMRAAGTASWGELFTGKPAMFQRTMMGIMIQSLQQLTGDNYFFYYGTIVFQAVGLSDSFETSIVFGVVNFFSTCCSLYTVDRFGRRNCLMWGAVGMVCCYVVYASVGVTRLWPNGQDQPSSKGAGNCMIVFACFYIFCFATTWAPIAYVVISECFPLRVKSKCMSIATAANWIWGFLISFFTPFITGAINFYYGYVFMGCMVFAYFYVFFFVPETKGLSLEEVNDMYAEGVLPWKSASWVPVSKRGADYNADDLMHDDQPFYKSLFSRK

SEQ ID NO: 56371 - protein, 218 aa, Zea mays
MILFPLPTTEKPVQANIKQARPSFSSPLTLDASPPLLPHPSIAPSLRSALPQPHPCAPADSRRPLLEGTMEQTFIMIKPDGVQRGLIGDIISRFEKKGFYLKGMKFMNVERSFAQQHYADLSDKPFFPGLVEYIISGPVVAMVWEGKDVVLTGRRIIGATRPWEAAPGTIRGDYAVEVGRNVIHGSDSVENGKKEIALWFPEGVAQWKSNLHPWIYEA

SEQ ID NO: 56372 - protein, 483 aa, Yarrowia lipolytica CLIB122
MGSKSATKDISKIKKADKKDSKKAVKATEPASESGASTSSDESTSSDDSSDSDSDSSDSDSSGSDSSDSSDSSDSDSSDSDSDSDSEDEKPVKKEETKEENESSSSDSDSDSDSDSSSSSSDSDSDSDSDSDSDSADENEKKETKEVKEVKEDKKEAKKEAKKEAKKEESSDSGSSESSDSDSDSDSDSDSSSSDSSSSDSDSDSDSSSSDSDSDSDSSSSDSDSDSDSDSDSDSDSDSDSDDEKETKKETKKETKKETKKETKKEDAKDVEMKDASSDSSDSSDSSDSSDSSDSSDSSDSSDSDSSSDSDSSSSDSDSSSDSDSSSSDSDSSSDSDSSSSSDSDSSDSDSSSSSDSDSDSSDEEEQPPAKKRKAEEIEVESLVIKKPKTDSPVDNSYVEATFEEEGGRKFFSRIDRTKISFEDQSLMDNTYKGAAGTWGEMANDKLMKVRGKDFTKGKNKMKKGAYKGGSITMSSGSYKFTD

SEQ ID NO: 56373 - protein, 236 aa, Glycine max
MQSRLAEATRRTSCALSSTTRFTLKRQLCSGTRIRTADPEIHSGELEAGPKVHRGQPQGISTQDKAKEARYSETERNASKAHEMLKSPKSPCEPSRKLKSAGVNQRLDPSIQQKREKGSKVGIEEVSCAGLDGTPWPEDTNKGKEKEDNREYFKRHKASPLSEIEFLDSRKPITRASDKTADSGRGVGVIGWLPEQMETAEETLMRAAEMWRERAMRGDPDAPHSRVLRALRGEDF

SEQ ID NO: 56374 - protein, 740 aa, Vitis vinifera
MNGAVLVAIAAAIGNFLQGWDNATIAGAIVYIKKELDLESTVEGLVVAMSLIGATLVTTCSGAISDWIGRRPMLIVSSMLYFISGLIMLWSPNVYVLLIARLLDGFGIGLAVTLVPIYISETAPADIRGSLNTLPQFTGSGGMFLSYCMVFGMSLLSSPSWRLMLGILSIPSLLYFTLTVFYLPESPRWLVSKGRMVEAKKVLQRLRGREDVSAEMALLVEGLGIGGETSIEEYIIGPTGELTEDQDPDAVKDQIKLYGPEAGLSWVAKPVPGGQSTLSLVPRQGSLATQTLPLMDPLVTLFGSVHEKPPETGSMRSMLFPNFGSMFSTADPQIKTEQWDEESLQQEGEDYASDGGGDSDHDLQSPLISRQTSSMEKDMVPPPSHSSIMSMRRHSSLMQGTAGEAAGGMGIGGGWQLAWKWSEREGEDGKKEGGFKRIYLHEEGVPGSRRGSLVSLPGGDVPAEGDYIQAAALVSQPALYSKELMDQDPVGPAMVHPAETASRGPMWAALLEPGVKHALFVGAGIQILQQFSGINGVLYYTPQILEEAGVEVLLESLGLGTESASFLISAFTTLLMLPSIVVAMKLMDIVGRRRMLLTTIPVLIVTLLVLVIGDLVTTTTVIHAAISTACVIIYFCCFVTAYGPIPNILCSEIFPTRVRGLCIAICALVYWIGDIIVTYTLPVMLTSIGLTGIFGIYAVVCVISWVFVFLKVPETKGMPLEVIAEFFAVGARQVTAAKND

SEQ ID NO: 56375 - protein, 175 aa, Arabidopsis thaliana
MSLSRRDPLVVGSVVGDVLDPFTRLVSLKVTYGHREVTNGLDLRPSQVLNKPIVEIGGDDFRNFYTLVMVDPDVPSPSNPHQREYLHWLVTDIPATTGNAFGNEVVCYESPRPPSGIHRIVLVLFRQLGRQTVYAPGWRQQFNTREFAEIYNLGLPVAASYFNCQRENGCGGRRT

SEQ ID NO: 56376 - protein, 286 aa, Yarrowia lipolytica CLIB122
MSTLYKTLSGESSKPEKTEKKDDGVTNKQRVLIITSRGVTFRQRHLISDLQTMLPHGRKESKLDTKSKLYQLNEIAEMYNCNNILYFEARKHMDLYMWMAKAPNGPTAKFHIQNLHTMDELNFTGNCLRGSRPILSFDSSFDDTPHNAVIKEMLTQTFGVPKGARKSKPFFDHVFTFSLVDNKVWFRNYQIQETVNEENPRETDISLVEIGPRFVMTLITMLEGSFGGPVIFENKQYVSPNTVRSQMKQQAAEQAASRAEAAFKRKVKVRDAVIAADPLADSVIFK

SEQ ID NO: 56377 - protein, 466 aa, Frankia sp. EAN1pec
MAAHFDLVVLGGGPGGYVAAIRAAQLGLSVAVVEEKYWGGVCLNVGCIPSKALLRNAELAHLFAHEAKTFGISGEVSFDFGAAFDRSRQVAEGRVKGVHFLMKKNKITEFTGRGTFRDPNTLDVALSAGGTDQVSFDHAIIATGSRVRLLPGVELSDNIVTYETQILTRELPRSMAIVGAGAIGMEFAYVLRNYGVDVTIIEFLDRALPNEDADVSKEIVRQYKKLGVPILTSTKVETVTDNGSSVTVEYTGKDGARGSLEVDKVLMSIGFAPNVEGFGLENTGVALTDRGAIAIDDHMRTNVEHIYAIGDVTAKLMLAHVAEAQGVVASETIAGAETVMLGDYRMMPRATFCQPQVASFGLTEAQAREEGHDIKVAKFPFTANGKAHGLGDPNGFVKLISDTKYGELLGGHLIGPDVSELLPELTLAQKWDLTALELARNVHTHPTLSEALQEAIHGLAGHMINL

SEQ ID NO: 56378 - protein, 112 aa, Glycine max
MAGLQRSAVSFRRQGSSGFVWDDRFLQEELNKVKEDHNNNNNHDHDNDDGGEIKELQVQTTPPLQRIRSNGGARGYRTGKVSPAIEPPSPRLSACGFCAAFGKAGDNKHRPR

SEQ ID NO: 56379 - protein, 121 aa, Neisseria meningitidis Z2491
MNLIQQLEQEEIARLNKDIPEFAPGDTVVVSVRVVEGTRSRLQAYEGVVIARRNRGLNSNFIVRKISSGEGVERTFQLYSPTVEKIEVKRRGDVRRAKLYYLRGLTGKAARIKEKLPARKG

SEQ ID NO: 56380 - protein, 378 aa, Schizosaccharomyces pombe 972h-
MSFEGKTITCKAAVAWGAKEPLSIEDIQVAPPKAHEVRVKVDWSAVCHTDAYTLSGVDPEGAFPIVLGHEGAGIVESIGEGVINVRPGDHVILLYTPECKECKFCRSGKTNLCSKIRETQGRGLMPDGTSRFSCRDKTLLHYMGCSSFSQYTVVADISLVAISHSAPLRSICLLGCGVTTGFGAVTHSAKVESGSTVAVVGCGCVGLAAMQGAVAAGASRIIAIDINADKEVYAKKFGATDFIDSSKVKDLVQYVIDVTDGGVDYAFDCTGNVTVMQQELQFCHKGWGKLCVIGVAAAGKTLDFRPFLVVTGRQVLGSAFGGVKGRSELPNFVDEYMQGHFKVDEYITNEEPLKNINKAFDHMHEGKCIRCVVDMNKP

SEQ ID NO: 56381 - protein, 348 aa, Candida albicans
MAHHHHHHGHHHQLSEDSELIEQVIEQPDSLIISPPSDSSSSSYNHIQPFVYLESTATTQTNHNVLLILNQKITIDLISLWKKCEIIVCADGGANSLYEYFNDNNHHHHHENLQRSDYIPDYIVGDFDSISPDVKTYYESHGSKIIRQSSQYYNDFTKSIHCIQLHYQLNHTKENWFESIDEVDGLAKLWNGLNNSSDVVVDIDITIYVLNAIGGRFDQTVQSINQLYIMNEDYPKVTVFFITTNDIIFLLKKGVNYISYKNRLMFHKDNGSSPTPTCGLLPLSNKTPIILNSYGLKYDMRNWKTEMLGQVSSSNRISGETGFIVECSDDIVMNIEIDVQLDGDLEAA

SEQ ID NO: 56382 - protein, 692 aa, Synechococcus sp. WH 5701
MSSIQLGHPWPLGAALTARGVNFSLVAPSASRVELLLFARGSSPEPFRIIPLDLRHRSGDHWHVEVEGIGAGTCYGYRVYGPLHPGGHGFNPSKVLLDPCARAISGWDVYRRGDAIGAIPNTAACLKGVVTERDHFDFVAAPRPRHSWQTTVIYELHVGGLSRGQGSPVAPERQGSLLGVIDCLPYLRSLGVTALELLPVMAFDPQDAPHGRQNYWGYSPLSWMAPHQGYLVGDDPLAGRQQVRQLVTACHQAGIEVLLDVVYNHTSEGNQAGPTLSWRGLADRLYYHQNSRGDYLDVTGCGNTIAANRPLARRLLLESMRCWALELGIDGFRFDLGIALSRGEELAPLDKPPLFEEIEADPELSDLKLVSEPWDCGGLYRLNDFPARRMGTWNGRFRDDVRRFWKGDDNGSWLMAQRLSGSPDLYGGKPATAGRSITFITAHDGFTLADLVSYDRKHNLANGEDNRDGDNHNNSWNHGVEGPCSDLQINELRNRQIRNMLGTMLLAPGVPMLLMGDEVRRSQGGNNNTWCQNNPLGWMHWRPDEDDQRLHRFLSRLVRLRRRLERLLNPEIPHADSPPSKPGERDLIWREWHGVELLQPDWGSWSHSLAWSLHDMRHGPLLWCGMNAYYQPMVFKLPEASAGWLRVIDTGAPDGDDVMASPQPWIAEEAALESRSLMLLLASHLGEKAVEA

SEQ ID NO: 56383 - protein, 308 aa, Xanthomonas campestris pv. campestris str. ATCC 33913
MSYATHADTQLPHVGMHCSGMTNTSIPADLGDWIIAQAIAGHPPEHTLQPLLEAGWSEQDAIDAVEALVRAHVQAHAQAHGLPVPVPVRVPAPLQADASSLLDLGDRQVQVLVSLMLPRVVVLGGLLADDECDALIALARPQLARSRTVDNRDGSEIVHAARTSHSMALQPGQDALCQRIEARIAQLLEWPVEHGEGLQVLRYATGAQYAPHYDYFEPDAPGTPVLLQHGGQRVASLVMYLNTPERGGATRVPDVHLDVAAVKGNAVFFSYDRPHPMTRTLHAGAPVLAGEKWVATKWLRERPLHAPT

SEQ ID NO: 56384 - protein, 136 aa, Triticum aestivum
NPGVTPIAPLSQQAGYYCSVCECVVKDSANYLDHINGKKHQRALGMSMRVERASLEQVQKRFEALKKRKDPASFSEQDLDERIWKQQQEEEEKKRQRREKKKEKKKEQAGQNEPEDIDPDVAAMMGFSGFGTSSKK

SEQ ID NO: 56385 - protein, 183 aa, Triticum aestivum
  misc_feature (116)..(116): Xaa can be any naturally occurring amino acid
  unsure (1)..(183): unsure at all Xaa locations
ERRERKEREPKKALPPSPNSILFLLPLSSPRPDPGRPDSRRRRRRRRWGWGREDRFSGWEAALGAGVAVAFAAGHGGVYLSMPDCDYGFLRWPRNLRELLILTGHLENYTSEYTVXVVIGYWAVNICMHSFMIPWKIFMSSCAGAVYGQLRGVDLLDVAASAGDSSCVFLDKLIVKPLASGLR

SEQ ID NO: 56386 - protein, 504 aa, Synechococcus sp. CC9605
MAGNHYFLELEPPAERLRDAPHVVIVGGGFAGVHACKALAKADVRITLIDKRNFNLFQPLLYQVATGLVSRSDVATPLRELVGTQGNVQVLLGEVTAVNPEGKQIVFNGKAYSYDHLILATGSGSTYFGHEDWRTFAPPMKILEHAEEIRRRLLMAMEQAEQTPNPEARQFLQTVVIVGGGPTGCEMAGAVSELMRWALNSAFKQLDSQKTRIVLVDPGDRVLRAMPEELSKDAQKTLELNGVEFIPQGRVQTMRPGEVVISSPDGDVRIQAATVIWTAGVKPSHLGQKLTEATGCELDRGGRVIVNPDFSIPNHPEIRIAGDLCSYSHTVNGKPLPGMAAPAKQAGTFIGKDIAAIVAGQDRPTFRYFDFGSMAVVQASAVADLHGFKVSGRMGLLLWAIVHLALMPNRENRITLSIKWLYVLATRERASILLTGMPSQHLALDAEDAHFPMASGKGPSIAEPDAALKAAMDYYAHQLSGLPQTQELLDTKDASAADSEAAIK

SEQ ID NO: 56387 - protein, 528 aa, Aspergillus oryzae
MTVEVKYDNGQLRDLLHSPYVFGAALLASFGGFSFGYDQGVISLILVMPQFREQFPETSPENPKYGFHTGFMTGMLELGAFIGCLFFPAVADRISRKWGLTVATVFFVIGAIIQTASMNYGTLVAGRFIGGVGVDTLAMGAPLYISEIAPPAWRGSLLVLESISIVIGAIVAYWITYGTRAIPGEWSFRLPFLLQMFPALIVGCAIHFFPFSPRWLAMRGREEDSLFALAKLRRRPVHDEQVQLEWKGILSEVRFQRQMLEKEYPDHQSRPLLVGLKQWVSLVRPKYFRRTLVALAIPFFQQFSGINAFVYYAPTFFEALGQSSETSLILSGMVNICQLVGGIPILMYLDRVGRRTMAIIGGVIMAIPHLIMAGLMNRYSNDWPSHKAIGWFCVALIYAYALAYAVSYGPLAWVLPAEVFPNSKRAKGVGAATAMNWLANFIIGVVVPEMLIKLGWGTFLFFGLFCVAAAIFSFLFVPETSGKSLEQIAVVFGDNLDGDERGLQEKIARETFENATARVLHVEKAGSA

SEQ ID NO: 56388 - protein, 348 aa, Schizosaccharomyces pombe 972h-
MAAVDRSRTEISVLSDRVTDVGSVDFPGYYFDEDNIWDLDKFKKNLKVSITSLDQETMVFEISGIDASIANAFRRILIAEIPTLAFEFVYIINNTSIIQDEVLSHRIGLVPISADPDMFKWFQHPLPGQEATHTDYDTVVFSLNKKCEFNKNAATDEKDPKRLYVNSEVYSGDLIWKPQGRQEERFADNPIRVVNPDIVVAKLRPGQEIDLEAHAILGIGQDHAKFSPVATASYRLLPTIHILSPIEGEDAVKFQKCFPKGVIELEEGPDGKKQARVADVRKDTVSRECLRHPEFADKVQLGRVRDHYLFSVESTGIMKPDVLFIKSIAVLKSKCLAVKSSLQNISSD

SEQ ID NO: 56389 - protein, 518 aa, Gibberella zeae PH-1
MAKRRERVPAFGLMGQDSIYLQVLSGDPAESQSKNAKRVLKLLNRGKHWVLVTLLLANVIVNESLPVVLDRTLGGGVAAVVGSTVLIVIFGEIVPQSICVRYGLPIGGYMSTPVLLLMYITAPISWPIAKLLDWILGEDHGTLYKKSGLKTLVTLHKSLGEISERLNQDEVTIITAVLDLKDKPVAEVMTPISDVYTLAEDHILDEETMDDILSSGYSRIPIYRSGNHLDFVGMLLVKTLITYDPEDRIPVREVPLGAIVETRPETSCLDIINFFQEGKSHMVLVSEFPGSDHGALGVVTLEDVIEELIGEEIVDESDVYVDVHKAIRRLTPAPRARRIHAAATAASVIASKKAPGDSILVDIEDHDAPSHHEPETASFHSNYEGGFHNAARTAIHMKRRTSDGGIEGTPVVVKASLDEMRSKLRLGPANRAANPRSNTRSLFKIKQGLSANGTPPSDNSRPLPPRAQSHMGFVNPQGSPARSHGHERTPLLGVGEDNEHAVEDDETHENTGHKTNGH

SEQ ID NO: 56390 - protein, 111 aa, Medicago truncatula
MEIESAKCECCGLKEDCTQDYISEVKSKFDGKWLCGLCSEAVRDEAIRGKKTFAMEEAIKAHMLFCRKIKSNPAVCVADGMRQILRRRSTELSSSNKHSTRSTSTSQVGGE

SEQ ID NO: 56391 - protein, 510 aa, Petunia x hybrida
MAGGFAAGSGGGDYEGKVTTFGIMTCLVAATGGLLFGYDIGISGGVTSMDEFLLKFFPNVYHKEKALKAGGNQYCKFDDHLLQLFTSSLYLAALVASFAASITTKAFGRKISMLIGGLIFLVGAVLNGAAMNLAALIIGRLLLGVGIGYANQSVPVYLSEMAPPKLRGALNVCFQMAVTLGIFVANMVNYGTSSMKKNGWRVSLVLAAVPAIIMTVGAVFLPDTPNSLIDRGQKEKAKAMLQKIRGTNNVDNEFEDLIIASDMSKLVTDPWGNIMKPRYRPQLTIAVLIPFFQQLTGINVIMFYAPVLFKTLGFGDEAALMTAVITGLVNVFATLISIFTVDRFGRRFLFLAGGLLMLICQAAVGSVIGSVFGTDGLGTFSKGLGNVTVGLICLYVAAFAWSWGPLGWLVPSEVFPMEIRSAGQSITVSVNMFFTFVIGQLFLTMLCEMKFGLFFFFAGFVVLMTLFIFFFLPETKGIPIEEVNRIWKNHWFWKSYVPNDDDDHHSKNQV

SEQ ID NO: 56392 - protein, 469 aa, Xylella fastidiosa Temecula1
MSLENVEKLVKDKKIEFVDLRFVDMRGVQQHVTFPVNILEQSLFKDGKMFDGSSIAGWKGINESDMVLLPDASTAYLDPFYADPTLVMTCDILDPATMQSYVRDPRGIAKRAEIYLNSLGIADQAFFGPEPEFFIFDSVRFANDMGHAFFQIASEEAAWNTGAEFEGGNSGYRPTVKGGYFPVPPTDSLHDLRAEMVKTLEQVGIETEVHHHEVATAGQCEIGTKFDSLVKKADQLMTMKYILKNVAYRNGKTVTFMPKPIVGDNGSGMHVHQSLSKGGVNLFSGDDHAGLSQLALYYIGGIFKHAHAINAFSNSGTNSYKRLVPGFEAPVMLAYSARNRSASCRIPWVSSPKARRIEMRFPDPLQSGYLTFTALMMAGLDGIKNKIHPGPPNDKDLYHLPPEEEKLIPQVCSSLDQALEALDKDRDFLKAGSVMSDDFINGYIALKMQEVTQFRAATHPLEYQMYYAN

SEQ ID NO: 56393 - protein, 341 aa, uncultured bacterium
AHNTISALLDNYLYQHRKDGFSLREIFWKRVLDVNDRSLRNVVTGLRGDGVVSETGFEITPASELMAILCLATSEEDLQRRIENIVLGITADGKPFRVRDLGVAGAITVLLRDALNPNLVQTTEHTPAFIHGGPFANIAHGCSSVLATKMAMTFCDYVVTEAGFGADLGAEKFFDIKCRKTGLKPRLVVIVATTQGLKMHGGVALEHIKEPNAQGLTEGLKNLNRHIRNMQGFGQPVIVTLNRHDTDSEEEIDIVRKNCEDLEVGFAVNEAFLKGGEGATELAQTVVDTIERQHPLPIRFTYKEADCLEDKIEKVCKRIYGASGVEYSKTAKKKLEDLRAY

SEQ ID NO: 56394 - protein, 352 aa, uncultured bacterium
IGAANNLLAAMIDNHIYQGNSLRIDPTNITWHRAVDMNDRQLRFMVNGLNGRTNGRPREDSFDITVASEIMAVLCPSSDILDLKERLARIIIGYNVDGEPVTAGQLNAQGAMAALLKDALKPNLVQTLEKTPAFVHGGPFANIAHGCNSVTATRLALKLGDYAVTEAGFGADLGAEKFLDIKCRMAGLKPSAVVVVATVRALKSHGGVPKAELNNENLDALAKGLPNLLQHVENVTTVFKLPCVVAINAFPTDTKAELDLVEEKCKELGVNVALSEVWGKGGEGGIALAEEVVRLCEQPNEFSFSYPSEMSIMDKLNAISTRIYRADGVALAGKAPKQLKQLEEQGFASLPI

SEQ ID NO: 56395 - protein, 676 aa, Methanococcus maripaludis S2
  misc_feature (133)..(133): Xaa can be any naturally occurring amino acid
  unsure (1)..(676): unsure at all Xaa locations
MTEFKVVHTICPYCGTGCGIDLVVKDGKVVDSHPFKRHPVNEGKVCIKGNYCYEFVHSEDRLTKPLIKKNGEFIEATWDEALDLIAGKLKQYSPDEVAFFSCARGTNEESYALQKFARTVLKTNNVDHCARIXHAPTVVGLGECFGSGAMTNSITDLAQADVLLIYGSNTFEAHPLIARSIVKAKENGTKIIAIDPRTTHTAKMADLHLKLIPGSNIDLINTITNIIIQEGMADEEFIKNRTEGYDELKDVVSKYTLEKTAELSGIPAETILEAARMYGSAENASIMYCLGVTEYTFGVDNVKSCCNLAMVTGNLGRPGTGVNPLRGQNNVQGACDMGALPNVFPGYQKVGEAYERLENLWETADLNREIGLTSPEVLHKAGEQVKFLHIVGEDPMVADADINHVEKALKSLDFFVVQDIFLTETAKLADVVLPAACWAEKDGTFTNSERRVQRIRKAVDAPGDALPDWLIVRKLAEKMGAGEKLNFESASEIFDEMAKVIPQYAGMSFERLGIDGLQWPCKTPEDPGTPILHKEKFLRPNGLGKFTPVEHKDADELIDEEYPLILTTGRIIFHYNSGTMTRRCDSITNEIDENFIEINTEDAKELGIKPGEKVRVSSRRGTVNADARVTENVIKGVVYMSFHFLEEATNKLTNSAYDPVSKTAELKICAVKVEKI

SEQ ID NO: 56396 - protein, 484 aa, Arabidopsis thaliana
MDISALFLTLFAGSLFLYFLRCLISQRRFGSSKLPLPPGTMGWPYVGETFQLYSQDPNVFFQSKQKRYGSVFKTHVLGCPCVMISSPEAAKFVLVTKSHLFKPTFPASKERMLGKQAIFFHQGDYHAKLRKLVLRAFMPESIRNMVPDIESIAQDSLRSWEGTMINTYQEMKTYTFNVALLSIFGKDEVLYREDLKRCYYILEKGYNSMPVNLPGTLFHKSMKARKELSQILARILSERRQNGSSHNDLLGSFMGDKEELTDEQIADNIIGVIFAARDTTASVMSWILKYLAENPNVLEAVTEEQMAIRKDKEEGESLTWGDTKKMPLTSRVIQETLRVASILSFTFREAVEDVEYEGYLIPKGWKVLPLFRNIHHSADIFSNPGKFDPSRFEVAPKPNTFMPFGNGTHSCPGNELAKLEMSIMIHHLTTKYRFGQLLERATGFSMGHSRFPKTDCPLCWPGSRRSKCRMTELPLAFLYLERGD

SEQ ID NO: 56397 - protein, 447 aa, Arabidopsis thaliana
MATHAALAVSRIPVTQRLQSKSAIHSFPAQCSSKRLEVAEFSGLRMSSIGGEASFFDAVAAQIIPKAVTTSTPVRGETVAKLKVAINGFGRIGRNFLRCWHGRKDSPLEVVVLNDSGGVKNASHLLKYDSMLGTFKAEVKIVDNETISVDGKLIKVVSNRDPLKLPWAELGIDIVIEGTGVFVDGPGAGKHIQAGASKVIITAPAKGADIPTYVMGVNEQDYGHDVANIISNASCTTNCLAPFAKVLDEEFGIVKGTMTTTHSYTGDQRLLDASHRDLRRARAAALNIVPTSTGAAKAVSLVLPQLKGKLNGIALRVPTPNVSVVDLVINVEKKGLTAEDVNEAFRKAANGPMKGILDVCDAPLVSVDFRCSDVSTTIDSSLTMVMGDDMVKVVAWYDNEWGYSQRVVDLAHLVASKWPGAEAVGSGDPLEDFCKTNPADEECKVYD

SEQ ID NO: 56398 - protein, 357 aa, uncultured bacterium
VTSAHNTISALLDNYIYQHRKDGFSLREIYWKRVLDVNDRALRNVVTGLRGDGVVSETGFDITPASELMAILCLATSEEDLQRRIENIVLGVTADGKHFRVKDLGVAGAITVLLRDALNPNLVQTTENTPAFIHGGPFANIAHGCSSVLATKMAMTYCDYVVTEAGFGADLGAEKFFDIKCRKAGLQPRLVVIVATTQGLKMHGGVSLDNIKEPNAKGLTEGLKNLNRHIRNMQGFGQPVIVTLNRFDFDTDEEIDIVRKNCEDLEVGFAVNEAFLKGGEGAVELAQLAVDTIDKQQPLPIRFTYKEADCLEDKIEKVCKRIYGASAVEYGQKVKKKLESLRATFTDDDGAIAHYPV

SEQ ID NO: 56399 - protein, 332 aa, uncultured bacterium
MLDNHIQQGNALGIDVKKITWKRCVDMNDRQLRFVVDGLGGKANGTPREDGFDITVASEIMAVFCLASSMSDLKERLSRIIVAYTYDDQPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLANEDLAALEKGIPNLLRHVNNITNVYQLPCVVAINRFPTDTDAEIDFIVRKCRELGVNMILSTVWAEGGKGGEDLAREVVRLCEEGKGNFTFSYELDASIEEKLEALTKKIYGGAGVALTPVAKKQAEQ

SEQ ID NO: 56400 - protein, 185 aa, Methanococcus maripaludis S2
MSKLLEESLKTCPIVKRGEYHYFIHPISDGVPLVEPELLRDVSTRVIKMIDTDVDKIVTAEAMGIPIVTAVSIATDIPYVIMRKREYLLEGEIPVHQETGYSKGELYLNGINKGDKVIILDDVISTGGTLVAIINALKRAGADIKDVLCIIDRGNGQNIVEEKTGYKVKTIVKIEVVDGKVNILE

SEQ ID NO: 56401 - protein, 353 aa, uncultured bacterium
IGAANNLLAAMLDNHIQQGNALGIDVKKITWKRCVDMNDRQLRFVVDGLGGRANGTPREDGFDITVASEIMAVFCLASSMSDLKERLSRIIVAYTYDNQPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLANEDLAALERGIPNLLRHVNNITNVYQLPCVVAINRFPTDTDAEIDFIVRKCREMGVNTILSTVWAEGGKGGEDLAREVVRLCEEGKGNFTFSYELDATIEEKLEALTKKIYGGAGVALTPAAKKQAEQLTRLGFDKLPV

SEQ ID NO: 56402 - protein, 365 aa, Glycine max
MPPVPISPIKVGHIDDVQELRKTKPRTIPQRFVRDLTERPTLTTPLPPPHSDMPVIDFSKLSKGNKEEVLTELFNLATACEEWGFFQVINHEIDLNLLESIENLSREFFMLPLEEKQKYPMAPGTVQGYGQAFVFSEDQKLDWCNMFALGIEPQYVRNPNLWPKKPEKFSETVEEYSGEIRKLCYNLLTYIALGLGLKGDEFEEMFGVSVQAVRMNYYPPCSRPDLVLGLSPHSDGSALTVLQQAKGGPVGLQILKDNTWVPIQPIPNALVINIGDTIEVLTNGKYRSVEHRAVAHEEKARLSIVTFFAPSYEVELGPMPEFVDENHPCKYKIYNHGEYSKHYVTNKLQGKKTLEFAKIQTKNTN

SEQ ID NO: 56403 - protein, 276 aa, Synechococcus sp. CC9605
MRIRPLLAVVLALCLAFFTTACSGDSDAVQRGGSNVTYDDIHNTGKANDCPTIGDSARGSIPLDAGGSYELREICMHPVQVYAKEEPKNIRQQAEFVEGKILTRYTSSLDSVFGDLKVTESGLQFQEKGGIDFQPITVLVPGGEEFPFTFSSKSLNATAEGSALTTSTDFEGTYRTPSYRTSNFIDPKGRALTTGVQYAQGLVALGGDDEQLEKDNNKRYIDGVGTMSLSITKVDPETGEFAGVFSAIQPSDSDMGGREVVDIKITGDLYGRLEEA

SEQ ID NO: 56404 - protein, 504 aa, Arabidopsis thaliana
MAMVKEKEQNTKDKKLLVGVIWNFSAELKLTFMALLVLCTLATLLPFIPSSFSLSTSDFRFCISRFSSAVPLNTTTTVEESSSSPSPEKNLDRVLDNGVIKRTFTGYGSAAYNFVSMSAYRGGVNSFAVIGLSSKPLHVYGHPSYRCEWVSLDPTQDPISTTGFKILTDWGYGRIYTTVVVNCTFSSISAVNPQNSGGTLILHATTGDPTLNLTDSISVLTEPPKSVDFDLYNSTKKTKKYDYLYCGSSLYGNLSPQRVREWIAYHVRFFGERSHFVLHDAGGIHEEVFEVLKPWIELGRVTLHDIRDQERFDGYYHNQFMIVNDCLHRYRFMTKWMFFFDVDEFLHVPVKETISSVMESLEEYSQFTIEQMPMSSRICYSGDGPARTYRKWGIEKLAYRDVKKVPRRDRKYAVQPENVFATGVHMSQNLQGKTYHKAESKIRYFHYHGSISQRREPCRQLFNDSRVVFENTPYVLDTTICDVGLAVRTFELRTIGDRLLRTRQ

SEQ ID NO: 56405 - protein, 467 aa, Synechococcus sp. WH 7805
MRASWVESRRGQANVSQMHFARQGVVTEEMAYVANREKLPESLVMEEVARGRMIIPANINHTGLEPMAIGIASKCKVNANIGASPNASDAAEEVNKLKLAVKYGADTVMDLSTGGVNLDEVRTAIIDASPVPIGTVPVYQALESVHGSIEKLDEDDFLHIIEKHCQQGVDYQTIHAGLLIEHLPKVKGRLTGIVSRGGGILAQWMLYHHRQNPLFTRFDDICEIFKRYDCTFSLGDSLRPGCQHDASDAAQLAELKTLGDLTRRAWTHDVQVMVEGPGHVPLDQIEFNVKKQMEECNEAPFYVLGPLVTDIAPGYDHITSAIGAAMAGWHGTAMLCYVTPKEHLGLPNAEDVREGLIAYKIAAHAADIARHRPGARDRDDELSRARYNFDWNKQFELSLDPERAKEYHDETLPADIYKQAEFCSMCGPKHCPMQTKITDEDIEGLEKALESKRGAGELAGVKMEKAD

SEQ ID NO: 56406 - protein, 107 aa, Neisseria meningitidis Z2491
MDNCIFCKIAAKDIPAQTVYEDGEMVCFKDINPAAPVHLLLIPKVHFDSLAHAAPEHQPLLGKMMLKVPEIAKAAGLADGFKTLINTGKGGGQEVFHLHIHIMGTPV

SEQ ID NO: 56407 - protein, 107 aa, Neisseria meningitidis Z2491
MGDSVLSAIQQTITQRKSANPSESYVAQLLHKGEDKILKKVIEEAGEVLMASKDKNPSHLVYEVADLWFHTMILLTHHDLKAEDVLDELARRQGLSGLAEKAARTES

SEQ ID NO: 56408 - protein, 354 aa, Neisseria meningitidis Z2491
MKAARFYDKGDIRIEDIPEPTVAPGTVGINVAWCGICGTDLHEFMEGPIFIPPCGHPHPISGESAPVTMGHEFSGVVYAVGEGVDDIKVGQHVVVEPYIIHDDVPTGEGSNYHLSKDMNFIGLGGCGGGLSEKIAVKRRWVHPISDKIPLDQAALIEPLSVGHHAYVRSGAKAGDVALVGGAGPIGLLLAAVLKAKGIKVIITELSKARKDKARESGVADYILDPSEVDVVEEVKKLTNGEGVDVAFECTSVNKVLDTLVEACKPAANLVIVSIWSHPATVNVHSVVMKELDVRGTIAYCNDHAETIKLVEEGKINLEPFITQRIKLDELVSEGFERLIHNNESAVKIIVSPNL

SEQ ID NO: 56409 - protein, 322 aa, Gluconobacter oxydans 621H
MREIVAVDIGGTHARFAIATIEDGKVVSLGEATTLKCAEHGSLALAWETFGRSLNRTLPREAGIAVACPVSGEILKLTNNPWIIQPSQLGARLHLDNFVLVNDFGAVAHAVAQVDSSHMKHLCGPDIDLPTEGAITIVGPGTGLGAACLLRRSDRYFVMETEGGHLDYPPLDELEDKILSALRLRFRRVSAERIVSGPGLTNLYEVIAEMQGWPITLRDNRTLWKNALDGSDTVAVAALERFCLSLGAISGDLALAHGARGVVIGGGLGLRLADSLGHSGFAERFVAKGRFEAMMTEMPVKIITHPQPGLFGAAAAYAEAHP

SEQ ID NO: 56410 - protein, 511 aa, Coccidioides immitis RS
MDNEAAVGGVFAGSVQTTRSRRRHVGKRDVGIAGQASWISSVINLLNTIVGAGVLAMPHALSRMGITLGVFVILWSGLVAGFGLYLQARCAEYLERGSASFFALSQITYPNAAVLFDAAIAIKCFGVGVSYLIIIGDLMPGVVEGFMGDTGMEFLLDRHFWVTAFMLIIIPISFLRRLDSLKYTSVVALISIGYLVILVVAHFIKGDTMEGRSPIRVIQWEGIIPALSVFPVIVFAYTCHQNMFSILNELSNNSHFRTTTVVAASIGSAAATYVLVAITGYLSFGDAIQGNIVGMYAPSLSSNIARAAIVVLVMFSYPLQVHPCRASVDAVLKWRWNSKGSSGSSNVSPHRNPLLPRSDRQPEEMGDTRFAAITTVIIVLSYIVAMTVSSLEAVLAYVGSTGSTSISFILPGLFYYKISSPESALHQRIMKEDDEAGADGFSDDSADEEIMGSGLLGGSGLLSSSGILRRRRRHWKRGLLRKLSLALAVYGIVVMVVCLVTNTFFLATNGS

SEQ ID NO: 56411 - protein, 263 aa, Zea mays
  misc_feature (50)..(50): Xaa can be any naturally occurring amino acid
  misc_feature (185)..(185): Xaa can be any naturally occurring amino acid
  unsure (1)..(263): unsure at all Xaa locations
MAKKVLMTANGDEVSRNIAIQLAKHGCRLVLMGNEASLRSTVDYIRVSVXGAFPVELIGADMEADSEEDFYVAVQKAWTRLGSLDAFVNCCTYQGKMQDILRVSEDEFKKITRINLTATWFILKAVASMMKENGTGGSIVFLATIASAERGLYPGADAYATAAAAIHQLVRASAMSLGKHKIRVXMISRGLHLGDEYPVSVGIDRAQKLVKDAAPLGQWLNPEKDIYSTVIYLISDGSCFMTGTTVMVDGAQSLTRPRLKSYM

SEQ ID NO: 56412 - protein, 290 aa, Arabidopsis thaliana
MAKQLKENGGKYESRPFSVGGYNWTLLIYPVIYIPTDSGGYVSIYVRVDNSSLITNPKDVYAEITFLAYKSSTDKYQISQETEAQRFHLFKQQWGLLQFLPIYYFENPAYGYFFEGESVVFGVDINIVKPFENWEVFSNEQNIRDPIFEWRLTKFSTRFLDSYTSDSFSSGGRNWALKVYPNGVGNATGNSLSLYLLSDQSNDKGYVEAKLRVIDQIQSNNFEKKVAAWPNATENGWGFDRFLSFADIKNTSKGFLVNDTLKLEVQILSFSKTDYYSHQSSLNVLTGDST

SEQ ID NO: 56413 - protein, 552 aa, Xylella fastidiosa Temecula1
MKALFRACRIGKVMLRYRLDTLLDGTAVERWLRLAKPFVPRISAEIVEQSRGRRLRLALQELGPIFVKFGQILSTRRDLVPQDIGDELVMLQDRVEPFEGQTARSIIETALGKSVESAFAHFDTVPLASASISQVHAATLHDRRAVVVKVLRPDIEHQISDDIALLKSLATLVEHTHPNADKIRPREIVAEIETTLAAELDLQREGANASVLRRFWEASDDIYVPEVIWSHTAERVLTLERMYGIPSDDIALLDASGIDRKALSSKGIRVFYTQVFRDNFFHADAHSGNIWVDSDPARKSNPRFIVLDFGIMGQLSQKDQYYLAENFMAIFHKDYRRIAELHVEAGWIPPHVRIEELEAAARSVCEPYFTRPLSQISLAEVMMKLFHVARRYQLTLQPQLILLQKTLLNIEGVGRQLDPELDIWVVARPVLERILRARYSPRHALKELNKRLPEIMTHAPDTPRLIHTWLVQQVESRKQNDVYLQQIRALAMTLQGLQRRVVNAIVGSGLLVAAAVLYGLHPDGLYLGTIPVWSLISGCIGALALFSAWWRS

SEQ ID NO: 56414 - protein, 292 aa, Synechococcus sp. WH 5701
MKISSQRFPLTTGLTRFLYFLGPVFIVLSHLGCLLLLATGLSLEAASWALALYVVRMLATTAIYHRLITHGSYRAPKLVVWIGALVGASAGQMGPSWWKAHHLAHHRHVDTDQDPHSPLQPQSGLRGFWRSQVGWLLQPSFFPERLPADVEADPVLRLIDRLHFLPLLALGGLSYAFGGLEWLAAFCLSTTVLFHGVATVNSLAHLAGDQPFITDDMSRNNAWVALITLGEGWHNLHHAFQWSVRQGYGVSGGRVQRLPDPTYAFIRVLERCGWADRLRLPAPDDLLARARP

SEQ ID NO: 56415 - protein, 429 aa, Bacillus halodurans C-125
MKTFEKSSAAFNRAKPLMPGGVNSPVRAFKSVNMDPVFMERGKGANIYDIDGNEYIDYVLSWGPLILGHADDQVVEKLKETTEKGTSFGAPSELETKLAELVIERVPSIEVVRMVNSGTEATMSALRLARGYTGRNKILKFEGCYHGHGDSLLIKAGSGVATLGLPDSPGVPETVAQNTLTVPYNDLESVRYAFEQFGDDLAGVIVEPVAGNMGVVPPEPGFLEELRRLTEENGTLLIFDEVMTGFRVGYHCAQGAFGITPDLTCLGKVIGGGLPVGAYGGKREIMEQIAPSGPIYQAGTLSGNPLAMTAGYETLVQLTEANYEYFDRLGDRLAEGLSAVAKEYDIPHYTSRAGSMVGFFFTDKKVKNFADASSSDLEFFAKYFKEMLHLGVSLPPSQFEGMFLSTKHTEADIDFTVDAARQAFKRLKK

SEQ ID NO: 56416 - protein, 394 aa, Flavobacteria bacterium BBFL7
MKTINDINFKDKKALVRVDFNVPLNDDFEVTDTTRIHAAKDTIIKILEDEGSVILMSHLGRPKGNQEEFSLKHIVAAATDILGVQVKFVEDTIGDAAQQAAANLQPCEVLLLENLRFHSEETAGDSAFAKALSQLGNVYVNDAFGTAHRAHASTAIIAQYFEEKCFGHLMTREIESLNKVLETPDQPVVAILGGAKVSSKITVIENILDKVDDLIIAGGMAYTFIKAQGGKIGDSLCEDDKMGLALEILEKAKSKNTNIHLPVDAITADAFSEHATMDNAAIDEIPNGWMGLDIGEKSRSEFHTVLMQAKTILWNGPAGVFELEPFSHGTISLGKSVAASTAAGAFSLVGGGDSVAAVKQFGFDNQVSYVSTGGGAMLEMLEGKTLPGIAAILD

SEQ ID NO: 56417 - protein, 118 aa, Arabidopsis thaliana
MATLDSDVTMIPAGEASSSVAASSSNKKAKRFEIKKWSAVALWAWDIVVDNCAICRNHIMDLCIECQANQASATSEECTVAWGVCNHAFHFHCISRWLKTRQVCPLDNSEWEFQKYGH

SEQ ID NO: 56418 - protein, 351 aa, uncultured bacterium
ITSANNLLAAMLDNHIQQGNELRIDTRRILWKRCVDMNDRVLRNVVVGLGSKNDGFVREDHFQITVASEIMAIFCLSKDLKDLKKRLSEIIVAYDLDGKAVTAGAIGAVGAMTALLKDAIRPNLVQTLEHTPVLIHGGPFANIAHGCNSIIATEAARHMADYCVTEAGFGADLGAEKFLDIKCRKAGFNPDAVVIVATIRALKYNGGVAKAELGNEDVAALEKGSANLKKHVENIKSYGLPVVVTINRFAQDTDAEIEKLSSICKECGVPFTVSEVFSKGGEGAVELVDELVKMTEDKHEFKPLYPDNLPLKEKIETVATKIYGAEGVDYSKEALTELDRLEKEGFGKLPV

SEQ ID NO: 56419 - protein, 516 aa, Agrobacterium tumefaciens str. C58
MTDKTPFYITTAISYPNGKPHIGHAYELIATDAMARFQRLDGMDVFFLTGTDEHGQKMQQTARAEGISPEELAQRNSDQFREMGKLLNASNDDFIRTTEERHHETSRNIWNLMADSGDIYKDSYAGWYSVRDEAYYAEDETEVRADGVRYGPQGTPVEWVEEESYFFKLSEYQEKLLKLYEENPDFIGPAERRNEIISFVKSGLKDLSISRTTFDWGIKVPDDPKHVMYVWVDALTNYITATGYIEDRNGPRAKYWPADVHIIGKDIIRFHAVYWPAFLMSAKLPLPKRVYAHGFLLNKGEKMSKSLGNVVDPANLVAHFGLDPVRYFFMREVSFGQDGSYSEEGIATRINADLANGIGNLASRSLSMIVKNCDGQIPTPGAFNDDDKAMLASADGLLAVCREEMGKQLIHRALAAIIAVVSETDRYFASQEPWALKKTDPERMGTVLYVTAEVVRQIGILLQPFMPQSCEKLLDLVAAPADGRDFTALGEAGRLAPGTPLEAPKPVFPRYVAPEA

SEQ ID NO: 56420 - protein, 352 aa, uncultured bacterium
IGAANNLLAAMIDNHIYQGNALDIDPRRVVWRRCVDMNDRQLRNVVDGLGGKANGYTREDGFDITVASEVMAAFCLATGLDDLKERFARIVVAYNRAGEPVTAGQINAQGAMTALLKDALKPNLVQTLEGTPAFIHGGPFANIAHGCNSVMATKMAMHFGDYVVTEAGFGADLGAEKFIDIKCRLTGLRPDAVIIVATIKALKYNGGVPKADVGKENLEALEAGIPNLLKHVENITKVFGLPAVVALNRFVNDTDAEIELVTKKCAELGVNVKMSEVWGKGGDGGIELAEEVIRLCEQPNEFKFAYDESLGIKEKIEAIATKVYGADGVDFAPKAAKEIEELEKFGYGNIPV

SEQ ID NO: 56421 - protein, 340 aa, uncultured bacterium
GAANNLLAAMLDNHIQQGNSLGIDPKQITWKRAVDMNDRQLRNIVDGLGGKAQGVPREDGFDITVASEVMAVLCLSSDITDLKRRCGNIIVGYTYGGEPVTARDLKAEGAMAALLKDALKPNLVQTLEGTPAFVHGGPFANIAHGCNSITATRMALKIGDYVVTEAGFAADLGAEKFLDIKCRMAGLKPDAVVIVATVRALKYHGGVAKADLNEENLTALEAGLPNLLQHVSNIKDVYGLPCVVAINAFPTDTKAELDMVEAKCKELGVNVALSEVWAKGGEGGKALAEEVVRLCEEPNDFRFSYELDMSIEEKMEAICKKIYHADGVQLTPGARKQMAK

SEQ ID NO: 56422 - protein, 358 aa, uncultured bacterium
ITAANNLLAAMLDNHIHQGNELRIDLRAITWKRALDINDRALRNVVVGLGNKSDGFVREDHFVITVASEIMAVLCLADDMEDLKERLGRMVVAYDLDGKAVTAKDLKAVGSMAALLKDAIKPNLIQTLEHTPALVHGGPFANIAHGCNSVRATKAALKMADYCITEAGFGADLGAEKFLDIKCPSANIAPSCIVLVATVRALKYNGGLAKDSLKEENLDALKKGIVNLEKHIENLQKYNVPVVVTLNRFDTDTPDELKFVEEFCTSRGCEFALSEVFAKGGEGGEDLARKVISSIENKEAHFKSIYEKDEPVDVKIEKVATEIYGASKVVYSSKALTSLKKLKDLGYGNLPVCMAKTQ

SEQ ID NO: 56423 - protein, 469 aa, Rhodobacter sphaeroides 2.4.1
MSKVADALKLMKDEEVEYVDIRFTDPRGKLQHVTLVADLVDEDFFEEGFMFDGSSIAGWKSIDQSDMKLIPDAGSVYIDPFYAEKTLCVHCNVVEPDTGEAYSRDPRGTAVKAEAYLKASGIGDVAYFGPEAEFFIFDDVRYSVTPAKVAYQIDADAAAWNTDSEYEMGNLAHRAGHKGGYFPVNPIDEAQDLRGEMLSTMKRMGMKVDKHHHEVATCQHELGLIFGGLTEQADNILKYKYVIHNVAAAYGKTVTFMPKPMKGDNGSGMHVNMSIWKDGKPLFAGDKYADLSQEALWFIGGILKHAKALNALTNPATNSYKRLIPGFEAPVLRAYSARNRSGCVRIPWTESPKAKRVEARFPDPSANPYLAFAALLMAGLDGIKNKIDPGPASDKDLYDLPPEELAAIPTVCGSLREALEELEKDHDFLLAGDVFTKDQLEGYMALKWEEVYAYEHTPHPVEYQMYYSC

SEQ ID NO: 56424 - protein, 352 aa, uncultured bacterium
IGAANNLLAAMIDNHIYQGNALDIDPRRVVWRRCVDMNDRQLRNVVDGLGGKANGYTREDGFDITVASEAMAAFCLATGLDDLKERFARIVVAYNRAGEPVTAGQINAQGAMTALLKDALKPNLVQTLEGTPAFIHGGPFANIAHGCNSVMATKMAMHFGDYVVTEAGFGADLGAEKFIDIKCRLTGLRPDAVIIVATIKALKYNGGVPKADVGKENLEALEAGIPNLLKHVENITKVFGLPAVVALNRFVNDTDAEIELVTKKCAELGVNVKMSEVWGKGGDGGIELAEEVIRLCEQPNEFKFAYDENLGIKEKIEAIATKVYGADGVDFAPKAAKEIEELEKFGYGNIPV

SEQ ID NO: 56425 - protein, 382 aa, Arabidopsis thaliana
MPATDFQGSFGRSLLSLRRDQVDSSTVVSGSSSHHEPSTMEVELDSFQRQVAEKFIDLNASSNDLLSLEWIGKLLDSFLCCQEEFRAIVFNHRSQISKSPMDRLISDYFERSIKALDVCNAIRDGIEQIRQWEKLADIVISALDSHRPIGEGQLRRAKKALIDLAIGMLDEKDHPSGTNLAHRNRSFGRVKDSHHRSIGHFRSLTWSVSRSWSASKQLQALASNLATPRPNDVVASNGLAVPVYTMTSVLLFVMWVLVAAIPCQDRGLQVNFFVPRHFQWAAPVMSLHDKIVEESKRRDRKNCCGLLKEIDRIEKSSRLMNELIDSIHFPLNDDKEVEVKQRVDELVQVREALRNGLDPFERKVREVFHRIVRSRTESLDSL

SEQ ID NO: 56426 - protein, 425 aa, Escherichia coli
MPHSLFSTDTDLTAENLLRLPAEFGCPVWVYDAQIIRRQIAALKQFDVVRFAQKACSNIHILRLMREQGVKVDSVSLGEIERALAAGYNPQTHPDDIVFTADVIDQATLERVSELQIPVNAGSVDMLDQLGQVSPGHRVWLRVNPGFGHGHSQKTNTGGENSKHGIWYTDLPAALDVIQRHHLQLVGIHMHIGSGVDYAHLEQVCGAMVRQVIEFGQDLQAISAGGGLSVPYQQGEEAVDTEHYYGLWNAAREQIARHLGHPVKLEIEPGRFLVAQSGVLITQVRSVKQMGSRHFVLVDAGFNDLMRPAMYGSYHHISALAADGRSLEHAPTVETVVAGPLCESGDVFTQQEGGNVETRALPEVKAGDYLVLHDTGAYGASMSSNYNSRPLLPEVLFDNGQARLIRRRQTIEELLALELLHHHHH

SEQ ID NO: 56427 - protein, 307 aa, Zea mays
MPPSADAMPAPGDAACAGDVRLISSKELREHASAADLWISISGDVYDVTPWLPHHPGGDLPLITLAGQDATDAFAAYHPPSARPLLRRFFVGRLSDYTVSPASADYRRLLAQLSSAGLFERVGPTPRVQLALMAVLFYAALYLVLACASASAHMLAGGLIGFVWIQSGWMGHDSGHHRITGHPLLDRVVQVLSGNCLTGLSIAWWKCNHNTLDILCPPWMDWFHGGLQFQIEHHLFPRLPRCHLRKVAPAVRDLCKKHGLTYSAASFLDANVLTWKTLWAAALQARSATGGGGAPKNLVWEALNTHG

SEQ ID NO: 56428 - protein, 152 aa, Arachis hypogaea
MASSSDSWMKEYNEAVKLADDINGMISERSSLSTSGPEAQRHASAIRRKITILGIRLDSLQSLLSKVPGKSEKEMNRRRETLTTLRSKVNQMASTLNMSNFANRDSLFGPEIKPDAMSRNVGWITVDSLGLSRPIMKEPEGRPWKNWEGDCL

SEQ ID NO: 56429 - protein, 428 aa, Pseudomonas syringae pv. syringae B728a
MAKIVDIKGREVLDSRGNPTVEADVLLDNGIIGSACAPSGASTGSREALELRDGDKSRYMGKGVLKAVANINGPIRDLLLGKDPVDQKALDHAMIELDGTENKASLGANAILAVSLAAAKAAAQDQDLPLYAHIANLNGTPGVYSMPVPMMNIINGGEHADNNIDIQEFMIQPVGAKSFAEGLRWGTEIFHHLKAVLKARGLNTAVGDEGGFAPNLASNKEALDAIAEAVANAGYTLGTDVTLALDCAASEFYKNGKYKLSEEGEYSSAEFAEYLAELTRKHPIISIEDGLDESDWDGWKILTDKIGEKTQLVGDDLFVTNTKILKEGIDKKIANSILIKFNQIGTLTETLEAIQMAKAAGYTAIISHRSGETEDSTIADLAVGTSAGQIKTGSLCRSDRVSKYNQLLRIEEQLGSKAVYRGRAEFRG

SEQ ID NO: 56430 - protein, 161 aa, Triticum aestivum
QTEQLVGIGIQRELAAETIYKERCIAVDDGDSWAKYMSISGSAEDEHDIITLQYTEEGLLTIDENRDGRAAAFGDDIAIECLATEFKREVFVVQAHGTDAMVDEDNCVFFLPHLPRGEICDVPIFLFMKGTAWCGAGADHYEPLIATVLQHVTPDKAAVVL

SEQ ID NO: 56431 - protein, 389 aa, Silicibacter pomeroyi DSS-3
MAAHWEIAVKNSSRSAVDPFIVMDVMEAARRAEEAGRRIIHMEVGQPGTGAPRGAVEALAKSLETDALGYTVALGLPALRQRIARLYGEWYGVDLDPGRVVITPGSSGGFLLAFTALFDSGDRVGIGAPGYPSYRQILRALGLVPVDLPTAPENRLQPVPADFAGLDLAGLMVASPANPTGTMLDHAAMGALIEAAQAQGASFISDEIYHGIEYEAKAVTALELTDECYVINSFSKYFSMTGWRVGWMVVPEDQVRVVERIAQNMFICAPHASQVAALAALDCDAELQANLDVYKANRKLMLERLPKAGFTRIAPPDGAFYVYADVSDLTDDSRAFAAEILEKAGVAVTPGLDFDPERGAGTLRFSYARATADIEEGLDRLEAFMQARG

SEQ ID NO: 56432 - protein, 370 aa, Pseudomonas syringae pv. syringae B728a
MIKSRAAVAFEAKKPLEIVEVDVAMPKAGEVLLRVVASGVCHTDAYTLSGADPEGIFPSILGHEGGAIVEAVGEGVTSVVVGDHVIPLYTPECRQCKFCRSGKTNLCQAIRATQGKGLMPDGTTRFSYKGEPIFHYMGTSTFSEYTVLPEISVAKIDKQAPLEKVCLLGCGVTTGIGAVLNTAKVKPGDTVAIFGLGGIGLSALIGAVKAKAARIIAIDINPAKFEIAKQLGATDCVNPKDFDRPIQEVIVDMTDGGVDFSFECIGNVQLMRAALESCHKGWGESVIIGVAGAGQEIATRPFQLVTGRVWRGSAFGGVRGRTELPSYVDMAQTGEIPLDTFITHTMGLEGINKAFDLMHEGKSIRTVIHF

SEQ ID NO: 56433 - protein, 225 aa, Anabaena variabilis ATCC 29413
MVTAILFDLDGTIVNTDPIHYQAWQQMLWKYNIEIDEKFYKSRISGRLNPEIVKDILPELSSAAGREFADEKEALFRQLASHLQPLNGFAELIAWTELHQLKRALVTNAPRLNAEFMLEVLGITESFHQIVLADDCVAGKPDPAPYQVALGKLGISAEKAIALEDSPSGIRAAVGAGIRTIGIASTHDPDVLQEVGSFMAIHDFTDLHLWTLLNSLIEPDLIRST

SEQ ID NO: 56434 - protein, 585 aa, Schizosaccharomyces pombe 972h-
MNAYVRDSESVYSESYPPENFISNEPEKSKDKDNFNGEEVISYVGEVETVPAKEENVFRRFINGFKIEKNQQDSAGQGLKRRLKSRHIQMIGIGGAIGTGVWVGSSKSLYRGGAASVLIDYCIVGTMVFCTVYALGELAVAFPTRGSFVTHATRFIDESWGFALSWNYVFSFIVTIPLELTTGTMMIKYWTNLNSGIWVTVFIVFLFFINIFGVKGYGEMEFIMSTIKVVAMCGFIILGIIIDCGGVPTDHRGYMGTHIFRENAFRHKFKGFCAVFTSAAFSFSGTEYVGVAAAETENPAKAFPVAVRQTLFRIAIFYILSLFIVSLLISGADPRLTSYHGVDASPFVLAIKDANIKALPSILNAIILISVISSANAQLYAGSRAIHSLGCNGFAPKCFTLVDREGRPLVALLILFLFMFLGYLVETGQYDTVFDWMLSISGLGTLFCWGSICLAHIRYRAAMKHQNRSLKEVGFVSPFNVYASYYAFILVCLVLAAEFYVSIFPVGGKPDASAFFENYLSAPVILVFFICHKLYYKTKRITLSNMDLETDFAYKTPVEEEEEEEKSAGSLSIKQRMKKLSDMMC

SEQ ID NO: 56435 - protein, 465 aa, Oryza sativa (japonica cultivar-group)
MDDDGETPMPSLELHKLPTLAGAAIPNPIARHPLYHPSPSFFISPTDVVLRDILFDASPASAAGERRRRHVAAYHRAGPRREVAFDPATVRAAIFTCGGLCPGTNTVVRELVVGLSELYGVRGGVFGVRNGYRGFYSDEVVPLDPAAVEHWHKAGGAALGTSRGGFDLARIVDAIERHGFNQVYAVGGDGTMRGAARIHREVRRRGRLAVAVAGIPKTVDNDVGVVDRSFGFHTAVEAAQQAIAAGHVEAESAANGVGLVKLMGRSAGHIALHATLSSRDVDCCLIPEEDFYLRGAGGLFDFLYRRIKDNGHAVVVVAEGAGQRLIPRTTTTSASGACAGADESGNETFLDVGAWLKAEMRAWWEEEHAGEVFTVKYIDPTYMIRAVPANAGDNLYCTLLAHAAIHGAMAGYTGFVSGTINGNYAYIPMDEVAEAKNPVDTKDHKWAWVRSITNQPDFIRAGPTS

SEQ ID NO: 56436 - protein, 794 aa, Neisseria meningitidis Z2491
MADNYVIWFENLRMTDVERVGGKNASLGEMISQLTEKGVRVPGGFATTADAYRAFLAHNGLSERISAALAKLDVEDVAELARVGKEIRQWILDTPFPEQLDAEIEAAWNKMVADAGGADISVAVRSSATAEDLPDASFAGQQETFLNINGLENVKEAMRHVFASLYNDRAISYRVHKGFEHDIVALSAGVQRMVRSDSGASGVMFTLDTESGYDQVVFVTSSYGLGENVVQGAVNPDEFYVFKPTLKAGKPAILRKTMGSKHIKMIFTDKAEAGKSVTNVDVPEEDRNRFSITDEEITELAHYALTIEKHYGRPMDIEWGRDGLDGKLYILQARPETVKSQEEGSRNLRRFSINGEKTVLCEGRAIGQKVGQGKVRLIKDASEMDSVEAGDVLVTDMTDPDWEPVMKRASAIVTNRGGRTCHAAIIARELGIPAVVGCGNATELLKNGQEVTVSCAEGDTGFIYSGLLDVQITDVALDNMPKAPVKVMMNVGNPELAFSFANLPSEGIGLARMEFIINRQIGIHPKALLEFDKQDDELKAEITRRIAGYASPVDFYVDKIAEGVATLAASVYPRKTIVRMSDFKSNEYANLVGGNVYEPHEENPMLGFRGAARYVADNFKDCFALECKALKRVRDEMGLTNVEIMIPFVRTLGEAEAVVKALKENGLERGKNGLRLIMMCELPSNAVLAEQFLQYFDGFSIGSNDMTQLTLGLDRDSGLVSESFDERNPAVKVMLHLAISACRKQNKYVGICGQGPSDHPDFAKWLVEEGIESVSLNPDTVIETWLYLANELNK

SEQ ID NO: 56437 - protein, 437 aa, Triticum aestivum
  misc_feature (295)..(295): Xaa can be any naturally occurring amino acid
  misc_feature (326)..(326): Xaa can be any naturally occurring amino acid
  unsure (1)..(437): unsure at all Xaa locations
MATRPPVFSTLTTSFSPSPPPLLRRLQTLTRALASSSPQPMASSPPLKKVLVPIANGTEPMEAVITIDVLRRAGADVAVASVEPGAAQVAASWGVKLAADALLADLAEADFDLISLPGGMPGASTFRDCKILENMVKKHAEKGKLYTAICAAPAVALGAWGLLNGLKATCHPSVMDKLPSEMQAVQSRVQIDGNCVTSRGPGTTMEYSVVLVEQLYGKEKADEVAGPMVMRPQHGAEFSMKELNSTSWNVGENPQILVPIANGTEEMEAIMIIDILRRAKANVVVASLESTWEIXPASRNVKMVADVQLDDALKQQYDLILLPGGXLGGAQAYAKSDKLIGLIKKQAEANKLYGAICASPAIALEPHGLLKGKKATSYPAMWSKLVDQSECKNRVVVDGNLITSQGPGTSMEFSLAIVEKLFGRERAFELAKAMVFV

SEQ ID NO: 56438 - protein, 194 aa, Bacillus halodurans C-125
MKVTKAELDCVAVKPEQYPNSPLPEVALAGRSNVGKSSFINKMINRKKLARTSQRPGKTQTLNFYNINDILHFVDVPGYGFAKVSKKDREAWGRMIETYLQQRGQLKAVLQIIDIRHDPTKDDQLMYDWLKHFEIPVIIIATKCDKIPKGKWPKHVKNIASVLEKDGGDPIVIFSSETGVGKDEAWKAILHAIS

SEQ ID NO: 56439 - protein, 352 aa, uncultured bacterium
IGAANNLLAAMIDNHIYQGNALDIDPRRVVWRRCVDMNDRQLRNVVDGLGGKANGYTREDGFDITVASEVMAAFCLATGLDDLKERFARIVVAYNRAGEPVTAGQINAQGAMTALLKDALKPNLVQTLEGTPAFIHGGPFANIAHGCNSVMATKMAMHFGDYVVTEAGFGADLGAEKFIDIKCRLTGLRPDAVIIVATIKALKYNGGVPKADVGKENLEALEAGIPNLLKHVENITKVFGLPAVVALNRFVNDTDAEIELVTKKCAELGVNVKMSEVWGKGGDGGIELAEEVIRLCEQPNEFKFAYDENLGIKEKIEAIATKVYGADGVDFAPKAAKEIEELEKFGYGNIPV

SEQ ID NO: 56440 - protein, 435 aa, Saccharomyces cerevisiae
MTTNEEFIGTQIFGTVFEITNRYNDLNPVGMGAFGLVCSATDTLTSQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFAEMIEGKPLFPGKDHVHQFSIITDLLGSPPKDVINTICSENTLKFVTSLPHRDPIPFSERFKTVEPDAVDLLEKMLVFDPKKRITAADALAHPYSAPYHDPTDEPVADAKFDWHFNDADLPVDTWRVMMYSEILDFHKIGGSDGQIDISATFDDQVAAATAAAAQAQAQAQAQVQLNMAAHSHNGAGTTGNDHSDIAGGNKVSDHVAANDTITDYGNQAIQYANEFQQ

SEQ ID NO: 56441 - protein, 334 aa, uncultured bacterium
LAAMVDNHIYQGNELDIDPRRITWHRAVDMNDRQLRNAVDGLGGKAQGYVREDHWDITVASEVMAVFCLSTSIDDLKERLARIVIGYSRAGKPITAGDLNAQGAMAALLKDALKPNLVQTLEGTPAFVHGGPFANIAHGCNSVLATQMAMHFADYVVTEAGFGADLGAEKFMDIKCRMAGLKPDAVIIVATVKALKYNGGVPKADVQKENLEALEAGIPNLLKHVENIKNVFGIPAVVALNKFVTDTDAEIELVTRKCKELGVNVKLSEVWGKGGEGGLELAEEVIRLCDQPSELHYAYELDTPITEKIEAIATKVYGADGVDFAASAKKEIDN

SEQ ID NO: 56442 - protein, 516 aa, Crocosphaera watsonii WH 8501
MVQSTQPKKKVKLNKFEKLKAEKDGLDIKDQLEHFAEIGWQAMDKSDLELRLKWVGIFYRPLTPGKFMLRLRMPNGILTSEQMRVLGHIVQRYGEDGNADITTRQNLQLRGIRLEDIPDIFNRLQEVNLTSMQSGMDNVRNITGSPMAGLDADELIDTRELVQKVQDMITNHGAGNYDFTNLPRKFNIALEGGRDNSVHAEINDIAFVPAYKNGELGFNVVVGGFFSASRCDAAIPLNAWVPPTEAAVIDLCRAILTIFRNNGLRGNRQKARLMWLIDEWGLNKFRAEVEQELGYQLETEAEKDAIDWEKRDHLGVFPQKQAGLNYVGMHVPVGRLYAEDMLDFARLAEVYGNGELRLTVEQNVLISHIPQENLETFLEEPILEKFSISPKPLQRALVSCTGAQFCSFALVETKNRAVALAKELDEALEIPKTVRIHWTGCPNSCGQPQVADIGLMGTKVRKDGQTVEGVNLYMGGKVGKDAHLGTCVQKRIACDDLIPVLTDILIENFGAKRKLP

SEQ ID NO: 56443 - protein, 363 aa, Bacillus halodurans C-125
MEKQIAVLPGDGIGPEVTDAAIEVLQAVADRFGHTFSYKKALLGGCAIDEVGTPLPEETLDVCRHADGILLGAVGGPKWDTLPGHLRPEKGLLGLRKGLNLFANLRPVTVYDSLADASTLKNDVIDGVDLLIVRELTGGLYFGEPRERRGEGETEEVVDTLLYTRGEMRRIIRKAFELAMVRNKHVTSVDKANVLESSRMWREVANEVAQEFPEVTLEHMLVDNAAMQLIRRPKQFDVLVTENLFGDILSDEASMVTGSLGMLPSASLTSDGPGLYEPIHGSAPDIAGKGVANPLATIASCAMMLKYSFGLHEEAKTIEDAIEAVLKQGYRTADIAKPGEESSSTKAITDAVVEAIQASVDIS

SEQ ID NO: 56444 - protein, 472 aa, Azorhizobium caulinodans
MAETSYDVIVIGGGPGGYVAAIRAAQLGFKTAVVEKKHLGGICLNWGCIPTKALLRSAEIYHYMEHAKDYGLSAEKIGFDIGAVVKRSRGVSQQLNTGVGFLMKKNKIDVIWGSATLTAPGKIKVEAAPDAPKGALGGGDYLAKHIIVATGARPRALPGIEPDKKLIWTYFEAMVPDRMPKSLLVMGSGAIGIEFASFYKTMGADVTVVEVMPQILPVEDAEIAALARKRFEKQGMKILSGAKVTKLEKKADSLTVHVVNSKGAKQDFQVERMISAVGVVGNVDGLGLENLGVKIERGIIVTDGYGRTNVPGVYAIGDVAGAPMLAHKAEHEGVICVETIKGLHTHPMDKAKIPGCTYCQPQVASVGLTEAKAKEDGRDIRVGRFRFGGNGKAIALGEDQGLVKTIFDKKTGQLLGAHMVGAEVTELIQGFVVAMNLETTEEELMHTVFPHPTLSEMMKEAVLDAYGRVLNA

SEQ ID NO: 56445 - protein, 328 aa, uncultured bacterium
LLAAVLDNHIQQGNALNIDVRRVVWKRVLDLNDRALRHVVIGLGGKAHGVPRETGFDITVASEMMAILCLSDSLTDMKRRLGEIVVAYTTDGRAVRAKELNVTGALTLLFKDAIKPNLVQTLGGIPAFVHGGPFANIAHGCNSVMATKLALKLADVVVTEAGFGADLGAEKFLDIKCRFAGFSPDAVVIVATVRALKMHGGVPKSDLSRVDMGALEKGMENLLKHIETIHAFGLPAVVAVNAFPTDTAEELSFVEKKCAELGAEVAVSEVWAKGGEGGVALAKKVEAAMAKPKNFHTLYESDAPIPEKIKTVASTVYGADGVIFTAAA

SEQ ID NO: 56446 - protein, 251 aa, Arabidopsis thaliana
MKVVSKKRWKSLGPLHLKSKSVARFCFFSKLKSNNHGPGRAPVYLNVYDLTPINGYIYWAGLGIFHSGVEVHGVEYAFGAHDYATSGVFEVEPRQCPGFKFKKSIFIGTTNLNPTQVREFMEDMACSYYGNMYHLIVKNCNHFCQDVCYKLTGKKIPKWVNRLAQIGSVCSCILPESLKITAVCHDPDGQIPEEENEKRSLRSSFSCLSSISIRQKQLSTSSLFLQSPLRGCLPPWQLKRSKSNSSSLKER

SEQ ID NO: 56447 - protein, 237 aa, Triticum aestivum
RRRFSVIQWEALALYTILGSASINYRTAPAGDTAFGLPITAIAYIYTLIFVTVPSLASVYNEYAMKSQDTSIYLQNLFLYGYGAIFNFLGILGTALFQGPENFNILQGHSRATMFLICNNAAQGILSSFFFKYADTILKKYSSTVATIFTGLASAAFLGHTLTINFLLGISVVFISMHQFFSPIAKVKDDKPGELLELQDTQNHRSSDSSFVNMTAGAAEDASHQLGTDERQPLLPI

SEQ ID NO: 56448 - protein, 641 aa, Helicobacter pylori 26695
MRLSNADLERLKSMANALRFLCADMIDKANSGHPGVCLGLADVMVVLSLHLNLNPTNPKWLNRDRLVFSGGHASALAYSLLHLWGFDLSLEDLKRFRQLHSKTPGHPELHHTEGIEITTGPLGQGFANAVGFSMASQYAQNLLDKEAISHKVYCLCGDGDLQEGISYESASLAGHLRLDNLIVIYDSNQISIEGAINISFSEQVKTRFVAQNWEVLECDGHDYQAIHNALEEAKKSTKPTLLIAHTIIGKGAVGLEGSEKTHGSPLNKEVLKQSKENAQINPNESFIISPKNKMHFEEVKVRGVSLEALWEKSLSPKIKEKIHALKDFDFSAIHYPTFKKGESLATRVSNGMILNAIAKECEGFLGGSADLAPSNNTQLKHSGDFPLGQNLHFGIREHAMGAITNALAAYGLFVPFCATFFVFSDYLMPSIRLSALMKLKALFIFTHDSIGVGEDGATHQPIEQLNHLRALPNFYAFRPSDAFENTACMQIALSLNAPSGLILSRQNLPVLDEVSKERVLKGAYVKHHSKDPIITLVASGSEVSLALESAKILERENIQTQVISAPCFDLLIEQDESYLKELFKGKVLVIEASRAIEWYRFADKIIGMDSFGSSAKGDKLFEKFGFSVENITAQAKRLLNA

SEQ ID NO: 56449 - protein, 511 aa, Yarrowia lipolytica CLIB122
MTNQESQSVKVVFVTRDETLQPEAPLPPVMVPTSLKRLGLSEIVNQLLDTETPVPLDFLIVKATAGDGGASILDEESASSSSVLLRPGASLESFLADNGLSSEVSLSIEYIRSVLPPSFLASFSNPDWVAAVDINARWTGDLKPVIASGSYDGVVRLWDHSGHVTGQLVGHNSAAKAVRWISNDQLVSGGSDRLLYLWNPDGKKYRRKEPGQVGKKELNYDSEEDSDEEMLDELPAASTVTPMAALHGHTAPINDLAVHAKTGKIISASADGSVGLWSTDYNDMPAIEPHTAAAGGLTSTSAQKRRKLANSGSGATGLGAARQRGPLAVMGGHSAAVSAVAFHHSDPTVAYSVSLDHTIKTWDLATAEAVQSNAGSPDPSVDTRSTSFSLLSLCTLPQGLIACGSSARHITLHDPRVTAQVATQAKLVGHTNFVSSLSRGPESNPFLLASGSHDGTVRIWDVRTTKSLHVIHRETLTENNAVFGVDWKQNLGIVSGGQDNKIQINNNPQSA

SEQ ID NO: 56450 - protein, 331 aa, Cryptococcus neoformans var. neoformans JEC21
MNFFNRQKTRTPADTVKSLKDNITRLDNAPAGEASRKINEDISRQLSIVKILLSGEGDTEPNPDAVAQVANEVYAQDLLSLMVVHLGKFDFEARKDVCNIYGVLLRRQLGSRSPTVDTIATRPDIIFNTLKGYANQDIALNTGMILKEMLRYEPLARILLYSDQFYTFPSYIENTSFGISCDALANMKETLTRHKPMVAQYIEANYDRFFNMYNTLILSSNYVTKRQSLKLLGEILLDRANYNIMTRYIASEANLKMMMNFLRDKSRNIQFEAFHVFKVFVANPNKPPQIASILRRNKEKLLVFLREFHNDKDDEQFNDEKQFLIHQIQQL

SEQ ID NO: 56451 - protein, 456 aa, Arabidopsis thaliana
MEEENEVVKTFAELGVREELVKACERLGWKNPSKIQAEALPFALEGKDVIGLAQTGSGKTGAFAIPILQALLEYVYDSEPKKGRRPDPAFFACVLSPTRELAIQIAEQFEALGADISLRCAVLFGGIDRMQQTIALGKRPHVIVATPGRLWDHMSDTKGFSLKSLKYLVLDEADRLLNEDFEKSLNQILEEIPRERKTFLFSATMTKKVRKLQRACLRNPVKIEAASKYSTVDTLKQQYRFVAAKYKDCYLVYILSEMPESTSMIFTRTCDGTRFLALVLRSLGFRAIPISGQMTQSKRLGALNKFKAGECNILVCTDVASRGLDIPSVDVVINYDIPTNSKDYIHRVGRTARAGRSGVGISLVNQYELEWYIQIEKLIGKKLPEYPAEEDEVLSLLERVAEAKKLSAMNMKESGGRKRRGEDDEESERFLGGNKDRGNKERGGNKDKKSSKKFKR

SEQ ID NO: 56452 - protein, 1082 aa, Magnaporthe grisea 70-15
MIQKYGGHAVKFSFSNSPLDNIFGLRFAWEFYRHGRRDEYLKFTHRSFAQSGAGRANPYTYEVNLGGVRTIWTADPENIKAMLGSQFEDYGRGKAFQSRWHDLLGTGIFNADGREWHDSRHRLRPLFNRQRVSNLDSFERQIQIMINRHLGGGRTVDLKDVISRFALDAIGDYAMGFQVNALADRKNDFLDALERIKTIQNIKECAGPLSWLVPTPGFKRDLKVLDDFMEPLIEHAASLPQSVLDEMEKTDHGWTYVKACASVSRDRHFLKYELMSVILAGRDTVSGTLVWTFLELVKRPDLMADLRREIENTVGIGRDAPRPTHDDLRSMRLVKNTLNETLRLYPTVSLNLRTALRDTSLPRGNDHDGNKPVGLAEGTPVIFSSHILQLSPETYEQSPPGTSPPHVFDPYRWEEWKPKPWTYIPFGGGPRICIGQEFALAEMAFLLVRLLQNYSRLEMRCEMRGNSDEGWERPNGSASIVEQFMMEKGRVRISGDVTLSPRDKDSQLVKIISTKPTMIVTIPVLLATYILYWTVRLVKNILRANATGLPVRWTPVAPTNPFWIVLGKPTSRVLRAILPSFLSNWTYFSTFDWHWLDRLYLDFEVHEKNGDTFLHATPSGLMLHTRDPQVAQQILHTCPKPDDVAKSLELCGPNLVSSSEVDWPRHRKVTVSTLSDRNNRLVWSETVRQTLNVLQSYQPGHGEIIDPEGDIRRIYLNMFSAVCFGRPLDAEKEPGETTDGKLPGGHKRSYRYCLETSLRDIFILHTVPSWIKYLPPALVPHKISEFFAASREMMQYLDEMIRRCQDEAQEGGEESKSGDNLLRITVRSGLQSNTKEPQGRSYLSKEEVRGNLLIYSLAGHESNAHTLTYALYLLAACPDVQDWLAEELAAITLLDGQLSAEETYFGIMAKLPRTLAVMYETLRLYPSIIFLPKTTASRSVSIDLGHVEGQSKAIIPPNTNIWVNMCGMQVLPEVWGDDARTFRPSRWINSSGQLAAPSLVAGSAYVAWGGGKRVCPGQRFSQAAFAASVVALLTGGKRVHVVPREGEEEGMARRRVLEVLDDSFVGTTIHMRRAGDVKLVVA

SEQ ID NO: 56453 - protein, 200 aa, Anabaena variabilis ATCC 29413
MNAFRVGVAGPVGSGKTALVDALCKALRDRYKLAVVTNDIYTQEDAQFLVRSQALTSDRILGVETGGCPHTAIREDASMNLAAIEQLEQRFTDLDLVFLESGGDNLAATFSPELVDLTIYVIDVAAGDKIPRKGGPGITKSDLLVINKTDLAPYVGADLSVMERDAKKMRGDKPFIFTNLKTQQGLNDVIEFVCHHICPV

SEQ ID NO: 56454 - protein, 515 aa, Triticum aestivum
MTRCKILYTMDWFLGQLLALLCCCCFFYYRHLQSKKACKAEPTEWPLLGHLFGMLANLHHYHDWATVVLAGRRYNFPAQTGLTGVRFFITCDPSNVRHIFTSNFLNYPKGEEYAEIFDILGHGIFNADGESWRSQRAMSQLLLATPRFRSFSARCTRDKVDKSLLPFLAHVADAGARCDLHDVIRRMTFDMTCNLVFGVDPGCLRIGLPVVPVARAMDDVLDTMFLRHVFPPTCWSLMYRYELGPEKKMAVARRTIDRFAANTIAKRRSDHEVGVKQSSSDMLSSFISSNDDDVSDEFLRDTAINLLFAGRDTTGAALSWFFYLVCKNPRVEQKILDELAPVAATKKPEDMVVFDFSELSNLVYLHAALCECLRLYPPLPFQHKAAIAGDVLPSGHELKAGDKILVYCYSMGRMEGVWGKDCMEFRPERWVTDDGKLRHEPSYKFFAFNAGPRTCLGKDVAFTQMKAVAAAVLWNFAVEAVPGHVVEPKLSVMLHMKNGLAVTVKRRKVPCVHAT

SEQ ID NO: 56455 - protein, 405 aa, Oryza sativa
DSLEEGFWFGLVWWFVRDFVGRRVMATAGKVIKCKAAVAWEAAKPLVIEEVEVAPPQAMEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECFHDGWGVAVLVGVPHKDAEFKTHPMNFLNERTLKGTFFGNYKPRTDLPNVVELYMKNVAWWLRKFITHSVPVFGDQHGVRPDAQGARGIRCIIRMEN

SEQ ID NO: 56456 - protein, 557 aa, Gibberella zeae PH-1
MSRRAPNPAAERAAQNQATIKSLLKLEANKVCSDCKRNKHPRWASWNLGVFICIRCSGIHRGMGTHISRVKSVDLDSWTDEQLQSVLKWGNARANKYWEAKLAAGHAPSEAKIENFIRTKYELKRWVMDGPMPDPATLDVEGDDDVPLSIVKEKQVIERKESIRKASLTNSSAPRTVPPPQGDLIGGDPVPVRSSSAAPQSSKVPPKGEPAPPRTTSTKDSLLGLDFFGEPQAPPRPASTTGTAPSGQSRPDLKQSILSLYASAPRVQPQAQPQQPPSAGGFGGFASPTFSHQSQGSVGGFNDAFSSLSVSNAPKPAAPDPFASLGSAGRTTSSNNNAFGGLGGGSFFDSKPSQPSAPTHQHQSSNFSNFGGFSSPAPVAAAAPAAPKPAQSSAMGDLFDLSAPVTTSPPPPQPAAAPASSVFNLSSPQSPPAAAPASTTTSSMGGFSGADVWGGGEWGAPATAPAPVQKAPEPVKPATTGFEWGNSGGAFANTPIVPGASGGLTSGGFNPIASPKVSADEEFGGWTSSGPPAGGSTSQTKSGGFGGDDDLFSNVWQ

SEQ ID NO: 56457 - protein, 924 aa, Silicibacter sp. TM1040
MSDKITFTLDGAQVTADAGMTIWEVANGRGLKIPHLCHKPQPGYRPDGNCRACMVEIEGERTLAASCIREPSEGMVVTTNNARAENARKMVMELLVADQPAQEVAHDKSSHMWDMAELNGVSESRFPKLEEGHIPLLDDSHVAMSVNLDACISCGLCVRACREVQVNDVIGMAGRGHNAYPTFDIADPMGESSCVACGECVQACPTGALMPATVVDENQVGDRKDFDSETESVCPFCGVGCKVSLKVKDGKVKYVEGINGPANEGRLCVKGRFGFDYIHHPHRLTKPLIRREDAPDKGLNVDPGNLMTHFREASWDEAMDLAAKGLIKLRDADPKSVAGFGSAKCTNEEAYLFQKFIRQGFKHNNVDHCTRLCHASSVAALIENVGSGAVTATFNEIENADVAIIIGANPIENHPVAATYFKQFTKRGGKLIVMDPRGVGMRRYADEMLQFRPGADVSMLNAIMNVIVEEELYDSQYIHRWTENWEAEKEHLRQFTPEKMSEICGIEPEQLRRVARTFAGAEAGMIFWGMGVSQHIHGTDNSRCLISLALMTGNVGKPGAGLHPLRGQNNVQGASDAGLIPMFLPDYQTVTSDDVRRSFTDVWGGGDFSNEKGLTVTEIVDQVYAGNIKGMYIQGENPAMSDPDADHAREAFAKLDLMIVQDIFLTETANFADIILPASTLYEKNGTVSNTNRQVQRVRPAVTPPGEAREDWKITVELAQRIGLPWAYSDVSEVFAEMKLNMKSLDNITWERLEVETITYPSLHETDPGQAIVFGDGFPRPEGRARFTPASVIPPDEAPDADFPMIMTTGRQLEHWHTGSMTRRSLVLDAVEPEANCSLHPRTLRTLGVEPGEMVRLSTRRGSIEIMARADRAVAEDMVFVPFAYVEAAANILTNPAIDPYGKIPEFKFSAVRVEKAEGQIAAE

SEQ ID NO: 56458 - protein, 117 aa, Xylella fastidiosa Temecula1
MSMSEETIFAKIIRREVPATIVYEDEEVLGFKDIMPRAPVHVLFIPKRQIIPTLDDLHPEQGPLIGKLVLAAAEYARREGFAQDGYRIVMNCREHGGQTVFHLHLHLLAGAPLGTSW

SEQ ID NO: 56459 - protein, 356 aa, uncultured bacterium
IGAANNLLAAMIDNHIYQGNELNIDPRKITWRRCVDMNDRQLRFVVDGLGGRVNGTPREDGYDITVASEIMAVLCLASDINDLKERPSRIIIGYTYGKVSEQKPVTAGDLHAQGAMAALLKDALKPNLVQTLEHVPAIVHGGPFANIAHGCNSVTATRMAMKLADYAVTEAGFGADLGAEKFLDIKCRMAGIKPNAVVIVSTVRSLKYNGGVAKADLGPENLEALEKGLPNLLKHVSNIRDVYGLPCVFAINEFPTDTPAEVKLVEDRCKELGVNVVLSQVWAKGGEGGKALAEEIIRLVDQPSDFRFSYELDGTIEEKLNQIATKIYGARGVVMTADAAKQAKQLEAIGFGNCPI

SEQ ID NO: 56460 - protein, 352 aa, uncultured bacterium
IGAANNLLAAMLDNHIQQGNKLGIDPKQITWKRAVDMNDRQLRNIVDGLGGKAQGVPREDGFDITVASEVMAVLCLASDINDLKARCGRIIVGYTYSGEPVTAHDLKAEGAMAALLKDALKPNLVQTLEGTPAFVHGGPFANIAHGCNSVTATRMALKIGDYIVTEAGFAADLGAEKFLDIKCRMAGLRPDAVVIVATVRALKYHGGVAKADLNEENLTALEAGLPNLLQHVSNIKDVYGLPCVVAINAFPTDTKAELDMVEVKCKELGVNVALSEVWAKGGEGGKALAEEVVRLCEEPNDFRFSYDLDMSIEEKMDAICRKIYHADGVVLTPAARKQMAKLEEIGCGNMPI

SEQ ID NO: 56461 - protein, 161 aa, Trema virgata
MSSSEVDKVFTEEQEALVVKSWAVMKKNSAELGLKFFLKIFEIAPSAKNLFSYLKDSPIPLEQNPKLKPHAMTVFVMTCESAVQLRKAGKVTVRESNLKRLGAIHFKNGVVNEHFETRFALLETIKEAVPEMWSAEMKNAWGEAYDQLVAAIKFEVKPSST

SEQ ID NO: 56462 - protein, 352 aa, uncultured bacterium
IGAANNLLAAMVDNHIHQGNALRIDARRISWKRAVDMNDRALRDIVVSLGGKANGFPRQDGFDITVASEVMAILCLASDIADLKERLARIIVAYNLDDQPVTAGDLNAQGAMAALLKDALKPNLVQTLEHTPAFVHGGPFANIAHGCNSVTTTRMALKTGEYVVTEAGFGADLGAEKFLDIKCRMAHLTPSAVVIVATVRALKMHGGLAKTQLKNEDLAALEKGLPNLLQHVENITKVYGLPAVVAINRFPDDTEAELALVEEKCKALGVNVVLSEVWMKGGEGGKALAEEVVRLCEDPSDFRFCYEDGLSLKEKIEAVATKIYHADGVDFLAPAVKELEKLEALGYARLPV

SEQ ID NO: 56463 - protein, 161 aa, Trema virgata
MSSSEVDKVFTEELEALVVKSWAVMKKNSAELGLKFFLKIFEIAPSAKNLFSYLKDSPIPLEQNPKLKPHAMTVFVMTCESAVQLRKAGKVTVRESNLKRLGAIHFKNGVVNEHFETRFALLETIKEAVPEMWSAEMKNAWGEAYDQLVAAIKFEVKPSST

SEQ ID NO: 56464 - protein, 332 aa, Arabidopsis thaliana
MDRINGLSDDIICHILSLLSFKEATSTSVLSMRWRYLFAFRPNLCLDDQEVGGGDSFIDFVDRVLVVTGNFPIRRISIKCRMSIDTGHVTRWMVDVLEHGVSYLDIDIISEDDIGFVPLEIFTCKTLVELKLARGFYAMVPDYVSLPSLKTLFLSSIWFCNRDCCPLGRLLSACPVLEELTIIGGCWQHIEFCRTVSSSTLKKLTITSSFHYEYWGITIDTPSLAYLEYSDLVPRHFPFVNLESLVEAKLALDLCSDSNPTNLIKGLRNVEVLELSSGYTSQILYDFREAIPVLSKLFRLSIKSNSRHYYIWNLLPILLEKSPKLETLVIKV

SEQ ID NO: 56465 - protein, 536 aa, Populus tomentosa
MNPQEEFIFRSKLPDIYIPKNLPLHSYVLENLSNHSSKPCLINGANGDVYTYADVELTARRVASGLNKIGIQQGDVIMLFLPSSPEFVLAFLGASHRGAIITAANPFSTPAELAKHAKASRAKLLITQACYYEKVKDFARESDVKVMCVDSAPDGCLHFSELTQADENEAPQVDISPDDVVALPYSSGTTGLPKGVMLTHKGLITSVAQQVDGDNPNLYFHSEDVILCVLPMFHIYALNSIMLCGLRVGASILIMPKFEIGSLLGLIEKYKVSIAPVVPPVMMSIAKSPDLDKHDLSSLRMIKSGGAPLGKELEDTVRAKFPQARLGQGYGMTEAGPVLAMCLAFAKEPFDIKPGACGTVVRNAEMKIVDPETGASLPRNQPGEICIRGDQIMKGYLNDPEATSRTIDKEGWLHTGDIGYIDDDDELFIVDRLKELIKYKGFQVAPAELEALLIAHPEISDAAVVGLKDENAGEVPVAFVVKSEKSQATEDEIKQYISKQVIFYKRIKRVFFIEAIPKAPSGKILRKNLKEKLAGI

SEQ ID NO: 56466 - protein, 352 aa, uncultured bacterium
IGAANNLLAAMIDNHIYQGNALDIDPRRVVWRRCVDMNDRQLRNVVDGLGGKANGYSREDGFDITVASEVMAAFCLATGLDDLKERFARIVVAYNRAGEPVTAGQINAQGAMTALLKDALKPNLVQTLEGTPAFIHGGPFANIAHGCNSVMATKMAMHFGDYVVTEAGFGADLGAEKFIDIKCRLTGLRPDAVIIVATIKALKYNGGVPKADVGKENLEALEAGIPNLLKHVENITKVFGLPAVVALNRFVNDTDAEIELVTKKCAELGVNVKMSEVWGKGGDGGIELAEEVIRLCEQPNEFKFAYDENLGIKEKIEAIATKVYGADGVDFAPKAAKEIEELEKFGYGNIPV

SEQ ID NO: 56467 - protein, 352 aa, uncultured bacterium
IGAANNLLAAMIDNHIYQGNALDIDPRRVVWRRCVDMNDRQLRNVVDGLGGKANGYSREDGFDITVASEVMAAFCLATGLDDLKERFARIVVAYNRAGEPVTAGQINAQGAMTALLKDALKPNLVQTLEGTPAFIHGGPFANIAHGCNSVMATKMAMHFGDYVVTEAGFGADLGAEKFIDIKCRLTGLRPDAVIIVATIKALKYNGGVPKADVGKENLEALEAGIPNLLKHVENITKVFGLPAVVALNRFVNDTDAEIELVTKKCAELGVNVKMSEVWGKGGDGGIELAEEVIRLCEQPNEFKFAYDENLGFKEKIEAIATKVYGADGVDFAPKAAKEIEELEKFGYGNIPV

SEQ ID NO: 56468 - protein, 513 aa, Lactobacillus reuteri
MLRKGMQILNDPFKNKGTAFTIEERKKYGLLGLLPSCVRTIEEQADEIYRLYQSKNSRIEQRHLLMEVFNTNRTLFFYLMEKHIAEFMPVVYDPVIAEAIEQYNERYIKPQDAAYLSIEHPDLIKEELADAADGRDIRLIVVTDAEGILGIGDWGVNGVDISVGKLMVYTAAAGIDPSQVLPVSIDAGTNNEKLLKDPHYLGNRMKRVEGQPYFDFIDKFVDAVEGLFPKSLLHFEDFGRGTAARILDKYQDKILTFNDDIQGTGIIALAGVLGAMNISKEKLTDQTFLTFGAGTAGMGIAKMLYDELIRQGLTPEEAKKHFYLVDRQGLLFDDTPGLTPKQKPFTRQRSEFANADELTNLLAVVKAVHPTVMIGTSTQPGSFDEAVVKEMAAHTLRPVIFPLSNPTKLAEAKAADLLKWTDGKALIATGIPVKDIEYNGTVYQIGQANNALIYPGVGFGALAAEAKVLNDNMLAAAAHALSGLVDPEKPGAAVLPPVSKLTEFSKRVAERVA

SEQ ID NO: 56469 - protein, 143 aa, Triticum aestivum
PVETFNPIRQGIHHDILLSNFFAQTEALMVGKNEEQVRAEMGTNVVENIVPHKIFKGNKPTNSFLFQKLTPATLGSLIAMYEHKIFVQGAIWDINSYDQWGVELGKQLAKAILPELSASGEVASHDASTNGLINHYKKNKKQY

SEQ ID NO: 56470 - protein, 118 aa, Arachis hypogaea
IGHMRRFASSRQTFSNFDWKAQIAPEDINHRDCYSEDDRPAAGSDVEDEHDEEEEVVIPFSAPIGGRGGCNGDFGGRGVHHEIVDNLNLQPRKEINLWKRRTMAPPRPLQLKPVLTAK

SEQ ID NO: 56471 - protein, 393 aa, Nicotiana benthamiana
MDGSGQQSDTMMSDAGAEQPPPAAQPVAGMDNIPATLSHGGRFIQYNIFGNIFEVTAKYKPPILPIGRGAYGIVCSALNSETIENVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIFMELMDRKPLFPGRDHVHQLRLIMELIGTPSEAEMEFLNENAKRYIRQLPLYRRQSFTEKFPHVHPDAIDLVETMLTFDPRRRITVEGALAHPYLNSLHDISDEPICMTPFSFDFEQHALTEEQMKELIYRESLAFNPEYQHM

SEQ ID NO: 56472 - protein, 315 aa, Synechococcus sp. WH 7805
MDCLCLGLLCADLVCHPVPALPNQGQLMETERMELSLGGCAANTAFDLAKLGVRTGISGCVGNDVLADFIVQTLNAAGVDTRGVVRSNEVATASTAVINVTDQDRRFISYAGANTAMTAALIPDELLESVSVLYIGGFLMLDGLESEAMLQRLAQARKAGTRILLDVVQVGDADAMERLQRFLPFTDVFLPNNDEAALLTGFSNPWEQAEAFRSAGARTVVITEGDRGAHLLNDQLKLRAGAYATDFQGGTGAGDAFDAGFIAALLQGHDLPTCLRWGSALGASCVRSTSATGSVFNREEALQFMGSHAITVESC

SEQ ID NO: 56473 - protein, 336 aa, Helicobacter pylori 26695
MPKTETYPRLLADIGGTNARFGLEVAPRQIECIEVLRCEDFESLSDAVRFYLSKCKESLKLHPIYGSFAVATPIMGDFVQMTNNHWTFSIETTRQCLTLKKLLVINDFVAQAYAISAMQENDLAQIGGIKCEINAPKAILGPGTGLGVSTLIQNSDGSLKVLPGEGGHVSFAPFDDLEILVWQYARSKFNHVSAERFLSGSGLVLIYEALSKRKGLEKVAKLSKAELTPQIISECALNGDYPICRLTLDTFCSMLGTLAADVALTLGARGGVYLCGGIIPRFIDYFKTSPFRARFETKGRMGAFLASIPVHVVLKKTPGLDGAGIALENYLLHDKI

SEQ ID NO: 56474 - protein, 353 aa, Synechococcus sp. WH 7805
MAILQRSAGCLMVSSPPQVLCVGEALVDRLGPLGGDPNTAAPSDCDDRLGGAPANVACALARLGTPVAFIGRLGRDAIGDSFLELLNDRGVDLRGLQHDDQRPSRVVLVRRDASGERVFQGFAGDRGAGFADQALDQAVLDPHWSSLAKAARWLLIGTIPLASASSAAALRSLLAQAQRDGVRVALDVNWRPTFWDPGADPAAGPDAQALALMQPLVQQADLLKLAREEAEWLFHTNTPDQISAALPRHPDVVVTDGGEPVQWCIAGQCGSMPVLAPPQVVDTTGAGDAFTAGLLHQLVCLAPVAGQSHQLDNAAVKEVVRYAAACGALVCTGAGGIDPQPLPSRVLEFLEQV

SEQ ID NO: 56475 - protein, 464 aa, Yarrowia lipolytica CLIB122
MRANFIQPQQVHQGFVNGNAGPDPRMGMMGQAGGAQGVNGMMRSTATQNQGGQQAQNSTPVRSAQQPGQQQQQQQQPNSGQRPGSALGLNSTPGQQTGGQQQGFPGMVNPLPMGMRNPMMMGQQGGVSGGRRGPGGAGGPPMMGAAQMQHLSQQQQQQQHPAPVREVWGFNLEEEMARVREVSERARYVSLECKFPGIVARPIGQFRSTNEYHYQTLRANVDLLKVIQVGLSFSDDSVAPPVTWQFNFRFDETQDMCSEDIKDLLKQSGVDFVRHQQHGIDAFNFGELLISSGLVLDDGIEWITFHAGYDLGYVLGIMLNKELPAEEQQFLAQVRRYFPRVWDLKNAVKNSGLTIRSNSLSSLAEDLRVRDQEVTNNQAGADAKLAAECFFEMRRYLGDQMALEMANKLCGLSELHPEQLMLLEEDEDAPGEDLTEVPVPTVQKPKEKQDGVNVFQFSKMGGGK

SEQ ID NO: 56476 - protein, 353 aa, uncultured rumen bacterium
IGAANNLLAAMLDNHIQQGNQLGIDPRKITWKRCVDMNDRQLRFVVDGLGGKVNGTPREDGFDITVASEIMAVFCLASSITDLKARLSRTIVGYTYDDKPVTAGDLKAVGAMTALLKDALKPNLVQTLEGTPAFVHGGPFANIAHGCNSVMATRLALKMGDYTVTEAGFGADLGAEKFLDIKCRMAGLTPDAVVVVATVRALKMHGGLNKKELNTEDLNALEKGIPNLLRHVSNITNVYQLPCVVAVNRFPTDTDAEIDFIIRKCRELGVNTVLSTVWAEGGKGGEALAREVVRPCEEEKGNFTFSYELDGSIEDKINAIVRKIYGGTGISVLPAAKKQIEQLTALGFDRLPI

SEQ ID NO: 56477 - protein, 439 aa, Oryza sativa (japonica cultivar-group)
MAAAKHFTYVILGGGVAAGYAAREFAKQGVKPGELAIISKESVAPYERPALSKGYLFPQNAARLPGFHTCVGSGGERLLPEWYSEKGIELILSTEIVKADLASKTLTSSADATFTYDTLLIATGSSVIKLTDFGVQGAEANDILYLRDIEDADKLVAAMQAKKDGKAVIVGGGYIGLELSAALKTNNFDVTMVYPEPWCMPRLFTSGLAAFYEGYYANKGIHIIKGTVAVGFDADANGDVTAVKLKNGNVLEADIVIVGVGGRPLTHLFKGQVAEEKGGIKTDAFFETSVPGVYAIADVAAFPMKLYNEIRRVEHVDHARKSAEQAVKVSHPRSRRRRPASRCRSTTTCPTSTPGRSTSRGSSYGDNVGEDVLFGDNDPTAAKPKFGSYWIKDGKVVGVFLEGGSAEENQVIAKVARAQPPVADVEALKKEGLDFAAKV

SEQ ID NO: 56478 - protein, 352 aa, uncultured rumen bacterium
IGAANNLLAAMIDNHIYQGNALDIDPRRIVWRRCVDMNDRQLRNVVDGLGGKANGYTREDGFDITVASEVMAAFCLATGLDDLKERFARIVVAYNRAGEPVTAGQINAQGAMTALLKDALKPNLVQTLEGTPAFIHGGPFANIAHGCNSVMATKMAMHFGDYVVTEAGFGADLGAEKFIDIKCRLTGLRPDAVIIVATIKALKYNGGVPKADVGKENLEALEAGITNLLKHVENITKVFGLPAVVALNRFVNDTDAEIELVTKKCAELGVNVKMSEVWGKGGDGGIELAEEVIRLCEQPNEFKFAYDENLGIKEKIEAIATKVYGADGVDFAPKAAKEIEELEKFGYGNIPV

SEQ ID NO: 56479 - protein, 117 aa, Zea mays
  misc_feature (27)..(27): Xaa can be any naturally occurring amino acid
  unsure (1)..(117): unsure at all Xaa locations
RKHRIVSLVSALLILLALAVSSTRNAXDVPGSENDLHLQELARFAVDEHNKKANALLGFEKLVKAKTQVVAGTMYYLTIEVKDGEVKKLYEAKVWEKPWEKFKELQEFKPVEEGASA

SEQ ID NO: 56480 - protein, 641 aa, Aspergillus oryzae
MDAKPQRIRVRGDENAAFPLTSKTVHQKNKSTPALSTMFQNGVTKNGPRRAAFGDVSNTVKTVQGIRDDISVAAKKQIKPLEKPSVQATERKSSVLAQPAQRPMSVAGVKGLSSNVTTSKPLEPIGKSIGVPQHTANARKALNKRGTVFKDHMEPLTEKRELTSKETTQTKEGITGGQLAHSSTAPSQLSSLKEKDVVNEGSNDESETHDEHSIVSSEVDGEEKDAPKLDEDVCKVQGIKELREASEPGTATDADGSDRAVKPQRVSVPGAHMSHEHVPAHSEPEESWDDEDDENEEEDEYITARSYRSRGENTTGATTTILFPKYTQQVRRELALAKQIVEATRTVEDIEDEYWDTSMVAEYSEDIFDYMREQEIKMLPNAHYMDNQAEIQWSMRSVLMDWLVQVHHRFSLLPETLFLCVNYIDRFLSCKIVSLGKLQLVGATAIFIAAKYEEINCPSVQEIVYMVDGGYTADEILKAERFMLTMLQFELGWPGPMSFLRKISKADDYDLETRTLAKYFLEITIMDERFVGCPPSFTAAGAHCLARMMLRKGNWTPAHVHYAGYTYSQLYPLISLMVECCEIPRKHHAAIYEKYTDKRFKRASLFVEAEMRKGFHLPEVTREKSLCNPPSLDAGHQWKRA

SEQ ID NO: 56481 - protein, 532 aa, Pseudomonas aeruginosa PAO1
MCGILGYVGTGFSVSRFAGALRLLAHRGPFGEGIAALPNGAIGMTRLPMSGAAAVPLPPQEGQRRVAYNGEVYQAGCEIHGEIRLLLDGLQRGVLPDGMYALASWDPQTRQLTLLRDEFGIKPLYYSYQPERGLLAFASEPRALLHLLGGARADAEAIAQVVAAGVPLEGQTLFQQVRLLLPGEVLRFDLSQERPRLCQRQRLATAPASEVDSLDEQLGETLERCRQTFRPCALLVSGGVDSNLLGSYLDPQLQRFHLCLEGDEESLLPHPRLQRFELRQEAFMPLLRRAVGNFGGATRMSSLLMYQRLADGIGEQGYHCVLLGEGADELFWGYPRHLELWRRRDTPEPRRFAAAWFGEYRRKAALLAEPAGRRVAERIEELAHEALGQGLEAAIGQFDLHYSLEPLLRRADHLLMSRTIEARTPYLHGALAQRAGRLQRIVGDTAKAPLVALLEQREKRWQAQPKRHFRLPFERWPQALGEMRRHLAERLPALHDLGLEGLDAPSVAALPGDQLFTLTTLSLWQQEYGASL

SEQ ID NO: 56482 - protein, 351 aa, uncultured rumen bacterium
ITTAHNLLAAVIDNHIQQGNALDLDVRRIAWKRVVDLNDRALRHVVIGMGGKAHGVPRETGFDITVASEMMAILCLATDLEDMKKRLGRIVVAYTRDGRAVRADELNVTGALTLLFKDAIKPNLVQTLEGTPALIHGGPFANIAHGCNSVMATKFALKFADIVVTEAGFGADLGAEKFLDIKCRFASLKPSAVVIVATVRALKMHGGLPKTELAKVDMTALEKGLENLIKHIETVKAFGLPAVVAINAFPTDTKEELDFVEKKCNEFGAEVALSEVWAKGGEGGIALAEKVLAATEKPNNFNFTYEVEQSIPEKIEAIVKRVYGGDGVVFTGPAQKQLEEIEALGLDKMPV

SEQ ID NO: 56483 - protein, 1227 aa, Kluyveromyces lactis NRRL Y-1140
MTGYSLAQVLAEASRSVVSRNNVFYTTPSKSENSGISLELSKTDAIRLLNSNDPFATISEAASKDVFTTVFTDDSTLLKALPYLYSLKSLPVVINVELTLQDFSIIPALKDLDYVSFVSNSFADAKAAAEVSYKVASTLLQPVLHFISVPYHVEGIAELSFQKAEFTEDEEAESERLEDLLTVEKYNFYSHNKLPSTVVINLSPYAQEFSESLPKDTALIDLKVYRPFDLTSLLAEIPTSVKDIVIVQKSNSKPENTNGFEPIQLDFFSDFNLLVEREIKQIVVSNVGEITDFSKTLQQLISNIKSDSPDLSLYLGERVETEATQGLSISIAGALSLEFAYEKVLNQLFKSNLDVLNKYDNESVNVTNPEYGFGLFLKQKQERDSLISLANKSLNASEYTSSDGQKIVELLDQWIKLNNVALEESTIEKGNKVAEELFELLQNNDHSSTALSLLKKIGSVEALKFKSSWLVGSDAWSYDLGQSGVHHVLASNENINILIIDSDPYDKVKASEIKSRKKDVGLYAMNFGNAYVASVAVYSSYTQLLTSFVEASKFVGPSIILAYLPYNSERDTPLEVLKETKIGVESGYWPLYRFNPYEERDDQVFKLDSSVIKQQLKDFLDRENKLTLLAQKSPELARNLKHSASDAIQLKQDRRAKAAFDQLLEGLSGPPLHIYHASDGGNAANLAKRLGTRASARGLKTIVLSMEDIVLEELPGEENVVFITSTAGQGEFPQDGKAFWDALKSSTDLDLASLNFSVFGLGDSAYWPRKEDAHYYNKPAKDLFKRLELLSGQELVSLGLGDDQDADGYQTGYAVWEAQLWEKLGVSGATVPDEPKPITNEDIKIASNFLRDTIVEGLQDESTGAISAWDQQLTKFHGIYMQDDRDIRDTRKSQGLEPYYIFMSRVRLPGGKANPDQWLILDHLADKTGNGTVKITTRATFQLHGVVKHNLKHTIRAMNSTLMDTLAACGDVNRNVMLSALPANATVHKQIADVGTYLSERFLPQTTAYHEIWLEGPDKDDEDPSWPETYEKRQEGPIKKKKTLVAGNALVDAEPVYGPTYLPRKFKINITVPPFNDVDVWSSDVGLIAIIDEPTQTLTGFNLYVGGGMGSTHNNKKTYPRTGSLFGYVSVADVGDAIEKVMIVQRDHGDRTNRKHARLKYTVDDLTIEGYKQKVEELWGKKFEPAAAYEIKSNIDYFGWVKDETGLNHFTAFIENGRVEDTVELPQ

SEQ ID NO: 56484 - protein, 351 aa, uncultured rumen bacterium
ITTAHNLLAAVLDNHIQQGNALNIDVRRVVWKRVLDLNDRALRHVVIGLGGKAHGVPRETGFDITVASEMMAILCLSSSLTDMKRRLGEIVVAYTTDGRAVRAKELNVTGALTLLFKDAIKPNLVQTLGGTPAFVHGGPFANIAHGCNSVMATKYALKLADVVVTEAGFGADLGAEKFLDIKCRFAGFSPDAVVIVATVRALKMYGGVPKSDLSRVDMGALEKGMENLLKHIETIHAFGLPAVVAVNAFPTDTAEELSFVEKKCAELGAEVAVSEVWAKGGEGGLALAKKVEAAMAKPKNFHTLYESDAPIAEKIETVARTVYGADGGTFTSAAKKQLDEIEALGLDKMPV

SEQ ID NO: 56485 - protein, 196 aa, Kluyveromyces lactis NRRL Y-1140
MKKDNFGHFRLTGNQHVLISDVDDEHLDEVKAIMNKYKLDNTNFSGLRLSSAACVALPTCGLAMAESERYLPVLITKLENALEEYGLRHDSIVMRMTGCPNGCARPWLAEVALVGKAPGTYNLLLGGGYYGQRLNKLYRASIKEDEILATLKPLFKRWSLERLEGEHFGDFVIRVGVIKPTLEGKYFHDDLPEEAL

SEQ ID NO: 56486 - protein, 161 aa, Trema virgata
MSSSEVDKVFTEEQEALVVKSWAVMKKNSAELGLKFFLKIFEIAPSAKNLFSYLKDSPIPLEQNPKLKPHAMTVFVMTCESAVQLRKAGKVTVRESNLKRLGAIHFKNGVVNEHFETRFALLETIKEAVPEMWSAEMKNAWGEAYDLLVAAIKFEVKPSST

SEQ ID NO: 56487 - protein, 352 aa, uncultured bacterium
IGAANNLLAAMLDNHIQQGNALGIDPKQITWKRAVDMNDRQLRQIVDGLGGRTQGVPREDGFDITVASEVMAVLCLASDIKDLKARLARIVVGYTYEGKPVTAHDLKAEGAMAALLKDAIKPNLVQTLEKTPALVHGGPFANIAHGCNSVTATRMALKLGDYVVTEAGFAADLGAEKFFDIKCRMAGLHPACTVVVATVRALKYHGGVPKNELGTENLAALEKGIPNLMRHVSNIRDVFGLPCVVAVNAFPTDTRAELDLVRKKCGELGVRVALSEVWGKGGEGGTELAEEVVRLCEQPNEFRQAYELDGTIEEEIEQICRKIYHADGVMLTPNAKKQAALLTSLGFDKMPV

SEQ ID NO: 56488 - protein, 1028 aa, Haemophilus influenzae 86-028NP
  misc_feature (204)..(204): Xaa can be any naturally occurring amino acid
  unsure (1)..(1028): unsure at all Xaa locations
MQVSRRKFFKICAGGMAGTSAAMLGFAPANVLAAPREYKLLRAFESRNTCTYCAVSCGMLLYSTGKPYNSLSSHTGTNTRSKLFHIEGDPDHPVSRGALCPKGAGSLDYVNSESRSLYPQYRAPGSDKWERISWKDAIKRIARLMKDDRDANFVEKDSNGKTVNRWATTGIMTASAMSNEAALLTQKWIRMLGMVPVCNQANTXHGPTVASLAPSFGRGAMTNNWVDIKNANLIIVQGGNPAEAHPVGFRWAIEAKKNGAKIIVIDPRFNRTASVADLHAPIRSGSDITFLMGVIRYLLETNQIQHEYVKHYTNASFLIDEGFKFEDGLFVGYNEEKRNYDKSKWNYQFDENGHAKRDMTLQHPRCVINILKEHVSRYTPEMVERITGVKQKLFLQICEEIGKTSVPNKTMTHLYALGFTEHSIGTQNIRSMAIIQLLLGNMGMPGGGINALRGHSNVQGTTDMGLLPMSLPGYMRLPNDRDTSYDQYINAITPKDIVPNQVNYYRHTSKFFVSMMKTFYGDNATKENGWGFDFLPKADRLYDPITHVKLMNEGKLHGWILQGFNVLNSLPNKNKTLSGMSKLKYLVVMDPLQTESSEFWKNFGESNDVNPAEIQTEVFRLPTTCFAEEEGSIVNSGRWTQWHWKGCDQPGEALPDVDILSMLREEMHELYKKEGGQGIESFEAMTWNYAQPHSPSAVELAKELNGYALEDLYDPNGNLMYKKGQLLNGFAHLRDDGTTTSGNWLYVGQWTEKGNQTANRDNSDPSGLGCTIGWGFAWPANRRVLYSRASLDINGNPWDKNRQLIKWNGKNWNWFDIADYGTQPPGSDTGPFIMSAEGVGRLFAVDKIANGPMPEHYEPVESPIDTNPFHPNVVTDPTLRIYKEDREFIGSNKEYPFVATTYRLTEHFHSWTAQSALNIIAQPQQFVEIGEKLAAEKGIQKGDMVKITSRRGYIKAVAVVTKRLKDLEIDGRVVHHIGLPIHWNMKALNGKGNRGFSTNTLTPSWGEAITQTPEYKTFLVNIEKVGEA

SEQ ID NO: 56489 - protein, 447 aa, marine gamma proteobacterium HTCC2143
MSAVIYPTTNFKAIEQLVIDRGEGIYVYDKDGKQYLEGMAGLWCTSLGYGNQEIIAASNEQMKKMSFTHMFGGKTHQAGIDLANRLAEMVPVENAKVFFGNSGSDANDTHIKLLRYYFNALGKPEKRKIITRERAYHGVTVAAGSLTSLPANLTHFDSPIDALGILRTDHPHYYRGANNGESEAEFVNRITNNLEQLIVREGPETIAAFIAEPITGASGVIVPPAGYYEKVQTILQRYNILFWADEVITGFGRTGNDFGCTTMNIKQPDMMTLAKQMSSAYYPISASIIRSELYEAMVELSSKVGVFGHGYTYSGHPVGCAIALKVLEIYQRDNIFKTAASTGDYLQRRLKAFSDHPLVGEVRGKGMIAALELVANKTTKAAFTDGSVGAKAVLACQHNGLIVRAVAGNSLALCPPLITTEAQVDEIMEKLGKALDSTLEHTTLSDR

SEQ ID NO: 56490 - protein, 351 aa, uncultured bacterium
ITSANNLLAALLDNHIQQGNVKRIDSRSIVWKRCMDMNDRALRNIVVGLGSKSDGFVREDHFVITVASEIMAVLCLAEDLKDLKARLGRIIVAYDLDGNPVTAEDIQAVGAMTALLKDAIRPNIIQTLEHTPAIVHGGPFANIAHGCNSVIATRTALKLADYCITEAGFGADLGAEKFLDIKCRQAGLTPSAVVLVATVRALKYNGGIPKDQLGSENLDALKKGIENLGKHIENIQSYGLPVVVALNAFVSDTDAEIEFVRQYCKSKNCTMSVARVWEKGGEGGTELAELVIKATEEKSDFKFCYPDELSITEKIEAVSKKIYGADGVDIASSAAKQIAKIEEMGFGNLPV

SEQ ID NO: 56491 - protein, 352 aa, uncultured bacterium
IGAANNLIAAMLDNHIKQGKELDVDLNNIIWRRCVDMNDRQLRNVVDGLGTAGDGVCREDGFDITVASEVMAVFCLATSLDDLKERLGRMVVAYSRSGKPVTVADIKAEGACTALLKDAIKPNLVQTLENNPAFVHGGPFANIAQGCNSVQATMTAMKMTDYVVTEAGFGADLGAEKFIDIKCRYAGFNPSCVVIVATVRALKHHGGVAKADLNNENLEALEAGLPNLLQHVANVKDVFGIAPVVAINAFPTDTEAELKLVQDKCAELGVNAVLAEHWAKGGEGATALAEEVVRICDQPNDFKFCYDVEMGIEEKIEAIATRVYHADGVDYTPKAKKQLAQLNELGFDKLPI

SEQ ID NO: 56492 - protein, 265 aa, Glycine max
MFYIFAENKEEEKKEETTEEKKEKEPPEIVLKVDMHCEACARKVAKALKGFEGVEEVTADSKASKVVVKGKAADPIKVCERLQKKSGKKVELISPLPKPPEEKKEEEIKEEPQPEEKKEELPPVVTVVLKVRMHCEACAQVIQKRIRKIQGVESVETSLGNDQVIVKGVIDPAKLVDYVYKRTKKQASIVKEEEKEKKEEEEKKEEEKKEEKEEEKKGEDGEEVDTKTDIKRSEYWPLRSHVDYVDYPYASQIFSDENPNACTVM

SEQ ID NO: 56493 - protein, 352 aa, uncultured bacterium
IGAANNLLAAMIDNHIYQGNALDIDPRRVVWRRCVDMNDRQLRNVVDGLGGKANGYTREDGFDITVASEVMAAFCLATGLDDLKERFGRIVVGCNRAGEPVTAGQINAQGAMTALLKDALKPNLVQTLEGTPAFIHGGPFANIAHGCNSVMATKMAMHFGDYVVTEAGFGADLGAEKFIDIKCRLTGLRPDAVIIVATIKALKYNGGVPKADVGKENLEALEAGIPNLLKHVENITKVFGLPAVVALNRFVNDTDAEIELVTKKCAELGVNVKMSEVWGKGGDGGIELAEEVIRLCEQPNEFKFAYDENLGIKEKIEAIATKVYGADGVDFAPKAAKEIEELEKFGYANNPV

SEQ ID NO: 56494 - protein, 427 aa, Burkholderia vietnamiensis G4
MSAIVDIIGREILDSRGNPTVECDVLLESGTMGRAAVPSGASTGSREAIELRDGEAGRYNGKGVLKAVEHINTEISEAIMGLDASEQAFLDKTLLELDGTDNKSRLGANAMLAVSMAVAKAAAEEAGLPLYRYFGGSGAMQLPVPMMNIVNGGAHANNSLDIQEFMIVPVSQPTFREALRCGAEVFHALKKILSDRGMSTAVGDEGGFAPNFGSNDECLSTILQAIEKAGYRAGEDVLLALDCAASEFYHDGKYQLAGEGLQLSSAEFTDYLATLADKFPIVSIEDGMHEGDWDGWKLLTERLGKKVQLVGDDLFVTNTRILKEGIEKGIANSILIKINQIGTLTETFAAIEMAKRAGYTAVISHRSGETEDSTIADIAVGLNAGQIKTGSLSRSDRISKYNQLLRIEEDLGDIASYPGKSAFYNLR

SEQ ID NO: 56495 - protein, 362 aa, Zea mays
  misc_feature (226)..(226): Xaa can be any naturally occurring amino acid
  unsure (1)..(362): unsure at all Xaa locations
MNGSSGSQGHHVSGEKKQVCHVSRPILNNGPKHRPLTPMRRCRGVACVVIILSTAFLLVVYLAPITTFAVRLFSVHYSRKATSFLFGMWLSLWPFLFEKINKTKVVFSGENVPPKRRVLLFANHRTEVDWMYLWDLALRKGHLGYIKYILKSSLMKLPIFSWAFHIFEFIPVERKWEIDEAIIQNKLSKFKNPRDPIWLAVFPEGTDYTEKKCIMSQEYASEHGLXPMLEHVLLPKTKGFICCLQELRSSLDAVYDVTIAYKHRLPDFLDNVYGVDPSEVHIHVRMVQLHHIPTTEDKITEWMVERFRQKDQLLADFFMKGHFPDEGTEGDLSTPKCLANFLTVVCLTAICLLPITPYYHPN

SEQ ID NO: 56496 - protein, 361 aa, Arabidopsis thaliana
MDLDDFRSVMDNAGVDVWTFIDTAILVASLDYGQELKRRRDNIVERLYATSMANKCRNCDFGGGGNVTEAAIGRVNNGRVHEETEEEDEEGVTAAAEEEVREKSVNVEDDDDFDPFAGLFDDEQKSIVEIKEKLEDPDLSEESLVELLQNLEDMDITFQALQETDIGRHVNRVRKHPSNNVRRLAKQLVKKWKETVDEWVKFNQPGDLEPPSLIEQSISSNVADEDSPVQKALHNGSRQQVPDFGYSPVPQNGYSSSSKNSNITEPERKPRPVAPQPRRESPSPAKPSRPSPSQQTIPRDKEHKEVDFDTARKRLQQNYRQAENAKKQRTIQVMDIHDIPKPKKGGFFPRKGGSSQGGRHW

SEQ ID NO: 56497 - protein, 279 aa, Cryptococcus neoformans var. neoformans JEC21
MMSSSPTSTPHQVPSFLANILLSHISPLDPSSTSSTTFDHHRSPTTQNPSHPQALQTAEHPPNPLYLPPPALPKVEEDLVPPENFALVSSGVYRCGFPKKRNFKFMETLRLKTVLTLVLEEYPKANLEWCQSQDIQFMQFGIPGNKEPFDNIPEDVICAALVAILDRRNHPILIHCNKGKHRTGCLIGCIRRLQAWSLTSIFDEYRRFSAPKSRAVDQQFIDLFDIMPVWEAVCRPKGGGLGNLPDWGMLVLPKGVVEVGRDGKEKKRVERDIFHMRGL

SEQ ID NO: 56498 - protein, 121 aa, Zea mays
  misc_feature (35)..(35): Xaa can be any naturally occurring amino acid
  misc_feature (45)..(45): Xaa can be any naturally occurring amino acid
  misc_feature (85)..(85): Xaa can be any naturally occurring amino acid
  misc_feature (100)..(100): Xaa can be any naturally occurring amino acid
  misc_feature (103)..(103): Xaa can be any naturally occurring amino acid
  misc_feature (107)..(107): Xaa can be any naturally occurring amino acid
  unsure (1)..(121): unsure at all Xaa locations
MAAAAAKVSATTAEDVLRLLRMEEQEEHGGDGAWXYLCLARRLRXRRPAHVLRVGLDLLNNASARSGLASEQWTLYEEVGTAFMXCQRLDGEKDLDLESXSKXFPGXTRVALVRKLVCLGK

SEQ ID NO: 56499 - protein, 530 aa, Bordetella pertussis Tohama I
MHQRILILDYGSQVTQLIARRVREAGVYSEIHAGDVDDAFVRDQVAQGLKGIILSGSHASAYEEGSMRVPAAVFDVGVPVLGICYGMQSMAQQLGGTVSFSDHREFGYAEVRAHGHTKLLDGLADFTTDEGHGMLKVWMSHGDKVTELPPGFKLMASTASCPIAGMADESRGFYAVQFHPEVTHTVQGKAMLARFVKDICGCEGDWNMPDYISEAVARIREQVGSDEVILGLSGGVDSSVAAALIHRAIGDQLTCVFVDHGLLRLDEGKQVMQTFTENMGVKIVHVDATSQFMGKLTGVADPEAKRKIIGREFVEVFQDEAGKLQGAKWLAQGTIYPDVIESAGAKTGKATSIKSHHNVGGLPDTLNLQLLEPLRELFKDEVRELGVALGLPPQMVYRHPFPGPGLGVRILGEVKHEYAELLRRADAIFIEELRNAKDPASGLTWYELTSQAFAVFLPVKSVGVMGDGRTYEYVVALRAVQTFDFMTADWAPLPHPLLARVSSRIINEVRGINRVVYDVSSKPPATIEWE

SEQ ID NO: 56500 - protein, 144 aa, Oryza sativa
QQSPTPLLFPSPHLALSPPRGARFLNPTSPRRRAPGRSPSQQPQPQPAKGKGKKKDEKKDDDLSEEDQALKEQLELYVVRAQDTDPGVQKLALESMRQEIRSATSSMTSVPKPLKFLRPHYGTLKAYFETMPESDLKKYMADIL

SEQ ID NO: 56501 - protein, 275 aa, Streptococcus pyogenes MGAS8232
MKKEEKLVFTVAFLIIGGVFFRTTAVTRIPANTVGVKVSATSGVQKQTLSTGYHLKVPFIDKIYKMPTSVQQKKIKKITTQTEDAQWLDTTLDVKYRVSEKNAMNVFKDYQSMENVNKSLIKAAVQRAVEQVTVNYDIYEALGSKRNELYAEIEKSLSERLAKESIELVSVTLTDQDAGDEIEKAIKDESVKQKQVDSAKQDKEKAKIEAETKQIQAQAEADAQVIKAKGEAESNNTKAASITDNLIKMKEAEARYKHGWVEVQTSGEVITNKGQ

SEQ ID NO: 56502 - protein, 251 aa, Silicibacter pomeroyi DSS-3
MRRKLAAGNWKMNGTGAALDALEAIAGAHSAAAVDLLICPPATLLYRAAQVAEGSRVRIGGQDCHAVTAGAHTGDISAMMLADAGASAVILGHSERRADHGETDAQVCDKARAALEAGLIAIICIGETLAQREAGQTLDVVCAQLAGSVPDGIDGTRVVVAYEPVWAIGTGLVPTLEQIAEVHDTLRQQLIGRFGSETAEAIRLLYGGSVKPGNAAEIFAVSNVDGALVGGASLTAADFSPIVSALEQAAG

SEQ ID NO: 56503 - protein, 260 aa, Bacillus cereus ATCC 14579
MLKSYRAVLVSLSLLFVFVLSGCSNAAPIDAHSTGIWDHYFVYPISFMIQFVAHHIPGASFGIAIIIMTLVIRSAMIPLAVSQYRSQAKMKKMQPELQKLKKKYGDVSKDLEKQKQYQKEMSELMKSGGWNPLAGCWPLLIQMPIFSALYYAISRTEEIRTSSFLWVNLGHADPYHILPIIAALTTFIQMKVFQSNITPGEQVQMLKMQQIMMPAMILFMGFAAPSGLVLYWITGNLFTMTQTIVLRKIMEREELQLQKA

SEQ ID NO: 56504 - protein, 342 aa, Triticum aestivum
  misc_feature (8)..(8): Xaa can be any naturally occurring amino acid
  misc_feature (213)..(213): Xaa can be any naturally occurring amino acid
  unsure (1)..(342): unsure at all Xaa locations
MDHAAEAXRTDLMTITRHALNEQGRHPESRGDFTILLSHIVLGCKFVASAVNKAGLAKLIGLAGETNVQGEEQKKLDVLSNEVFVKALVSSGRTCVLVSEENEAAIFVDAPLRGKYCVCFDPLDGSSNIDCGVSIGTIFGIYMIKDKDNATLEDVLQPGTHMIAAGYCMYGSSCTLVLSTGNGVNGFTLDPSLGEFILTHPNIKIPNKGKIYXSVNEGNARNWDAPTAKYVERCKFPQDGSSPKSLRYIGSMVADVHRTLLYGGIFLYPADKKSPNGKLRVLYEVFPMSFLMEQAGGQSFTGKHRALEIVPSEIHQRSPIFLGSYDDVEEIKSLYAAESSTA

SEQ ID NO: 56505 - protein, 577 aa, Streptococcus salivarius
MTEMLKGIAASDGVAVAKAYLLVQPDLSFETVTVEDTSAEEARLDAALAASQDELSVIREKAVESLGEEAAAVFDAHLMVLADPEMTGQIKETIRAKQVNAEAALTEVTDMFIAIFEGMEDNPYMQERAADIRDVTKRVLANLLGKKLPNPATINEESIVVAHDLTPSDTAQLNKKYVKAFVTNIGGRTSHSAIMARTLEIAAVLGTNNITELVKDGDILAVSGITGEVVINPTEEQIAEFKAAGEAYAKQKAEWALLKDAQTVTADGKHFELAANIGTPKDVEGVNDNGAEAVGLYRTEFLYMDSQDFPTEDDQYEAYKAVLEGMNGKPVVVRTMDIGGDKELPYFDLPKEMNPFLGYRALRISISETGNQMFRTQLRALLRASVHGKLRIMFPMVALLTEFRTAKGILEEEKAKLVAEGVAVADDIEVGIMIEIPAAAMLADQFAKEVDFFSIGTNDLIQYTMAADRMNEQVSYLYQPYNPSILRLINNVIKAAHAEGKWAGMCGEMAGDQTAVPLLVGMGLDEFSMSATSVLRTRSLMKKLDTAKMEEYANRALTECSTMEEVLELSKEYVNVD

SEQ ID NO: 56506 - protein, 351 aa, uncultured rumen bacterium
ITTAHNLLAAVIDNHIQQGNTLDIDVRRVVWKRVLDLNDRALRHVVIGMGGKAHGVPRETGFDITVASEMMAILCLASDLEDMKKRLGEIVVAYTRDGRAVRAKELNVTGALTLLFKDAIKPNLVQTLEGTPAFIHGGPFANIAHGCNSVMATKFALKFADYVVTEAGFGADLGAEKFLDIKCRFAGIHPDAVVIVATVRALKMHGGMDKKDLGKVDMSALERGMQNLEKHIENIQKFGLPAVVAINAFPTDTKEELDFVEAACNKRGAEVALSEVWAKGGEGGLKLAEKVEAAMNKPNDFHFIYETEASVEEKITAIAKKIYGADGIAFTDAAKKQLAEINALGFDKMPV

SEQ ID NO: 56507 - protein, 807 aa, Ustilago maydis 521
MVNEIDIARTSSHSSSGAKSSSKDHAATPGIEELHNVEKNLKNDFLDHRINDPNMETEKIDAVERVIEQGDYKAEAQIEEELEEDSPYPEVRAAVSNIDDPTMPVMTFRAWTLGLLFTIVIPGVNQLLSYRYPTTTITSFVAQLLAYPMGVFMAKVLPTKVFKTPFGSFTLNPGPFNVKEHTIITVMSNVTYQRAYASNVSAVQRITYGFDWGFGYIILLTLSSQLIGFSMAGFFRRWLVWPAAMIWPGNLGNTALFSALHRQVDTGSNHMSRYKFFMIAVSCAFAWYFVPGYLFALMSVGNWFCLIAPNNVPLNQILGTQQGLGLIPLTFDWNQYSYNGNPIYTPWWAQANVLGGFLFCYCFIAPILYYKNVWNFAYLPFSTSGVYDRFGKKFKTSKVTTPDHLHFNPAGYNAYSEQYFSVTYAVSFALSFASITAIVVHVALFHGKQIYKQFTTSINAERDVHARLMQRYPEVPKLWYAILFLICFGMGVGCTAGYATDFPVWAFIISLIIGAFFMLPVGIVYAISNVEVGLNVISEFIIGYMHPGSATGMMMFKVFCYMAVYQGLSFTGDMKLGHYMKVPPRDMFIAQVTAIVVSSFVVLGVQSWVFSNIKNVCTPEAADNFTCNYLIVFGTASQIWGLIGPGAVFSPGKQYGKLLWMFLAGAIFPVIVWALTKKFPRSFIRKVNSPVIFTGTGLMPPATGINFTAWAMCGFVFNYILKKYRTGWWTRYNYVLGAALDTGTAISAVIIFFCLIFPSGKQSDFASDGWWGNTAPYNTADGELASYLTAPETGFAPAPADFRPYMA

SEQ ID NO: 56508 - protein, 322 aa, Colwellia psychrerythraea 34H
MQRLAPALRQDNVPLDLISLIKTILAATKEISFRVSQGHLGDVMGSTLDENIQGEVQKQLDVVANELFKDILLESGFVKAISSEEEDHSVAGDENGKYIVSFDPLDGSSNIDINSLIGTIFSIHEAPKDIAAGDDDMFKQAGDKQVCAGYVLYGPSTMLVMTTGSGTHFYVLDRTHGGFLLVERNVQVPADTQEFAVNMSNQRFWQAPMQNYISDLLAGDTGPREKNFNMRWIAAMVGDIHRVLCRGGIFTYPADSRKPEQPYKLRLMYEANPMAFLLEQAGGLAMTSEGRIMDIEPNSIHQRVEVIMGSKNEVEKCLSYYN

SEQ ID NO: 56509 - protein, 447 aa, Synechococcus sp. WH 5701
MPAPDPAAIGLEARRVAWRVLQAVAAGAYTDLALERELRRSPLAPADRGLATELACGAIRQRALLDGWIDALGKVSAERQPPPLRWLLHLGLYQLLFTARVPASAAVSTTVEIAKRDCLARLAPVVNGLLRACLRRRQPLAPGAAPWEPLPLPSDPAASLALRGSLPPWLAAGLLEWLPPEGAEAFALAANQPPALDLRVNHLRASREGVIEALAAAGVSAEPLPDLPWGLSLGGRSGDLRALPGYDEGHWSVQDRTAQMIAPLLDPQPGERLLDACAAPGGKSTHLAELIGDAGTVVAVDRSEGRLRRLRDNARRLGLNAIEPLTADAAITGAIGGPPFDRILLDAPCSGLGTLARHPDARWRITPASISDLVALQRSLLEAMLPLLVPAGRLVYATCTVHPSENSALIASFLAQHSGWRLLSQQQHWPAPHGGDGFYAAVLQAPG

SEQ ID NO: 56510 - protein, 493 aa, Arabidopsis thaliana
MVSSVSLFASLTPYLVSALLLFLLLEQLFYRLKKRNLPGPLFVFPIIGNVVALIRDPTSFWDKQSAMADTSVGLSVNYLIGKFIIYIKDAELSNKVFSNIRPDAFQLVGHPFGKKLFGDHSLIFMFGENHKSVRRQVAPNFTRKPLSAYSSLQQIVILRHLRQWEESFSSGSRPVSMRQLIRELNLETSQTVFVGPYLDKEVKNTIRDDYNVFNPGTMALPIDLPGFTFGEARRAVSRLVNTMSLCVRKSKEKMAAGENPTCLVDFWTHSIVAESPPPPHSKDEEISCVLVDFLFASQDASTSSLLWAVVLLESEPEVLRRVREDVARFWSPESKESITADQLAEMKYIRAVAREVLRYRPPASMVPHVAVSDFRLTESYTIPKGTIVFPSLFDASFQGFTEPDRFDPDRFSETRQEDEVFKRNFLTFGIGSHQCVGQRYALNHLVLFIAMFSSMFDFKRVRSDGCDEIVHIPTMSPKDGCTVFLSSRLVTSP

SEQ ID NO: 56511 - protein, 342 aa, Xanthomonas axonopodis pv. citri str. 306
MTSIINRRIVLASRPHGEPSADNFRIEEVPVAPTGHDQILVRNRFLSLDPYMRGRMDEGPSYAAPVAIDAVMEGGTVGEVIASNHADYHPGDLLVLPGGWQAHSLLTPTTPLRKLPKDDSLPPSTALGVYGMPGFTAYAGLHEIGKPQPGETLVVAAASGPVGATVAQLARLQGLRVVAIAGGAEKVRYLRDTLHVDVALDHRADDFAEQLRAATPNGIDIYFENVGGKVFDAVLPQLNEFARIPVCGVIATYNSRGQAHPGPDRLPDFMGQVLRKRLTVRGFIQHDFIRLMPAFLREMGQWLREDKIQYREHVLHGLDSAPQGLIDVLRGKNFGKAVVALA

SEQ ID NO: 56512 - protein, 353 aa, uncultured bacterium
IGAANNLLAAMLDNHIQQGNALGIDVKKITWKRCVDMNDRQLRFVVDGLGGKANGTPREDGFDITVASEIMAVFCLASSMKDLKERLGRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVIVGTVRALKMHGGLDKKQLVNEDLAALEKGIPNLLRHVNNIKNVYQLPCVVAINRFPTDTDAEIDFIIRKCRELGVNTVLSTVWAEGGKGGEDLAREVVRLCEKEKGNFTYSYELDASIEEKLEAVTKKIYGGAGVSLTPNAKKQAERLTELGFDKMPV

SEQ ID NO: 56513 - protein, 103 aa, Zea mays
MSGRGKGGKGLGKGGAKRHRKILRDNIQGITKPAIRRLARRGGVKRISGLIYEETRTVLKSFLEGVIRDAVTYTEHAKRKTVTSLDVVYALKRQGRTLYGFGG

SEQ ID NO: 56514 - protein, 426 aa, Methanococcus maripaludis S2
MTQMTDAKSGITTEEMKFVAKEEGMDVETLKNLIAKGYVVIPKNVNRNTKPVGIGDNLRTKVNVNLGTSPDFIDIACELKKVEISNKYGADAIMDLSTGGNLPEIRKEIIKNTNLPIGTVPIYEVGVDAKEKYGRVIDMDEDLIFNVIERQAKEGVDFMTLHCGITKQTVSALNNDPRKMGVVSRGGAFLTAYIMYHDKENPLYKEFDYLLELLKEHDVTLSLGDGMRPGCLQDNTDRAQIQELITLGELVDKCREKGVQVMVEGPGHVPYNNIEANMKIQKTLCKNAPFYVLGPIVTDLAPGYDHITAAIGGTLAAVSGANFLCYVTPAEHVRLMKEDDVKEGLIASKIAAQAADVAKGHPVAWKLEKEMADARIKHDWERQFEIALDSNKPRKMREEIPSKDEKACSVCGDYCALLMVEELGKR

SEQ ID NO: 56515 - protein, 342 aa, uncultured bacterium
NLLAAMLDASIQYGNPLNIDVRNITWKRVVDMNDRQLRFIVDGLGGKTNGTPREDGFDITVASEVMAIFCLATSISDLKARLGRIVVGYTYDGAPVTAHDLKAEGAMAALLKDALKPNLVQTLEGTPAFVHGGPLANIAHGCNSIMATRMALALGDYAVTEAGFGADLGAEKFLDIKCRLAGLKPDAVVVVATVRALKNHGGVAKADLNEENLEALEAGLPNLLQHVENITTIYKLPCVVAINAFPTDTKAELDLVEAKCKELGVNVALSEVWAKGGEGGLALADEVVRLCEEGKGAETFQFCYEDELSLAEKIETIAKRVYRADGVNFEPNALKEIEKSES

SEQ ID NO: 56516 - protein, 378 aa, Flavobacteria bacterium BBFL7
MINSKLPNTSDSIFSIMSRLAHNNNALNLSQGFPSFPVDLELKEHLSNAIEQDHNQYAPMAGLPQLRESISLLMENIHNANYDPNSEICITAGATQAIYTAIQAIINHGDEVIVFTPAYDSYIPAIQMAGGTAVELPMTLPDFKIDWQMVVDHINQNTAMIMINSPHNPSGTMLDHDDMIELERIAEQHDLIVLSDEVYEHITLDENIHLSAARYPELKKRSFITASFGKTFHITGWKTGYCLAPKHLMKEFYKVHQYLVFSINHPTQVAIANYIQNEDRYLRLGTFYQRKRDLFLYAIEDSKFSFSPAQGTYFQLLNYSKITDQGDVAFANRLTIDHKIASIPISVFMNGADPKMLRFCFAKEDHEIIQAAHILNSL

SEQ ID NO: 56517 - protein, 224 aa, Sinorhizobium meliloti 1021
MRIEPVFLFDLDGTLVDSVYQHVLAWKEALDAEGIDLSVWRIHRKIGMSGGLFTDQLLRETNMEISGDRVARLRQRHAEAYRRQADSIRPLPGARELLTWLTDAKISYAIATSGRMETAAVNLAALGVDPAVVPVVTRDVVKYAKPDPDLFLAAAEQLGAPIETAVVVGDSIWDMLAAVRCRALAIGLLSGGYGHEELRQAGAYRIFDDPADMLHHIDEVGGRR

SEQ ID NO: 56518 - protein, 334 aa, uncultured bacterium
IDNHIYQGNELNIDPRKITWRRCVDMNDRQLRFVVDGLGGRVNGTPREDGYDITVASEIMAILCLSNDISDLKNRLSKIIVGYTYGKPAEQKPVTAGELHAEGAMAALLKDALKPNLVQTLEHTPAIVHGGPFANIAHGCNSVTATKMCMNLADYTITEAGFGADLGAEKFLDIKCRIAGLKPNAVVIVCTVRALKYNGGVPKAELGSENLEALKAGLPNLLKHVDNITNVFGLPCVVAVNAFPTDTKAELDLVEAECKKLGVNVKLSEVWAKGGEGGRALAEEVVRLCEQPNNFRYSYELEGSIGDKIRTIATRIYGAKDIVLTSNAVKQAAE

SEQ ID NO: 56519 - protein, 353 aa, uncultured bacterium
IGAANNLLAAMLDNHIQQGSALGIDVKKITWKRCVDMNDRQLRFVVDGLGGRANGTPREDGFDITVASEIMAVFCLASSMSDLKERLSRIIVAYTYDNQPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLANEDLAALERGIPNLLRHVNNITNVYQLPCVVAINRFPTDTDAEIDFIVRKCREMGVNTILSTVWAEGGKGGEDLAREVVRLCEEGKGNFTFSYELDATIEEKLEALTKKIYGGAGVALTPAAKKQAEQLTRLGFDKLPV

SEQ ID NO: 56520 - protein, 454 aa, Cryptococcus neoformans var. neoformans JEC21
MRSKSLVFRVAIYIIPLIISAYLFLPYPNKHSYSIVAMSLSSKLNITDVDLKGERVLIRVDFNVPMDKEGKITNPARIVAALPTIKYAIDNGAKSVILMSHLGRPDGSPNPKYSLKPVASKLSELLSKDVKFLPECVGDEVKSEVLKGENGQVFLLENLRFHIEEEGKGKKGDEKVKADPAAVKKFREQLTELGTVYINDAFGTAHRAHSSMVGVQLPKRAAGFLMKKELEYFAKVLEKPERPFLAILGGAKVADKIQLIENMLDQVNTLIICGGMSFTFKKTLDNVEIGTSLFDEAGSKQVKDLVEKAKKNNVKLVFPVDYVTADKFDKDAKTGSATDESGIPSDWMGLDCGPKSRELFAQTVAEAKTILWNGPAGVFEFPAFASGSNALLEACIKAAKNGSTVIVGGGDTATLVAQAGKEDELSHVSTGGGASLELLEGKTLPGVAELSEKK

SEQ ID NO: 56521 - protein, 119 aa, Xanthomonas axonopodis pv. citri str. 306
MAAASSGGGMSTLSTHVLDTASGRPAAGVPLRLFAGDTLHFEGVTNHDGRCPDLAALALQPGRYRLEFDLARYWQATGMALADPPFLDRIPIAFGIADDGHYHVPLLLSPYGYSTYRGS

SEQ ID NO: 56522 - protein, 351 aa, uncultured bacterium
ITTAHNLLAAVLDNHIQQGNALNIDVRRVVWKRVLDLNDRALRHVVIGLGGKAHGVPRETGFDITVASEMMAILCLSSSLTDMKRRLGEIVVAYTTDGRAVRAKELNVTGALTLLFKDAIKPNLVQTLGGTPAFVHGGPFANIAHGCNSVMATKYALKLAEVVVTEAGFGADLGAEKFLDIKCRFAGFSPDAVVIVATVRALKMHGGVPKSDLSRVDMGALEKGMENLLKHIETIHAFGLPAVVAVNAFPTDTAEELSFVEKKCAELGAEVAVSEVWAKGGEGGLALAKKVEAAMAKPKNFHTLYESDAPIAEKIETVARTVYGADGVTFTSAAKKQLDEIEALGLDKMPV

SEQ ID NO: 56523 - protein, 417 aa, Cryptococcus neoformans var. neoformans JEC21
MSLSSKLNITDVDLKGERVLIRVDFNVPMDKEGKITNPARIVAALPTIKYAIDNGAKSVILMSHLGRPDGSPNPKYSLKPVASKLSELLSKDVKFLPECVGDEVKSEVLKGENGQVFLLENLRFHIEEEGKGKKGDEKVKADPAAVKKFREQLTELGTVYINDAFGTAHRAHSSMVGVQLPKRAAGFLMKKELEYFAKVLEKPERPFLAILGGAKVADKIQLIENMLDQVNTLIICGGMSFTFKKTLDNVEIGTSLFDEAGSKQVKDLVEKAKKNNVKLVFPVDYVTADKFDKDAKTGSATDESGIPSDWMGLDCGPKSRELFAQTVAEAKTILWNGPAGVFEFPAFASGSNALLEACIKAAKNGSTVIVGGGDTATLVAQAGKEDELSHVSTGGGASLELLEGKTLPGVAELSEKK

SEQ ID NO: 56524 - protein, 352 aa, Arabidopsis thaliana
MWRFCFFISLLFFDVSAVKSAESIFLPSQIGVEDSRVFESLSLSPVCSAADPNLNYKPVIGILTHPGEGRWDARLHSLKNYAYATNISYIAASYVKLAETGGARVIPLIYNEPEEILFQKLELVNGVIFTGGWAKTGLYYDVVEKIFNKVMEKNDAGEHFPVYAMCLGFEILSMIISQNRDILERFNSVNYASSLQFFKNVNIEATVFQRFPPELLKKLSADCLVMQNHYFGISPDNFQGNPYLSSFFNIVTTSADKDSKTFVSTIRSKRYPVTAFQWHPEKNAFEWGSSEIPHSEDAIQVTQHAANYLVSEARKSMNRPSSEKVLSNLIYNYKPTYSGYKGSGDDEVYIFT

SEQ ID NO: 56525 - protein, 109 aa, Chlamydomonas reinhardtii
MGGRIIQVKSAEEWTSHMRECRAFGGKSYLVDFTASWCGPCQKIAPLYEKYSAENPNITFLKVDVDELADVAGECDVKAMPTFIGYFNGEQVDTVVGADDAKLRELIAT

SEQ ID NO: 56526 - protein, 426 aa, Methanococcoides burtonii DSM 6242
MTETIDDEPRSNNYSFSGIGNGELVSKSDEDFSKYLLDRMKQLESRNNLLKEQYDQMESDKRYIESQKLKYERETHRLQSEIERLKSPPLVVASVVDIFDDDKALIRSSTGPQFLVNVSQDFEDDDLLVPGARVGLNQQTLAVVDIIPESDEPLITAMEVIDSQEVDYSQVGGLDQQIREISESVELPITKPEAFKRIGITPPKGVLLFGPPGTGKTLLAKAVAHRTNATFIRVVGSELVQKYIGDGAKLVRDIFEMARKKAPAIIFIDELDAIAATRLGDTNGADREVQRTLMQLLAEMDGFDNRGDVRIIAATNRPDVLDPAIVRPGRFDRIIEIPLPDQDGRETIFLIHMDMLNIGSDVDVKKLASLTEGASGADIGAIVMEAGMLAVRNDSDHIGMSDLLDAVTKVMVPKENNLDHSENMFW

SEQ ID NO: 56527 - protein, 566 aa, Aspergillus oryzae
MAGIFEQPRNADTLFLGGQKITGPDVREQNVLATQAIANVVKSSFGPSGLDKMMVDDIGDVTVTNDGATILSLLDIEHPAGKILVDLAQQQDKEVGDGTTSVVLIAAELLRRGNELMKNRIHPTTIINGYRLALREAVKYMNENITTKVETLGKDSLVNIAKTSMSSKIIGSDADFFANMVVDAMLLVKTTNQRNEVKYPVKAVNLLKAHGKSGTESMLVNGYALNCTVASQAMKTRITDAKIACLDMNLQKERMKLGVQITVDDPDQLEKIREREAGIVIERVEMILKSGANVIFTTKGIDDMVLKLFVERGAMAVRRCKKEDLRRIAKASGATLVSTLSDLNGDEKFEASYLGHAEEVVQERISDDECILVKGTKVHTSASIILRGANDFSLDEMERSVHDSLCAVKRTLESGSIVPGGGAVETALHIYLEEFAVTVGSREQLAIGEFAQSLLIVPKTLAVNAAKDSSELVAQLRVRHALSQRVQDGDANEEEKAIAKKKTYRNYGLDLTKGRVHDTLKAGVLEPSMGKIKQLKSAVEACIAIMRIDTMIKLDPEVKEDDGHGH

SEQ ID NO: 56528 - protein, 351 aa, uncultured rumen bacterium
ITTAHNLLAAVIDNHIQQGNALDLDVRRIAWKRVVDLNDRALRHVVIGMGGKAHGVPRETGFDITVASEMMAILCLATNLEDMKKRLGRIVVAYTRDGRAVRADELNVTGALTLLFKDAIKPNLVQTLEGTPALIHGGPFANIAHGCNSVMATKFALKFADIVVTEAGFGADLGAEKFLDIKCRFAGLKPSAVVIVATVRALKMHGGLPKTELAKVDMTALEKGLENLIKHIETVKAFGLPAVVAINAFPTDTKEELDFVEKKCNEFGAEVALLEVWAKGGEGGIALAEKVLAATEKPNNFNFTYEVEQSIPEKIEAIVKRVYGGDGVVFTGPAQKQLEEIEALGLDKMPV

SEQ ID NO: 56529 - protein, 554 aa, Silicibacter pomeroyi DSS-3
MYRYSEFDTAFLAERNAQFRAQVERRIDGSLTEDEFKPLRLMNGLYLQLHAYMLRVAIPYGTLNAAQMRQLALLAEKWDKGYGHFTTRQNIQYNWPKLRDVPDMLDALAEVGLHAIQTSGNTIRNVTADHFAGAAADEVADPRPYAELLRQWSTDHPEFQFMPRKFKIAITGSANDRAVIKAHDIGLQLVVRDGVLGARVIVGGGLGRTPMIGQELSPFVAFDDLLAYLEATVSVWNQIGRRDNKYKARIKITVFEHGIEAIRARVNERFVKVRGRFKGADMALLDEIKGHFAPPSWRTSSLAPFEAAYAKDPVFRSWVDTNIAAHKQADHAIVTISLKAHGATPGDATAEQMRVMADLAERYGYDELRISHEQNVILPHVHKSDLPAIHAELAANGLGTANIGLISDIIACPGMDYCALATARSIPVAQEIATRFEELKLEHEIGALKIKISGCINACGHHHVGHIGILGLDRAGVENYQITLGGDATETAAIGERTGPGFAYDQIVPAVERIVETYLDQRRDREESFIETYRRVGMAPFKAALYPEARADAA

SEQ ID NO: 56530 - protein, 352 aa, uncultured rumen bacterium
IGAANNLLAAMLDNHIQQGNALGIDPRSITWKRAVDMNDRQLRFIVDGLGGKANGTPREDGFDITVASEVMAVLCLADGIMDLKARLSRIVVGYTYDNRPVTAGDLKAAGAMAALLKDALKPNLVQTLEHTPALVHGGPFANIAHGCNSVTATKLALKLGDYCVTEAGFGADLGAEKFFDIKCRMAGLKPDAAVVVATIRALKHHGGASKDQLTSENLAALEKGLPNLLQHVSNVKNTFGLPAVVAINRFPQDTEAEIALLEEKCHELGVNVVLSEVWAKGGEGGEDLAREVVRLCEQPNDFHFAYEADETILEKLTHIVQRVYHGNGVELTPGALKQMKRLEELGFGVMPA

SEQ ID NO: 56531 - protein, 142 aa, Oryza sativa (japonica cultivar-group)
MASLVAVQPVAVKGLAGSSISGRKLAVRPSPRALCRTTRRPRAAVVAKYGEKSVYFDLEDIGNTTGQWDLYGSDAPSPYNPLQSKFFETFAGPFTKRGLLLKFLLLGGGSLVAYVSASASPDLLPIKKGPQLPPTPGPRGKI

SEQ ID NO: 56532 - protein, 408 aa, Gibberella zeae PH-1
MMRPMLARSALRSARLSSFRPLCQAQRFSIKAEAASSAQHMGLDASKLTIQKTGNHKTLSKPETLVFGKEFTDHMLAIEWNQDKGWLEPKITPYQNLSLDPATCVFHYAFECFEGMKAYKDKNGKVRLFRPDMNMARLNKSAARIALPTFEPAEFAQLISKLVNLDSRFIPDQRGYSLYLRPTMIGTQKTLGVGPPGSALLYCIASPVGPYYPTGFKAVSLEATDYAVRAWPGGVGDKKLGANYAPCILPQLQAASRGFQQNLWLFGEEEFVTEVGTMNMFVALKNKETGQKELITAPLDGTILEGVTRDSVLALARERLIPQGWKITERKYTMKELAEAADEGRLLEAFGTGTAAIVSPVRSISWKGKLVDCGLSEVEESGEIALQMKNWIEAIQYGDEEHEWSYTI

SEQ ID NO: 56533 - protein, 713 aa, delta proteobacterium MLMS-1
MKATNIKKSALALTIIALAGAFFWFDLHHWLTLENIRGFQEQARDFYAQRPLSAVAAFAGVYLLVVALNLPGGALLGLLAGAVFGVLVGTVVVSFASTIAATVACALSRYLFRDLVRARFPQVLTSVDKGMAREGAFYLFSLRLIPAVPFFVINMVMGLTAIPLRTFYWVSQLGMLPGTLVFVNAGGELGRLTSTGDIFSFRLLLAFALLGILPWAANRLLGWYRKRVNKQPHPIFGQAARLTEGTDFKSVPDYAVPGCKTSPGARLFVYSPLNQQVIAPGERLRKRSGQGGKNEGDGARQPTAPPPLVEQAASLASHCTRCGACAARCAFLQEYGLPGDIAAAWAAGSGKVDPFACSLCNLCAAVCPEQLEPGNFLLQLRRRAATAANFDLRPYRPLLSYERLGGSWLFATRRLPAGCRTVFFPGCSLPGTRPQSTRRLIHRLRELVPNLGLVLDCCHKPSHDLGRQEYFTERFAALRQSLQQKEVEEILVACPNCYKVFTQYGGRLRVKSVWELLAAELPGADRQPAERRPEAGGPQTNRGERARSNVHRPLNQHPAGPGEWLANSRGARPVETAAARVTIHDPCPLRHLPELQRAVRRLALSHGLEVMEMKSSGRRTICCGEGGAVARVRPGLAADWGRLRQKQADGLPVLTYCAGCAGFLKRAGMTTIHLADLLADPAAALNGTAPVASGPRTYINRLLLRWRKDPAGS

SEQ ID NO: 56534 - protein, 355 aa, uncultured bacterium
IGAANNLIAAMLDNHIYQGNSLGIDNRRIIWRRCVDMNDRQLRNIVNGMGGPTQGVVREDGFDITVASEIMALFCLASDVDDLKARIAKIIVAYTRDGKPVTAGDLKAEGACAALLKDALKPNLVQSLEGTPAFIHGGPFANIAHGCNTVMATKLALKMAGKDGYVITEGGFGGDLGAEKFLDIKCRIAGLKPECVVIVATVRALKMHGGMPKDKLTEVDLAALEKGLANLTQHIENMKKFGLPAVVAINAFPLDTDEELALVEKKVKEYGANVVLSKVWANGGEGGSDLATEVVRIVKEGKADFKPIYDEKKTIAEKIETIAKEIYRADGVDFTLDAQKQIKVLEELGLDRVPI

SEQ ID NO: 56535 - protein, 352 aa, uncultured bacterium
IGAANNPLAAMLDNHIQQGNELNIDPRRITWKRAVDMNDRQLRNIIDGLGNRTDGTPRQDGFDITVASEVMAVLCLSADISDLKERLSRIVVGYTYDNEPVTAGQLKAQGAMAALLKDALKPNLVQTLEGTPAFIHGGPFANIAHGCNSVTATRMALKLGDYAVTEAGFGADLGAEKFLDIKCRMAGLKPDAVVIVATVRALKHRGGAAKDQLKEENLEALEKGLPNLLQHVDNIKNVFRLPCVVAINRFPTDSEAELKLIEDRCRELGVNVALSEVWSKGGEGGKTLAEEVVRLCDEPNDFTFAYDLNLPIKEKLLAIAQKIYHADGIHLPGNVPKQIKQLEDLGFGNLPI

SEQ ID NO: 56536 - protein, 352 aa, uncultured bacterium
IGAANNLLAAMIDNHIQQGNELDIDPRRITWRRAVDMNDRQLRNIIDGLGNRSDGTPRQGGFDITVASEVMAVLCLSNDISDLKERLGKIIIGYTYDNRPVSVRQLKAQGAMAALLKDALKPNLVQTLEGTPAFVHGGPFANIAHGCNSLIATRLAMKLGDYCVTEAGFGADLGAEKFLDIKCRLGNLKPDAVVIVATVRALKHHGGVGKDLLKQEDLEALKKGLPNLLQHVDNIRNVFRLPCVVAINRFPGDTEAELKLIEDECRKLGVNVALSEVFAKGSQGGIDLAKQVIALCEQPNDFTFAYDLDLPIKEKLETIAKRIYHAKGIHLPGNVPKQIKQLEELGFSNLPI

SEQ ID NO: 56537 - protein, 1562 aa, Oryza sativa
  misc_feature (338)..(338): Xaa can be any naturally occurring amino acid
  misc_feature (349)..(349): Xaa can be any naturally occurring amino acid
  misc_feature (1350)..(1350): Xaa can be any naturally occurring amino acid
  misc_feature (1393)..(1393): Xaa can be any naturally occurring amino acid
  unsure (1)..(1562): unsure at all Xaa locations
MAAASRARRWSLAGKTALVTGGTKGIGRAIVEELAGFGVRVHTCSRHDADLQDCLRRWNAAGEGGGAAALVTGSVCDVSVRGDREALVAAARAALGGRLDMLVNNAGQVVVGPAAETAPEEYARLMATNLESCFHLAQLAHHLLRDAAAGGGAAASVVNISSTAAFYAAPHLAVYSATKGGMNQLTRCLAAEWARDGVRVNAVAPGATRTDICDTSGVALGEKTRRRLADAGAMDRVPIRRIGEPEEVAAAVVFLCMPAASYITGQAQGLWGAVEPEGDDLVDYRQDRQALAAILRAVPAEMLATLAVKETAQEAWEAIKTRRIGVQRVREANAQQLXREFGDILFKDXVPEHLQQIAISIETLLDVNELSLEEVTGRLRSVEQRKQRKTAAASSRVDANGRLLFTEEEWLAKFRKAASLQDAAHSSGGNGDRRGRGRGKKDDGAPKEAQPKPANPGGRNLGNCKNCGKRGHWAKDCRSKPKAQQAYVAQEEDEEPALLLAKVQLDPPRPRVAAPTNVVSPPSAPRALSPMGELAVVEAKVFAQLDGGGEHDPAMWILDTGATNHMTGSRSAFAELDTAVTGTVRFGDGSVVRIEGRGTILFSCRFGEHRGIAGVYYIPRLTANIVSLGQLDRSGSKVLIHHGVLRVWDPRGHLLVRVRRSDDCLYTIKLDIDRPVCLAARSAEPAWRWHARYDHLNFPTLRKLAQQEMVRGLPLLQQVTQVCDGCLLRKQRRAAFPTQSKYRADEHLELVHGDLCGPIEPATPAGNRYFLLLVDDMSRYMWLTLIRSKDESANAIKHFQARAEVESGRKLRALRTDRGGEFTSIEFGEYCANLGVGRQLTAPYSPQQNGVVERRNQTIIATARSMMKAKGVPGRFWGEAMSTAVFLLNRSPTKSLDNQTPYEAWYGQRPAVHFLRTFGCVGHVKITKPGLKKLDDRSAPMVLLGYEQGSKAYRLYDPVSERVHVSRDVVFDEDAAWDWGPVVTTTIGTAPASSPTPPSPPSPAPSAPTTPAPPSPPSPEAVEFVTPPTQDSILDVDADDDVVPRYRLVDNLLGNASPPGHAPRVLEQLELHVVSANEPASLAEAEADPNWRGAMQDELNAIVDNDTWSLTDLPHGHRAIGLKWVYKLKRDEQGAIVRYKARLVAKGYVQRQGVDFDEVFAPVARLESVRLLLVVAVHQGWQVHHMDVKSAFLNGELLEEVYVSQPPGFVDDNHKNKVYRLHKALYGLRQAPRAWNAKFDSSLLSLGFHRSSSEHGVYTRTRGGRRLTVGVYVDDLIITGDHDDEIRSFKGEMMKLFKMSDLGALRYYLGIEVTQDSDGITLGQAAYASKILEKAGLKDCNPCQTPMELXVGSLRYLVNTRPDLAFSVGYVSRFMESPREDHLAVVRRILRYXGARCALPMLVGYSESDLAGDPDERKSTSGQIFFINGGPVTWQSSKQKVVALSSCEAEYIAAAAATCQGVWLARLLAEVLGDEIATPLLKVDNQSTISLIKNPVHHDRSKHIDVKYHYIRECAEKKLIEMMFVGTAEQLGDIFTKSLGRTRFQELRSKIGVCSLDKSSQT

SEQ ID NO: 56538 - protein, 449 aa, Oryza sativa (japonica cultivar-group)
MATRSQNVAAAPQPPQNRGNVAALGKQKAVVAGRPDAKNRRALGEIGNVMNVRLPEGKPLQQAPAGRTANFGAQLLKNAQANAAANKQNAVAPAAVARPAQRQARKAPVKPAPPPPEHVIEISSDSDQSMRQQSEGSASSVRKCSRKKVINTLTSVLTARSKVACGITDKPREVIEDIDKLDGDNELAVVDYIEDIYKFYKVAENECRPCDYIDTQVEINSKMRAILADWIIEVHHKFELMPETLYLSMYVIDRYLSMQQVQRRELQLVGVSAMLIACKYEEIWAPEVNDFILISDSAYTREQILAMEKGILNKLQWNLTVPTAYVFIMRYLKAGASADNKSDKEMEHMAFFFAELALMQYGLVASLPSKVAASAVYAARLTLKKSPLWTDTLKHHTGFTESQLLDSAKLLVTSHSTAPESKLRVVYKKYSSEQLGGVALRSPAVELCK

SEQ ID NO: 56539 - protein, 890 aa, Magnetospirillum magnetotacticum MS-1
MYSFGGGKAEGRADMKNLLGGKGANLAEMSNLGIPVPPGFTISTEVCTYYYGNGETYPPSLKDEVMAALAQVEGDIGLKFGSTADPLLVSVRSGARASMPGMMDTILNLGLNDKSVEGLAKRSNDARFAYDSYRRFIQMYSNVVLGVDHHNFEEILDEVKEDKGVSLDTELDADDLKKVVAKYKDKVAEQLGKPFPQDVHEQLWGAVGAVFGSWMNQRAITYRRLHDIPAEWGTAVNVQSMVFGNMGSDCSTGVCFTRNPSTGENAFYGEFLVNAQGEDVVAGIRTPQQLTIAGKNAQSSDLPAMEECMPEVFKELNAIRHKLEAHYKDMQDMEFTVQQNRLWMLQTRTGKRTTNAALKIAVDMAREGLISRKDAIKRIDPASLDQLLHPTLDPKAPRKILGRGLPASPGAASGKVVFSADEAEDWVKNRKERVILVRIETSPEDIGGMHVSEGILTTRGGMTSHAAVVARGMGTPCVAGAGEIRVDYAAKTLKVAGQVVKEGETITLDGSTGEVFIGAVATIQPELTGDFGTLMEWVDTIRTLKVRANAETPLDAATARKFGAEGIGLCRTEHMFFDPKRIIAMREMILAETEKGRRAALAKLLPYQRQDFIELFEIMQGLPVTIRLLDPPLHEFLPNSEAEIAEVAKEAGVEPSVVKARNAALHENNPMLGHRGCRLGITYPEIYEMQARAIFEAAVHVSRDTGRTVVPEIMIPLVGAKRELDLMKASIDKEAEAVFAEQKYSVHYMVGTMIELPRAALLAGDIAQTGEFFSFGTNDLTQTTFGMSRDDSGPFLEVYRAKGIYEHDPFASLDQAGVGELIKIAAERGRATRPGLKLGICGEHGGDPASIHFCQGAGLDYVSCSPYRVPIARLAAAQAALGGSSSSGTA

SEQ ID NO: 56540 - protein, 355 aa, uncultured bacterium
IGAANNLLAAMIDAHIQAGNELNIDPRKITWRRAVDMNDRQLRNIVDGLGGKPHGTPREDGFDITVASEVMAIFCLATSISDLKARLGRIVIGYTYDDKPVTAGELKAAGAMAALLKDALKPNLVQTLEGTPAFIHGGPFANIAHGCNSIMATKMALNFGDYAITEAGFGADLGAEKFLDIKCRLAGLKPNAVVIVATVRALKNHGGVPKAELNNENLEALEAGLPNLLQHVENITNVYKLPCVVAINAFPTDNEAELKLVEDKCKELGVNAVLATHWANGGDGAIELAKEVVRLCEEGTGAEDFEFCYADELSLREKIEAIATRIYRADGVLFAGNAEKQLNQLEDLGFANMPV

SEQ ID NO: 56541 - protein, 338 aa, uncultured bacterium
CNNLLAAMLDASIQYGNPLNIDVRNITWKRVVDMNDRQLRFIVDGLGGKTNGTPREDGFDITVASEVMAIFCLATSISDLKARLGRIVVGYTYDGAPVTAHDLKAEGAMAALLKDALKPDLVQTLEGTPAFVHGGPFANIAHGCNSIMATRMALALGDYAVTEAGFGADLGAEKFLDIKCRLAGLKPDAVVVVATVRALKNHGGVAKADLNEENLEALEAGLPNLLQHVENITTIYKLPCVVAINAFPTDTKAELDLVEAKCKELGVNVALSEVWAKGGEGGLALADEVVRLCEEGKGAETFQFCYEDELSLAEKIETIAKRVYRADGVNFEPNALKE

SEQ ID NO: 56542 - protein, 122 aa, Oryza sativa
FCFLLVLYQLICLSDLEFDYINPYDSSSRINSVVLIEYALQGALCASFLLTLHWFPFLVMAPVAYYHGKLYMDRKHLVDVTEIFRQLNWEKKYRMIKLAFYFSLFIITIYRFDFSSFFIHHF

SEQ ID NO: 56543 - protein, 343 aa, Ipomoea purpurea
MVNSTQGSNLRSENSVTYESPYPIFAMAVSSFAASHHGLRRRSVAVGSFLEEYNNRVEILSFEEDTVTLKTNPGLAFDHPYPPTKLMFHPNPTASMKSADLLVSSGDYLRLWEVREASIEPVSTLNNSKTSEYCAPLTSFDWNEVEPRRIGTSSIDTTCTIWDIEKGVVETQLIAHDKEVYDIAWGEAGVFSSVSADGSVRIFDLRDKEHSTIIYESPQPDTPLLRLAWNKQDLRYMATILMDSNKVVILDIRSPAMPVAELERHNASVNAIAWAPQSSRHISSAGDDGQALIWELPTVAGPNGIDPMSMYSAGAEINQLQWSAAQPDWIAIAFSNKLQMLKV

SEQ ID NO: 56544 - protein, 338 aa, Rhizobium leguminosarum bv. viciae 3841
MGVVIPLEESKNKLASIKPLVDLTRADMERVNQLILSKAGSDVQMIPEVANHLISSGGKRLRPMLTLASASLFDYRGENHIKLATSVEFMHTATLLHDDVVDESDLRRGKSTARMIWGNQASVLVGDFLLGQAFRMMVDVGSLDALDVLSSAACVIAEGEVLQLSVAKNMETTEDDYLSVIRAKTAALFAAAAEVGPIVAEVGRSGRNALKSYGMNLGLAFQLVDDALDYGGKAADLGKNVGDDFREGKITLPVILAYRRGTEDERAFWRDAIEAGNSTDANLEKALGLITKYGTLSDTIGRAIHYGTIARDALAPLPDTVWKSALMEVIDFCIERVN

SEQ ID NO: 56545 - protein, 446 aa, Rhizobium leguminosarum bv. viciae 3841
MDVLNPNPKSGWRHERGEASLSDVYRTVGTGRHSSAWRRAAAFAGPGYMVAVGYMDPGNWATSLAGGSKFGYALLTVALLSNLMAIVLQSLCARLAIASGRDLAQACRDAFPKYVSLPLWAFAEIAIIATDIAEVIGTAIGLNLLMGIPLELGVLITALDVFVILFLQKLGFRWVEAFIIALLGVIAVCFGVQILLADPQWGAVLTGFFPTTEIVTNPEMLYLALGILGATVMPHNLYLHSGIVQTRAYGHTIPEKREALTFATIDSTVALCFALLINASILILAAAAFNAHGKTDVVELGDAYSLLSPLLGLAIAPTLFGIALLCCGLNSTVTATLAGQIVMEGFLKIRLKPWVRRLITRAIAIVPAAIVTIWYGDKGTAELLILTQVVLSLQLSFAVFPLVMFTANKAKMGELVAPRWLSGVAYLIAVVIAGLNVKLLLDFVTG

SEQ ID NO: 56546 - protein, 443 aa, Zea mays
MEWASAAYTAAALVCAAAACVVALAHIYRHLLHYAEPIYQRFIVRIIFMVPAATAMELKYKYSVESFAGAYDSDQKVYAVMSFLSLILPNNAIYFNSIREIYDAWVIYNFLSLCFGMGGRSWCCGAIPLDGRFIRRCKQGCLQFVILKPILVVITFILYAKGKYKDGNFSVNQSYLYITIIYTISYSMALYALALFYAACRDLLRPYNPVPKFIMIKSVVFLTYWQGVLVFLAAKSRFIKNADKAADLQNFVLCVEMLIAAVGHLFAFPYKEYTGPNARPSRGFRESLLHALKFNDFYHDTVHQFAPTYNEYVLYNHNEGDSAQTKYPSGSTATSGQGVELAGITVAASNSPVSSSVSSNQADQEETMTTPIKDKVDPPGGLYDLTELLDIDLSSYPAKLPGTTDVDSEQLGVPERAAAADDDERGGGGVGQQGAEELRRRRV

SEQ ID NO: 56547 - protein, 257 aa, Oryza sativa
MAANFWTSSHCKQLLDQEDVDKVPQADSDRGITLEEFRLVKIHMSFHIWRLAQQVKVRQRVIATAVTYFRRVYTRKSMTEYDPRLVAPTCLYLASKVEESTVQARLLVFYIKKMCASDEKYRFEIKDILEMEMKLLEALDYYLVVYHPYRPLLQLLQDAGITDLTQFAWGIVNDTYKMDLILIHPPYMIALACIYIASVLKDKDITLWFEELRVDMNIVKNISMEILDFYDTYKIDPQRGLPEDKIAPVMNKLPSKA

SEQ ID NO: 56548 - protein, 267 aa, Bordetella pertussis Tohama I
MCLAVLALHAIPGLPVLIAANRDEFHARPTAEATRWPGSPSIYAGRDLQAGGTWMGVSDHGRYAVVTNFRDPRNIQPDAPSRGALVEAFLRGAASAQEYLHDVHARGARYNGFNLIVGDAGGAWYCSNRDGAPRRLAAGVYALSNHLLDTPWPKLARTKAAFERIIAAAPQPDLAALYAALADPTPAADHELPATGLALERERLLSSPFIVSPDYGTRSACILALHDDGRGELHERRFRPDGAIAGQTDLDFPWRAAHAELHRASCV

SEQ ID NO: 56549 - protein, 352 aa, uncultured rumen bacterium
ITSANNLLAALLDNHIQQGNELRIDLKSINWKRCEDMNDRQLRNIVIGMGRKTDGVVREDHFVITVASEIMAILCLADDMDDLKARLARIIVAYDVDGNPVTADMLHATGSMAALLKDAIKPNIIQTLEHNMAIVHGGPFANIAHGCNSVQATRFALKLGDIAVTEAGFGADLGAEKFFDIKCQMAGFKPDAVVLVATVRALKYNGGVPKAELSTENLDALRKGIVNLEKHIENLQTYGVPVVVAINQFASDTEAELNFIEDFCRNKGADFALSKVHGEGGKGGVELANAVIRTLETKESLFAPVQNLSESLYDKINSVAINIYGADGVDFEPKAKKALDKLTELGFGNVPV

SEQ ID NO: 56550 - protein, 527 aa, Oryza sativa
MATLLSKLLALPQQWQLLLLLLLLPIASLLLVIGRNTGGRRRRRHLRLPPGPARLPVLGNLLQLGALPHRSLRDLARRHGPVMMLRLGAVPAVVVSSPEAAQEVLRTHDADCCSRPSSPGPMRLSYGYKDVAFAPYDAYGRAARRLFVAELFSAPRVQAAWRARQDQVEKLIGKLTRPEPEPVELNDHIFALTDGIIGAVAFGSIYGTERFAGGGRKRFHHLLDDVMDMLASFSAEDFFPNAAAARLFETPHGLVAHRERVFQQLDAFFEMVIEQHLDSDSSNAGGGGGNLVGALIGLWKQGKQYGDRRFTRENVKAIIFDAFIGGIGTSSVTILWAMAELMRSPRVMRKVQAEIRATVGDRDGGGMVQPDDLPRLAYLKMVVKETLRLHPPATLLMPRETMRDVRIGGYEVAARTPVILNVRAIGRDAARWEEAEVFDPDRFEAKRVEFNGGHFELLPFGSGRRICPGIAMGAANVEFTLANLLHCFDWALPVGMAPEELSMEESGGLVLHRKAPLVLVPTRYIQL

SEQ ID NO: 56551 - protein, 352 aa, uncultured rumen bacterium
ITSANNLLAAMLDNHIQQGNSLGIDPRQIVWKRCLDMNDRVLRNIVVGLGSKMDGMVREDHFVITVASEIMAILCLADDMHDLKKRLGRIIVAYSFDGKPVTADDLQATGAMAALLKDALKPNLIQTLEHTPAIVHGGPFANIAHGCNSVRATKAAMKLADITITEAGFGADLGAEKFFDIKCRMAGLTPDAVVLVATIRALKYNGGVPKAELTTENLDALKKGIVNLEKHIGNLQKYGVPVVVTLNSFVTDTQAETDFVRNFCQERGCEFALSEVWEKGGQGGVELAEKVLYVLENKESNFKPLYEDSLSLTDKIKTVATEIYGADDVTYSAAALKELKRIEELGMGDFPV

SEQ ID NO: 56552 - protein, 481 aa, Prochlorococcus marinus subsp. marinus str. CCMP1375
MPERFSQQRQRVRPNSNEEAVVKRAQEHFERSLIKINGHLAGSVAALEHPANNDALNYGEIFLRDNVPVMIYLLTQKRYDIVKKFLTVCLDLQSTSYQTRGVFPTSFVEEKDELIADYGQRSIGRITSADASLWWPILCWLYVRKSKDTTFGISQKVQRGIQLLLDLVLHPTFEGTPVLFVPDCSFMIDRPMDVWGAPLEVEVLLYASLSSCIELMDLSSKHQVSRLLDQRLLLTRQWVHDLRQFLLKHYWVTSKTMQVLRRRPTEQYGEDQHQNEFNVQPQIVPSWLQDWLENRGGYLIGNIRTGRPDFRFYSLGNSLACMFGVLTAPQQRALFRLVLHNRQHLMAQMPMRICHPPMEVEEWQNKTGSDPKNWPWSYHNGGHWPSILWFFGASILLHEQRYPKADVLLMGQMRSLLEECYWSQLNQLPKQKWAEYFDGPTGTWVGQQSRTYQTWTIVGFLLMHHFLKTSPEDVSMLDLNQ

SEQ ID NO: 56553 - protein, 98 aa, Zea mays
  misc_feature (55)..(55): Xaa can be any naturally occurring amino acid
  misc_feature (70)..(70): Xaa can be any naturally occurring amino acid
  unsure (1)..(98): unsure at all Xaa locations
KGGQGLGKVGSKRHRKVLHDNIQGITKPAIRRLARRVGVKRISGLIYENTRGVLXIFLETVIRNAVTNSXHARCKPVTAMEVVYALKREARTLSVFGG

SEQ ID NO: 56554 - protein, 564 aa, Bacillus halodurans C-125
MVDVENREWFNAYPKEVPHTIDYPNQTLHDLIKEAATTYPHHVALHFLGKTMTYQLFYEQVQRFAANLQQLGLQKGERVSIMLPNCPQAVIAYYGVLVAGGVVVQTNPLYVERELNHQLIDSGARFIVCLDVLYPRVIKSREGAPLEHVIVTAIKDYLPFPKNMIYPFIQKPKPKGKIGYGSHVHRFVPMAQSGSTNPTPVRIDPKEDLALLQYTGGTTGVAKGVMLTHYNLVANTIQCRKWMYKWRDGQERTLAVLPFFHVYGMTTSMNLTLMTGSELHIVPRFDPLQVLKMIDKKKITMFPGAPTMYIALINHPDLKKYDLSSIEACISGSSSLPAEVQQTFEQLTGGRLVEGYGLTEASPVTNCNLVWGERKDQSIGVPWPDTDVHIRSLETGESLPSGEIGEVVVRGPQVMKGYWNRPEETNATLQNGWLYTGDMGYKDEEGYFYIVDRKKDMIIAGGFNIYPREVEEVLYAHAKVQEAVVIGVPDEYRGETVKAFIVVKEGESVSEKELNDYCRTHLAAYKVPRKYEFRDDLPKTMVGKVLKRVLIEEETKKQGIKQSS

SEQ ID NO: 56555 - protein, 352 aa, uncultured bacterium
ITSAHMLLSAMLDNSIQQGNPLNIDPRRIIWKRVVDMNDRALRNIVIGLGGKAHGVPREDGFDITVASEVMAILCLASNLHDLKERLKRIVVAYNYDGKPVTAEDLHAAGAMAALLKDAVKPNLVQTLEHVPAIIHGGPFANIAHGCNSVMATRTALRLADFTITEAGFGADLGAEKFFDIKCRQAGLAPDACVLVATVRALKMHGGVAKADLKEPNVEAVKKGLPNLGKHIENIFKFGVPVVVAINIFAQDTKEELQAVYDFCAGMGVNVALSDVFAKGGEGGVELAKEVVALAESGMARFKPIYPLEMSLREKVATIVKEVYGGDRVEFQTKAAQALDQYEKEGYGNLPV

SEQ ID NO: 56556 - protein, 222 aa, Oryza sativa
  misc_feature (106)..(106): Xaa can be any naturally occurring amino acid
  unsure (1)..(222): unsure at all Xaa locations
MMMETELCSSRVLSPPRYESGDEELSVLPRHTKVIVTGNNRTKSVLVGLQGVVKKAVGLGGWHWLVLKNGVEVKLQRNALSVLEPPTGNEDDDDIDGNNSFCSSSXDMGDKDMDYSSIEYHKPTKPRVRHTRPWSSCIKSSNRGNFHPSTKLRTRVNLTKLGTPTLWRYWKHFNLVSMNPNPSKEQLFHGVQQHFQSQQLDELQVILGFIQAAKRLKTLYRS

SEQ ID NO: 56557 - protein, 566 aa, Bacillus halodurans C-125
MTIDRVWLKSYPKEIPHSIDYEERTLQSYLKQAAEEFPSHIAVQFLGKEMTYRELYEQAKQFGNQLKTLGISKGDRVAIMLANSPQSIISYYGALMIGAVVVQTNPLYVERELEHQLVDSGAKVIVCLDLVFPRVSKVRKATQLEYVIVTSIKDYLPFPKNVLYPFVQKKQTGMKIDITYNENTLSFKKFLQGGVTTEPSEDVSPTDDLALLQYTGGTTGPAKGVMLTHANLVANTIQGLHWMYKSKRAEEVILCVLPFFHVYGMSAGMNLAIMNAYKMVILPKFNPKDVLKAIEKHKVTLFPGAPTMYVGLINDPSIQDYNLTSVEACISGAAPLPLEVQQKFEQLTGGKLVEGYGLTETSPVAIATPIWGKRKQRSIGIPWPDTDVMIISAETGEPADVNEVGELAVRGPQVMKGYWNRPEETAQVFKDDWFLTGDMGYMDEDGYFYIVDRKKDMIIAGGFNIYPREIEEILYEHDAIKEAVVIGAPDAYRGETVKAFIVLKEGRSVSEEELDAFCRKHLAAYKVPRLYEFREELPKTLVGKILRRVLVEEEKKKAEQQKVSNE

SEQ ID NO: 56558 - protein, 148 aa, Arabidopsis thaliana
MPSSTFSGTVSTPKLSVAVDMGNPFLNLTVDAFLKIGAVGVTKSLAEDTYKAIDKGSLSKSTLEHALKKLCKEGVYWGAAGGVYIGTEYGIERIRGSRDWKNAMLAGAATGAVLSAVGKKGKDTIVIDAILGGALATASQFVNNHYFY

SEQ ID NO: 56559 - protein, 354 aa, uncultured bacterium
IGAANNLLAAMIDNHIYQGNALDIDPRRIIWRRCVDMNDRQLRNVVDGLGGKAQGCPREDGYDITVASEVMAIFCLASSITDLKERLSKIIIGYSRKGEPVTAGQLNAQGAMTALLRDALNPNLVQTLEGTPAFVHGGPFANIAHGCNSVIATKTALHFADYVVTEAGFGADLGAEKFLDIKCRMAGLKPDAVIIVATIRALKYNGGVPKDKTTEENLEALEKGLPNLLKHVEDSTQVYHLPCVVALNRFVSDTDAEIDLVTKKCKELGVNVKMSEVWGKGGDGGIELANEVVRLCEEESNDKFEFCYDLNKPLKEKIETIAKRIYGAAEVTYDKAASDELANLEKLGFGDKPI

SEQ ID NO: 56560 - protein, 298 aa, Rubrobacter xylanophilus DSM 9941
MAENGHITGTFRVKSGMAQMLKGGVIMDVVNAEQAKIAEEAGAVAVMALERVPADIRAQGGVARMSDPEKIIEIQQAVTIPVMAKVRIGHFVEAQILEALEVDYIDESEVLTPADERNHINKWDFKVPFVCGATNLGEALRRIGEGAAMIRSKGEAGTGNVVEAVRHMREIVGGIRRLGALGPEELMSEAKALGAPYELVKWVAENGRLPVVLFTAGGIATPADAALMMQLGADGVFVGSGIFKSEDPARRAQAIVKATTHYGDAKLLAEVSRGLGAAMAGREMGELSEGERLAARGW

SEQ ID NO: 56561 - protein, 332 aa, uncultured bacterium
MLDNHIKQGNELDIDLNNIIWRRCVDMNDRQLRNVVDGLGTAGDGVAREDGFDITVASEVMAVFCLATSLDDLKERLGRMVVAYSRSGKPVTVADIKAEGACTALLKDAIKPNLVQTLENNPAFVHGGPFANIAHGCNSVQATMTAMKMTDYVVTEAGFGADLGAEKFMDIKCRYAGFNPSCVVIVATVRALKHHGGVAKADLNNENLEALEAGLPNLLQHVSNVKDVFGLSPVVAINAFPTDTPAELKLVQDKCAELGVNAVLAEHWAKGGEGATALAEEVVRICDQPNDFKFCYDVEMGIEEKIEAIAKRIYHADGVDYTPKAKKQLAQL

SEQ ID NO: 56562 - protein, 346 aa, Ipomoea purpurea
MGASSDPNQDGSDEQQRRSEIYTYEAPWHIYAMNWSVRKDKRYRLAIASLLEQYPNRVEIVQLDDSNGEIRSDPNLSFEHPYPPTKVIFIPDKECQKPDLIATSSDYLRVWRVADDNSRVEIKTLLNNNRNSEFSGPLTSFDWNEAEPKRIGTSSIDTTCTIWDIERETVDTQLIAHDKEVYDIAWGGVGVFASVSADGSVRVFDLRDKEHSTIIYESSEPDTPLVRLGWNKQDPRYMATIIMDSSKVVVLDIRFPTLPVVELQRHQASVNAVAWAPHSSCHICTAGDDSQALIWDLSSMGQPIEGGLDPILAYTAGAEIEQLQWSSSQPDWVAIAFSNKLQILRV

SEQ ID NO: 56563 - protein, 377 aa, Arabidopsis thaliana
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNTPAMYVAIQAVLSLYASGRTTGIFLDSGDGVSHTVPIYEGYALPHAILRLDLAGRDLTDHLMKILTERGYSFTTTAEREIVRDMKEKLSYIALDFEQELETSKTSSSVEKSFELPDGQVITIGAERFRCPEVLFQPSMIGMENPGIHETTYNSIMKCDVDIRKDLYGNIVLSGGTTMFGGIGDRMSKEITALAPSSMKIKVVAPPERKYSVWIGGSILASLSTFQQMWIAKAEYDESGPSIVHRKCF

SEQ ID NO: 56564 - protein, 164 aa, Glycine max
KNKEWLNGVTSDAISCFFPGLTNVKGPLDCWLLGGVHFLLLLPHHGRLFAVSKFLQSGTFDLVGTIIYEIDEHPFQSTFFNGTVEVVESGAFLSMESVFLVTLGVALLVLLGLWIHGQIQHLSKKTKRAPKVEVGTRTTDASTDEWLQGTAYTQSMSSKSKKKK

SEQ ID NO: 56565 - protein, 464 aa, Agrobacterium tumefaciens str. C58
MTEIGFRTPSTDTTGAQPVSKLATARLALSLIRNPLKALPPEIFSEPAVFTRLGGVMRVHLADPVLIHEALVKNAALLGKGEDVRRALGPALGQGLLTADGDHWKWQRQSVAAAFRHEKLLELLPVMIETARRTQKRWRSSSTADIDIGHEMMRTTFDIIVETMMSGGYGIDIARVEQSITDYLKPTGWTFALAMLGAPEWLPHPGRRKSRAAVDYLRASLATVITGRRKNPTDRPDLVSMLLEAKDPETGRMMSDEEIIDNLLTFITAGHETTALGLAWTFHLLSQNPETERKAVEEIEAVTGGEPVAAEHIANLAYVRQVFSEAMRLYPPAPVITRTALQDFRLGEHDIPAGTVLYVPIYAVHRHTALWDEPERFDPSRFEPEKVKARHRYAYMPFGAGPRVCIGNAFAMMEAVAILAVILQKNHLENRTMASAEPLMRVTLRPQERLMMKITQRQNKSPAV

SEQ ID NO: 56566 - protein, 352 aa, uncultured bacterium
IGAANNLLAAMLDNHIYQGNKLGIDPRRITWRRCVDMNDRQLRFVVDGLGGRVNGTPREDGYDITVASEIMAVLCLANSLSDLKARLSRIIVGYAYDEQPVTAGQLNAAGAMTALLKDALKPNLVQTLEGTPAFVHGGPFANIAHGCNSVIATKMALKLGDYTVTEAGFGADLGAEKFLDIKCRYAGLTPSAVVVVATIRALKMHGGLAKTELGTENLEALEKGLPNLLRHVSNMKNVYKLPCVVAVNRFPTDTDAEVALVIEKCRELGVNVRLSTVWADGGAGGTELAEEVVRLCEEPNNFSFSYDLDGSIEEKIEAVVKRVYGGAGITIMPKAKKAIDTLTSLGYGNIPV

SEQ ID NO: 56567 - protein, 690 aa, Magnaporthe grisea 70-15
MPRLAAPPLPVPSHNLLRFLRSQTDGLLSFDAASATTCRTSRVVPSAHGPLGPRALTCKAKTLALPPGRRSFCTSNLRPQRTEGDGSRNFIFDMNKILPRVFRRQRGSTSRGTQEGQYPDEDRPNAYPRATKPTWQEKLGWGGVKSLGSDMGGPGSSDDCGPDNNFTFGSRRAQLMRAPMDPRLRCTEVDENGEVILVDGEYKKSELIAKYGLLPRDLRKIDSSNLPHILVRPSAILINLLHLRVLIKSDRVLLFDVFGSKTSYNQSAFMYDLQGRLRQKQPAGSNAVLPYEFRALEAVLISVTSALEADLLTVREPVVRVLRELEDDINRDRLRILLVLSKKVSTFEQKAKLVRDAIDELLEADDDLAAMYLTEKRHDLYRGVDDHTEVEMLLESYHKICDEVVQEASSLVSSIRNTEEIIRAILDANRNSLMLLDLKFSIGTLGLAMGTFLAGLYGMNLENFIEETNWGFAGVTTFSIFFSLLVCRYGLVKLRKVQRVKMHGTDGGTTSSWFRENVQTIEQGNAPGLGGNMGSIDNCSRSSGDNARKQAAPQGSRSRSVLLGSTVARRTGTGDSGNGSQWITKRYSWVISNITKELSTSKPYPNTRITSRNSEHFTSTQRSSGVHNLRLNIPPRHATMQPGDGTLLVPSRTVKTGATNGESALYRLSGAHHERYDWDSSPREQLGKTR

SEQ ID NO: 56568 - protein, 289 aa, Brassica napus
MASGFPPQKQETQPGVQHAMDPSPQFSSPNYKPSNKLHGKVALVTGGDSGIGRAVCHCYVLEGASVAFTYVKGREDKDADETLRLLHEAKTKDAKDPIMIATDLGFEENCKRTVDEVVNAFGRIDVLVNCAAEQHEVSIDEIEEARLERVFRTNIFSQFFLAKYALKHMKEGSSIINTTSVVAYAGSSSLLEYASTKGAIVSFTRALALQLASKGIRVNGVAPGPVWTPLITASFSEEAIKQFGSETPMKRAAQPVEVAPSYVFLACEHCSSYYTGQILHPNGGSIVNA

SEQ ID NO: 56569 - protein, 352 aa, uncultured rumen bacterium
ITSAHMLLSAMLDNSIQQGNPLNIDPRRIIWKRVVDMNDRALRNIVIGLGGKAHGVPREDGFDITVASEVMAILCLASNLHDLKERLKRIVVAYNYDGKPVTAEDLHAAGAMAALLKDAVKPNLVQTLEHVPAIIHGGPFANIAHGCNSVMATRTALRLADFTITEAGFGADLGAEKFFDIKCRQAGLAPDACVLVATVRALKMHGGVAKADLKEPNVEAVKKGLPNLGKHIENIFKFGVPVVVAINIFAQDTKEELQAVYDFCAGMGVSVALSDVFAKGGEGGVELAKEVVALAESGMARFKPIYPENMSLREKVATIVKEVYGGDRVEFQTKAAQALDQYEKEGYGNLPV

SEQ ID NO: 56570 - protein, 528 aa, Ustilago maydis 521
MYPIFVFAAEVAGLVTAPVNPALTVGELAKSLQQASVDIVLSHPSCQDNVRAAWEQAKIAMGRPIATSSSDAVSDGLFMFDDADELVVGKHGEPDIRAQMTDNLLESYRVEDPATETAFIMFSSGTSGSAKGVEITHSNVIHSVMALVATHDDYFGQKDVQVGFLPFYHIFGLIKLMHHPFYLGMKIVVLPKFSLDLFCEKIQEHRATASLVVPPVLLQLAKSPVPENYDMSSLKCVQCGAAPLSAELFELLEKRYPGMVVLNGYGLTESLPSVICSGPKELPNSKGAAGRIAPGVEVRLVSEEGHDVGQEQGREGVPGEVWLRGPTIMKGYLDNEEATREAFTADGWFKTGDVAVMRNTEIFIVDRIKDLIKFKGFQVSPAELEAVITSHPEVADVAVFGVWCPAQMTEVPRACIVPRNLELLNQPEECMELEKRVRSHMEKLVAAHKKIRGGIEWVATIPKSPSGKILRRLLRDEAARAAVKADKKNQLRSTLVITLSATNTSKSNKDEEESRETIFSPVSPVAAA

SEQ ID NO: 56571 - protein, 352 aa, uncultured rumen bacterium
ISAANNLLAAMIDNHIFQGNELGINPTSVVWRRCVDMNDRQLRFVVDGLGGAKNGVPREDGYDITVASEVMAILCLSTSVSDLKERLGRIIIGYTYEGNAVTAADLKAAGAVTAILKDALKPNLVQSLEGTPAFIHGGPFANIAHGCNSVLATKMALKCGDYVCTEAGFGADLGAEKFMDIKCRTTGLRPKAVVVVATVRALKMHGGLKKDSLGSEDLEALDKGLPNLLRHVSVMTDVYKIPCVVAVNRFPTDTEAELELVARRCRELGVNAVLSEVWGKGGEGGISLAEEVVRLCEKESSLELTYEDSDSIETKISKVVRRIYGGSSVSYAPGVRTKIKRLEAAGFASVPV

SEQ ID NO: 56572 - protein, 453 aa, Anabaena variabilis ATCC 29413
MVEALDNNPPHKVVIVGGGFGGLYAAKALAKAKVDVTLIDKRNFHLFQPLLYQVATGTLSPADISSPLRAVLSKSKNTQVLLGEVSDIDPEAQELVMGDEKIPYDTLIVATGAKHSYFGKDNWEEFAPGLKTVEDAIEMRRRIFTAFEAAEKEKDPAKRRAWLTFVVVGGGPTGVELAGAIAELAYKTLKEDFRNIDTTETQVILLEGLDRVLPPFAPELSQEAEISLKQLGVVVQTKTLVTNIENDIVTLKQGEEVKQIASKTVLWAAGVKASAMGKVLAERTGVECDRAGRVIVESDLSIKGHSNIFVVGDLANFSHQNGKPLPGVAPVAKQEGEYVAALVQKRLQGQTLPAFNYTDKGSLAMIGQNAAVVDLGFIKLKGFFAWLFWLVIHIYFLIEFDNKLVVMIQWVWNYVTRNRGARLITGQEVALEVKAVNNNGHYQATEKRLPVNV

SEQ ID NO: 56573 - protein, 453 aa, Anabaena variabilis ATCC 29413
MVASLEPHQVVIVGGGFGGLYAAKALAKANVNVTLIDKRNFHLFQPLLYQVATGTLSPADISAPLRSVLSKSKNTKVLLGEVNDIDPKVQQIIVGDKVVPYDTLIVATGAKHSYFGKDNWQELAPGLKTVEDAIEMRRRIFGAFEAAEKETDPEKRKAFLTFVIVGGGPTGVELAGAIAELAYKTLQEDFRNINTSETRILLLQGGDRILPHIAPELSQAATTSLREFGVVVQTKTRVTSIENDIVTFKQGDELQTITSKTILWAAGVKASAMGQVLAQRTGVECDRAGRAIVEPDLSIKGHKNIFVVGDLANFSHQNGQPLPSVAPVAIQEGEYVAKLIKKRLQGKTLPAFKYNDHGSLAMIGQNAAVVDLGLVKLQGFSAWAFWLLIHIYFLIEFDSKLLVMIQWAWNYFTRKRGSRLITGKESLAFANNFDDSNATNNYAAASNRQPLNV

SEQ ID NO: 56574 - protein, 557 aa, Streptococcus pyogenes M1 GAS
MVLSDIEIANSVTMEPISKVADQLGIDKEALCLYGKYKAKIDARQLVALKNKPDGKLILVTAISPTPAGEGKTTTSVGLVDALSAIGKKAVIALREPSLGPVFGVKGGAAGGGHAQVVPMEDINLHFTGDFHAIGVANNLLAALIDNHIHHGNSLGIDSRRITWKRVVDMNDRQLRHIVDGLQGKVNGIPREDGYDITVASEIMAILCLSENISDLKARLEKIIIGYNYQGEPVTAKDLKAGGALAALLKDAIHPNLVQTLEHTPALIHGGPFANIAHGCNSVLATKLALKYGDYAVTEAGFGADLGAEKFIDIKCRMSGLRPAAVVLVATIRALKMHGGVPKADLATENVQAVVDGLPNLDKHLANIQDVYGLPVVVAINKFPLDTDAELQAVYDACDKRGVDVVISDVWANGGAGGRELAEKVVTLAEQDNQFRFVYEEDDSIETKLTKIVTKVYGGKGINLSSAAKRELADLERLGFGNYPICMAKTQYSFSDDAKKLGAPTDFTVTISNLKVSAGAGFIVALTGAIMTMPGLPKVPASETIDIDEEGNITGLF

SEQ ID NO: 56575 - protein, 352 aa, uncultured rumen bacterium
ITSANNLLAAIIDNHIQQGNELGIDTRQIIWKRALDMNDRALRNIVVGLGAKADGVPREDHFVITVASEIMAILCLADDMDDLKKRLSRIIVAYTREGEPVTAGQLNAVGAMAALLKDAIKPNMVQTLEHNPVIIHGGPFANIAHGCNSVRATKTALGIADYTVTEAGFGADLGAEKFLDIKCRMAGLKPDAVVLVATIRALKYNGGVDKKNLGEENLEALKKGIVNLEKHIENIQKYGVPVVVTLNSFLTDTQAETDFVKTFCEERNCRFAFSEVWAKGGEGGEALAKEVIETLNTKPSNYAPIYSDDLSLKEKIETVAKEIYGADGVTFTPAASKQLAKIEEMGFGKMPV

SEQ ID NO: 56576 - protein, 504 aa, Streptomyces avermitilis MA-4680
MAQSTRTVIPKGFRSAELGWPELHRIPHPPHRLPVVGDVLGVNVRTPVQDSLRIGRRLGPVFRRKAFGKEIVFVGGADLAAELADESRFAKHVGLGVANLRPVAGDGLFTAYNHEPNWQLGHDVLAPGFSREAMAGYHPMMLAVTERLIDHWDREQTAGRAVDVPGDMTKLTLETIARTGFGHDFGSFERARPHPFVTAMVGTLTYAQRRNVVPEPLAPLLLRTATRRNAADLAYLNRTVDALVRARRTTSGEGDLLDRMLDTARPGTGERLAPENIRRQVITFLVAGHETTSGALSFALHYLSRHPDVAARARAEVDRVWGGTARPGYDQVAKLRYVRRVLDESLRLWPTAPAFAREARRDTVLGGVHPMREGAWALVLTAMLHRDPGVWGADAERFDPDRFDAQAVRSRAAHTFKPFGTGARACIGRQFALHEATLVLGLLLRRYELRAEPGYRLRVAERLTLMPEGLRLRLDRRVPAVEDVPVANPEVSSGPRCPVTGAGE

SEQ ID NO: 56577 - protein, 808 aa, Bacillus halodurans C-125
MLVSYQWLKQYVDLDGISAEEVAEKLTRGGIEVDIIHDLNQGATGVVVGHVLECRQHPNADKLNLCQVEIGEEEPVQIVCGAPNVAAGQKVAVAKVGAVLPGNFKIKKAKLRGELSQGMICSLQELGVENKFVQKEFADGIYVFSDDVEIGSDALEALNRYDQVLELDLTPNRSDCLNMYGVAYEVAALFDKEVHWPTAESSGTDGQASDYVSVEIEDIEKNPYYGATIIKNVKVGPSPLWLQNRLIAAGIRPISNVVDVTNYVLLEYGQPLHAFDYDRLGSNKVVTRLAKEGEKMVTLDDVERTLQADHLLITNGRDPVAIAGVMGGATSEVQEDTTTVLLEAAYFDPATVRKASRDLGLRSDSSSRFEKGVDPKRVREAAARAATLIAEVAGGTVVGGVVEAGELAIEEPVVSLNLPHMNQRLGMELSHDEVAAIFDRLGFAYTVENDTFEVTAPSRRGDIRIEEDLFEEVARLYGYDNIPTTFPVGGTTRGGLTDYQQKRRKIRRYLEGAGLFEVMTYSLTSEEKEKGLQGENEDYLPIRVAMPMSEERSTMRTSLVPHLLDVVQYNLNRKQEALFIYELGSVFLSKEETLTKQPEEREMLAGALTGFWTEHLWQGEKKAVDFFVVKGILEGMFAELGLSEKVTFERGEQPGMHPGRTANVKVNGRAVGFAGQIHPERQSELDLKETYVFQLDVESLLTEEGTEVAYEPLPRFPAISRDIALVVDENVTAAQLQQVIEANGGEWLKHVYLFDLYEGEHMEAGKKSIAFSLTYFDPERTLTDEEVTAVHEQILKELEASTGAVLRG

SEQ ID NO: 56578 - protein, 324 aa, Leptospira interrogans serovar Lai str. 56601
MAVLTYREALNRAMCEEMDKDPNIFLMGEEVGHYDGAYKVSQGMLSKYGEKRVIDTPISENGFAGVGIGAAMVGLRPIIEFMTWNFSLVAIDQIINSAAKMNYMSAGQFPIPIVFRGAGGAGGRLAAQHSQSFESWYAHIPGLKVIAPYTPSDACGLLKTAIRDNNPTIFIESEVLYGTRGEVPDQEYSIPFGKADIKREGSDITIVSWSRALMYVLPAAEKLSKEGISVEVLDLRSIRPLDEEAIYTSIRKTNRALVVEEGWEVAGFGSQIAYLIQKNSFDDLDAPVERITQEDVPMPYAANLEKASLPSEEKIISKVREMLE

SEQ ID NO: 56579 - protein, 355 aa, uncultured bacterium
IGAANNLLAAMLDASIQYGNPLNIDVRNITWKRVVDMNDRQLRFIVDGLGGKTNGTPREDGFDITVASEVMAIFCLATSISDLKARLGRIVVGYTYDGDPVTAHDLKAEGAMAALLKDALKPNLVQTLEGTPAFVHGGPFANIAHGCNSIMATRMALALGDYAVTEAGFGADLGAEKFLDIKCRLAGLKPDAVVIVATVRALKNHGGVAKADLGAENLEALEAGLPNLLQHVENITNIYKLPCVVAINQFPTDTEAELALVEAKCKELGVNVALSQVWAKGGEGGLALADEVIRLCDEGKGAETFEFCYPDELSLKEKIETIATRVYRADGVNFEPNALKEIEKLESLGFAGMPV

SEQ ID NO: 56580 - protein, 400 aa, Triticum aestivum
MQLASPIYFLRGRGREGQPRSKSWPATRSDLQPTPATMARHHLLLFPPLLALAFSFVVAAPEGDAAAFIDGASHRYLRDQQEDQATSMSLDEVSAAVSVLLGFAPPAMLPAPSSAKLNKLLLPNPFDRPRSVFLMQLDGSHDYVDGFISDAGSIYKTKIDGAKSAAIELTDKDELIVIRSDESSGLDVLDNELANLATWLAGSYQKADSKLNIPLKSGNSLTLFLTKEADVEFASSLISLLKTIERGIQVHEDFSGGIVSPAELLVCHFTGIKALEDEYGSAEIVKQGAEVVQTALTKALDQLQGAYNGKIVGLVISAKEASTSLASIIDALSSLHISRRLAEASKTNATASIAAIYLVRLSLAWITGIILLVSTLIGICLLMNMPLTRDTLLYSNVKID

SEQ ID NO: 56581 - protein, 343 aa, Ipomoea nil
MENSTQGSNLRSENSVTYESPYPIFAMAVSSFAAAHHGLRRRSVAVGSFLEEYKNRVEILSFEEDTVTLKTNPGLAFDHPYPPTKLMFHPNPTASMKSADLLVSSGDYLRLWEVREASIEPVSTLNNSKTSEYCAPLTSFDWNEVEPRRIGTSSIDTTCTIWDIEKGVVETQLIAHDKEVYDIAWGEAGVFSSVSADGSVRIFDLRDKEHSTIIYESPQPDTPLLRLAWNKQDLRYMATILMDSNKVVILDIRSPAMPVAELERHNASVNAIAWAPQSSRHISSAGDDGQALIWELPTVAGPNGIDPMSMYSAGAEINQLQWSAAQPDWIAIAFSNKLQMLKV

SEQ ID NO: 56582 - protein, 340 aa, uncultured bacterium
GAANNLLAAMIDNHIQQGNSLNIDPKRITWRRAVDMNDRQLRNIVDGLGNRTDGTPRQDGFDITVASEVMAILCLSSDITDLKERLGRIVIGYTYDNKPVTAKDLKAQGAMTALLKDALKPNLVQTLEGTPAFVHGGPFANITHGCNSVTATRLAMKLGDYCVTEAGFGADLGAEKFLDIKCRLANLKPDAVVLVATIRALKHHGGVSKDQLNEPNLEALKNGLPNLLQHVENITKVYKLPCVVAINAFPTDIKEELDFIENKCQELGVNVALSEVFTKGGEGGKTLAEEVVRLCETKNDFTFAYSDEMSITEKLNAISKKIYHADGVDLIGNAPKQLKQ

SEQ ID NO: 56583 - protein, 244 aa, Gentiana triflora
MGRGKVELKRIENKINRQVTFAKRRNGLLKKAYELSVLCDAEVALIIFSNRGKLYEFCSGSSTTETVERYQRYTYGLQDAGHPSDDPQNSYQEYVKLKARVEVLQGYHRNFLGEDLGSLSCKELEHLEHQVETSLKQVRSTKTSFMLDQVADLQRKEEMLAEENKALRGKLDERANQVPLRLSWEGRQQAPTGYNNVPAHTQGFFQPLGLNSTLQMGYNQGGAEGNYNVHAGNNINGFMPGFMN

SEQ ID NO: 56584 - protein, 352 aa, uncultured bacterium
IGAANNLLAAMLDNHIQQGNSLNIDPRRITWKRAVDMNDRQLRNIIDGLGARSDGTPRQDGFDITVASEVMAVLCLASDIPDLKGRLARIVVGYTYDNQPVTAGDLKAQGAMAALLKDALKPNLVQTLEHTPAFIHGGPFANIAHGCNSVTATRMALKLGEYAVTEAGFGADLGAEKFLDIKCRTAGLKPNAVVIVATVRALKHNGGVNKVDLGKENLEALEKGMPNLLQHVDNITNVYKLPCVVAINRFPTDTEAELKLIEDRCRELGVNVALSEVWAKGGEGGIKLAEEVVRLCEQPNDFTYSYDLNMSIMEKLETIARRIYHADGVDLVGNASKQLIQLESMGFSDLPI

SEQ ID NO: 56585 - protein, 427 aa, Methanococcus maripaludis S2
MELNIKMDRSKELFEESKKYLVGGVNSPVRLFKPFPFFVKSAKDCFLYDEDGNEFIDYCLAYGPMVLGHANENILNAVKSQMDLGTAYGVPSEKEITLAKEVINRIPCAEMVRFVNSGTEATMGAIRLARGVTKRNKIIKFEGAFHGAHDYVLVKTGSGALTHGAPNSPGIPEDTTKNTLLIPFNDEEAVRKVISENKEEIACIILEPVMGNVGCIPPKDGYLQFLREITEENGILLIFDEVITGFRLSKGGAQEYYGIKSDLATVGKILGGGFPIGAITGKKEYMEQFSPNGQIYQAGTFNGNPISVTAGIETLKNLDDKFYKETTKKAGILSNCLRETAEKYNIPAKVYNVASIFQVYFNDKEIVTYEDAKSSDTEKFMKYFYTLLENGVFVAPSQFECCFTSIKHNDEVLEKTMNAIDIAMKKL

SEQ ID NO: 56586 - protein, 352 aa, uncultured bacterium
ITSANNLLAALLDNHIQQGNELGIDTRTITWKRCEDMNDRVLRNIVVGLGAKADGVVREDHFVITVASEIMAIFCLATDMKDLKERLSRIIVAYNYEGKPVTAGDLQAVGAMAALLKDAMKPNVIQTLEHTAAIVHGGPFANIAHGCNSIRATKAAMKLADITVTEAGFGADLGAEKFFDIKCRMGGLKPDAVVLVATIRALKYNGGVAKEDLAAENLDALKAGIVNLEKHIENLQKYQVPIVVTLNSFVTDTEAETSFVQQFCEERGCEFALSEVWEKGGEGGIALAEKVLDVLEHKTSNFAPLYPDTMSLEEKIETVAREIYGADGVDYSPAAKRELAHLTELGMGNCPV

SEQ ID NO: 56587 - protein, 161 aa, Emericella nidulans
MAEKMLVMTSNDGKNIEVPRDVAERSLLIKNMLEDLGDPTEPIPIPNVSENVLSKVLEWCAHHRNDPPSSADDDDSRRKTTDIEEWDQKFMQVDQEMLFEIILAANYLDIKPLLDIGCKTVANMIKGKSPEEIRKTFNIQNDFTPEEEDQIRRENEWAEDR

SEQ ID NO: 56588 - protein, 118 aa, Helicobacter pylori 26695
MKNRYIQQFEDAQLKDKTMPAFKAGDTLRLGITIKEGEKTRTQYFEGVCIAIRGNGVDKTFCVRKIGANNIGVEKIFPFYSESLASVEVLRVGRVRRAKLYYLRDRRGKAARIKEVRH

SEQ ID NO: 56589 - protein, 129 aa, Thermoplasma acidophilum DSM 1728
MKNDTLNDVINSIKNASRLGKREIIAEPAAKLIGKVLKVMQDYNYIKSFEVIDESRGGKFKIVLNTTINNCGVIKPRFPVKNENLEKYEARYLPAEDFGILILTTTKGVMSNIEARKLGIGGKLLAYVY

SEQ ID NO: 56590 - protein, 540 aa, Prochlorococcus marinus subsp. marinus str. CCMP1375
MPNKSSATSMRSGHIAPVVLTILDGWGHREENINNAINNADTPVMDALWQAYPHTLIEASGADVGLPDNQMGNSEVGHLTIGAGRIIQQELVRISNTIRSKKLDQITNLSNLANKLIETDKTLHLVGLCSDGGVHSHINHLCGLLEWAKNKGIQKVAVHAFTDGRDTPAKSSLQYLKIIKEKFEVLGIGELATLCGRYWSMDRDNRWERIEKAYELLTNPNYPLSELSSDEIITNSYDSSITDEFLEPIRLTPSYLKDGDGLIMFNFRPDRARQLIKSITLPSFSEFKRKYQPQLNVVTLTQYEMDLPVSVVFPPESLDNLLGQVISEHGLLQYRTAETEKYPHVTYFFNGGIEQPLPGEKRHLVPSPRVATYDLSPEMSAEKLTKSCQEAIESGIYSLIVINYANPDMVGHTGIHAATKKAISTVDKCIGKILDSTGKMSGTLLITADHGNAELMKGPDGEPWTAHTTNPVPVILIEGEKRKISGQGNQIRLREGGGLADIAPTLLEVLSLPKPDAMTGSSLIETIQTNSKTNLVQQHV

SEQ ID NO: 56591 - protein, 181 aa, Brassica napus
MASSMLSSAAVVTSPAQATMVAPFTGLKSSSAFPVTRKANNDITSIVSNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 56592 - protein, 183 aa, Hevea brasiliensis
MASSMLSTAAVACINRASPAQASMVAPFTGLKSTSAFPTTRKTTTDITSIASNGGRVQCMQVWPPRGKKFYETLSYLPPLTREQLAKEVEYLLRKGWVPCLEFELEHGTVYREYHRSPGYYDGRYWTMWKLPMFGCTDAVQVLQELDEMIKAYPDCYGRIIGFDNVRQVQCISFLAYKPKGAE

SEQ ID NO: 56593 - protein, 352 aa, uncultured rumen bacterium
ITSAHMLLSAMLDNSIQQGNPLNIDPRRIIWKRVVDMNDRALRNIVIGLGGKAHGVPREDGFDITVASEVMAILCLASNLHDLKERLKRIVVAYNYDGKPVTAEDLHAAGAMAALLKDAVKPNLVQTLEHVPAIIHGGPFANIAHGCNSVMATRTALRLADFTITEAGFGADLGAEKFFDIKCRQAGLAPDACVLVATVRALKMHGGVAKADLKEPNVEAVKKGLPNLGKHIENIFKFGVPVVVAINIFAQDTKEELQAVYDYCAGMGVNVALSDVFAKGGEGGVELAKEVVALAESGMARFKPVYPLDIPLRKKVETIVKEIYGGDRVEFQAKAAQALDQYEKEGYGNLPV

SEQ ID NO: 56594 - protein, 327 aa, Leptospira interrogans serovar Lai str. 56601
MMNHPKTKQETQDLFELYRQMLLIRRFEEGAAKSYSTGKIGGFCHLYIGQEAVGVGSIAALKEQDYIVSTYRDHGHALARGLDPKALMAELFGKRTGISSGYGGSMHFFDKNKRFMGGHGIVGGHISLAAGIAYASKYKNENSVTICFFGEGAANIGSFHEGMNLAAIWKLPLVMICENNHYAMGTPEYRSLSVKDVSVRATAYDIARDHIEGDEVRKVRDHVSVAVERARRGEGPTLMEISTYRFRGHSMSDPAKYRTKEELDRYKKSDPLLKAKDDLIHSEWKEEELEKLDIDIQAQVEDAIVFADKSEEPPLGWLYKHVYAEDV

SEQ ID NO: 56595 - protein, 238 aa, Brassica napus
  misc_feature (221)..(221): Xaa can be any naturally occurring amino acid
  unsure (1)..(238): unsure at all Xaa locations
MNNKKNPDQKPEMPPSSSSPKKQTLFISSLILLWYTSNIGVLLLNKFLLSNYGFKFPIFLTMCHMSACAILSYVSIVFLKLVPLQHLKSRSQFMKVATLSIVFCASVVGGNVSLRYLPVSFNQAVGATTPFFTALFAYLMTFKREAWVTYGALVPVVTGVVIASGGEPGFHWFGFIMCISATAARAFKSVLQGILLSSEGEKLNSMNLMLYMSPIAVIALXLPVTIVMEQDVMSVTLS

SEQ ID NO: 56596 - protein, 381 aa, Anabaena variabilis ATCC 29413
MNLPSILVIDDLPDNFDVIETLLSEQDYTLHYVASGQEAIASLNLFQPDLILLDVMMPGMDGIEVCQRIKAMPQWQSVPIIMVTALTAKEDLARCLKSGADDFISKPINALELRARLHSMLRIKQQYDKIQTLSNIQTSTIKVLESTLDELRGNLAAALPHELNTPLNGIVGTISILMADIENMDTGEIQELLGWVDLSARNLERLIKQLLLYLELELSTNQQQNIASESTHFSIAVIEAILQSHAPSVNRRDDLMFAIEEAEVSISARYLAIIIYELVDNALKFSRRGTTIKISSQVVAGMLNVYIHDFGRGMTEEQISKIGAFMQFERKTYEQQGIGMGLKLAKQIIESHGGLFSISSVYKKETMVHIALPIAYSRYLS

SEQ ID NO: 56597 - protein, 352 aa, uncultured rumen bacterium
IGAANNLLAAMIDNHIQQGNSLNIDPKRITWRRAVDMNDRQLRNIVDGLGNRTDGTPRQDGFDITVASEVMAILCLASDINDLKKRLGNIVIGYTYENKPVTARELKAQGAMAVLLKDAIKPNLVQTLEGTPALVHGGPFANIAHGCNSLIATRMAMKLGDYAITEAGFGADLGAEKFLDIKCRIGNLKPDAVVVVATIRALKHHGGAKKEDLNKEDLECLAKGMPNLLRHVENITKVYKLPCVVAINAFPTDTAKELQYVEDECKKLGANVALSEVWAKGGEGGIRLAEEVIRLCETENDFSYSYTDDMSIYDKLCAVAKKVYHADGVDLIGNAPKQLKQLEELGYSRPPV

SEQ ID NO: 56598 - protein, 276 aa, Triticum aestivum
MTAPAELSREENVYMAKLAEQAERYEEMVEFMEKVAKTVDSEELTVEERNLLSVAYKNVIGARRASWRIISSIEQKEESRGNEDRVTLIKEYRGKIETELSKICDGILKLLETHLVPSSTAPESKVFYLKMKGDYYRYLAEFKSGPERKDAAENTMVAYKAAQDIALAELAPTHPIRLGLALNFSVFYYEILNSPDRACNLAKQAFDEAISELDTLSEESYKDSTLIMQLLRDNLTLWTSDITEDTAEEEIREAPKHDSQRGAVKPGFADAPQATS

SEQ ID NO: 56599 - protein, 331 aa, uncultured bacterium
LAAMIDNHIYQGNALDIDPRRIIWRRCVDMNDRQLRNVVDGLGGKAQGCPREDGYDITVAGEVMAIFCLASSITDLKERLSKIIIGYSRKGEPVTAGQLNAQGAMTALLRDALNPNLVQTLEGTPAFVHGGPFADIAHGCNSVIATKTALHFADYVVTEAGFGADLGAEKFLDIKCRMAGLKPDAVIIVATIRALKYNGGVPKDKTTEENLEALEKGLPNLLKHVENITQVYHLPCVVALNRFVSDTDAEIDLVTKKCKELGVNVKMSEVWGKGGDGGIELANEVVRLCEEESNDKFEFCYDLNKPLKEKIETIAKRVYGAAEVTYDKAAS

SEQ ID NO: 56600 - protein, 167 aa, Oryza sativa (japonica cultivar-group)
MQVNCAGMSFLKPAVELTPDDCSQVMGMNFESCFHLSQLAYPLLKASQRGCIINISSIASVVAFCSLPNAVYSAAKGAMNQVTRNLAAEWANDGIRVNCVAPGFIRTPLLSEFVEGNELGRAEFSRVPMGRLGEPEDIASLVAFLSMPASSYITGQVICADGGRCLS

SEQ ID NO: 56601 - protein, 352 aa, uncultured bacterium
ITTANNLLAAMLDNHIQQGNELGIDPRAVVWKRCLDINDRNLRNIVVGLGAKADGMVREDHFVITVASEIMAILCLADDMNDLKKRLGKIVVAYNFEGEPVTAGDLGATGSMAALLKDALKPNMIQTLEHTPALVHGGPFANIAHGCNSVRATKMALKLADYTITEAGFGADLGAEKFFDIKCNMAGLKPDCVVLVATVRALKYNGGVPKDELTKENVDALKKGICNLEKHIENLQKYNVPIVVTLNAFVSDTDAEVEYIRTFCEEGGCEFALSKVWEKGGEGGVELANAVISSIENKPSNFKPLYDNNLSIEEKIEKVATEIYGAKDVVYSKAATRELNRLKKLGFDKMPV

SEQ ID NO: 56602 - protein, 352 aa, uncultured bacterium
ITTANNLLAAMLDNHIQQGNELGIDPRAVVWKRCLDINDRNLRNIVVGLGAKADGMVREDHFVITVASEIMAILCLADDMNDLKKRLGKIVVAYNFEGEPVTAGDLGATGSMAALLKDALKPNMIQTLEHTPALVHGGPFANIAHGCNSVRATKMALKLADYTITEAGFGADLGAEKFFDIKCNMAGLKPDCVVLVATVRALKYNGGVPKDELTKENVDALKKGICNLEKHIENLQKYNVPIVVTLNAFVSDTDAEVEYIRTFCEERGCEFALSKVWEKGGEGGVELANAVISSIENKPSNFKPLYDNNLSIEEKIEKVATEIYGAKDVVYSKAATRELNRLKKLGFDKMPV

SEQ ID NO: 56603 - protein, 549 aa, Rubrobacter xylanophilus DSM 9941
MGGRSGNLRRFAQIGRVLVRHGFGFVFDARRERREERGLQEVLAPSFGARLRRALDDLGPTFVKFGQLLSTRSDILPESVLAELRKLQDTVAPMPPGAAQAIVERELGAPVERLFESFDPEPLGSASIGQVHRAVLRDGRVVAVKVQRPEARPRVESDLELMRELAAFIDRRFGERIFVDVPGLVAEFEGVIRRELDYTAEAENARRFRANFAGSRVRIPAVHTDLSTSRVLTLEYVEGTRFYAIRPLLLRPSERRRVAELGAEAIFRMAFEHGFFHGDPHPGNLILTPEGDLALLDFGMVGFLSRGDIDALGRLFVAVIDRDAPAVLVGLEELGVQYAPEVRADLVQDVGEFLHKYSGLSVGEVTLGQALSELISLARRYRLRVPPVFPLLTKALVTAEGIARSIDPTLNVYEVARPYARRLLLGRYRPRAVGEAVEERALEYARYAEDYPEQVRQLLSELADGELEVRLRHRGLDNLAGEVDVLANRLVFAVVTGALIVGSSVLGAFELGGPAVPYIGVPLVSFVGFSLAIALASVVLVIIFRSGRL

SEQ ID NO: 56604 - protein, 264 aa, Oryza sativa
  misc_feature (72)..(72): Xaa can be any naturally occurring amino acid
  unsure (1)..(264): unsure at all Xaa locations
MAGLYERPSETYTKKRPRYPDAWFSKLAALTAGHHRAWDAGCGTGQASISIAEHYDSVVATDASEGQIRHAXSRHPKVRYLHTPVDLSEDDLVAMVGGEGSLDLVVVATSIHWFDIPLFYAVANRVLKRPGGVLAVWGYNYEIHPFEDKLHGQLYPAMRPYMDPRTRLAMDRYRDLPFPFEPVGVGREGEPADVDIEVDMTLDDLVGFLKTGSVVTTAREKGVDLEAVTKDVMKGVEAEWGDPAVARKLVFKAFMLAGKPKVLN

SEQ ID NO: 56605 - protein, 354 aa, uncultured bacterium
IGAANNLLAAMIDNHIYQGNALDIDPRRIIWRRCVDMNDRQLRNVADGLGGKAQGCPREDGYDITVASEVMAIFCLASSITDLKERLSKIIIGYSRKGEPVTAGQLNAQGAMTALLRDALNPNLVQTLEGTPAFVHGGPFANIAHGCNSVIATKTALHFADYVVTEAGFGADLGAEKFLDIKCRMAGLKPDAVIIVATIRALKYNGGVPKDKTTEENLEALEKGLPNLLKHVENITQVYHLPCVVALNRFVSDTDAEIDLVTKKCKELGVSVKMSEVWGKGGDGGIELANEVVRLCEEESNDKFEFCYDLNKPLKEKIETIAKRVYGAAEVTYDKAASDELANLEKLGFGDKPI

SEQ ID NO: 56606 - protein, 199 aa, Zea mays
  misc_feature (168)..(168): Xaa can be any naturally occurring amino acid
  unsure (1)..(199): unsure at all Xaa locations
MWRYVWSLLLLFVVCKDTIFMAKSAAILLPSQTGVDDSVCSAPDPSLNYKPVIGILTHPGDGATGRLNNDTNASYIAASYVKLAEAGGARVVPLIYNEPEELLFQKLELVNGVIFTGGWAKKGLYFDVVKKIFTRALERNDGGEHFPVYAICLGFEVLTMIIRPKHRXFFKKCVVKKGVKSFPVVENVNPQGNGVPRQK

SEQ ID NO: 56607 - protein, 352 aa, uncultured rumen bacterium
IGAANNLLAAMIDNHIYQGNALDIDPRRVVWRRCVDMNDRQLRNVVDGLGGKANGYTREDGFDITVASEVMAAFCLATGLDDLKERFSKIVVAYNRSGDPVTAGQINAQGAMTALLKDALKPNLVQTLEGTPAFIHGGPFANIAHGCNSVMATKMAMHFGDYVVTEAGFGADLGAEKFIDIKCRPTGLRPDAVIIVATIKALKYNGGVPKADVGKENLEALEAGIPNLLKHVENVTKVFGLPAVVALNRFVNDTDAEIELVTKKCAELGVNVKMSEVWGKGGEGGIELAEEVIRLCEQPNEFKFAYDENLGIKGKIEAIATKVYGADGVDFAPKAAKEIEELEKFGYGNIPV

SEQ ID NO: 56608 - protein, 228 aa, Bordetella pertussis Tohama I
MDIERVEQVRAVERLAHRRGLALMPRAGLAAADFVAARLPAGAQVLALAGPGNNGGDALVAATLLQARGYRVAVVMPAGPARLPDDARRAWQDWCAAGGQASADLPAHAPALVIDGLFGIGLARPLDGAWQGLIDQVNAWRVPVLALDVPSGLSAASGQPLGDPPGRPVRATWTLSFIGVPAALRAPGAAAWCGEQYLSLLGLTPAFLAEAVGPCGQATATAARRSGP

SEQ ID NO: 56609 - protein, 223 aa, Bacillus subtilis
MKNTPTQLEPNVPVTRSHSMGFVILISCAAGLGGLLYGYDTAVISGAIGFLKDLYSLSPFMEGLVISSIMIGGVVGVGISGFLSDRFGRRKILMTAALLFAISAIVSALSQDVSTLIIARIIGGLGIGMGSSLSVTYITEAAPPAIRGSLSSLYQLFTILGISATYFINLAVQRSGTYEWGVHTGWRWMLAYGMVPSVIFFLVLLVVPESPRWLAKAGKTNEA

SEQ ID NO: 56610 - protein, 352 aa, uncultured rumen bacterium
ITSANNLLAAMLDNHIQQGNSLDIDTRQVIWKCCEDMNDRALRNIVVGLGSKMDGFVREDRFVITVASEIMAILCLADDMEDLKARLSRIVVAYNRAGDPVTAGDLKATGAMAALLKDALKPNLIQTLEHTPAIVHGGPFANIAHGCNSVRATKMALKLADYVITEAGFGADLGAEKFFDIKCRMAGLKPDAVVLVSTVRALKYNGGVPKSDLSEKNMEALAAGIVNLEKHIENLQKYQVPIVVTLNAFVADTEEEIEYVKNFCEERGCEFALSEVWEKGGEGGIALAQKLLYTLENKKSEFKLLYEGDLSLKEKIETVAKEIYGAAGVSYSAAAEKSLKKITEMGFGSMPV

SEQ ID NO: 56611 - protein, 351 aa, uncultured rumen bacterium
ITTAHNLLAAVLDNHIQQGNALNIDVRRVVWKRVLDLNDRALRHVVIGLGGKAHGVPRETGFDITVASEMMAILCLSSSLTDMKRRLGEIVVAYTTDGRAVRAKELNVTGALTLLFKDAIKPNLVQTLGGTPAFVHGGPFANIAHGCNSVMATKYALKLADVVVTEAGFGADLGAEKFLDIKCRFAGFSPDAVVIVATVRALKMHGGVPKSDLSRVDMGALEKGMENLLKHIETIHAFGLPAVVAVNAFPTDTAEELSFVEKKCAELGAEVAVSEVWAKGGEGGLALAKKVEAAMAKPKNFHTLYESDALIAEKIETVARTVYGADGVTFTSAAKKQLDEIEALGLDKMPV

SEQ ID NO: 56612 - protein, 639 aa, Ustilago maydis 521
MSEPSAVSVAVGEPTTQWAYRAQKSIGLNTGSPSYTSVSGFDQVTGATRVFQYSPDGSTFAAAMDDFTRLVDTRAASTSSVKRDLPVPKVVDLQFSPRGAFLSTWERPSKLDDGSNARNLKMWDTETGETVAAFERKSQEGCFFQFTANEQYCVRQVSTELQIYEPRHITDKGVIGRLRLEGITSFEVGPGDKPSIAVFCGEKKGAPASVRVYSLASLIPCPESPPAPVSQKTFFKADKIQIKWNKAGSALLFMTSTDHDKTGKSYYGETNLYLMSVRGDFDCRVALDKEGPIHDFEWNPNSKEFIVIYGYMPAKAVLFSHRVNVIAELGTQPRNFVAFNPQGRLFCIAGFGNLSGTVDVWDRQELSKGKIFSMDASNSSVCQWSPDGHFLLTATLSPRLRVENGVKIWHCTGQLVHVDMIDELYQAGWRPGSNAGLVAFPAQIPSAPAASAAAASYLATKAATKRPTGTYRPPGARGQGTPDIYKRIDEGGSGASTPDLARSGSQNGTYQAPGSGNRKRAIPGAPGSAPRTNGNAATNQKDGKKKGGKQQQNGKNANAASASVTVVEESAGTASSGAAEVGGNSSAANLEKKVRNLNKKLKAIEELKLRQAGGEKLEAMQLAKIAAEQEVRRDLATLE

SEQ ID NO: 56613 - protein, 1072 aa, Kluyveromyces lactis NRRL Y-1140
MPLLFKELKYVVKPFANLAKFSAKHPIHVILISLLIAATTYLSVIEHYFNGWSVESRGLLSYQGSLSSNSVEDDCTHYHFTPETAQWTEVSYEDVEKLRYQSIPIDHYYLLPFEFHSNNKSLEWPKLEGSVYQNGSVEYLLKDEFNVSKTLKSEDETEWTLRAHRYKLHDVKIFVISVYQDLFNRINSAEPFDIFIVGTAYVAMAYTLISLFIEMRVTGSKFWIALAAVVNSGTAFFVALYATQKICNKPVTALSLIEGVPFVVVIVGFKHKIKLAKYVVDQFKRFDVSQKVTTYQVVYDAMLNEGQRLVQDHLLCLIAFGGCAVYASSLSALSNFCFFCAVLLGFDLFITSTFFAAVLALKLEINIIHRATTIKQTLEEDGVVPSTAGIISDSETLKKNKILRSNTTLTLGKLLFVAGFIFFNFYNFSARWTYETFATLYAKSTTTELPTFITSVIPNKSKSVLISVAPSQFYEPTKAYFQVEDNILSLIRYISIAIRDRFVSKVLIFSLVISASINVYLLNAARIHTELTANDIQKQRASKKSFKSHTVHNENQSPSSSASNETKVEKPAETVPDVVSDHDSETESESDQEPTTVRSLEELVTELKDGKVKSLKNKEVVSLVVNNKLPLYALEKQLGDTTRAVVVRRKALAILADAPVLSTERLPYKHYDYDRVFGACCENVIGYMPLPVGVIGPLMIDGVYYHIPMATTEGCLVASAMRGCKAMNAGGGVQTVLTKDGMTRGPCVRFPSLARAGACKIWLDSEEGQNRVKKAFNSTSRFARLQHIQTALAGDLLFIRFRTTTGDAMGMNMISKGVEFSLKQMVEEFGWNDMEIVSVSGNFCMDKKPAAINWIEGRGKSVVAEATIPGDVVRKVLKSDVKALVDLNISKNLIGSAMAGSVGGFNAHASNLVSAVFLALGQDPAQNVESSNCITLMKEVDGDLRISVSMPSIEVGTIGGGTILEPQGAMLDLLGVRGPHPTQPGNNARQLAKIVASAVMAGELSLCSALAAGHLVQSHMVHNRAKQPATDGSTTNNATATATATPLTNGKKPLTPEELKTLKEGSVICIKS

SEQ ID NO: 56614 - protein, 309 aa, Nocardioides sp. JS614
MVDSPTPDSTASTPTTGTTGTTRVKRGMAEMLKGGVIMDVVTPEQAKIAEDAGAVAVMALERVPADIRAQGGVSRMSDPDMIDGIIEAVSIPVMAKARIGHFAEAQVLQSLGVDYVDESEVLTPADYANHIDKWAFTVPFVCGATNLGEALRRITEGAAMIRSKGEAGTGDVSNAVTHMRTIRREIRRLGALESDELYVAAKELQAPYDLVKEVAERGKLPVVLFTAGGIATPADAAMMMQLGAEGVFVGSGIFKSGNPAQRAEAIVKATTFHDDPDVVAKVSRGLGEAMVGINVEELPQPHRLAERGW

SEQ ID NO: 56615 - protein, 233 aa, Rubrobacter xylanophilus DSM 9941
MRGARGVAALTGSGVSAESGVPTFRDAQTGLWERFDPEELATPEAFLRDPKLVWEWYSWRRELVARAEPNPAHRALADLERRVPSFALITQNVDGLHRRAGSRNVIELHGNILRTVCSAERLPREPGEGAPPRCPRCGAPLRPDVVWFGEALPPGAMEAASEAARSCEVFLCVGTSGVVYPAAGLPREAAGAGALVVEVNPEPTPVTPLAAFALRGRAGELLPALVAAAFSAG

SEQ ID NO: 56616 - protein, 460 aa, Prochlorococcus marinus subsp. marinus str. CCMP1375
MASHDIFMPALSSTMTEGKIVEWLKQPGEKVSRGESVLVVESDKADMDVESFQDGFLAAVLMPSGSTVPVGETIGLIVETEAEIPAVQAANPTKSNVSPPENLSVSKDSKQTSDDSKQTPEDKPSTAEPFTSPKASSASLPAKAIINQGRIVATPRAKKLSTQLGVDLATVSGTGPHGRIQAEDVQKAQGQPITVPWIAESNAPASIPTAPSVVVTESSRNRSQPVEVPKGNSFGNPGETIPFNTLQQAVNRNMEMSLSVPCFRVGYAITTDKLDAFYKQVKPKGVTMTALLAKAVGKTLARHPQLNAAWSNEGMTYPKQINVAVAVAMEEGGLITPVLQNADLTDLFELSRQWADLVKRSRTKQLQPNEYNSGTFTLSNLGMFGVDRFDAILPPNTGGILAVAASLPKVIAGRDGSISVKRQMQVNLTADHRVVYGADGASFLKDLANLIENNPESLSS

SEQ ID NO: 56617 - protein, 327 aa, Oryza sativa (japonica cultivar-group)
MESLPVETRFTEFPLRQYGGFWLLEVMLNGVAAAETSFQPRPSDILLSSFPKCGTTWLKALAFATLNRSTYPPSDEHHPLLEHNPHDLVGFLEIYPKLELYESLPSPRLLSTHLPYSMLPHRIREQETGCRLVYIYRDPKDAMVSMWHQNKKEKKNRLTFEEMFDMFCEGRCVVGPQWCHAGEYWDESQARPEKVLFLMYEDLLQDTVGNLRTLAEFMGCGFSRQEEDDGIVQQIVELCSLNNLKNLNVNKSGTTLLGISKDGFFRKGGTGDWSNHMSPEMAARLDKIVKERLEGSGHPIISRINAKATTSIGSSNHGASEAKYIKE

SEQ ID NO: 56618 - protein, 657 aa, Staphylococcus aureus subsp. aureus COL
MAKETFYITTPIYYPSGNLHIGHAYSTVAGDVIARYKRMQGYDVRYLTGTDEHGQKIQEKAQKAGKTEIEYLDEMIAGIKQLWAKLEISNDDFIRTTEERHKHVVEQVFERLLKQGDIYLGEYEGWYSVPDETYYTESQLVDPQYENGKIIGGKSPDSGHEVELVKEESYFFNISKYTDRLLEFYDQNPDFIQPPSRKNEMINNFIKPGLADLAVSRTSFNWGVHVPSNPKHVVYVWIDALVNYISALGYLSDDESLFNKYWPADIHLMAKEIVRFHSIIWPILLMALDLPLPKKVFAHGWILMKDGKMSKSKGNVVDPNILIDRYGLDATRYYLMRELPFGSDGVFTPEAFVERTNFDLANDLGNLVNRTISMVNKYFDGELPAYQGPLHELDEEMEAMALETVKSYTESMESLQFSVALSTVWKFISRTNKYIDETTPWVLAKDDSQKDMLGNVMAHLVENIRYAAVLLRPFLTHAPKEIFEQLNINNPQFMEFSSLEQYGVLNESIMVTGQPKPIFPRLDSEAEIAYIKESMQPPATKEEKEEIPSKPQIDIKDFDKVEIKAATIIDAEHVKKSDKLLKIQVDLDSEQRQIVSGIAKFYTPDDIIGKKVAVVTNLKPAKLMGQKSEGMILSAEKDGVLTLVSLPSAIPNGAVIK

SEQ ID NO: 56619 - protein, 240 aa, Triticum aestivum
MACRPAVSNPSALTPAPRRRVVPGRSSTGGRVDCPLRSSSTGAVRLGARRAPAAAFVVRAAAAEGDLDLQAKVTSKCFFDVEIGGDRAGKVVIGLFGEVVPKTVDNFRALCTGDKGYGYKGCSFHRIIKDFMIQGGDFQNNNGTGGRSIYGECFDDENFTLKHVGPGVLSMANAGPDTNGSQFFICTVKTPWLDNRHVVFGHVLEGMDVVRELESQETSRSDIPKQPCRIVDCGELPLDG

SEQ ID NO: 56620 - protein, 479 aa, Wolbachia endosymbiont strain TRS of Brugia malayi
MITRIPSVIYSLLNMRKLVSEYDIVVIGSGPGGYIAAIRAAQLGFKTAIIEKEKSLGGICLNWGCIPTKSLLRASKVYELIKRSEEFGIKVKDASFDIQSIVKSSRNVVGKLSSGVAYLMKKNGIKVYQGFGKLAGNHTIKVSSGREEQEISSRHIILATGVRMRNLHGIEADGDLLWNAQHAMTPDRLPKSLLIIGSGAIGIEFASFYSTLGVDVTIIEVKNAILPLEDKDISNLAQEIFTRKGIRIYTNNSVKAFTKGKNSIKVQLSSGESKEFDRVIVAVGIQASTESIGLENTKVKLSASGFVETNEWYETDESSVYAIGDIAGPPCLAHKASHEAVICIERIAGKNVRALRKECIPNCTYSHPQIASVGLTEEQAIKDGYDIKIGKFHSNFNGKSITLGETEGLVKVIIDKKTGELLGAHMIGVGVTELISNFVLVKQLEGTDCDIKSVVFPHPTISEMIHESVLAAYDESLNS

SEQ ID NO: 56621 - protein, 260 aa, Triticum aestivum
MLALHTVRTSLPSPRRSSPRRHALHLSKRRFSICACSSEDAGSDGPLPHGGDQRQQEVLAKIAMLQTQKVRITNFLDERSAYLTKFTKDADTEFDMIGQNAMKELDQIGDQIMERLDSKMQSYEETAEMQRQEIEMNERVLEDFEDWIEEEKNEGMFFKSLGKVKKPQNNEEIKVKAKIEAQKVREIAEESAGSKARMNIYLALTAILGLTIANAVFATPEVEWRKVAALGLIFIGLVAQVIYEQDPSPPVADKDEKREE

SEQ ID NO: 56622 - protein, 557 aa, Zea mays
MAAQVVAAGDGGSWPQQWRLTLVLAALVPLLSLCLLLARTTRRARASSWSSSSKGRRLDVHRLPPGPPRLPLLGNLHQLGSLPHRSLRELARRHGPVMLLRLGSVPTLVVSSADAAREVMKARDADCCSRPDTPGARRLSYGHKDVAFAPYTDYWRQMRKLFVVELLSARRVRAADHAREAEVDKLIARLSSAGGKPVQLEDHMFALMDGVIGTVAFGNIYGAEQFAHRNHFHDVLDEALSAKAGFSAEDYYPNAAGRLVDRLTGAAARRERVFRDLDAFFDTIIDQHLVVVDPSSSPPSSATTTPDLIDVFVDLMEESRHQPQVHGSLRFTRDHIKGLLSNVFTAGVDTSSVTMVWAMAELTRRPAMLRKAQEEVRSVVGGDRERVHPDDMPKLRYLKAVVKETLRLHPAAPLLLPRETMRHVSVCGYDVPAKTRVLVNAWAIGRDPRSWGPRAEEFDPGRFEDGGDVGFNGTHFELIPFGAGRRMCPGIAMGVATMEFTLANLLYCFDWELPEGVGVEDVSMEEAGSLTVHKKTPLLLVPTRYKANCQSRHSFQF

SEQ ID NO: 56623 - protein, 462 aa, Wolbachia endosymbiont strain TRS of Brugia malayi
MNNYDLIVIGGGPSGYKCAIAAAKLGLKVACIDKNSIFGGTCLRVGCIPSKALLHSSYQYVYTKNNLPKLGIKTKDVNFNLKEMLGYKDARVQELGKGIDYLFNLYKITKINGLGKITSFDQDSLKVSVEDKVLKTKNIVIATGSNVSSLPGINIDEKNIISSTGALSLTEVPKKLVVIGAGAIGLEISSVWSRLGSEVIVVEFLDRIAATMDGELSKSLLSSLQKQGIKFMLSTKVEKIKQNSNSLSVKVSSIKDNQTNTIETDKVLIAVGRKPCTEDLGIDEKIEEDNRGFIQVNNRYETNVKGIFAIGDVIGGAMLAHKAEEEGVAVAEIIAGQSPHVDYEIIPSVIYTHPAVSSIGKIEEELKSAGRKYKVGKCQFAANGRAKITDDAEGFVKVLTCSTTDTILGVHIIGAYADTLINEAAVAMAYGAAAEDIYRICHSHPDINEAFRDACIDAFFKK

SEQ ID NO: 56624 - protein, 545 aa, Helicobacter pylori 26695
MLTQLKTYPKLLKHYEEIKEVHMRDWFFKDKERASRYFLQFESLSLDYSKNRLNDTTLKLLFELANDCSLKEKIEAMFKGEKINTTEKRAVLHTALRSLNDTEILLDNMEVLKSIRSVLKRMRAFSDSVRSGKRLGYTNQVITDIVNIGIGGSDLGALMVCTALKRYAHPRLKMHFVSNVDGTQILDVLEKLNPASTLFIVASKTFSTQETLTNALTARKWFVERSGDEKHIAKHFVAVSTNKEAVQQFGIDEHNMFEFWDFVGGRYSLWSAIGLSIMIYLGKKNFNALLKGAYLMDEHFRNAPFESNLPVLMGLIGVWYINFFQSKSHLIAPYDQYLRHFPKFIQQLDMESNGKRISKKGEIIPYDTCPVVWGDMGINAQHAFFQLLHQGTHLIPIDFIASLDKKPNAKGHHEILFSNVLAQAQAFMKGKSYEEALGELLFKGLDKDEAKDLAHHRVFFGNRPSNILLLEKISPSNIGALVALYEHKVFVQGVIWDINSFDQWGVELGKELAVPILQELEGHKSNAYFDSSTKHLIELYKNYNQ

SEQ ID NO: 56625 - protein, 122 aa, Zea mays
  misc_feature (102)..(102): Xaa can be any naturally occurring amino acid
  unsure (1)..(122): unsure at all Xaa locations
MNPRGYRSNRTSLFDGIEEGGIRATSYSSHEIDEQENDGAIDGLQDRVSILKRLSGDIHEEVETHNRMLDRMGNDMDTSRGFLSGTVDKFKMVFETKSSRRXWGTLVASFVALFLLVYYLTR

SEQ ID NO: 56626 - protein, 312 aa, Chara vulgaris
KVGINGFGRIGRLVLRASLNHPNVQVVAVNDPFLDPEYIVYLFKYDTVHGKYKGEVGLSADKKLVVDGKEIAIFALRDPAAIPWGEAGADYVVESTGVFTAKDKAAAHLKGGAKKVVISAPSGDAPMFVMGVNEDKYTADLDVISNASCTTNCLAPLAKVMNDNFGIVEGLMTTVHAVTATQKTVDGPSGKDWRGGHGAGFNIIPSGTGAAKAVGKVLPELNGKLTGMAFRIPTADVSVVDLTVRLAKSTTYDEIKAVIKKASESDLKGILGYTDDDVVSSDFIGDVRSSIFDAKAGIALNGNFVKLVSWYD

SEQ ID NO: 56627 - protein, 178 aa, Oryza sativa
  misc_feature (163)..(163): Xaa can be any naturally occurring amino acid
  unsure (1)..(178): unsure at all Xaa locations
MKSLCPKPGKGGKIHPSPLGGGDGDPVRAALRLLPAAILALATALRPEDQQVLAYLVTRCLQGAGAAHHPEREHPPARGGGGGRRRRGAHPPAIGCGCFDCYTSFWSRWDCSPSRELIHDAIEAFEDHLAAAESSAPPSSSSSKRRDKGKRRPPPPPSPMSPXVTRRQQQPPQPAEKS

SEQ ID NO: 56628 - protein, 396 aa, Zea mays
MASVTDETAKIEGLTSAAAFVEGGIQDACDDACSICLEAFCESDPSALTGCKHEFHLQCILEWCQRSSQCPMCWQPITMKDPTSQELLEAVERERNIRTNQTRNTTIFHHPALGDFELQHLPVGNDAELEERILQHLAAAAAMGRAHHLGRREGHRGRSGSHGRPHFLVFSTQPNSPSAGTISSSSAHMEGENDSNPATPRASESSPRAIRIGEVGNQSPGMLTYDAEQDAVVSSGNSTPVSSPRFFNRRHSTGQSTPDRAGPSDIQSFSDSLKSRLNAVSMKYKESITKSTRGWKERLFSRNSSVADLGSEVRREVNAGIASVSRMMERLETRGNSRTSDSPAASTSEVPSATESSNERVTESNSAAAAAGGGTTTTGTSASNASAPCVATSGSN

SEQ ID NO: 56629 - protein, 321 aa, Colwellia psychrerythraea 34H
MNLVADIGGTNIRLGVSDSSNIIIDIETYQCRDFTCLLDVIQYYLTEKKIAQGNINACLAIACPVDTDIISMTNLPWQFSQTELKKALKLNKLVLINDYTAIAMAIPMLTDEQKVKIGGGTALSDKAIAVCGPGTGLGVANLIPIVNKWYCLGGEGGHVDYAPIDDKEIQVLRYIQGFKKRVSYEQLLSGYGLEQIYQALLIIEQGDSSPQQPTKLTAQEISTQALIETCTLSQQALDLFCKVLGSFAGNLALTMNTQGGVYIAGGIVPCFIDYLRNSDFRLRFEAKGRMSPLNKEIATYVITEKQPGLLGASVYLNQVMA

SEQ ID NO: 56630 - protein, 352 aa, uncultured rumen bacterium
IGAANNLLAAMIDNHIYQGNELGIDPRRVTWRRCVDMNDRQLRFVVDGLGGKANGTPREDGYDITVASEIMAVLCLADDIHDLKERLARIIVGYNYDGEPVTAGQLKAAGAMAALLKDAMKPNLVQTLEGTPVFIHGGPFANIAHGCNSVIATKLAMKIGDYAVTEAGFGADLGAEKFLDIKCRYAGLKPSAVVLVGTVRALKLHGGADKKNLAEEDIDALIKGIPNLLKHASNIQNVYKLPCVVAINRFPTDTENEIKVIIDELKKINVNVILSEVWAKGGEGAIELANEVVRLCETDNDFTFAYEDEDSIETKIEKIVKKVYGGAGVDYTADAKKQLRTFKKLGYNRMPV

SEQ ID NO: 56631 - protein, 554 aa, Bacillus thuringiensis serovar konkukian str. 97-27
MSRKIIVVGGVAGGASVAARLRRLSEEDEIIMVERGEYISFANCGLPYYIGGVITERQKLLVQTVERMSKRFNLDIRVLSEVVKINKEEKTITIKNVTTNETYNEAYDVLILSPGAKPIVPSIPGIEEAKALFTLRNVPDTDRIKAYIDEKKPRHATVIGGGFIGVEMVENLRERGIDVTLVEMANQVMPPIDYEMAAYVHEHMKNHDVELIFEDGVDALEESGAVVRLKSGSVIQTDMLILAIGVQPESSLAKDAGLALGVRGTIKVNEKFQTSDPHIYAIGDAIEVKDFVTETETMIPLAWPANRQGRMLADIIHGHTDSLYKGTLGTSVAKVFDLTVASTGVNEKILKRLNIPYEVVHVQANSHAGYYPNATPVLIKLIFNKDSGKIYGAQALGRDGVDKRMDVIATAIKANLTVLDLPDLELSYAPPYSSAKDPVNMVGYAASNIVDGFVDTVQWHEIDRIVENGGYLIDVREPNELKQGMIKGSINIPLDELRDRLDEVPVDKDIYITCQLGMRGYVAARMLMEKGYKVKNVDGGFKLYGTVLPERIAY

SEQ ID NO: 56632 - protein, 185 aa, Nocardioides sp. JS614
MTLPGPEAPGLSEALALIADVPDFPQPGILFKDITPLLAEHAALEAVVAALAAPGRDQTGAPVVDKVLGMESRGFILGAPVALALGVGFVPVRKAGKLPRATYAVSYALEYGEATLEVHQDALEPGDRVLLVDDVLATGGTARATIDLVEKCGASVHAVAILMELGFLPGREALGTVPLTTLLTV

SEQ ID NO: 56633 - protein, 304 aa, Oryza sativa (indica cultivar-group)
MAKFSLDDADDDPPVATARDKRKRDDGPADAEDEPPRARGSAVAGREPAAPGAEAEAAGRRGPAEEMANGEVEGGLSVQIDPDVLDCSICFESLRPPLYQCQNGHVACFSCWSKLSNKCHICSRDAKFARNIALEKIVESIKSSCSYAKWGCCKFINYAQRDAHEEACLFAPSVCPISNCGYRGFTGRWSGHFLTSHSSDVVRFIYGQPFEVNIEVSVPFLVFLGEDDHLFLLQNNNLTPFGHAFSVVCLRSGNLNWMFSYQIEATSRKKPENRLQLKASVTNTRQWTALIAIPLRQDWGCVIG

SEQ ID NO: 56634 - protein, 893 aa, Carboxydothermus hydrogenoformans Z-2901
  misc_feature (353)..(353): Xaa can be any naturally occurring amino acid
  unsure (1)..(893): unsure at all Xaa locations
MADVTLKINGIEVTVPEGTTILEAAQIAGFKIPTLCYDPELSKPGACRICVVEVKGARNLVASCVTPVAPGMEVLTHSEPVINARREILDLLLSNHPEDCLTCDKMGECALADYAYEYGVRRGSYQGEKNVYPIEDNNPFIVRDMNKCILCGKCVRVCDEIVGYSVIDFINRGFKTKVAPPYDGTLAESNCVFCGSCVTVCPTGALTVKDTRGKFRPWEVKRVKTTCPYCGVGCNFDLLVKDDKVVGVAPNPTSEVNGRFMCVKGRFGYKFIHSDDRLTKPLIKKNGELTEASWDEALTLVAEKLGEIKAKYGSDSIGVLASAKCTNEENYLLSKFTRAVLGTNNIDHCARLXHSPSVAGLAAAFGSGAMTNSFEDIMETELIMLIGSNTTESHPVAGYKIKQAVKKGAKLIVIDPRNIELASYADLHLQLKPGTNLPLLNAMAHVIIEEGLYNEQFIRERTEGFDSYKDTVKDYSPEAVAEICGVPAEKIREAARMYAKAGKAMILYTMGVTQFSFGTYGVLAVANLAMLTGHVGKDGAGVNPLRGQNNVQGACDMGGLPNVFTGYQRVDDPAANEKFSKAWGVKLPEKPGLTLGEMFDGALKGNIKAMYIMGENPVLSDPDARHIEEALKKLDFLVVQDIFLTETAKFADVVLPAATFAEKDGTFTNTERRVQRVRKAIPCVGEAKPDWEIIALVATKMGYPMSYSSAEEIFDEMRTLTPSYAGITYERLEKKSLQWPCPAPDHPGTKFLHSDKFVRGKGLFHPIPFKEPEEKPDSEYPFTLITGRRLYHYHTGTMSRRSMMGEHVPEDHLEMNPADAKKLNIKDGDRVRVTTRRGSVEIKVALTDKVPEGTVFASFHFFESPVNQVTNPARDPMAKTPELKYSAAKIEKL

SEQ ID NO: 56635 - protein, 349 aa, Clostridium tetani E88
MFNMINLLDLSLEDLKKWMIENKEKEFRAKQVLDWVYKGVYNFEAMKNIPKVITNKLQENFYLSVPSVVQKYVSKDESTVKFLFKYNDGNIIESVVMKYKHGNTICVSTQVGCKMGCTFCASTIGGIVRSLSHGEILGQVLKAQEETGERISNIVMMGSGEPLDNYDNSLNFIRMVNAENGLNIGQRHITLSTCGIVPKIRQLAEENLQITLAISLHAPNDNIRRKTMPIASVYSVEELIEACNYYINKTNRRITFEYALVSNLNDKEVHAEELATLLKGMLCHVNLIPVNKIDEKDFKSSSTNRIKNFSNILLKSGIQTTIRREMGSDINAACGQLRRRYVKNNSKEV

SEQ ID NO: 56636 - protein, 258 aa, Triticum aestivum
MAIARTGVYVDDYLEYSSTLAGDLQRILSTMHELDERAHGILGQTKGQIKYLLGVPSHGFDRPNVVHDENASEKMTRDIENSQDNALSLCTEKVLLARQAYDLIESHIKRLDEDLGQFAEDLKQEGKIPPDEPHILPPMPVGGRDERRRSSFSTPQAARKFVREKEWDRDRERGMDFDLMPPPGSSNKKAVASMDVDQMIDPNEPTYCICHQVSYGDMIACDNENCEGGEWFHYSCVGLTPETRFKGKWFCPTCRNLQ

SEQ ID NO: 56637 - protein, 394 aa, Triticum aestivum
  misc_feature (18)..(18): Xaa can be any naturally occurring amino acid
  misc_feature (342)..(342): Xaa can be any naturally occurring amino acid
  misc_feature (386)..(386): Xaa can be any naturally occurring amino acid
  unsure (1)..(394): unsure at all Xaa locations
AATHASATAHAWECLKDXLSGDYTDNILCSIGMPIIFKSVRYNCQVFCLNRKIIMIRPKMSLANDGNYREFRWFSAWTYKDELVDFQLPSDVSEATNQETVPFGYGYLQFLDVSLAAETCEELFTANAPRIDLAFSGVEVFMNASGSHHQLRKLNLRIDSMRDATRLCGGVYMYANHQGCDGGRLYYDGCCCIAVNGDVVAQGSQFSLKDVEVLDALIDLDAVSSYRPCVSSFREQASHVTKVPCVKVQYKLCQTFRDGMIPTDPIEVMYHCPEEEIAFGPSCWLWDYLRRSRASGFLLPLSGGADSSSVAAIVGCMCQLVIKDIDKGDEQVKANAFRIVQXKNGEFPPTEKTCKNFLFICLYMGTENSSEDTRSRAKRLAEEIGXFHFDVPID

SEQ ID NO: 56638 - protein, 246 aa, Ipomoea nil
MENSTQGSNLRSENSVTYESPYPIFAMAVSSFAAAHHGLRRRSVAVGSFLEEYKNRVEILSFEEDTVTLKTNPGLAFDHPYPPTKLMFHPNPTASMKSADLLVSSGDYLRLWEVREASIEPVSTLNNSKTSEYCAPLTSFDWNEVEPRRIGTSSIDTTCTIWDIEKGVVETQLIAHDKEVYDIAWGEAGVFSSVSADGSVRIFDLRDKEHSTIIYGVREPPTRHPIAQAGLEQARFKVHGDNINGQ

SEQ ID NO: 56639 - protein, 463 aa, Oryza sativa (japonica cultivar-group)
MARLTVEQAKREAGSAGTLATSLNLSHRALSDVSCLSSFVNLERLDLGYNCLLTLEGLSNCANLKWLSVIENKLVSLKGVEGLSKLQVLNAGKNKLKTMDEVKSLTSLGALILNDNNISSICKLDQLHQLNTLVLSKNPIFTIGDALMKAKAMKKLSLSHCQIEKIGSSLTACVELKELRLAHNKITTIPSDLAKNVKILNLDLGNNLIERRSDLEVLSELHYLRNLNLQGNPIAEKDGLAKKVKKLVPNLRIFNSKPMEASSKSKNSREENLPINDADTPDDGPTDIYTKKKGKGKHSKQQIKSPEEPAGQSTRPDVTIAAPAKSELLDGKEMKKEKAAVEHVKNKKSKRKDDNSSVDHTDKKVSKGAKRTKSAKKEEKNADGIDDTEMPFADLVFSGEGNNPELELKGKNQEIARDGKFGGLVIDHTKKKKKAKGTVFGSSALEQLSSVPEVGSGALSGWD

SEQ ID NO: 56640 - protein, 317 aa, Coleochaete scutata
NGFGRIGRNFLRCWYEREDSPIEVVAINDSGGVKNAAHLLKYDSMLGTFKAEVKAIDDKTLSVGGKPITVVSNRDPLKLPWADLGIDIVIEGTGVFIDGPGAGKHIQAGAKKVIITAPAKGADIPTYVVGVNADDYDHDVANIISNASCTTNCLAPFVKIMDAEFGIVKGTMTTTHSYTGDQRLLDASHRDLRRARAAALNIVPTSTGAAKAVALVLPQLKGKLNGIALRVPTPNVSVVDLVVNTVKKGFTAEDVNTAFRNAANGSLKGILGVSDLPLVSIDFRCSDESSTIDSSLTMVMGDDMLKVVAWYDNEWGY

SEQ ID NO: 56641 - protein, 195 aa, Populus tomentosa
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRPNLWGLINSPKEVPLVANLFLGWKGVLLIGGGPKNLGLLSPKPK

SEQ ID NO: 56642 - protein, 280 aa, Glycine max
EIVGPKGIYVLISRFLQLYFNPATVKMLSNLKVLVIALLLKVIMKRRFSIIQWEALALLLIGISVNQLRSLPEGTTALGLPVTMGAYIYTLIFVTVPSLASVYNEYALKSQYDTSIYLQNLFLYGYGAIFNFLGILGTVVVKGPSSFDILQGHSKATMLLIANNAAQGILSSFFFKYADTILKKYSSTVATIFTGIASAVLFGHTLTMNFVIGISIVFISMHQFFSPLSKVKDEQNGVLELHDVHDKQRSKESFINMAAGANEEATHRVGHDERQPLLPS

SEQ ID NO: 56643 - protein, 357 aa, Rhizobium leguminosarum bv. viciae 3841
MREYAIATIPADGIGPEVIAAGTRVLAAIEKREGGIKFNIENFDWGSDYYKKHGIMMPTDGLKQLKKFDAIYFGAVGSPDVPDHITLWGLRLPICQGFDQYANVRPTKILPGITPPLRNCGPGDLDWVIVRENSEGEYSGHGGRAHRGLPEEVGTEVAIFTRVGVTRIMRYAFKLAQSRPRKFLTVVTKSNAQRHGMVMWDEIAAEVAEEFPDVTWDKMLVDAMTVRMTLNPRSLDTIVATNLHADILSDLAGALAGSLGVAPTANIDPERRFPSMFEPIHGSAFDITGKGIANPVATFWTAAQMLDHLGETDASARLMQAVERVTGAGILTPDVGGTANTKEVTDAVVDAIYASNV

SEQ ID NO: 56644 - protein, 352 aa, uncultured rumen bacterium
IGAANNLLAAMLDNHIQQGNSLGIDPKAITWKRAVDMNDRQLRHIVDGLGGKAQGVPREDGFDITVASEIMAVLCLAADLKDLKARLARVIVGYTYDGKPVTAHDLKAEGAMTALLKDAIKPNLVQTLEGTPAFVHGGPFTNIAHGCNSVTATHTALKLADYVVTEAGFAADLGAEKFLDIKCRLSDLHPDAVVIVATVRALKYHGGVPKSELSAENLDALEKGLPNLLQHVGNIKDIFGLPCVVAINAFPTDTEAELKLVEARCRELGVNVALSEVWEKGGKGGIALAEEVVRLCDQPNDFRFAYPLDISIEEKLETICRRIYHADGVLLEAGAKKQARQLTELGFDRLPI

SEQ ID NO: 56645 - protein, 1072 aa, Bacillus cereus E33L
MPKRLDINTILVIGSGPIVIGQAAEFDYSGTQACQSLKEEGYKVILVNSNPATIMTDTATADKVYIEPLTLEFVSRIIRKERPDAILPTLGGQTGLNMAVELAKSGVLEECGVEILGTKLSAIEQAEDRDLFRTLMQDLNEPTPPSEIIHNLDEAYGFVNEIGYPVIVRPAFTLGGTGGGICHNEEELIEIVTSGLKHSPVTQCLLEKSIAGCKEIEYEVMRDSNDNAIVVCNMENIDPVGVHTGDSIVVAPSQTLSDREYQMLRNTSLRIIRALGIEGGCNVQLALDPYSFQYYVIEVNPRVSRSSALASKATGYPIAKLAAKIAVGLTLDEIVNPVTQKTYACFEPALDYVVSKIPRWPFDKFESANRTLGTQMKATGEVMSIGRNLEESLLKAVRSLELGIYHLELDHLKELDKETMKKRIIKADDERLFIVAEAIRQGVTKEEINEWCEMDFFFLQKVENIVNMEREVKANVGNMEVLQTAKEMGFSDHYIAAAWNKTEREIYDMRKENNMTPVFKMVDTCAAEFESATPYYYSTYADENESIVTDRKSVVVLGSGPIRIGQGVEFDYATVHSVWAIKEAGYEAIIINNNPETVSTDFSISDKLYFEPLTIEDVMHIIDLEKPEGVIVQFGGQTAINLAAKLEEHGVKILGTSLEDLDRAEDRDKFEAALTKLGIPQPVGKTATTVEQAVAIAEEIGYPVLVRPSYVLGGRAMEIVYRQEELLHYMKNAVKVHADHPVLIDRYMVGKEIEVDAISDGENVFIPGIMEHIERAGVHSGDSIGVYPPQSLSEKLKEQIIEHTIALGKGLNIVGLLNIQFVVFKDQVYVIEVNPRASRTVPFLSKITGVPMANVATKVILGQDLVEQGYGTGYHPEEKEVYVKAPVFSFAKLRSVDTTLGPEMKSTGEVMGKDLTLEKALYKGLVASGINIPTHGSVIITVADKDKEEAMEIAKRFHEIGYNLLATAGTAQSLAEQNIPVQVVNKIDSEEYNLLDIIRQGKAQFVINTLTKGKQPARDGFRIRRESVENGVACLTSLDTTRAILRVLESMTFSAHSMKEITQTKRHEVVHA

SEQ ID NO: 56646 - protein, 403 aa, Ustilago maydis 521
MVSGLTLAGRLLSRHATVLSALEATAASSTLRWRAIQTHAALLGPTRRPRLQVNLRSASAGPTTSGKRWLARQSTSREFVIPVIDFGAFVRADATDADRARTSHELTQAFKSSGFAYLCNHGISTEQIENTFLKSAEFFKLPIVKKEQLAWKDPRANRGYVAQGRERVTQATSAEEIAALRQQTPDYKESLEIGNDDDPVWKNEWPQESDAPEFKDTMLAFQTAAHELHIKVMSSIAIGLGLEAHFFDDKCDQEWHTLRLLHYPSVKIDKLKVQGSARAGEHSDYGSITLLFQDSVGGLEAKNPNTGMYHAADPIPGTIVVNVGDLLARWSNDQLRSTLHRVKAPQALDAKAEYTPTRYSIAFFCNPNEKQLIEALPNLNERPKYERILTKHYLAKRLSETYT

SEQ ID NO: 56647 - protein, 674 aa, Oryza sativa (japonica cultivar-group)
MLVLLLLLAAAAAVSSPAPVAGDGGGALPVLNPISSFCNTTAARRTYLPNSTFEANLNGLFAVLSRNASASGYAAGAFGAAPDTAYGLLLCRGDFTGNDCSAARLASSFQQAASSCLYSKDVAVYYDQYQLRYSDQDFLAGAGAGAANEPETAAFNMNNVSDAGDVAAFDALVAELVNAVADRASNATRRYAAGKAGFAPEAMTVYAIAQCTPDLSPPQCRGCLAGIIDQMPKWFSGRVGGRILGVRCDFRYEKDPFFKIPNDMVVLSPLPDPSSQGSSSSGGLWIVAIVVPVAVLLLGFLGCFLWIRRRRRRGTVSVPTMSMEMEQVLKLWRIEESGSEFSLYDFDQIADATDNFSDACKLGQGGFGPVYKGQLPDGLEIAIKRLSSCSVQGLMEFKTEIQLIAKLQHTNLVRLLGCCVQADEKMLIYEYMHNKSLDCFIFDTEKGAMLNWDKRFRIIDGIAQGLLYLHKHSRLRVIHRDLKASNILLDREMNPKISDFGMARIFCSNVTEANTTRVVGTHGYIAPEYASEGLFSIKSDVFSFGVLLLEIISGKRTAGFYQYGKFFNLTGYAYQLWQEGQWHELVDQALGEDFPAMEVMKCVQVALLCVQDSADDRPNMSDVIAMLGSEGVTMPEPRQPAYFNVRISSLAVSSSSFGESYCMSNVTLMEEDGR

SEQ ID NO: 56648 - protein, 205 aa, Zea mays
  misc_feature (169)..(169): Xaa can be any naturally occurring amino acid
  unsure (1)..(205): unsure at all Xaa locations
MRFTPPLRASLRIAGLVMPWMLSRSTLRWRFAPPLPRPLPPLPRPDIVAAGALSFTLSSPRRKWGIFLTSSRSRAAARDLELVQIPQSSCSTPLSSSNSAAMSGRGKGGKGLGKGGAKRHRKVLRDNIQGITKPAIRRLARRGGVKRISGLIYEETRGVLKIFLENVIXRDAVTYTEHARRKTVTAMDVVYALKRQGRTLYGFGG

SEQ ID NO: 56649 - protein, 1076 aa, Bacteroides fragilis NCTC 9343
MKENNIKKVLLLGSGALKIGEAGEFDYSGSQALKALKEEGIETILINPNIATVQTSEGVADQIYFLPVTPYFVEKVIRKERPESIMLAFGGQTALNCGVALYREGILEKYNVKVLGTPVQAIIDTEDRELFVDKLNEIDVKTIKSEAVENAEDARRAARELGYPVIVRAAYALGGLGSGFCDNEEELDLLVEKAFSFSPQVLVEKSLRGWKEVEYEVVRDRFDNCITVCNMENFDPLGIHTGESIVIAPSQTLTNKEYHKLRELAIRIIRHIGIVGECNVQYAFDPESEDYRVIEVNARLSRSSALASKATGYPLAFVAAKLGLGYGLFDLKNSVTKTTSAFFEPALDYVVCKIPRWDLGKFHGVDKELGSSMKSVGEVMAIGRTFEEAIQKGLRMIGQGMHGFVENKELVIPDIDKALHEPTDKRIFVISKAFRAGYTIDQVHELTKIDKWFLQKLMNIMNTSEELHQWGNNHKQIADLPADLLKQAKRQGFSDFQIARAIGYEGDMEDGSLYVRNYRKSLGIVPVVKQIDTLAAEYPAQTNYLYLTYSGTANDVTYLGDHRSIVVLGSGAYRIGSSVEFDWCGVQALNTIRKEGWRSVMINYNPETVSTDYDMCDRLYFDELTFERVMDVLELENPHGVIVSTGGQIPNNLALRLDAQNIHILGTSAQSIDNAEDRDKFSAMLDRIGVDQPEWRALTSLEDINSFVDKVGFPVLVRPSYVLSGAAMNVCSNQEELERFLQLAANVSKKHPVVVSQFIEHAKEVEMDAVAQNGEIIAYAISEHIEFAGVHSGDATIQFPPQKLYVETVRRIKRISREIAKALNISGPFNIQYLAKDNDIKVIECNLRASRSFPFVSKVLKINFIELATKVMLGLPVEKPEKNLFELDYVGIKASQFSFNRLQKADPVLGVDMASTGEVGCIGSDTSCAVLKAMLSVGYRIPKKKILLSTGTPKQKVDMLEAARMLQKKGYDIFATGGSSKFLTENGVENTRVYWPSEEGHPQALEMLHKKEIDMVVNIPKNLTAGELDNGYKIRRAAIDLNIPLITNARLASAFINAFCTMDIDDIAIKSWEEYK

SEQ ID NO: 56650 - protein, 558 aa, Bacteroides fragilis NCTC 9343
MCGIAGIFNIKIQSRELRNKALRMARKIRHRGPDWSGMYCGGSAILAHERLSIVDPQSGGQPLYSSDRKQVLAVNGEIYNHRDIRAQYAGRYEFRTGSDCEVILALYRDKGIHFLEELNGIFAFALYDEEKDEYLIARDPIGVIPLYIGKDAEGHVYFGSELKALEGFCDEYEPFLPGHYYHSKEGTMKRWYTRDWMEYKEENDKQADSRSPTRQIQDALENAVHRQLMSDVPYGVLLSGGLDSSVISAIAKKYAAKRIETDGASDAWWPQLHSFAIGLKGAPDLIKAREVAEYIGTVHHEINYTLQEGLDAIRDVIYFIETYDVTTVRASTPMYLLARVIKSMGIKMVLSGEGADEIFGGYLYFHKAPDARAFHEETVRKLSKLHLYDCLRANKSLAAWGVEGRVPFLDKEFLDVAMQLDPEIKMAPGKVIEKKVLREAFADMLPSGIAWRQKEQFSDGVGYSWIDTLKEITATAVSDEQMAHAAERFPIHTPMNKEEYYYRSIFEEHFPSESAARSVPSIPSVACSTAEALAWDTAFKNLNDPSGRAVKGVHEEAY

SEQ ID NO: 56651 - protein, 438 aa, Prochlorococcus marinus subsp. marinus str. CCMP1375
MLKKGLLSRLAAWEILQTVGRGAYSDIAIDHSFRKYSLSIADRALATELACGAIRQRLVLDCWIDCLAKVSAEKQPPLLRWLLHVGLYQIFYMDRIPVSAAVNTTVELAKKKNLKSLAPVVNAILREAIRARDLGKELPGLIEPQDRLSLKHSIPTWLAYELIEWKGEKGAEIIAKAFNQAPAIDLRVNSKRSSVKSLRQKFQDSGIESKLIETCPYGLTVTSGAGDLRQWPGYEQGEWSVQDRSAQWVVPLLEPRSGEVVLDACSAPGGKTTHLAELMNDIGEIWAVDRSPKRLQKVSLNAARLGHHCIKFLSADATNLIELKPSWKGYFNKILLDVPCSGLGTLARNPDARWRMSPSQIEGLIQLQFNLLEGILPLLKPGGRIVYSTCTIHPDENFRQIEKFVSMHQPLNLERQKQIWPGDAQGGDGFYAAIIDSG

SEQ ID NO: 56652 - protein, 45 aa, Hevea brasiliensis
EQCGRQAGGKLCPNNLCCSQYGWCGSSDDYCSPSKNCQSNCKGGG

SEQ ID NO: 56653 - protein, 335 aa, Zea mays
MGECEDGKEYRCWEELLPDALGLIFRNLPLQEVLTVLPRVCKSWGRVVAGPYCWQEIDIEEWSQQQSKPEQIGRMVELLVGRSGGSCRRISVSGLPCDPLFSFIADNARALGTLEIPRSEISDSVVEAVAPRLSNVTFLDISSCTKIGARALEAFGRHCRSLVGLRRVMHPIDLADKVCQHDEAHAIARSMPRLRHLEMGYMLVATEAVLEILGQCRELKFLDLRGCWAVDDRFLRERHPGLRVLGPRVVDDCYENSYWEECSDYYSDEDEDYDDDVVSWGLFVDDDDDYYYAVGSDDDEAIWDDAQGLENLEVRFYGGGGFGESFAGFDWPPSP

SEQ ID NO: 56654 - protein, 925 aa, Prochlorococcus marinus subsp. marinus str. CCMP1375
MSREVINTTFDDDLDLENIFPFSLDDFQLEAIDALNQGHSVVVSAPTGSGKTLIGEYAIYRALSHGQKVFYTTPLKALSNQKLRDFRNQFGYANVGLLTGDLSVNRGAAITVMTTEIFRNMLYAEVDERDDPLDEVETVVLDECHYMNDSQRGTVWEESIIHCPSSVQLVALSATVANAGQLTDWIQKVHGPTKLIFSDFRPVPLNFNFCSAKGLHPLLNESRTGLHPNCKVWRPPKGQKRKSRSNKPLQPDAPPISFVIEKMAEREMLPAIYFIFSRRGCDKAVKDLGKVDLVSIKEKRIIETRLNTYLKENPEGVRHGIHVDALKRGIASHHAGVLPAWKELIEELFQKSLVKTVFATETLAAGINMPARSTVISSLSKRTENGHRQLMGSEFLQMAGRAGRRGLDSQGDVVTVQSRFEGVREAGQLATSAANPLISQFTPSYGMVLNLLQRYDLEKSRELVQRSFGCYLASLDLFDDEELLDQLRDQLGKLQSIAGDVPWREFEVYEKQRSRLKEERRLLRILQKQAADTLMNELTLALQFVSVGSLISFKISSLKGRVIPAVIIDKYEGISNLPLLLCLTDENIWILIPCKSVVALHTEMSCLDVKSVVAPTLKHIGEIVYGDQYSHDISMVVAQTAKIHDMVTPQYDLAGEVLVQANLVKELEEYLIKLPAHQWGDRKKLKKHRRKMEELEFEIKERQQLIHHRANRHWDTFLLLMEILQYFGCLDELDHTDIGKTVSALRGDNELWLGLALMSGHLDELSPSSLAAVLQAISTETNRHDLWSGFSPSPESMEALNDLSGIRRELLRSQEQLKLEIPVWSEPELMGLVEKWANGITWSDLIANTSLDEGDVVRIMRRTIDLLAQLPYCVAISKQLKRNAAIALKGLNRFPVREAEDLLNKEMERENNLNPATERLSKDNR

SEQ ID NO: 56655 - protein, 514 aa, Rhizobium leguminosarum bv. viciae 3841
MSKIYITTSIPYVNAAPHVGFALELVQADAYARHFRLLGHDIRFQCGTDDNSLKNVRSAEAAGVQVKDFVDANAYRFEHLGGLLDISNEEFVRTSHDPRHIACVHALWRACAGKGDLYRKAYEGLYCVGCEQFYEPSELDDGRCPEHGIALETIREENWFFRLSRYGDRLIELIETGELRIVPAHRRNEILALLRRGLTDISVSRSAERARGWGVPIPDGDEVVYVWFDALANYLTGLGHGSDETLLQRYWNDGQRIHVVGKGISKFHAIYWPAILLSAGLPPPSSILVHGYVTVDGRKIGKSAGNGIDPERIIQTYGTPDALRYYLLRHIRSGDDGDFSAERLEAAWSGELAGQLGNLANRVLALLSTSFGGIVPPVPDSAFVDEAARLPGKVAEAFDAYELHVGLADIFAFIGEANRRFTKGAPWADAKALLADLTPEDRRATAARLSACLAEQVYGLAVVARCLLPFLPSSAATLHSRLGIPAPRLYQDPLILAGVKAAPQAVLFPQRAAA

SEQ ID NO: 56656 - protein, 211 aa, Brassica napus
  misc_feature (197)..(197): Xaa can be any naturally occurring amino acid
  unsure (1)..(211): unsure at all Xaa locations
GLFDSLHEKMVPEAAGGNTRSGIFPHFGSMFSTNADGKPPHWEKDVESQFNKDHDDYATDDNAADDDSDNDLRSPLMSRQTTSMDKDMIPHPTGGSTLSMRRHSTLTGETNMGIGNGWHMGYRYDNGEYKRYYLKEDNAESRRGSIISLPGGQDGGSYIHASALVSKSVLGPKSIHGSAMVPPEKTATTGPLWSALXEPGVKRALVVGVGI

SEQ ID NO: 56657 - protein, 562 aa, Colwellia psychrerythraea 34H
MPQSQRPLYIPYAGPSLLETPLLNKGSAFSKEERGSFNLTGLLPPRFESIDEQAERAFRQYSCFQTNINKHIYLRAIHDNNETLFFKLVQNNLAEMMPIIYTPTVGDACEQFSDIYRSSRGLFISYEDRFNIDDMLRNATKNKVKVIVVTDGERILGLGDQGIGGMGIPIGKLSLYTACGGISPAHTLPVMLDVGTNNQKLLDDPMYMGARHKRIDQDSYDEFLELFISAVKRRWPNVLLQFEDFAQPNAMPLLQRYKDRICCFNDDIQGTASVTVGTLLAACRSKGSKLSELNVAFVGAGSAGCGIAEQIISQMMNEGLGAEQARSQVFMVDRFGLLTQGMGELRDFQQKLVQSNEAIAEWDIAGEFASLVEVMHGAKPDILIGVSGQAGLFTEKVITAMKSHCEMPIIFPLSNPSRQVEATPSQVINWTQGQVIIATGSPFDPIEYQGKTFPIAQCNNSYIFPGVGLAVVAANISRITDGMLQVASETLAAASPLANGESDELLPPLTSIAQLSRDIAFAIAKVAYKQGLALELTDDELLAKIEHNFWKPEYRQYRRTSL

SEQ ID NO: 56658 - protein, 607 aa, Bacillus thuringiensis serovar konkukian str. 97-27
MCGITGWVDWKEDLSNQHVILKKMANRIQHRGPDAEGFWFSPRAAFAHRRLIVIDPEGGTQPKTFRAGDYTYALTYNGEIYNFRELREQLRKCGHLFETHSDTEVLLHAYLEWKEDCVQHLNGIFAFALWDDQKQRLFLARDHLGVKPLFYTERNNSIIFGSEIKALLAHPSVPAEIDADGINEIFGLGLFRTPGCGVFKHIQEVRAGHSITFTRDKKVVTKYWNLESKIHTDSIEDTSSRILSILQDTVKRQLIADVPLVCMLSGGLDSSGITALAGKEFAAENKTLHTYSVDFVNSAKDFELTFARTGLDAPWVKRVSEHVGTSHHDIIVNAEELANHLFVPLRAKDLPSAGEMETSLYLLFCEMKKDATVALSGESADEVFGGYPWFHQEELLYVDKFPWLTNWKTTSPLLLHEVSNQCNLENYIDTRFQEAILEVPTLEGESKKSAKQRQMFYLFLTRFLPFLLDRKDRMSMAVGFEVRVPFCDYRLVEYLWNVPFNIKSIDNIEKGILRRALKPALPDDVRNRRKSAYPTSQDPHYLQTIRNLTLEMCSNKNSPIFSLINHSTLLAIADGSNKEINNFEARSAMEYMLQVNEWLKTYHIHIA

SEQ ID NO: 56659 - protein, 1329 aa, Vibrio sp. Ex25
MDNKTFKLSTIAKTVLPLISVAVISGCGSDSTNEDTTNPGSGLYPAGENEVVIYYKRDVASASTASDYEGWGLHLWNGEGCTSTDLDAMGIPGTGTDWSAPHPFDGINDTYGAYYVLKVNPDASDPHECMNFILHKGDEKAFGSANSKVELTKIGESKGLFGFHGSSELYYEPIEERPVDIDGQKAHWLDANTIAWEAVANADSMKLFYSLSNDIKMDEDKQISGGTAVELTKAGDLSDGLKSRFRHLASLQAAGIDVDDATLRTILKSQIVMVAYNANGDVISATEVQKPGVLDAVFADSKAGNAIGQELGAIVEGGAATFKLWAPTAQDVDLIIYDENLAEEATVAMTEDPATGIWVSEAQSNVVNKYYRYQVKVYHPTTGVVETRLVTDPYSMSLSKNSRYSQVVDLDDPSLMPQDWKNYARPMVKKDEDHVLYESHIRDFSFNDSKGTPSLDGKYLALTESERESVSHLQALKDAGLTTLHILPAFDIATVDEDADQRVDITDTVGKLCGIKPEASICETEDDGKVIEEVLNSYDPTTGKAQALMNDLRMLDSFNWGYDPYHYTVPEGSYATDPNGSKRILEFREMVQATHKMDLKLVMDVVYNHTNASGVNEKSVLDKIVPGYYHRLNVNTGGVENSTCCDNTATENLMMGKLMVDSLMVWADDYKVDGFRFDLMGHQPKDVMVYALEKVREIDPNTLFYGEGWDFGEVAQNARFDQATQVNMAGTEIGTFSDRLRDAVRGGSPFDGGVDSEGKHPLRFNQGFGNAAYPNEETKTDAESVNGRLHNQDLVRLGMAGNLADYVLLDYKGETKLGKNVDYNGAPAGYTKVPSENISYVSKHDNQTLWDNNAYKIATGTSSAERARMQSVSLSTVMLGQGIPFIHMGSELLRSKSMQRDSYDSGDWFNRVFFDGSDNNWNVGLPREDKDGANWELIKTIVGDSTAKPDSTDIELTKQQFLELLKIRSTSELFRLDTAQEVMNRVDFRNVGKDQVEGLIVMSIDDGTSAGADLDSNYDAIVAVVNSTSTEKSFKVAGATGFELHEVQQNSADDIVKGASFANETFTVPALTTAVFVQPQDGAQGAGLPVNTDNKDVSSIPPYGETVVYVKGTMNEWSDSSDWAMTFIGNGMYSVTGVLEAGEHEFKFADSGWANPNIGCDAADLASGSLDLGSAGNCTLSVAETGKYNFTLNALHVQDESVEKPVVSVTKSADAPTFGERALYLRGTITTWDTPAQDSTAKFSYVANDVYSLDIDLAAGNYEMKVASADWAADTNFGGEGSVELGKALTMEVGGGSANLKIAIAEAGNYNFHFNAADKSAPIVTVTKN

SEQ ID NO: 56660 - protein, 568 aa, Xanthomonas campestris pv. campestris str. ATCC 33913
MTHSVEDIKSTSRRLRGSLEQSLADPVTGALREDDQTLIKYHGSYQQDDRDIRDERRRQKLEPAYQFMIRTRTPGGVISPSQWLALDGIATRYANHSLRITTRQAFQFHGVIKRELKATMQAINATLIDTLAACGDVNRNVQVAANPLRSQAHATLYADAARVSEHLLPNTRAYYEIWLDEERVSGSGAEDEPIYGDRYLPRKFKIGFAAPPHNDVDVFANDLGFIAILREGQLLGYNVSIGGGMGASHGDAETWPRVANVIGFVTGDQLLDIATAVVTTQRDLGNRAVRKRARFKYTIDDHGLDTIVAEIERRAGFSLQPAQPFAFAHNGDRYGWVEGEQGDWHLTLSLPAGRIADTDTAAHLSGLRAIAQLQMGEFRMTPNQNLVIAGVPAEQRAQIDQLVAQYGLDAGNLAPTALARGAMACVALPTCGLAMAEAERYLPDFSAALQPLLERHGLAQTPIVLRLSGCPNGCSRPYLAEIALVGKAPGRYNLMLGGDRRGQRLNTLYRENINEADILAALEPLLARYAAERDRHTDEGFGDFLHRSGLIALPPYPTHRHLDLELLA

SEQ ID NO: 56661 - protein, 487 aa, Colwellia psychrerythraea 34H
MPLIKYKNYVDGAYTSNGTGETFDVTNPATGQVIYQVEIADELIKSKAIESAKRGFAQWSAMSATERSRVLLKAVDLLRERNDELAEIEVLDTGKPWQEASVVDVQSGADSIEFFAGLAPGIEGNQQQVGADFYYTRREALGICAGIGAWNYPLQIACWKAAPALACGNAMIFKPSEETPLGALKLAEIFSEAGLPDGVFNVLQGAGDVGSWLSHHPEIAKVSFTGEVGTGKKVMAGAATTLKDVTMELGGKSPLIIFDDADVDNAVSAAMLGNFYTQGEICTNGTRVFVQKEIYPTFIKKLVERTKNNIIVGDPMDPETNFGALISAKHQRLVLDYIDLGLKEGATLLQGGAALNPIGCDAGYFVEPTIFTDCNDDMRICCEEIFGPVMSVLTFDDEDEVIKRANATEFGLAAGVFTQDITRAHRVIHQMQAGICWINSYGLSPAEMPVGGYKLSGIGRENGLATLNHYTQIKAVYVGLEPLESPF

SEQ ID NO: 56662 - protein, 670 aa, Oryza sativa (japonica cultivar-group)
MATPRGHLPACVAAVAAAAALLTSLLPPPVAGQPLGNFCGDSGNYTANSTYQGNIRSISATLPKNASSSRTLFATATLGAVPDIVYALALCRGDTANATACAGCVAAAFQDAQQLCPYNKDATVFYDACALRFSNQNFLASTNGDNKFLILMNTQNVSAPAKVFDAAVGVLINATADYAAANSSRRFGTGEEGFNGSKIYGLAQCTPDMATATCRSCLGGIVGMMPKYFSGKQGGRVLGLRCNYRYEIYPFFDGVSLLQLPAASLGAPPAPSPAAVNVTPPATTTGTRRRGNTTGRVLAIALPIVAAILAAVVICFYIWKRKTERARKPSIADPTDPADIESIDSLILSISTLRVATNNFDDSNKLGEGGFGAVYKGVLPSDQEIAVKRLSQSSRQGIEELKNELVLVAKLQHKNLVRLLGVCLEEHEKLLVYEYMPNKSLDTILFDPDRSNVLDWWKRLKIVNAIARGLQYLHEDSQLKIIHRDLKASNVLLDSDFNPKISDFGLARLFGNDQSQDVTNRVVGTYGYMAPEYAMRGHYSIKSDVFSFGVLILEIVTGRKNNVSYDSEQSVDLLTLVWEHWLAGTVVELADSSMAGHCPGDQILKCVHIGLLCVQEDPTERPMMSMVNVMLSSSTVSLQAPSRPAFCIQKSSVNSDSYSEPFRGANQSTV

SEQ ID NO: 56663 - protein, 352 aa, uncultured rumen bacterium
IGAANNLLAAMLDNHIQQDNVLGIDPRRITWKRAVDMNDRQLRNIVDGLGGKPNGVPREDGFEITVASEVMAVLCLSSSISDLKDRLGRIIVGYTYQGEPVTAHDLKAEGAMAALLKDAIKPNLVQTLEGTPAFIHGGPFANIAHGCNSVMATRLALKLGDYVVTEAGFAADLGAEKFVDIKCRMAGLKPSAVVIVATVRALKYHGGVAKTNLNEENLEALEKGLPNLLQHVSNVRNEYGLPCVVAINAFPSDTKAELDMVEEKCHELGVNVALSEVWAKGGEGGKALAEEVVRLCEQPNDFHFVYDLDMPIKKKLETICRKIYHADGIHLPGNTPKQIKQLEDLGFGNLPI

SEQ ID NO: 56664 - protein, 270 aa, Nocardioides sp. JS614
MTRCAVLGDPIAHSLSPVLHRAGYAALGLDWSYEAVRVPEDGLEGFLTGLGPQWRGLSLTMPLKRRALAIVAGVTERARLAGGVNTLVLEDGAVVLADNTDLPGAVAAVRERYAGPVTAGTVLGGGATAAATGLALVELGARRVRLLARTPERAAAAAGAIAAHPAAPQVEVATLADGPVDGEIVVSTIPAAAQDPSLVARCGAVPVVFEVVYDPWPTPLAASATGRILVGGLDLLVHQAVLQFELFTGAPGPLDAMRAAGERALGTAPA

SEQ ID NO: 56665 - protein, 449 aa, Oryza sativa
MAVTIQSVKARQIFDSRGNPTVEVDVGLSDGSFARGAVPSGASTGIYEALELRDGGSDYLGKGVLKAVSNVNTIIGPALIGKDPTEQVDIDNFMVQQLDGTSNNWGWCKQKLGANAILAVSLAVCKAGAMVKKIPLYQKLQHIANLAGNKTLVLPVPAFNVINGGSHAGNKLAMQEFMILPTGASSFKEAMKMGVEVYHHLKSIIKKKYGQDATNVGDEGGFAPNIQENKEGLELLKAAIAKAGYTGKVVIGMDVAASEFYSEKDKTYDLNFKEDNNDGSHKISGDSLKDVYKSFVSEYPIVSIEDPFDQDDWATYAKLTDEIGQQVQIVGDDLLVTNPTRVAKAISEKTCNALLLKVNQIGSVTESIEAVRMSKRAGWGVMASHRSGETEDTFIADLSVGLSTGQIKTGAPCRSERLAKYNQLLRIEEELGDAAVYAGEKFRAPVEPY

SEQ ID NO: 56666 - protein, 698 aa, Oryza sativa (japonica cultivar-group)
MARHRVRCLLAAALLLVAPMAAAQPWQFCGQSGNFSANSAYQSNLRQLSATLPKNASAALFAAGSLGTVPDIVYALALCRGDANASACESCVDNAFQGGQQLCPYNKDVFIVYDLCYLRFTNRNLLASATDNGSPMMLMNAQNASATAEVFDAAAATLLNATSGYAAANSSRRFATGEEAFDAADPTIYGLSQCTPDMSPDDCRSCLGGIIALIPQYFGRKRGARVIGTRCNYRYEVYPFFAGGSMLRLPAPAAPAAPPPAPGPANMTPPAHTGERKKNKSGTALAIALPLVVVLLAMVAICFSVQRRRKRSRSKQQHSYSMQMGEDIESVDSLFIDLSTLRAATGNFSETNRLGEGGFGSVYKGVLPNGEEIAVKRLSMSSGQGIEELKNELVLVAKLQHKNLVRLVGVCLQEHEKLLVYEYMPNRSIDTILFGTILYSEFNKLLVKLWFTNDLDKRRELDWGKRFRIINGIARGLQYLQEDSQLRIIHRDLKASNVLLDSDYTPKISDFGLARLFGGDQTREITRHVVGTYGYMAPEYAMRGHYSVKSDVFSFGILMIEIVTGRRSSGSLSFDQSNDLLSLVWEHWTMGTILEMMDPSLTSHAPRDQMLKCIHIGLLCVQDNPADRPMMSTVNVMLSSSTVSLQSPSKPSFFIPKSDTDSNIYSESHPLTSQSTASTGRSGGMSVNDVSITELEPR

SEQ ID NO: 56667 - protein, 168 aa, Glycine max
CGWSSCFLSLICVLSSSEKLCRSLLDLVTLGNSCLLLQIRGYGVVGGDGRNNRVALFDGIEEGGIRASSLYSSSSSHEIDEHDNEQALDGLQDRVNLLKRLSGDINEEVDSHNRMLDRMGNDMDSSRGVLSGTMDKFKMVFETKSSRRMFSLVASFVVLFLIIYYLTR

SEQ ID NO: 56668 - protein, 561 aa, Cryptococcus neoformans var. neoformans JEC21
MSDIVTVKTKPYSGQKPGTSGLRKKVKIFQQEHYTENFVQAILSAMPGGPEGKTIVVGGDGRYFSPEATQIILRIGAANGIKHVILGQNAILSTPAGSALIRSLKTDGGILLTASHNPGGPDNDFGIKFNTPNGGPAPEDVTNAIHEIADSIQEYKQINLPDLDLSKIGEFTHGPLKVTIVDPVSNYIDLLKSIFDFDAIKNWLHNTTPRPTVLFDALNGVTGPYGRAIFVEELGLPESSIQNCVPSPDFGGGHPDPNLTYAHELVERVEKENIEFGAASDGDGDRNMIYGKGAFVTPSDSVAIIADWAEKAIPYFKSGIKGLARSMPTSGAIDIVAKERGLEVFEVPTGWKFFGNLMDAGRLSICGEESFGTGSDHIREKDGVWAIVAWLAILAAANKEKPGSGINDVLMQHWKKYGRSFFSRYDYEECESGPAEKMMSHLSDLFASSGFVGSSLKATSSDASFKVAEADNFSYTDPIDGSVSTNQGLYIKFEDGSRIIFRLSGTGSSGATIRLYVEKYSKDESEYGNDAQVGLKPLIEVALNISKLKEYTGREKPSVIT

SEQ ID NO: 56669 - protein, 473 aa, Nocardia farcinica IFM 10152
MSAHPAGPRHAESSATPHLAQRPVDPKQMIELPANVWPRNATRDEAGQVRLAGVPVRELAEQFGTPLFVVDEDDFRSRCRDMVRAFGPDARVHYASKAFLCGEIARWLRDEGLSLDVCSGGELAIALHAGFPAERIALHGNNKSVAELEAAVAAGVGHVVVDSLIEIERLEAVAERAGVVQDVLVRVTVGVEAHTHEYISTAHEDQKFGFSIAGGDAMEALARVFEASNLRLVGLHSHIGSQIFEIDGFEIAARRMLGLLRAAIDTFGVERTAQISTLDLGGGLGISYLPEDNPPPLDEFAAKLRAIVAEEAARAGLPEPTIAVEPGRAIAGPGTVTVYEVGTIKDVSLDAGLRRRYVSVDGGMSDNIRPALYQADYDCRLVSRPSEAEAVLARVVGKHCESGDIVIRDTWMPADVGPGDLIAVAATGAYCYSMSSRYNQLTRPAVVAVRDGSARLVLRRETVADLLSLEVES

SEQ ID NO: 56670 - protein, 183 aa, Glycine max
YRFRIQRSTHASVRLRKTTEGGTSSSTSSYSLRFSSSKPHSVTIRNSQAEGPIRRPVAPPIREPSSSSSSASQLQKPTLPSQPPPSPSPPQKPATVVGDDKNVITLEFQRQKAKELQEYFKQKKLEQADQGPFFGFIGKNEISNGRWAMFGFAVGLLTEYATGSDFVDQVKILLSNFGIVDLE

SEQ ID NO: 56671 - protein, 122 aa, Clostridium tetani E88
MIRRECTMLDVIKAIEAEQIRTDLPAFKVGDTVKVHVKIKEGTRERIQVFEGTVIKRQNGGLRETFTVRRLAYGVGVERTFPVNAPTVSKIEIVRKGKVRRAKLFYLRDRVGKAAKVKERRY

SEQ ID NO: 56672 - protein, 123 aa, Oryza sativa (indica cultivar-group)
MARLFAVCFVILSFAMAAAAARPATSSTADAPATSGDCSSDVQDLMANCQDYVMFPADPKIDPSQACCAAVQRANMPCVCNKVIPEVEQLICMDKVVYVVAFCKKPFQPGSNCGSYRVPASLA

SEQ ID NO: 56673 - protein, 348 aa, Prochlorococcus marinus subsp. marinus str. CCMP1375
MESHKIQLLGLDLSQLERLALDHGESLYRGRQLHQWLYQKGVDNLDDITVLPKAWRNSLIQKGISVGGLVEVNRFIAGDRTIKLLLSTGDGEIIETVGIPSGNRLTICVSSQIGCPMGCQFCATGKDGLKRSLKVNEIVAQVFAVKKAFNRSPSNVVFMGMGEPLLNIEEVLSSICCLNKDLGIGQRRITVSTVGVKNTLPQLAELALQFLGSVQFTLALSLHAPNQKLRESLIPSAQNYPIKLLLEDCRHYLDLTGRRVSFEYILLGHLNDHIEHAEELADLVGGFQSHVNLIAYNPIDGESFQRPSNQRVNIFIKTLQKRGIVVSLRASRGLDKNAACGQLRSMNM

SEQ ID NO: 56674 - protein, 656 aa, Vibrio sp. Ex25
MTRLLSRPYPLGATVNKEGCNFSIHAPGNKDIKLALFADDGSYALHDLPNEYADIRHTFIPDIKPGQKYGYLVSHKEEPLLISDPYAKSIDKALHYHPPYSPAKSFDMPKCIVIEDNFDWQDTDHPRIPREEMVLFETHVKGLTQLHPEVEDKLKGRYLGLASPKMLAFYEQQNINTLQLLPVAACMHEPHLLEMEKVNYWGYNPYLFMVPDPRYAEKDAVTELKTTIRELHKNGIEVILDVVYNHTAEGGEGPTIFNLKALDSRFYIKHGNHFANYTGCGNTVDLTYQPALNLVMDTLRYWVSEFKVDGFRFDLAATLGRQGDDYNPEAAFFKAVAQDPILRETKLIAEPWDIGPNGYQVGNFPFGWNECNDKLRDISRSFWRGDQGYLKEFATRLMGSRDIYSAANWPYKLTVNYITYHDGFTLQDLVSYKHKHNEANGEENRDGHGDNRSENYGVEGETENLMIIATREKQKRNLIASLLFAFGIPHILTADVLSHTQGGNNNAYCQDNETSWLHWGETERKQHFKTWMSQMVANRNQYMVPFIRAFSGENRNNNRIFWRRTDGRLMEHDDWNRLSSVALHLGIGKEGQELVYLINQTNATARFKLPNERKQEWVTICDTNVRNLNPGHAEGEVLLSPTSMVILHYHPKSDQS

SEQ ID NO: 56675 - protein, 344 aa, Arabidopsis thaliana
MQPKTEFVKFLRKGAYGSVDLVKYIKRDDNALPLYAAVKTAECEDYNSLEREIQILSKLEGCRRIVQCYGNYTLEEDFDVGGFRVYKMVMEYAAAGSLFSFMDSYKDRKLPETMIKDFTRMILQGLVSVHRLGYVHCDLKPDNLLVFPCRQSYELKISDFGSSRKVGEYSDCWDVDLPFVGTPVYMSPESVRSGVAEKALDLWSLGCIVLEMYTGVIPWSEVEFEDLAPALSKGKAPEIPKSLPCDARKFLETCFSRNPKERGSASDLLSHQFLRGEVVSGFSLPPLKLKIKLAPEKPTNVSKKPLKLKIIPPKPPQFKKGGIKPLKLKIMPLKPPASSFVSVQ

SEQ ID NO: 56676 - protein, 659 aa, Oryza sativa (japonica cultivar-group)
MAHRAGCLSMLLTAAVVLLALAPRGAAYPWQVCGTTGNFTANSTYQANLDAVAAALPRNISSSPDLFATAMVGAVPEQVSALALCRGDANATECSGCLATAFQDVQNMCAYDKDAAIYYDPCILYYSNVPFLSSVDNAASTSRVNLQNVTSDPGRFNGMVAALVNATADYAAHNSTRRYASGEAVLDRESEFPKVYSWAQCTPDLTPAQCGDCLAAIIAKLPRLFTNRIGGRVLGVRCSYRYEVNPFLNGLVMVHLTAPPIPTASPPAAAAAAAGEGKDYNVPRLVLAILLPTIAALVLINILVWLCFWRRMERLRSGATQPYSSNSAESENISSVESMLIDISTLRAATGCFAERNKLGEGGFGAVYKGTLPDGDEIAVKRLSKSSAQGVGELKNELALVAKLQHKNLVRLVGVCLEQEERLLVYEFVPNRSLDQILFDADKRQQLDWGKRYKIINGIARGLQYLHEDSQLKVVHRDLKASNILLDMNMNPKISDFGLARLFGRDQTQGVTNLVIGTYGYMSPEYAMRGNYSLKSDVFSFGVMVLEIVTGKKNNDCYNSLQSEDLLTLVWEQWTARAVSEAVDPVMGGGFSWSDVMRCIHIGLLCVQENPADRPVMSSVVMMLGSDTVSLRAPSKPAFCASSGGTSSGTSTAASVQGK

SEQ ID NO: 56677 - protein, 392 aa, Ustilago maydis 521
MPSKTKSRTSASAATEKPIVATASSSQIGVSNSNLDSEQVLKAFRALSAHVARRNASSATGSSLPLDGPSGALRDASNTVYLQLTLSTLSPTSHIKPVRINLPHALHTPGEVSTCLLVKDPQREYKDRLVAEKIRCISRVVGVTKLKGKFKPYDARRALVQDHDIFLADSRIVPNLANLCGKVFFDARKNPITVNLTKKSEALKKELESAIQATTFLQNKGSCSTIKIGYMHKHSPEQLTQNLMAAMPAVLSRVKGGWENVNNVDVKTGNSAALPVWNKKLGVKTHVTPSNERLVDETSQPSIPAEHKHDLSAETPVKKSNSLVNKGQHTWPPTSSPSPRKTRGAAAAAAAAAAAKANLTIANDAVATPTKSAKSTPKKPTSSVGRSARKPK

SEQ ID NO: 56678 - protein, 334 aa, Xanthomonas campestris pv. campestris str. ATCC 33913
MSIEQLAETAQAMVAPGKGIIAIDESTSTIAKRFSGVGIENTEENRRAYRELLLTTPKLSDYISGAILFDETIRQKTKDGVPFAKYMADHGIIPGIKVDKGAQPLAGMPGELVTEGLDGLRARLEEYYTLGARFAKWRAVINIGEDIPSGTCIEANAHALARYAALCQEQGLVPMVEPEVIMDGDHDIETCYEVTEATLRSLFGALYEQNVVLEGTILKASMVISGKGCEEQASVEEVAESTVMCLKSTVPAILPGIVFLSGGQTDEQSTAHLNEMHQLGNLPWPLSFSYGRAMQQAALKLWSKDMTGNYAKAQQIIYERAKENGLAALGKWKG

SEQ ID NO: 56679 - protein, 391 aa, Xanthomonas campestris pv. campestris str. ATCC 33913
MSIVRMTDLDLSGKRVLIRQDLNVPIDNGQITSEQRITASVPTIKLALEKGAAVMVTSHLGRPKEGTWSEEDSLAPVAARLTTLLGLDVPLVRDWVDGVDVAPGQVVLLENCRMNVGEGKDDEALARKYAALCDVFVMDAFGTAHRAQASTHGVIRFAPVAAGGPLLMAELDALAKALDNPAKPLLAIVAGSKVSTKLELLSNLVNKVDQLIVGGGIANTFIAAAGHDVGKSLSEPDLIPTANQIVADAKARGAEIPLPTDVVVAKQFLPDAEASVKSLDQVDADDLILDIGPQTAAHYAELIANAGTVVWNGPVGVFEFEPFSHGTETLARAIAASKAFSIAGGGDTLAAVDKYAIAKDVTYISTGGGAFLEFLEGKTLPAVAALEARGQ

SEQ ID NO: 56680 - protein, 456 aa, Colwellia psychrerythraea 34H
MIKVGQTTEVENFLSNHPEVEAIDVLISDLVGFARGKRIEKSSLEKIYSSGLNMPATIFSMNVLGETIEECGLGQDIGEPDMVCKPIANTLHMASWHDRPIAQVLMSMFNHDGTPFFADPRNILSNVVRQLAEINLYPVVAVELEFYLLDKNKDNKGNLQAPISPKTGKRDEHTQVYSVDTLNDYSALLDDINRVCIEQNVPADTAVAECAPGQFEINLKHEADPVAACDNAILLKRIIKTVADKHNFDATFMAKPYSNEAGSGMHVHASLLDECGNNVFADEHNDYNETLEHAIGGMLELMPASMPLLCPNVNSYRRFMPGYYVAMAKNWGVDNRTVALRLPRGHKNATRIEHRVSGADANPYLVMAVILASIHHGITNKIKPINPTVGNAFDDDCEALPLKLDRALAELEKDQILTSYLGEEFTKNYHTVKQKELEQFDMHISELEVKWYLSNS

SEQ ID NO: 56681 - protein, 444 aa, Brassica napus
MATITVVKARQIFDSRGNPTVEVDVHTSTGVKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGASSFKEAMKMGVEVYHNLKSVIKKKYGQDATNVGDEGGFAPNIQENKEGLELLKTAIEKAGYTGKVVIGMDVAASEFYSSDKTYDLNFKEENNNGSQKISGDALKDLYKSFVAEYPIVSIEDPFDQDDWEHYAKMTAECGDSVQIVGDDLLVTNPKRVAKAIAEKSCNALLLKVNQIGSVTESIEAVKMSKRAGWGVMASHRSGETEDTFIADLSVGLSTGQIKTGAPCRSERLAKYNQLLRIEEELGSEAVYAGANFRKPVEPY

SEQ ID NO: 56682 - protein, 508 aa, Acidovorax sp. JS42
MPGMQRIAPDRPHPLFDTAATRRLEACAAAALAPHTLMQRAGQATARLALALAPHARTFWFACGGGNNGGDGLEAALLLHRGGHPVVVTWLGTPETAPADARQSWQRAQEAGVPFAAEPPFLGPQDLCVDALLGIGLSADPRPRRPDARLLQWLARMHACAAPTLCVDLPSGLVAESGQYIPGLAPAHPGATAARHTLSLLTLKPGLFTGQGRDAAGSVWFDDLGVPASTETPCAWLAGPPAPAVRAHASHKGSYGDVAVIGGEGLQARGMGMTGAALLAASAALHAGAGRVMVALLDAGALPALPQQPELMLRRCDALALDHATVVCGCGGGAAVAAVLPDVLQQSARLVLDADALNAVAADPHLQHLLRERGRQGRPTVLTPHPLEAARLLAGTTAAVQADRLAAARTLADQYGCTVLLKGSGSVIAAPGRTPLLNPTGNARLATGGTGDVLAGLVGARLAAEPAQAGAAFAAAGNACWEHGAAADRWPAGRSLTAGALARALNAG

SEQ ID NO: 56683 - protein, 234 aa, Citrus x paradisi
MAEEIKKQQKSHEYEPSVGTEGAVETKDRGMLDFLGKKEEEKPQHHDQEVIATEFEKVHVSEPQPKVEEHRKEEKEEEKKPGFLDKLHRSTSSSSSSSDEEEGDDEEKKKKKKEKKGLKEKLKEKISGEKEEDTTVPVEKLDDVHAPHHQEEAHPEEKKGFLNKIKEKLPGQQKKPGDHQVPSPPAAEHPTSVEAPEAEAKEKKGILEKLKEKLPGYHPKSEDEKDKDKETAAH

SEQ ID NO: 56684 - protein, 490 aa, Erwinia carotovora subsp. atroseptica SCRI1043
MSRYGLQQLYINGAYVDSTGNDTFDAVNPANGDIIACIQSATAADVDRAVSAATAGQKVWAAMTAMERSRILRRAVDILRERNDELALLETHDTGKPLSETRTVDIVTGADVLEYYAGLIPMLEGQQIPLRDTSFVYTRREPLGVVAGIGAWNYPIQIALWKSAPALAAGNAMIFKPSEVTSLTALKLAEIYTEAGLPAGVFNVLTGTGKSVGQALTTHPGIAKVSFTGGIASGKTVMANAAGSTLKDVTMELGGKSPLIIFDDADLDKAADIAMMANFFSSGQVCTNGTRVFVPKALQAQFEEKILACVQRIRAGDPTDESVNFGPLVSFPHRESVLRYIESGKREGARVLVGGEPMTDGDYAQGAYVAPTVFTDCRDDMKIVRKEIFGPVMSILTYQDEDEVIRRANDSEYGLAAGIVTRDLNRAHRVIHQLEAGICWINTWGESPAEMPVGGYKHSGVGRENGVTTLEHYTQIKSIQVELGEFRSVF

SEQ ID NO: 56685 - protein, 213 aa, Cucurbita maxima
MASFQCNKPAERSHHQRHDQCHQEHQHHHGHGPAGGHGHGPAWGHGHGPSGGHGCGPSGGHGHGPSGGHGHGPSGGHGHGPAWGHGHGPSGGHGCGPSGGHGHGPSGGHGHGPSGGHGHGPSGGHGHGPSGGHGHGPAWGHGHGPSGGHGCGPAGGHGHGPAGGQGHCQPANPNVGHCQPANPNVGHCQPASPNVGHHSDSSDSDNDCRRGQH

SEQ ID NO: 56686 - protein, 237 aa, Prochlorococcus marinus subsp. marinus str. CCMP1375
MTDLQTQMKIAVAQEAIGEIKDGMILGLGSGSTAALMIKSLGEKLKEGSLKEIIGVPTSFQGEVLASQLGIPLRAFSAVSKIDLAIDGADEVDPNFQLIKGGGACHVQEKLVASIADRFVVVVDSTKIVEKLNLEFKLPVEVLPAAWKLVQKELNDLGAKSDLRMAEKKAGPIVTDQGNLVLDVQFADGISDPQNLEKQINNFPGVLENGLFVNLTDEVLVGEIKNGVSSVNRLKKA

SEQ ID NO: 56687 - protein, 221 aa, marine gamma proteobacterium HTCC2080
MALDSTPKIPLPNIDFRVASFMQSASSLGNAPSDTGSEVAFAGRSNAGKSSAINTLTSNRKLARTSRTPGRTQLINFFSLSDSQRLVDLPGYGYAKVPLKMKQEWNRHMADYLQRRESLRGLILLMDIRHPLTDADEQMIGWASKAQMPIHALLTKADKLKRGPAKATLLSVQARLLEFGDLASAQLFSSLKEDGLPALRTKLKTWLTDDSVFEEPDPSSG

SEQ ID NO: 56688 - protein, 1349 aa, Candida albicans SC5314
MPHSRQPSISSSIMSQSNHNHPQKIGPWKLGKTLGRGATGRVLLATHQTTGQKAAVKVVSKSELQDEETEKNGDGLPYGIEREIIIMKLLTHPNVLRLYDVWETSKALYLVLEYVEGGELFDLLVERGPLPEVEAIKYFRQIILGTAYCHALGICHRDLKPENLLLDSQLNVKLADFGMAALESNGKLLETSCGSPHYAAPEIVSGLKYHGAASDVWSCGVILFALLTGRLPFDDENIRNLLLKVQAGNFEMPVDEVSREARDLIARMLEVDPMRRISTEKILRHPLLTKYPMSNEDLISEKSLPHPQTGYKSLGSVRNIDKQILSNLTILWNDRPEEEIVDCLLKDGSNPEKTFYALLMRYKHNQEDNTNNNSPKKSTSFNNKVVRSGSKYSLNGTPRRKRASHISVSRPTSFQYKSNPGAGATANRNSVARHSVASSANNSPRKSPYKSPYRSPYRSPYKSPSKRYSYNQSPTKSPYGRRSNSQRQFENEPLKAKPRNIYNEIVDAQSNFSLPPSLPPSLPSKDSRYMIDEPNQPQLQQPALSQVPENPIVDESPDLMQSAKISSGKRNSIIGKNNNNSNSNKRMSKRKSIRASMTTGLKRNSITMKLLSTYAKLSGDDDWEYMDKQTKRTSATFAALCDKIFNQEDYDEEDEQLVDPEEKEAKEYERLMELERKKHEAELKARRELEKKKRRQKRRSILSSKKLSIIVKNDADPNNSEQELVDEGIKQPKRQSKNLTALRALSEGNHASEELTLEDVENLKRRSASQPVPKRRQTPVLTRRPVSRLDPLWQAHENEQLDRAKDALEQEWRDSQKRSSTVSRKKVNRESMISVMDDIVEEDQGRVNRRSTRNTYYERERDYELPEPTVEDSNLTDDYMTEIRKSRLLNSQLNVRDPLNEKRKSEPKTLISNVQIPSVTRKSRNFTTSNKRLSVLSMYSTKESYRDLNSIINSPDENPEQHQNMNKPALRTSIADRLDKAGLAEPEYETETDGEDKVSVIDLDDHLADRRTSYYDGSGKRASRASTTKRYNVHSSSGQRPKSKVPDLPKNDYDDTFVSNSDEVHKRQYKSMVSDESSASDDVFDKIKLPDGKSTKSSIDELANGTSTSGHRKPKIRHSQPGPEMLIPHLNGGIESSQPMSKVRGNNSSGHDDSVPPPPPAHKVNKKPLDDKTNFPPPEVDPKRKGSFFRKLSWGSKKTIENNTNAATNTTTQQQLPSPAESKEEKPKSSFFRWFSSSNTPSAAEIRKFNTILPKHEMSTALFALLNSWSNFGLKDLRNDQVGYYITGAISKHNSFNLKSCKFRIKINQRDFNQKSEIVCVRVKGSKVTTDTLFSEIEKVLLKEGVLDK

SEQ ID NO: 56689 - protein, 333 aa, Xanthomonas campestris pv. campestris str. ATCC 33913
MAIKVGINGFGRIGRNVLRSAVQNFANDIEIVAINDLLEPDYLAYMLQYDSVHGRFKAEVSVDGNTLIVNGKKIRLTQERDPANLKWDAVGAEVVIESTGLFLTKETAQKHIDAGAKKVILSAPSKDDTPMFVYGVNDKTYKGEAIVSNASCTTNCLAPLAKVINDKWGIKRGLMTTVHAATATQKTVDGPSNKDWRGGRGILENIIPSSTGAAKAVGVVIPELNKKLTGMSFRVPTSDVSVVDLTVELEKPATYAEICAEVKAQSEGALKGILGYTEDKVVATDFRGETCTSVFDADAGIALDSTFVKLVSWYDNEWGYSNKCLEMVRVVAK

SEQ ID NO: 56690 - protein, 802 aa, Burkholderia thailandensis E264
MRDRHDRRGATQHAASGPPPPAASALARGLDVRQFARATLFVDSNPQGPRPIERRNGESGPAAARLPVVRGPPGEHAAPAPMPARGARHPEQAMTTPASPRRPATGDAPAQCFLNPYRHGFVRIAVAIPPVRVADPAFNASRTIDAMRDAARAHALALVCPELGLSAYTCDDLFQQQALLDAGIAALGDVVAASRDLATIAIVGVPLQFGSTLYNCAAVVHRGRICAIVPKTYLANYREFYEARQFASGDALARDTVDLPMQSGIPCGSSLLFQVRARPLFTFHVEICEDLWVPVPPSSYAALAGATVLFNLSASNATVAKAEYRRALVGNQSARCLAAYAYSGAGAGESTTDLAWDGHGMLFENGVLLAEARRFAPTPQLVIADVDVERLASERMRQTSFAHAALRHRNACAAFRTIPLDADIDDGRMLPLARACERFPYVPSDPAVRHGRCEEISEIQVQGLVTRMNAAGVDRLVLGVSGGLDSTLALLVCARATDALRLPRDHVLACTLPGFATSARTAGQAARLINALGCRHIDIDIRPACMRMLRDLDHPFARAQARYDATFENVQAGMRTDYLFRLANRHGALVVGTGDLSELALGWCTYGVGDQMSHYAVNASIPKTLVRYLVRWAAEQGPFAGAASPVLHDVLATTISPELIPGDADTEPAQQSETAVGPFELQDFNLYYLLRLGYRPSKVAYLAWHAWHDATHGPWPDMPDGRRRAYSIGEIKHWLEIFVTRFFEDMQFKRSCLPNGPKVGSGGSLSPRGDYRAPSDASARAWLADLATVPETFDDDRAPTPH

SEQ ID NO: 56691 - protein, 649 aa, Oryza sativa (japonica cultivar-group)
MHVGYGIVAVVLVLLPPSATPAGIADCDEGVGNTYVANSTFEANLNVLAAALSPNVSVAPAGFAVATVGADPDKVFAMALCRGDVNASACSACVAAAFVDGKKDCPGNSGVAMYEDACVARFSRYRFMDFLSPDQWQVSQMIWYPEQASASVDVPAVGWFNAAVTKILAAMVDHAVTSTTGNSTTKKYFVTGEEEFDPNIYGFAQCVPDLTPAQCNDCLKDLLFYAKQAYLGKSLSWVRVNSVWCRLMYSVQPFYRGRAMLQVSAPPPTAEAPVLSPEPGSGKKISTAGIAAGVASSVVVLLILSVFAFVRFRRRTKVTDAVHPLKKITRAQCMIFDLSALQEATENFSPNNKLGEGGFGAVYKGVLSDGQEVAVKKLLGTGHGLDQLYNEIKLLAELQHKNLVRLQGFCLHQEQTLLVYEYLKNRSLDNFLFDPSRGNALNWDQQYNIILGIAKGILYLHEDSSLRIIHRDLKSNNILVGDDMEPKIADFGLARLLGEGHTHSKTTRVVGTFGYMAPEYAIDGNVSTKIDIFSFGVLVLEIITRRRNWHSDDHDLVSDVWNCWTKGTATKMIYQSLNGYSESQALRCIHIGLLCVQPDPDDRPHMSSIIFMLTKENMKLQPPAEPAFFLGRESASSPPSCGQHGYNCD

SEQ ID NO: 56692 - protein, 346 aa, Burkholderia thailandensis E264
MRHRIAERASMPEMQMRSLNADLLRYHRGPRSRVLGHASMTETNYQEILERIHCDIEPLRTAGRVADYIPELASVPAERFGMAVVTLDGRVFSVGDARERFSIQSISKLFACTLAFQLLGDSLWKRVGREPSGTAFNSLVQLESERGIPRNPFINAGALIVTDVLCRRFVGAETALVQFMRRLTGVTDLDYNLRVANSELAHAERNRAMAHFMASFGNLHMPPETVIDAYCRQCAIEMNCIELATAALFLANAGVAPVSGERILDASSAKRLSALMLTCGTYDAAGDFVYRVGLPAKSGVGGGIVAVLPGEMAVCVWSPGLDANGNSVAGVHALEQLTTLTGQSIF

SEQ ID NO: 56693 - protein, 1143 aa, Nocardioides sp. JS614
MPKREDIKSVLVIGSGPIIIGQACEFDYSGTQACRVLKAEGLRVVLVNSNPATIMTDPEFADATYVEPITPEFVEKVIAKERPDALLPTLGGQTALNAAIALHERGVLEEYGVEMIGASFEAIHRGENRELFNGIVASVGGEVARSVICHSLEDCEKAVVELGYPVVVRPSFTMGGTGSGIAYDESDLARIAGAGLAASPTTEVLIEESIIGWKEYELEVMRDKADNVVIVCSIENVDPMGVHTGDSITVAPAMTLTDREYQRLRDLSIAIIREVGVDTGGCNIQYAVNPVDGRVIVIEMNPRVSRSSALASKATGFPIAKIAAKVAIGYTLDEIPNDITTVGGFAPHTPRAPHTPTVGGSATVGGSAPHTPRGAHGSQGSDMWRPFTPAAFEPTLDYVVVKVPRFAFEKFPGADPTLTTHMKSVGEAMAIGRNFTEALQKALRSLESRDAVFDWEKEWVDLDKQAILEEIRKPHDGRLKKVMDAIRAGATPEEVFDATGIDPWFVDQLMLINDLAAEVTAAPELTPELLRKAKRHGFSDLQIGKIRGMTPAVVRGVRHALGIRPVYKTVDTCAAEFAATTPYHYSSYDEETEVRPRDRDAVIILGSGPNRIGQGIEFDYSCVHAALALSDAGYETVMVNCNPETVSTDYDTSDRLYFEPLTLEDVLEIVYAEQQAGPVAGVICQLGGQTPLGLAQGLKDNGVTVLGTSPEAIHLAEERGAFGHVLHEAGLPAPKHGMATSFAEAKEIADEIGFPVLVRPSYVLGGRGMEIVYDDDALRGYITRATQISPAHPVLVDRFIDDAVEIDVDALFDGEELFLGGVMEHIEEAGIHSGDSSCALPPITLGDSEIRRIREATEAIARGVGVRGLLNIQFALGSDVLYVLEANPRASRTVPFVSKATATPLARAAARIMLGETVAGLRSAGILPAVGDGGSLPPDQPIAVKEAVMPFNRFRTPDGRQVDTVLGPEMKSTGEVMGLDADFGAAFAKAQAGAFGALPTSGRVFVSVANRDKRNMIFPIKVLAEHGFEILATQGTAEVLRRNGVDATVVRKHFEGAGPHGEKTTVQLILEGEVQLVVNTPHGSTSGSSVRLDGYEIRTAAIRANIPCVTTIQGLGAAVQGIEAVRRGEIGVRSLQDWARNGG

SEQ ID NO: 56694 - protein, 427 aa, Triticum aestivum
MIEGARFHNMLGGGGAGIGGGRGKLENEGNGFYDMPYYHKVGESSHMSVDSADNMNSMNYVGGSVAMSVDNSSVASNESRTVMLNHPGLRDVPTPNYSVCNSVIYPNKAAASVLKEDALARVLMDPTHPTEILTNYEAWTIDLGKLDMGAPFAQGAFGKLYRGTYNGEDVAIKLLEKPENDLERAQLMEQQFVQEVMMLSTLRHPNIVRFIGACRKSIVWCIITEYAKGGSVRQFLARRQTKSVPLRLAVKQALDVARGMAYVHALGFIHRDLKSDNLLISADKSIKIADFGVARIEVKTEGMTPETGTYRWMAPEMIQHRPYDHKVDVYSFGIVLWELMTGMLPFTNMTAVQAAFAVVNKNARPAIPQDCLPALSHIMTRCWDANPEVRPSFNEVVTMLEAAETDVVSNVRKARFRCCISEPMTTD

SEQ ID NO: 56695 - protein, 486 aa, Cryptococcus neoformans var. neoformans JEC21
MSIDPAGSQASRQLPINLFTRSPTDAIPQSTYFIPSAWRRFQLSELINQVLGNTAENGSKPVPFDFLVNGEVLRGSLEAWVKKNRGGDEESQIDVEYVRSVMPPEEAARVEVEDWVSGLSLSRKGYVLLSSYLSHLQVLPLSAAAQSSSALYTLPLPTSLGATSCTWVSPQTQETDILVAAGGVDRQTHVYSIPSLSPDTADAPRELYTLHGHTGPISSVIASSSGKEIVTGSWDGNINLYVLPDAEPTEHQVPADPVSYLPGQGTKKRRKLEKDQEKAPIEGLTDGDATGEGGWRRAPDAVMRGHTGRVGGLVWDKLDSGKIWSAGWDGSVRGWEVETGAAGALRQGPFDKSALCVDQWKMNGTLATGNMDRTICLWDTRQATSLISLTLPTTSPVPSVTCHPTSPFTLASATYSGVVQIWDIRSPKTALFTVSKAQSKLADPNRKVTKNGKVLGERLLAVDWNGEVLVAGGEDGEVGIWRARGE

SEQ ID NO: 56696 - protein, 473 aa, Triticum aestivum
MDVPLASKTFPSPSPSKREQCNVDGHKSSSKHADLNPHANDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLDDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 56697 - protein, 328 aa, Myxococcus xanthus DK 1622
MTRPTSSTDFDPHLAPLLPPLKGYLPLQMTLEQLEHFRRLSHVTRDTLIGDAQVSCVDYSIPGYQGAEIVVSVIARQGHSVPGPAVYHIHGGGMVMGTRFAGAKPLVEWALRHDAVCVTVEYRLAPEHPAPTLVEDCYAGLAWMAAHADMLRFDPNQLVIFGGSGGGGLAAGTTLLARDRQGPRLLGQLLQCPMLDDRNETESAHRYDGVGVWDRTSNLTAWRAVLGDRCGGPEVSPYSAPARASDLSGLPPTFIDVGGAETFRDEAVAYARGILAAGGECELHVWGGAFHGFYDIAPQSDLARACIAARDAWIARMFARGAMSPCPP

SEQ ID NO: 56698 - protein, 255 aa, Glycine max
  misc_feature (136)..(136): Xaa can be any naturally occurring amino acid
  unsure (1)..(255): unsure at all Xaa locations
VQEASSIFCFSQRFSPCYIVFFFFVNKIIHIISYYDIPPLVIGFSAPQGCGKTTLVFALDYLFEVIGRKSATVSIDDFYLTAEGQNKLREANPGNALLELRGNAGSHDLALSVETLLALTKLTREVAKGGLPVDDXSAFNGRGDRADPSRWPEVEGPMTVVLFEGWMLGFKPLPVEAVKVVDPQLETVNKNLEAYYDAWDKYIKSWIVIKIKDPNCVFQWRLQAEIAMREAGNPGMTDDEVRDFVSRYLPAYYAY

SEQ ID NO: 56699 - protein, 400 aa, Vibrio sp. Ex25
MSNSLSLPTRVSQQVHTLAQQQNQPLCAYVYDLNALEEHIKQLRHVLPRNVELFYAAKANPSGPILKTLAPYVDGFEAASGGELAHLHQQQLDKPLIFGGPGKMPSELQQAIELDVDAIHVESLTELQRIGALTERLNRPASIFLRMNIDIGDITLSKLAMGGKPTPFGLDESELSNALMLLRDFPQVSLKGFHFHLMSHQLDVERHLALMQRYFQVVKAWQQEFELGELMINLGGGMGINYQNPEQHFPWMEFCDKLEFLIAKEQVQDWTLRFECGRFITAACGYYVMEVLDIKQNLGENFVIARGGTHHFRTPAAQSHDHPFVILKSEQHHEISHPIQHAQATFAGQLCTPKDVLARNQHVAHVDIGDYVVFTLAGAYAWNISHQNFLMHEPPIFHYF

SEQ ID NO: 56700 - protein, 275 aa, marine gamma proteobacterium HTCC2080
MTQAHFETLTSGIRYRHWQPAAKPRATILLIHGLGEHSGRYQGVAAALTARGFAVVAPDHLGHGESPGHRVFVNHFDDYLAGVRDCRQVLAQSYPDLPCFVLGHSMGGLITGRLLLEDQGQYHGALLSGPAFAAAEVPPAPVMWIGRLLAKLMPRAGMLALDGSGVSRDAEVVAAYEADPLVNHGKVTAGLGIALFDAMDRVMTEAGSITLPMLIMHGGADTLAAPIGSETFAAKVGASDLTLKVLPGLYHEIFNEPEGEEIIGQYADWIEARLP

SEQ ID NO: 56701 - protein, 315 aa, Oryza sativa (japonica cultivar-group)
MAEVGVIPVLPEPGPTTISAPRHTAADARGAPETESYNRAVQRLKDGSGKGSATEADARCGCSRATSRWCRSYANFSADSAESYGNMMKNKVLGTDGSDGDMPAAQMPAFAYLHLNHDYGDDDKMFFCDDDQRLVMRTDTYIVPSLFLVTTFQDELDALFPERGAVFHYLGRYLFPQANHTAVLQRVPRAGVAAAGRRPDCGSQALFCSSAAAAEDDTLTCAKPWRDILQILMSWLSINYFLESYVSLNRAKAALKGSYNPRGQEGWIWRSIESSLNQVAKEPKRRMGKDTGCARRGNRSRRCMEIRGGEGGEGD

SEQ ID NO: 56702 - protein, 185 aa, Brassica napus
  misc_feature (45)..(45): Xaa can be any naturally occurring amino acid
  misc_feature (48)..(48): Xaa can be any naturally occurring amino acid
  misc_feature (68)..(68): Xaa can be any naturally occurring amino acid
  misc_feature (110)..(110): Xaa can be any naturally occurring amino acid
  unsure (1)..(185): unsure at all Xaa locations
ILRPDGCTWKPWGRLEAWSESGYSSDALGYRFELFQDGIATAVSXRRXYSLKTAAGFVIDVTGGNTTXASTPTTSPQGSWDLGSGSSAGSRPASRPGSGSGSDFGYLLPXHPAQSRGFVMSASVEGVGKRSKPEVEVGVTHVTCTEDAAAHVALAAAVVLSLDACRLFSQKLRKELRQQSQLGVV

SEQ ID NO: 56703 - protein, 326 aa, Bacillus thuringiensis serovar konkukian str. 97-27
MQKETAIIIGGGPCGLAAAISLQKVGINPLVIEKGNIVNAIYNYPTHQTFFSSSEKLEIGDVAFITENRKPVRNQALAYYREVVKRKSVRVNAFERVEKVQKDGEVFQVETTKRDGSKEIYIAKYIVVATGYYDNPNYMNVPGEELKKVAHYFKEGHPYFDRDVVVIGGKNSSVDAALELVKAGARVTVLYRGSEYSPSIKPWILPEFEALVRNGTIHMHFGAHVKEITEHTLTYTVDGETNTIQNDFVFAMTGYHPDHSFLTKMGVRIDEATGRPIYAEDTMETNAANIFIAGVIAAGNNANEIFIENGRFHGDAIAQTIATREM

SEQ ID NO: 56704 - protein, 171 aa, Glycine max
  misc_feature (69)..(69): Xaa can be any naturally occurring amino acid
  misc_feature (130)..(130): Xaa can be any naturally occurring amino acid
  unsure (1)..(171): unsure at all Xaa locations
MDRRRRSSLVIDNGSGMCKAGFAGDDAPRAVFPSIVGRPRHTGVMVGMGQKDSYVGDEAQSKRGILTLXYPIEHGIVTNWDDMEKIWHHTFYNELRVAPEEHPVLLTEAPLNPKANREKMTQIMFETFNXPAMYVAIQAVLSLYASGRTTGIVMDSGDGVSHTVPIYEGYA

SEQ ID NO: 56705 - protein, 924 aa, Oryza sativa (japonica cultivar-group)
MLAGYVYGGGILAVVLAVVVVTLPLPATAAPVAECDPGVANTNVTGNSAFDRNLGLLAAALAANASAAGAPGFAVRTAGAAPDQVYALALCRGDVNASACRACVAAAFVDAKGVCPGGISLYEDACLIRFTGQSFMDFLRPDKWQVSQMTWIPGQASGNVKVPEVGWFNAAVAKILAALVEHAWATTTTTTTGNNSTTTIKYFATGEESFNPKIYGFAQCVPVLTPEQCKECLRSLHDNAKTVYMGNSLRWVGIYSVWCRLMYSVRPFYGGRATLQLSPPPPPVVETPVEAGAGKKKSAAGVAAGLACSVLVLLILAVFAFVRFKRRTKAVEADHPLKKITRAQCMIFDLPTLQEATENFSENNKLGEGGFGSVYKGVLSDGQEVAVKKLLGTSGHGLDQLHNEVLLLAELQHKNLVRLHGFCLHQGETLLVYEYIKNGSLDNFLFDINRGNALNWEQQYNIILGIAKGILYLHEDSSLRIIHRDLKSNNILLGEDMEPKIADFGLARLLGEGHTHTRTTRVVGTFGYMAPEYAIDGNVSTKIDIFSFGVLVLEIVTRRRNCNSDDHDLVNLLSDVWNCWTKGTVSQMIDQSLHGYSQSQALRCIHIALLCVQSDPNDRPQISSVIFMLTRENMELQPPAQPAFFFGGGSASSSPSFGQRSYVVRAISRSQIPDLSSSSIPNPNLSKSNPSAKVYFASPRVDGPKSLSAHLPLPPPVLSLSLSPSAPPARCARVREGRAERPSPSALPARVRVSRPRRAESSFPLPRCRSPRVVHARARVVVARIASAPSAPPGPAALPRHSIRRPPPPPRCNPRARAVVADRLVAAVVSACPRLSPVSPLRSKPPCRHRCRHRLGPASPRASRQGTEAESLHSLPRHPRSPPPFPQRGKGRAPLFSPSFPLFPSRRRHLLSLFWPLAGAPARA

SEQ ID NO: 56706 - protein, 516 aa, Leptospira interrogans serovar Lai str. 56601
MKLLGGVVERSGTGEYGPASLQLHGTNGNSILKNFVGGEQVWMNHADEVVKLPEGFSKIAFSKDCGYAVVANSSKKIFGIQFHAEVSHSEKGSVLLDNFIQICGVSKTWGIDQFLKEKIKEIQETVKQEQKIFMLVSGGVDSTVSYLLLCKALGAERVLGFLIDTGFMRKDEVVSLQKKLTFQNIHLTVRDESSLFYKSLKDKSDPEEKRKIVGNLFLEARDRAVKDLDLEYGDWLLGQGTIYPDTIESGGTKHSHTIKTHHNRVEAIQKLIEQGKVIEPIRDLYKDEVRDLGVLLGLESEWVGRHPFPGPGLVVRMLAVEKKGTDKDQLEIDSYLSTQDGLSGKILPIASVGVKGDRRSYANCVVLNDIETDWNTLDRVATHLSNRFSFINRVVLLPFESDLKKWNFQFTGMQLDKKCSDLLREADFTVESVIRKLGLYNKIWQMPVVLLPIGEKENEKSIVLRPVESQEAMTANFFRMERSVLQEIKIEVLKIPEIRYLFFDLTNKPPGTIEWE

SEQ ID NO: 56707 - protein, 842 aa, Pichia pastoris
MTFPLLPAYASVAEFDNSLSLVGKAVFPYAADQLHNLIKFTQSTELQVNVQVESSVTEDQFEELIDNLLKLYNNGINEVILDLDLAERVVQRIPGARVIYRTLVDKVASLPANASIAVPFSSPLGDLKSFTNGGSRTVYAFSETAKLVDVTSTVASGIIPIIDARQLTTEYELSEDVKKFPVSEILLASLTTDRPDGLFTTLVADSSNYSLGLVYSSKKSIPEAIRTQTGVYQSRRHGLWYKGATSGATQKLLGIELDCDGDCLKFVVEQTGVGFCHLERTSCFGQSKGLRAMEATLWDRKSNAPEGSYTKRLFDDEVLLNAKIREEADELAEAKSKEDIAWECADLFYFALVRCAKYGVTLDEVERNLDMKSLKVTRRKGDAKPGYTKEQPKEESKPKEVPSEGRIELCKIDVSKASSQEIEDALRRPIQKTEQIMELVKPIVDNVRQNGDKALLELTAKFDGVALKTPVLEAPFPEELMQLPDNVKRAIDLSIDNVRKFHEAQLAETLQVETCPGVVCSRFARPIEKVGLYIPGGTAILPSTSLMLGVPAKVAGCKEIVFASPPKKDGTLTPEVIYVAHKVGAKCIVLAGGAQAVAAMAYGTETVPKCDKIFGPGNQFVTAAKMMVQNDTSALCSIDMPAGPSEVLVIADKYADPDFVVSDLLSQAEHGIDSQVILLAVDMTDKELARIEDAVHNQAVQLPRVEIVRKCIAHSTTLSVATYEQALEMSNQYAPEHLILQIENASYVDQVQHAGSVFVGAYSPESCGDYSSGTNHTLPTYGYARQYSGVNTATFQKFITSQDVTPEGLKHIGQAVMDLAAVEGLDAHRNAVKVRMEKLGLI

SEQ ID NO: 56708 - protein, 460 aa, Kineococcus radiotolerans SRS30216
MGRTSTDASTGAPLSLQDLRHDITSGRIDTVLVAMTDMQGRLQGKRLTGRFFLDEVLEHGTEGCNYLLGVDVEMNTVDGYEITSWSRGYGDLLLRPDLSTLRRIPWHPATAMVLCDVLQLDDEPVRPSPRQVLRAQLQRLEGHGLRPLVATELEFNLLRVTYEEAHANGYRDLRPASTHNIDYSLLGTGRVEPVLRRIRNEMDGAGLYTESAKGECNLGQQEIGFRYADALTTCDQHSVFKLGAKEIAAQEGMSVTFMAKLDQREGNSCHIHLSLTDLDGSPVFAAGAGSEMAPVMRSFLAGQLAALRELTLLLAPNVNSYKRFADGSFAPTAVAWGYDNRTCALRVVGRGPSLRMENRVPGGDANPYLAVSALIAAGLHGIEEGLELEEVTTGNAYTGGAPRVPTTLLAAAELFAGSALARRAFGDDVVDHYARAAHVELEAFQTAVTDWERARGFERL

SEQ ID NO: 56709 - protein, 248 aa, Carboxydothermus hydrogenoformans Z-2901
MTKLSGRKILLMTDFDGTIAAYRKDPRKVSLAKDMVAILQKFTRQPNLKLAVVSGRGLQDLEKMVNIRGIILAGCFGGVFRDEQGKVHTWEKAPDYFGPVEELAEFFSRSPVFKGVYIEKKEIALTLHYKDLGVKKRREVLKVIEEAREKNPIFNFHVGDKGTEIIPQGLGKGWFIQEMLKKYPDFYPVFLGNDWVDLEGIEVLRGQGLAFYVGDTPPPGSHGLSGLKEVKKLFKKLLAVNQAALNAS

SEQ ID NO: 56710 - protein, 948 aa, Zea mays
  misc_feature (532)..(532): Xaa can be any naturally occurring amino acid
  misc_feature (665)..(665): Xaa can be any naturally occurring amino acid
  misc_feature (715)..(715): Xaa can be any naturally occurring amino acid
  misc_feature (780)..(780): Xaa can be any naturally occurring amino acid
  unsure (1)..(948): unsure at all Xaa locations
MSVWNYVVTAHKPTSVSHSCVGNFTSPNQLNLIIAKCTRIEIHLLTPQGLQPMLDVPIYGRIATIELFRPHNETQDFLFIATERYKFCVLQWDAEKSELITRAMGDVSDRIGRPTDNGQIGIIDPDCRLIGLHLYDGLFKVIPFDNKGQLKEAFNIRLEELQVLDIKFLHGCAKPTIVVLYQDNKDVRHVKTYEVALKDKDFVEGPWSQNNVDNGAGLLIPVPAPLGGVIIIGEEQIVYCNANSTFKAIPIKQSIIRAYGRVDPDGSRYLLGDNTGILHLLVLTHERERVTGLKIEYLGETSIASSISYLDNGVVYVGSRFGDSQLVKLNLQADASGSFVEILERYVNLGPIVDFCVVDLDRQGQGQVVTCSGAFKDGSLRVVRNGIGINEQASVELQGIKGLWSLKSSINDPFDMYLGRDHASETRFLAMNMEDELEETEIEGFDAQTQTLFCQNAINDLLIQVTANSVRLVSCTSRELVNQWNAPAGFSVNVASANASQVARSSQVCFQINCEGKAVPKASPRRSHTLHXLAAAETRQTASRSMGCVGSTPATKDAGGSSDVNHGTKRVRKPKAWKHPQPITMAQLRQMREEFWDTAPHYGGQKEIWDALRVASESEVSHAQAVVESAGIIVSNADLTLCYDERGAKYELPKYVLSEPTNLIXTAERQPAVGRPTDVKTVNDCRCRQIGPLLVVTGVPRVTFRFALATFGNRXFSSSSVQIKKNFCVPSSIVLGSTVNMSLLRILWSENAAEIVLVHYHDTSWSIRFRNLSHLVQIVXNEVYVGAENSYNLFTVRKNSDAATDDERARLEVVGEYHLGEFVNRFRHGSLVMRLPDSDIGQIPTVIFGTINGVIGIIASLPHDQYIFLEKLQSTLVKYIKGVGNLSHEQWRSFHNDKKTAEARNFLDGDLIESFLDLSRSKMEEVSKAMGVPVEELSKRVEELTRLH

SEQ ID NO: 56711 - protein, 371 aa, Ipomoea nil
MVSTITATVPSRVERLASSGIERIPKEYIRPEEERRSIGDIFEEEKIAGGPQVPTVDLKGINSEDLEVREKCREELRKAAVDWGVMHLVNHGISEELTGRVKAAGEGFFGQPIEEKEKYANDQAAGNVQGYGSKLANNASGQLEWEDYFFHCIFPEDKTDLSIWPKTPSDYIDATKEYAKQLRALATKVLAVLSLGLGLEEGRLEKEVGGMEELLLQMKINYYPKCPQPELALGVEAHTDVSALTFILHNMVAGLQLFYGGKWVTAKCVPNSIIMHVGDTVEILSNGKYKSILHRGVVNREKVRVSWAVFCEPPKDKILLQPLPETVSEAEPPRFPPRTFAQHIKHKLFRQSDQEAADTPKPDNDDHHQSN

SEQ ID NO: 56712 - protein, 1077 aa, Oryza sativa
MEGGSNDFPGDLLRAVLQRLPPPDLARAACVCRLWRGVASDRAVLEAAFASPWGVRRVVGEPETRAFWRAASLARFALSHTVRRGDTVPGIALKYSIQVTDIKRFNNMMSDHGIYLRERLLIPISNPEILQGSTCYIEMDYNARREVAVFYPQGRPSGKAESSTNTAAAERRSRRILESVKRSLHTDDRTAAYYLSVTDGDPRAAMMEYSEDLRMLGGLKDKLTGKNGNKIKGLAVLMSRKLLDPRDFTASLLDNVHEVFGNSITCQLVSATVADQNNEGRGIVGSEANLEQGLTDLPSVSQGESKLTVRFNWEMDKHGVPGAIIIKNHHSTKFFLKTITLHDVPGCDTIVFVANSWIYPVGKYHYNRIFFANNSYLPSQMPEALRPYREDELRYLRGEDRQGPYQEHDRIYRYDVYNDLGEPDRDNPRPVLGGSQKHPYPRRGRTGRIPTKKDPNSESRLSLLEQIYVPSDERFAHLKMSDFAGYSIKAIVQGILPAIRTYVDLTPGEFDSFEDILKLYRGGLKLPSIPALEELRKSFPVQLIKDLLPVGGSYLLKFPKPDIIKENEVAWRTDEEFAREILAGLNPMVIRRLTEFPPKSTLDPSKYGDQTSTITPAHIEKNLEGLSVQQALDSNRLYILDHHDHFMPFLIDINSLDGIFTYATRTLLFLRDDDTLKPLAIELSLPHIEGNLTSAKSKVHTPASSGIESWVWQLAKAYVAVNDSGWRQLISHWLNTHAVMEPFVIATNRQLSVTHPVYKLLQPHYRDTMTINALARQTLINGGGIFEQTVFPGKHALAMSSAVYKNWNFTEQGLPDDLIKRGIAIKDPSSPSKVKLLIKDYPYATDGLAIWQAIEQWVTEYCAIYYPNDGVLQGDVELQAWWKEVREVGHGDLKDADWWPKMQSLPELTKACTTIIWIASALHAAVNFGQYPYAGYLPNRPTISRRPMPEPGSKEYTELDENPEKFFIRTITSQFQTILGVSLIEILSKHSADEIYLGQRDTPEWTSDPKALEAFKRFSRQLVEIESKVLNMNKDPLLKNRVGPANFPYTLMFPNTSDNKGAAEGITARGIPNSISI

SEQ ID NO: 56713 - protein, 235 aa, Acidovorax avenae subsp. avenae
MLECSPAALVARADAAIVDLDGTMVDTLGDFAEALRRMLGELSLPGIEAAQIERMVGKGTEHLLRSVLDHVLQPMEPQRRAAAVEAHYPQAWEAYGRHYLAINGSHSRVYEGVAEGLLALRAAGLRLACVTNKPMAFAVPLLRAKGLDGFFDHVFGGDAFERKKPDPLPLLKACEALGTAPARTLAIGDSVNDARAARGAGCPVVLVTYGYNHGQPAREVDADAHVDSLQALCAG

SEQ ID NO: 56714 - protein, 630 aa, Hordeum vulgare subsp. vulgare
  misc_feature (602)..(602): Xaa can be any naturally occurring amino acid
  misc_feature (614)..(614): Xaa can be any naturally occurring amino acid
  unsure (1)..(630): unsure at all Xaa locations
MSKFLAIGLLLLHLINHGIYLVKAWDDKDFFKYCPPSQCSQHGPEIRFPFCLESSNKSSSSSSSSSCGCDGRSIRKLACSGQDTILVHPFLGPYSVSAIDYRHSSMKVIPLVDPCLMLNQNLIISRNSSSLQIDVINVYKTKFDRDFFWPSYAAVVRCSREFSPGADDRIVGPVSCLSNATHFFYFVASYADMSILPLDCKAAPLSHGVSGSLIPMYWSCSPYNLGSFKEGAETFLSSAETTVCWLGSECRKCEIIGGRCAFSSERNLAFCMPGGSRIKVIAATSSVAAFVVLLLTVAIVLYLSLKTRYNAEIHLKVEMFLKTYGTSKPTRYTFFEVKKMARRFKEKVGQGGFGSVYKGELPNGVPVAVKMLENSRGEGEVFINEVATIGLIHHANIVRLLGFCSEGMRRALIYEFMPNESLEKYIFSDDPNIFQNLLVPDKLVDIALGIARGMEYLHQGCNQRILHFDIKPHNILLDYNFNPKISDFGLAKLCARDQSIVTLTAARGTMGYIAPELYSRNFGGVSYKSDVYSFGMLVLEMVSGRRDSDPSIESQSDVYLPEWIYEKVINGEELALTLGATQGEKEKVTQLAMVALWCIQWXPRNRPSMTKVLXMLTGRLQTCRCHQSRS

SEQ ID NO: 56715 - protein, 316 aa, Arabidopsis thaliana
MLVSSSKITRAREMVTKTEEKQLNQLEIQVDNGGGGTWEYLCLVRNLKVRRSEKVLKHGSSILNDQKKRSALGPDEWTLNEQVAIAAMDCQCLGVAQSCIKALQTKFPGSKRVGRLEALLLEAKGLWGEAEEAYASLLEDNPLDQAIHKRRVAISKALGKPSIAIELLNKYLELFMADHDAWRELAELYLSLQMYKQAAFCYEELILSQPTVPLYHLAYAEVLYTIGGVENIISARKYYAATVDLTGGKNTRALLGICLCASAIAQLSKGRNKEDKDATAAPELHSLAAAAVEKEYKQKAPDKLQLISSALRILKT

SEQ ID NO: 56716 - protein, 675 aa, Hordeum vulgare subsp. vulgare
  misc_feature (177)..(177): Xaa can be any naturally occurring amino acid
  misc_feature (646)..(646): Xaa can be any naturally occurring amino acid
  unsure (1)..(675): unsure at all Xaa locations
MGNPGAFHHSITLQSLTVFSLVAVLAADHVQGRDDGCAPFSCGHLQDIRAPFRRQGDPLECGVEAYELGCNSSKANIHISTGTYYVTAINYTGSYFWVIDTNFDTISSCPLPLWNHVPYGRYLGGINSVSPPGFLYLVSQSYDIACFANCSQAVTDSSSYKPVSCLSANNSHVYVWXSHYSCVVEDFEPYCGYLAKIPFGKDYTPYWHNASYADITQFIGKGFTVQFPVDIMGPSASVKLRKNINICLNNSISYFKEQASGASIVNWAHAFFWSEVHFLECVTQSSEDHYCTTQFLLAVVTIFLAIAIPKFFFVLCRLLLAPLAVWIFLAYKYMKTRIIIDAVEKFLRIQQMIGPTRYSYTDIVAVTSHFRDKLGQGGYGTVYKGILLPGGVHVAVKMLEGNSNCNGEDFISEVSTIGRIHHVNVVRLVGFCSEEMRRALVYEYMPHGSLDKYIFSAEKSFSWDKLNEIALGIARGINYLHQGCDMQILHFDIKPHNILLDSNFVPKVADFGLAKLYPRGDSFVPLSAMRGTVGYIAPEMISRSFGVISSKSDVYSFGMLLLEMAGGRRNADPNMGSSSQAYYPSWVYDRLTQEEAGETSAVAADMHELEKKLCVVGLWCIQMRSRDRPTMGEVIEILESGVDGLXMPSRPFFCDEGHIHVEDSYHFTSELTAVS

SEQ ID NO: 56717 - protein, 344 aa, Burkholderia thailandensis E264
MSSGQPPSTNEGASQPEGAIGSAIPASFPSGSHGFARPTTVSPRSAVRLDRRIAAVVTLLPALGTAAAIALWIGGHGPGAAEWIVFAIFYFATALGLEVGFHRHVTHKAFKAKPWVRAALIALGSMGAHGPVNWWASTHRRHHSTSDGCGDPHSPHLSGDGIGGRLKGLYHSHMGWLFVGESTRPAGWEKYVPDLYQDPLVFRQHMAYYRWVAIGLVLPPFVCGLASRSWMGVLLGFLWGDMARIFAVSHCIWALNSLCHVIGRRDFHTTAHDRSRNSLLLAIPTFGQGWHNNHHAFPASAFTGLHWWQIDPGGLFVRVLERLHLVYDVHRPNAELIEKKRIAP

SEQ ID NO: 56718 - protein, 696 aa, Oryza sativa (japonica cultivar-group)
MCRGSVLLLRVHAALLLLAALPALIAGQPWEICGENGNYTANSTYQANLKQLAAALHKNVSSGTGGGRLFASGAVGAVPDAVYALALCRGDINASACADCVGTIFQDAQQLCPYRKEVSIVYDSCYLRFSNLDFLSSADNSGVVDLYNTGTVSGDVGRYDRAVTGLLNATARYAAGNTNASSRLFATGVMVGFDAQFPKIYAMAQCSPDLSPAQCGLCLGAMVARWWQTFEPNTQGARSVGARCNMRVELYSFYNVPSMLQLQAEAVAPSPSPAPAPAGKPPAVPGTTGGKRRNGAGKVLAIVMPIVAAILAVTVIGFCFWRRRRPEKTPPPGPLRSASRSEDFESIESLFLDLSTLRIATDNFSENNKLGEGGFGVVYKGSLPHGEEIAVKRLSQSSVQGMGELKNELVLVAKLQHKNLVRLVGVCLEEHERMLVYEYMPNRSLDTILFDAEKSSLLDWGRRLKIINGVARGMQYLHEDSQLKIVHRDLKASNVLLDSDYNPKISDFGLARLFGGDQTQDVTNRVVGTYGYMAPEYAMRGHYSVKSDVFSFGVLVLEIVTGRRNSGSYYSEQSGDLLSIIWEHWTMGTIMEMVDRSMGERAAGGEIARCIHVGLLCVQENPASRPAMSAVNVMLSSGTVSLKAPSRPAFYIRKGGGDDGGGTGSYSGSFVGTLPSSGRSAPMSPNEVSITELEPR

SEQ ID NO: 56719 - protein, 669 aa, Hordeum vulgare subsp. vulgare
  misc_feature (668)..(668): Xaa can be any naturally occurring amino acid
  unsure (1)..(669): unsure at all Xaa locations
MGNPGAFHHSITLQSLTIFSLVAVLAADHVQGRDDGCTPFSCGHLQDIRPPFRRRGDPLECGVEAYELGCTSSKATIHINTGTYYVTAINYTGSYFWVINTNFDTSSSCPLPPRNQFLLVGIDSVSPPGFRYLDTAMYYTACFANCSRAVRDNSSYKPVSCLSASNSHVYVWVSPYGCMVVDLEPYCGYLAEIPFDYEYSEEYWQNASYADIIQVISKGFIVRFPVDTMTEPSDSVKLRKNMNLCLNNSISYFKEQSSGASIVNWTHAFFWSEVHFLECVTQLFPEDADYKYNDHYFTTPFVLVVVTIVSAIVIPKFLFVLCRFLLAPLAVWIFLAYKYWKTRIIIDAVEKFLRVQQLIGPTRYAYTDIIAITRHFRDNLGQGGYGSVYKGVLLPGGVHVAVKMLEGNSNCNGEDFISEVSTIGRIHHVNIVRLVGFCSEEMRMALVYEYMPNGSLDKYIFSAEKSFSWDKLNEIALGVARGINYLHQGCDMQILHFDIKPHNILLDSNFVPKVADFGLAKLYPRGDSFVPLSAMRGTVGYIAPEMISRSFGVISSKSDVYSFGMLLLEMAGGRRNADPNAGSSSQAYYPSWVYDQLTREEVGEISPVAADMHELEKNLCVVGLWCIQMRSRDRPTMSEVIEILEAGVDGLQMPSRPFFCDEGHIHVXG

SEQ ID NO: 56720 - protein, 260 aa, Bacillus thuringiensis serovar konkukian str. 97-27
MLKSYRAVLVSLSLLLVFVLSGCSNATPIDAHSTGIWDHYFVYPISFMIQFVAHHIPGASFGIAIIIMTLVIRSAMIPLAVSQYRSQAKMKKMQPELQKLKQKYGDVSKDLEKQKQYQKEMSELMKSGGWNPLAGCWPLLIQMPIFSALYYAISRTEEIRTSTFLWVNLGHADPYHILPIIAALTTFIQMKVFQSNSTPGEQVQMLKMQQIMMPAMILFMGFAAPSGLVLYWITGNLFTMMQTIVLRKIMEREELQLQKA

SEQ ID NO: 56721 - protein, 211 aa, Zea mays
MFADAGFSFSAYSSSPPGPAYSYSYSYSSSPTVLSHPHPDHSSFSSPPSSAAPAQPPPPPLPLPLPLLHQQHQHQHQHQAAAAVATASNDDDDDAMYHHLGDMGQPSLISEYDLGAEGDLFKAPEPIIEEPLLALDPVAAAISMMSGGDNAMDDSIKVSDMRLSEVLYECEKELMEKSAIEETISELLDVKIPMLQVEERPGELRASSSST

SEQ ID NO: 56722 - protein, 344 aa, Arabidopsis thaliana
MGFRSVYQSLTELFPQIDPKILRGVAIEHQHDADEAASVVISEIFPFSSPNSTQPHNKNKTKVSDNPPNLKVKCDDGSLSLSQWLQPSKLPHSYLALLNEDSTPNVKPPLDYVVEKVVLPSRGPATGLGGGIRTMYSSDNIGGSSLVKPSIRVQSRTNNELSGSSSKVPGRRRSSRKSVQPWSPDYSEKLRSWKKRSNNNNRDFSQLFDNDIDVPSTRSNKCYTNERERKQRIADNIKALGKLLPHKVEGDNHELTLNAMVDHVKLLHLQMKELSRSRLGGEPISHPMAFIEGYGHYIHHEQTMAKSLEEVMEDLLTKDFDAAANLLESKGLYLTPLSSVQGSC

SEQ ID NO: 56723 - protein, 353 aa, Leptospira interrogans serovar Copenhageni str. Fiocruz L1-130
MISENLGENQTEKIPLKGRTLKELSEIMITLGEKPFRAKQIYHGLYVNRYETWDQFTTFSKIFKEKLEELCSLTHLQVVKQLKSVDGTQKFTFTSESGNGKEFEAVWIPSGDGGRKTICISSQIGCTLNCKFCATAKLEFQGNLKAHEIVDQILQVEKIVGDKATNVVFMGMGEPLHNYFNVIRAASIFHDPDALNLGAKRITISTSGVVNGIRRFIENKEPYNFAISLNHPDPKGRLQIMDIEEKFSLPELLQAAKDFTRELKRRITFEYVMIPGVNMGFENANKLVKIAKSLDCKINVIPLNTEFFGWRRPTREEIAEFIALLEPAGVPILNRRSPGKDIFGACGMLASKS

SEQ ID NO: 56724 - protein, 634 aa, Leptospira interrogans serovar Lai str. 56601
MKDRNFSDSISELEFVKTELEREKKEEDSIFSKDWLSRPIPDRVRQGITLYPIVYEEQTLGREGNWILTFRFSNQEEYPIKFQTGAPVQLGKNEDRAKAILVSLHKEKIKISIEEVPEWAEEGKCFLDLLPDETSYKEMFNALDAVRLATKGTRLYVNREFLLGYGKPDLISTRDSDRSRILGRISTSLNESQKNAVIHSVLSEDVMIIHGPPGTGKTTTLTEIVSQLVAEEKKILVSAPTNSACDLLVESISARGILVLRLGHPARINEIAIHSTLDYKLFHHPDGKLLNEYRKDVIEISKQAKKFKRNFGEKEREERKKLFTEVKELKKTIRSMEIGLIDSLVSSHPVIVSTPVASARGILENRTFDFCVLDESSQALEPAFWIPILKSDRVILAGDHKQLPPTLFSEKNYLETTLFEKAVENLESYGRVFLLDTQYRMKDEISAFPSKEFYSGLLKSGRSEKERKSNFPKTFPFLNAFQWIDTSGTDSEEVILDDSISNPFEADLQVRLCFLLKENDWPEDEITILSPYRAQVRLISEKLRDVGLTKINVSTIDSFQGRENRCILLGFVRSNLEGRSGFLKESRRINVGMTRARDLLLCIGDSSTLSQDPFLSKLIRFAEEKEVFRTAWEF

SEQ ID NO: 56725 - protein, 666 aa, Xanthomonas campestris pv. campestris str. ATCC 33913
MTQPTRRQLANAIRFLAADAVEAAKSGHPGMPMGMADIAEVLWNDFFRHNPNNPQWFNRDRFVLSNGHGSMLQYALLHLSGYDLPIEQLKQFRQLHSKTAGHPERSETPGVETTTGPLGQGFANAVGFALAEKLLAQRYNRPELEIVDHRTWVFMGDGCMMEGISHEAASLAGTWGLGKLVAFWDNNQISIDGNTAGWFSDNTPARFEAYGWHVIRDVDGHDADKIKAAIEAALENSDKPTLICCRTKIGFGAPTKSGKESSHGAPLGKEELEGARKALEWPYGPFEIPEEIYAGWRAGGTGTLRQAEWEQLFDKYAKQYGEQADELTRRSRGELPADFIVQADAYIAKAQEDGQTIASRKASQLAIEAFAPLLPELVGGSADLAHSNLTLWKASKSVATDDPNANYVYYGVREFGMTAIANGLALHGGFIPFDATFLVFSDYARNGVRMSALNPAHAIHVYTHDSIGLGEDGPTHQPVEHLASLRYIPNNDVWRPGDAVESAVSWKAAITRKDGPSCLVFSRQNLQHQPRSAEQIKLIERGGYVLADAEGGTPDVILIGTGSEVGLAVEAKKTLDAAGLKTRVVSMPSTDVFDRQDAAYREQVLPNAVRKRVAVEAGVTGFWRKYVGLDGDVVGIDTFGASAPADQLYAYFKITAEHVVEAAKAL

SEQ ID NO: 56726 - protein, 149 aa, Glycine max
MGWNLLFWLVICFPANIALLASTFYQVLILSDLESDYINPFDAASRINYFVLPEYVGQGALCALCLFTGHWFMFLLTVPVTCYHLRLYVKREHLIDVTEVFRVLNAEKKYRIAKLALYLTVLIVTIFRLTLTAVYYLGIEDDEDIGNLW

SEQ ID NO: 56727 - protein, 303 aa, Brassica napus
  misc_feature (287)..(287): Xaa can be any naturally occurring amino acid
  unsure (1)..(303): unsure at all Xaa locations
MDPSHQRVEQSQVTLPRDDDNEGTESRDVIVGNCDVVTELGLGSGTVFIENIGGDSDVVDVNNLNDFDEPDDDDLEVRGITSMGSEIRLITIESGSDDDDHDHENEREVWGIDLNDDDDVNDDDDDDDDDVNVTIPLCWDSLQVEDRGVAAEEFDWEEVDGGGGLVDEREILTGFAEIDDGDGDGLEDEREIEILTGFAEADIDEDTSVSISISPMISSEGLDTGERTEGAANLEWEVLLNSHTLEINFDVGNREIFLTGDNEVNINAPEYDMLFEQFSQAGLANLXRFPSASRSFIKDLPMV

SEQ ID NO: 56728 - protein, 305 aa, Pyrococcus abyssi GE5
MVLVMICSIGELLVDVIATEEGDLKDVRLFEKHPGGAPANVAVGIARLGFDSCLVSKVGDDPFGEFLVESLRRENVKTDGIVKDEEKHTGIVFVQLTGVSPSFILYDGVAYFNLRREDINWELINSSRIVHFGSVILARSPSRETVLDVIKRVKTIVSFDVNLRLDLWKNRGEDMLRTIEEAIKLADIVKASEEEVDYLEDNGIEVEGKLITAITMGSKGAKLNGIQVPGYKVNPVDTTGAGDAFTAALLVGIMKVREITNENLEKIGKFANLVAALSTLKRGAWSVPKVEELLKYKEAREILRL

SEQ ID NO: 56729 - protein, 397 aa, Clostridium tetani E88
MLSKKGKEISPSVTLAITAKANEMKKDGIDVVGFGAGEPDFNTPENIQNAAIKAMREGYTKYTPVSGVVELKDAIVNKFKKENNLIYKSSQIIVSTGAKQCIANLFMAILNPGDEVLISAPYWVSYPELVKLADGVPVFVDCKKENDYKYSIDELEKRVSSKTKAIIISSPNNPTGSIYYEEELRDIAEFCKKHNLIILSDEIYEKLIYGHNKHISIASLNEDTYNRTVVINGVSKTYAMTGWRIGYAAGPGNVIKLMNNIQSHMTSNPNSIAQYAALEALTGEQESINSMVSEFEKRRNYMVERINSINGIECIEPKGAFYMFADINKVIGKKINGEEIKNSVDFCEKLLELYKVAVVPGAAFGLENHIRLSYAISMENIEKGLDRISNCVSELQS

SEQ ID NO: 56730 - protein, 260 aa, Brassica napus
  misc_feature (99)..(99): Xaa can be any naturally occurring amino acid
  unsure (1)..(260): unsure at all Xaa locations
MGSLPPTHLDFSSANHQDISKDNLVSLFKSQQDLLNHFFKHLDLSQTLSFSRLLLSASGTVFFTGVGKSAFVANKVSQTLVSLSFRSSFLSPLDALHGXDIGALSPRDILVLFSKSGATEELLRLVPCAKARGAFLVSLTSVPGNPLAGVCDMNVHLPLERELCPFNLAPVTSTAIQMVFGDTIAVALMAARNLTKEEYGANHPAGRIGKSLIFKVKDVMKKKDELPVCKEGDLIMDQLVELTSKGCGCLLVVDEGHRLI

SEQ ID NO: 56731 - protein, 371 aa, Triticum aestivum
  misc_feature (215)..(215): Xaa can be any naturally occurring amino acid
  misc_feature (237)..(237): Xaa can be any naturally occurring amino acid
  misc_feature (287)..(287): Xaa can be any naturally occurring amino acid
  unsure (1)..(371): unsure at all Xaa locations
MADKENSAYAAAAAPRTTRASAKRAAAVTAVAVAAKRKRVALSEIPTLPNGAPQPQTKPKKSSSQVAKPKKRSVSSLSLPAPKPAPGAADETGDPQLCAPYASDIYSYLRSMEVQAKRRPAADYIERVQVDVTPNMRGILVDWLVEVAEEYKLVSDTLYLTVSYIDRFLSANSLNRQKLQLLGVSAMLIASKYEEISPPNVEDFCYITDNTYMKXQELVKMERDILNNLKFEMGNPXTAKTFLRMFIKSGQEDKKYPSLLLEFMGSYLTELSLLDYGCVRFLPSAVXAASAVFVARLTLNPDSNPWSKKLQSVTGYRASELKDCITAIHNLQLSRKGQSWNAIRDKYKQHMFKGVSSLLPPVGIPASYFED

SEQ ID NO: 56732 - protein, 488 aa, Legionella pneumophila str. Paris
MEIYEMYIDGKFTLAKSGTTRDIFDPANGELIARVPESAKEDAILAIKAARKAFDEGEWRKSLALDRGKLLFKLADLIRANAKMLAELETRNCGKPLPEAEFDVTDAANCFEFYGGLATKIHGETMSVPANSFSYVVREPIGVCGQIIPWNFPLLMAAWKLAPALAAGNTAVLKPSELTPITALELFKLIDQCGFPAGVVNLITGTGIGVGEELANNAMVDKVAFTGGSATGRKIMQAATGNLKKISLELGGKNPNIVFADCDLEMAIDGALFGAFANQGEVCSAGSRLLVERSIHKKIVEGMLKKIPNIKLGHGLDAGVKMGPLVSSAHREKVESYVKLGMEEGAKLLCGGKRPTGSEFAKGNFFEPTIFDEVKSTMRIAREEIFGPVLVVIPFDTEEEAIRIANDTDYGLSGAVWTKSVTRAHRVTSQIRAGILWVNHYHPTYNEMPWGGYKQSGAGRELGLYGIESYLEVKQVNINLDETPIGWY

SEQ ID NO: 56733 - protein, 363 aa, Buchnera aphidicola
MKKNYRIAVLSGDGIGPEVMQEACKILNVLKKYFFLSLEIQKFNIGGIAIEREGVALPKTTLLGCENSDSILLGSVGGKKWDNLPVEQRPERAALLPLRKYFNLFSNLRPAKLYPELKCLSPLRSDIVKNGFDILCVRELTGGIYFGEPKGFVNKNNTKYAFDTEIYHEYEIIRIAHLAFKLARSKKKKVCSIDKSNVLRSSILWGKVVESVSKKYPDVHLSHLYIDNAAMQIIKDPNQFDVLLCSNLFGDIISDECATITGSIGMLPSASFNEKNFGLYEPAGGSAPDIEGKNIANPIAQILSLSMLVRYGMNLNQIADKIDKAVNNVLKKGYRTSDISHDNNFLKTDEMGDLIVDSLINGK

SEQ ID NO: 56734 - protein, 390 aa, Burkholderia thailandensis E264
MSETKEAAATGAAGGFKPKKSVALSGVAAGNTALCTVGKTGNDLHYRGYDILDIAGSSEFEEIAHLLVHETLPNVTELAAYKAKLRAMRGLPANVKAALEWIPASAHPMDVMRTGVSVLGTVLPEKDDHNLPGARDIADRLMASLGSMLLYWYHYSHNGRRIETETDDDSIGGHFLHLLHGKAPSKSWVDAMHTSLILYAEHEFNASTFTGRVIAGTGSDMYSSITGAIGALRGPKHGGANEVAYEIQNRYRTPDEAEADIRRRVENKEVVIGFGHPVYTISDPRNKVIKEVARKLSKEAGDLKLFNIAERLESVMWEIKKMFPNLDWFSAVSYHMMGVPTAMFTPLFVIARTSGWSAHIIEQRVDNKIIRPSANYTGPEDLKFVPIEKR

SEQ ID NO: 56735 - protein, 711 aa, Oryza sativa (japonica cultivar-group)
MATTVATAMRRRRNLTPCDSRLATAVPLLVAFLLLLHAPPLAEAQPLPWQMCDTAGGNYTEGSTYQANVRALASALPVNASSSRALFAKGAAGAAPDVVYAIALCRGDTNASSCAACVATAFQDAQQLCAFNRRATMFDDPCILRYSDQDILANATDGQGNFIAWNYNNVSAARAAAFDAASGRLVNATAGYAAADPVRRFGTGEVGFDDATYPRIFSLAQCTPDLSEADCRSCLGRIIRWVPQYFAGKPGGRVFGVRCNFRFESYSFFSGRPLLQLPGPPPAPAPSPANMAPPSPPGTMGGRTRHRTGRVLAITLPIAGAILALIVLTCFCFWRRRTPARKASPVPYSTNPDDIQSIDSLLLDLSTLRAATDNFAERNKLGEGGFGIVYKGVLPEGREIAVKRLSQSSRQGIEELKTELVLVAKLRHKNLVSLVGVCLEEGEKLLVYEYLPNKSLDTILFDYEKSKDLDWGKRLNIVSGVARGLQYLHEDSQLRVVHRDLKASNVLLDFDHNPKISDFGLAKLFEWDQTQDVTSHIAGTYGYMAPEYAMRGQYSVKSDAFSFGVLIIEIVTGRRNSSFSNSEQSIDLLSLVWEHWTTGTIEELLDPAIGSRAVNVLLKLINIGLLCVQDNPADRPAMSAVNVMLSSDTVSLQAPSRPTFSIQEMDGAADTDLYESGAYPRSAFQPTGDGNTRAAAAASPNELSLSELEPR

SEQ ID NO: 56736 - protein, 469 aa, Candida albicans SC5314
MFRTQSRYLVRSILANHCVLPSTRMAVSPILNQSIKFYSSKDNATDKSQEKEQPKSILNDDMLARAGFEDVDPKEETSNSEEQATKQTGRKRKRAQTSKDLQRERYANMFYLSALIFGVAGVGYMSRDWDSEKEQEEMDGKNVENGYTPKLMYERLSKRLGSLFTFFSEPAFENLLPPPPPEQYRRPLTLVVTLDDFLIHSNWDTQHGWRTGKRPGLDYFLGYLSQYYEIVVFSSNSQIYSDKTVNKLDPYHAYISYALFREACRYKDGKLIKDLSLLNRDLGKTVMIDVDEDSAALQPENSIIVKKWEGQPDEYLISLIPFLEYLATQPVKDVRPILNSYKDKSNIVAEFAERENKLREQWRKDHGGNNGKPNAGNFIAKLLGIPVPEPKMPLDIIREHGQLQYEHFQKYLQENAHKFLEEEQKLKDEFGKVTLNKLITEGAPNAEEIAKVQQQRALEEAQKQQEGHK

SEQ ID NO: 56737 - protein, 698 aa, Oryza sativa (japonica cultivar-group)
MATAVAATAMRRGQHLPLSLSLCYNLAAVALLVAVFLHAPPRAGAQPLPWQLCNATAGNYTEGSTYQANVRALASALPGNASSSPALFAEGAAGTAPDVVYAIALCRGDTNASSCAACVATAFDTAQQLCAFNKRATLFNDPCILRYSDLDILANVTDNSGRFVAWNYNNVSAAKAAAYDAASGRLVNATADYAAADPVRRFGTGEVGSDDATYPRIFSLAQCTPDMSEADCRSCLGDIIRKATPKYFVGKPGGRVFGVRCNFRFEAYEFFSGRPLLQLSGPPPPPANMTPPVTSEGRTSHRTGRILAITLPIAGAALAFIALTCFCFRRKRTPANKASSLPFSTNPDDIQSIDSLLLDLSTLRAATDNFADRNKLGEGGFGAVYKGVLSEGQEIAVKRLSQSSRQGIEELKTELVLVAKLRHKNLVSLVGVCLEGDEKLLVYEYMPNKSLDTILFDYEKSKDLDWGKRLKIVSGVARGLQYLHEDSQLRVVHRDLKASNVLLDFDHNPKISDFGLAKLFEWDQTQDVTSHIAGTYGYMAPEYAMRGQYSVKSDAFSFGVMILEIVTGRRNSSFSNSEQSIDLLSLVWEHWTTGTIEELLDPAMRGRSADDLLKLINIGLLCVQDNPADRPTMSAVSVMLSSETFSIQAPSRPTFCIQETDSAADTDLYSSALRSTGDSKTRAVASPNEVSLTELEPR

SEQ ID NO: 56738 - protein, 159 aa, Triticum aestivum
  misc_feature (58)..(58): Xaa can be any naturally occurring amino acid
  misc_feature (72)..(72): Xaa can be any naturally occurring amino acid
  misc_feature (82)..(82): Xaa can be any naturally occurring amino acid
  misc_feature (101)..(102): Xaa can be any naturally occurring amino acid
  misc_feature (110)..(110): Xaa can be any naturally occurring amino acid
  misc_feature (114)..(114): Xaa can be any naturally occurring amino acid
  misc_feature (130)..(130): Xaa can be any naturally occurring amino acid
  misc_feature (132)..(133): Xaa can be any naturally occurring amino acid
  misc_feature (139)..(139): Xaa can be any naturally occurring amino acid
  unsure (1)..(159): unsure at all Xaa locations
MAPTVMASSATSVAPFQGLKSTAGLPVSRRSNGASLGSVSNGGRIRCMQVWPIEGIKXFETLSYLPPLNTEXLLKQVDYLIXRSKWVPCLRIQQVGSTFPXXHNATPGVXTIGXYWDNVETAISGCTDAXQXXNKLEEXKKDTLTLFRISGTTSSSCST

SEQ ID NO: 56739 - protein, 695 aa, Oryza sativa (japonica cultivar-group)
MRRHRPYLDGVAAAAATFLLAVLLHAPLAAGEDEPPPWVLCGPYPPSGNYSKNGTYQVNLDLLSTTLPKNTSSSPAMYATGTVGDVPDKVYGLALCRGDANASACERCVAAALRDAPRRCPLVKDVLVFYDLCQLRYSNRDFFLDDDYFVTTYTLQRSRRVGAAAAAAFDAAVAVLVNATADYAAADSSRRYGTGEEEGVDGDSDRPKIYALAQCTPDKTPEVCRTCLSTVIGQLPKEFSGRTGGGMFGVWCNFRYEVFPFFSGRPLLQLPAFVETPPPPPSPSATSGEKTKNRIGTVLAIVMPAIAAILLMVVACFCCWKRIKKRRPEEQTFLSYSVSSDDIQSIDSLILDLPTIRVATDDFADTKMIGQGGFGMVYKGVLPDGQEIAVKRLCQSSRQGIGELKSELILVAKLYHKNLVRLIGVCLEQQEKILVYEYMPNGSLDIVLFDTDKNRELDWGKRFKIINGIARGLQYLHEDSQLKIVHRDLKASNILLDFDYSPKISDFGLAKIFGGDQSEDVTNRIAGTYGYMAPEYAMRGNYSIKSDVFSFGVLVLEIITGRRNTGSYDSGQDVDLLNLVWEHWTRGNVVELIDPSMGDHPPIEQMLKCIHIGLLCVQKKPASRPTISSVNIMLSSNTVRLPSLSRPAFCIQEVSASDSSNPYSERYPRPRHSGYSDNSTVVSSNDLSITELVPR

SEQ ID NO: 56740 - protein, 205 aa, Triticum aestivum
  misc_feature (61)..(61): Xaa can be any naturally occurring amino acid
  misc_feature (66)..(66): Xaa can be any naturally occurring amino acid
  misc_feature (85)..(85): Xaa can be any naturally occurring amino acid
  misc_feature (99)..(99): Xaa can be any naturally occurring amino acid
  misc_feature (115)..(115): Xaa can be any naturally occurring amino acid
  misc_feature (160)..(160): Xaa can be any naturally occurring amino acid
  unsure (1)..(205): unsure at all Xaa locations
MAARLALVVALLCAGAAAAAAQQASNVRATYHYYRPAQNGWDLGAPAVSAYCSTWDAGKPXSWRSXRYGWTAFCGPAGPRGQASXCGGGIRVTNTGTGXARLTGEGFVDQCANGXGLDLDWDTVFVKIDTDGMGYQRGHLIVNYQFVDCRDNHINFHGKXNETLPASTGCCCVSKSYCSSTCMMLKMPHLLRCTHTCYECMARVG

SEQ ID NO: 56741 - protein, 645 aa, Oryza sativa (japonica cultivar-group)
MSMACYYLAAAAAGLALLLLHAPLTDAQTLVPLCGDSGNYTEHGTYHANIQYLATSLPSYASSSPSLFASGSSGTVPDAIYALALCRGDTNSSSCATCVAAAIQSAQELCPLVKTVIVYDDTCILRFANDAFPISPTSNSQGMVVAWKAQNVSAAVAPAFEAAVVRLINTTADYAATDSVRRFGTGEEAFDETTFPKIYSLAQCTPDMAATACRSCLEDIVGRMVSGNLIGRMGGRVLGVRCNLWFEVYPFFSGRSLLQLPGPSPSPAPPVTAAGERSKNKRSAILAISMPTIALVLATIAAWFCSTSWRRRRLARKTLRPKSSEDEMQSFASLVLDLQTLRTATDNFSEHKRLGEGGFGVVYKGDLPEGQEIAVKRLAQTSRQGIEELKTELLLVAKLNHNNLVRLIGVCLEENEKILAYEYMPNRSLDTILFDAERIKELDWGQRFKIINGIARGLQYLHEDSQLKIVHRDLKASNVLLDSAYNPKISDFGLAKIFERDQSQVITHRIAGTYGYMSPEYAMRGQYSMKLDVYSFGVLVLEIITGRRNFGSYGSDHVVDLIYVTWEHWTSDKAIELIDPSLGNHYPVDKVLKCIHIGLLCVQPKPADRPLMSAVNAMLSSTGTVRLPCLSRPSFWVQEIGATAS

SEQ ID NO: 56742 - protein, 622 aa, Hordeum vulgare subsp. vulgare
MGVPPWAIWALLLLHPAARVLANTEGDALHSLRTNLNDPNNVLQSWDPTLVNPCTWFHVTCNNDNSVIRVDLGNAALFGTLVPQLGQLRNLQYLELYSNNISGTIPSELGNLTNLVSLDLYLNNFTGPIPDSLGNLLKLRFLRLNNNSLSGTIPKSLTAITALQVLDLSNNKLSGEVPSTGSFSLFTPISFGNNPALCGPGTSKPCPGAPPFSPPPPYNPPTPEQSPGSSSSSTGAIAGGVAAGAALLFAIPAIGFAYWRRRKPQEHFFDVPAEEDPEVHLGQLKRFSLRELQVATDTFSNRNILGRGGFGKVYKGRLTDGTLVAVKRLKEERTPGGELQFQTEVEMISMAVHRNLLRLRGFCMTPTERLLVYPYMANGSVASRLRERGPAEPPLDWQTRRRIALGSARGLSYLHDHCDPKIIHRDVKAANILLDEDFEAVVGDFGLAKLMDYKDTHVTTAVRGTIGHIAPEYLSTRKSSEKTDVFGYGIMLLELITGQRAFDLARLANDDDVMLLDWVKGLLKERRLEMLVDPDLQTNYIDVEVESLIQVALLCTQGSPMERPKMSEVVRMLEGDGLAERWDEWQKVEVSRQEVELGPHRNSEWIVDSTDSLHAVELSGPR

SEQ ID NO: 56743 - protein, 437 aa, Staphylococcus aureus
KLWLRNFMQAFFVVFFVYMAMYLIRNNFKAAQPFLKEEIGLSTLELGYIGLAFSITYGLGKTLLGYFVDGRNTKRIISFLLILSAITVLIMGFVLSYFGSVMGLLIVLWGLNGVFQSVGGPASYSTISRWAPRTKRGRYLGFWNTSHNIGGAIAGGVALWGANVFFHGNVIGMFIFPSVIALLIGIATLFIGKDDPEELGWNRAEEIWEEPVDKENIDSQGMTKWEIFKKYILGNPVIWILCVSNVFVYIVRIGIDNWAPLYVSEHLHFSKGDAVNTIFYFEIGALVASLLWGYVSDLLKGRRAIVAIGCMFMITFVVLFYTNATSVMMVNISLFALGALIFGPQLLIGVSLTGFVPKNAISVANGMTGSFAYLFGDSMAKVGLAAIADPTRNGLNIFGYTLSGWTDVFIVFYVALFLGMILLGIVAFYEEKKIRSL

SEQ ID NO: 56744 - protein, 438 aa, Bacillus anthracis str. Sterne
MQRFKLKEDVTMEQKPVLDVNEVPKPGKWLFLSIQHLFAMFGSTVLVPFLTGLNPSVALISSGLGTLAFLLITKGQVPAYLGSSFAFIAPIITAKTAGGPGAAMLGGLLAGLVYILISLGIKKSGSKWIMKLLPPIVVGPVVMVIGLALAHTAVNMAMNGADGKYSFTHFSVALVTLAITIICSIFGRGFFSIIPVLLGIIGGYIFAYFQGLVDLKPVAEAKWFVVPDFTVPFVTYTPEFSWKIVLLMVPVALVTISEHIGHQIVLGNVIKRDLIEKPGLHRSIFGDGVATLIASLIGGPPNTTYGENIGVLAITRAYSVYLFIGSAVFAIMFGFIGKISALIHSIPTPVMGGVSILLFGVIASSGLRMMVDDKTDLSDKRNLMIASVILVIGIGGAVLHVGESFQVEGMALAAIVGVLLNLLLPETKQIKQSKQIAS

SEQ ID NO: 56745 - protein, 421 aa, Clostridium tetani E88
MNVEELNPFKNVQKIMKKICEDLNLNESVYELIKEPSRIVEVNIPVKMDNGSIKVFKGYRSQHNNSIGATKGGVRFHQGVNLDEVKALSIWMTLKCAIANLPFGGGKGGIIVDPKTLSKGELERLSRGYVEKLYEVLGEDLDIPAPDVNTNGEIIAWMADEYNKLSRQNAWGTFTGKPVELNGSKGRTEATGLGVAIVAREALKKLNRNIENSSVAVQGFGNVGSHAALCIENLGGKIVSVSEWDREKGFYAIYDEKGLNIKELISYFNENGTLLDFPRTSKISEEEFWSLSVDVLVPAALENSINTNNANLINAKLVCEGANGPVTPAADEILEKKGIEVTPDILTNAGGVIVSYFEWVQNLDNYYWNEKDVKTREEEFLVEGFNNVWFMKDKFNCTMRNAAYMYAINKLAKSMKARGWY

SEQ ID NO: 56746 - protein, 128 aa, Zea mays
MAMSWTRGLKHGVVPRHAAQLVESRSLAIASKAKKGGKGDASKTPALSQELKSTTVFGANIFKEGSDPKIQPDSEYPDWLWHLLDKRPVLSELRRKDPKTLSYEDAERFVKLDNRSRIKIRNDLNAKN

SEQ ID NO: 56747 - protein, 514 aa, Oryza sativa (japonica cultivar-group)
MQFMMPLDTNACAQPMRRAGEGAGTERLMERLNIGGMTQEKALRKRCFGDGVTGTARRVFTSDADRDTPHLRTQFSRKNYADASHVSAVILGGGTGVQLFPLTRTRATPAVPVGGCYRLIDIPMSNCFNSGINKNIFVMTQFNLTSLNRNIHHTYLVGGINLTDGSVQVLAATQMPDEPAGWFQGTADAIRKFMWILEDHIHKSIDNIVILCGDQLYRMNYMELVQKHVDTNADITISCAPIDGSRASDYGLVKFDHSGRVIQFLEKPEGADLESMVDTSFLSYAIDDKQKYPYIASMGIYVLKKDVLLDILKSKYAHLQDFGSEILPRALLEHNVKVACVFTEYWEDIGTIKSFFDANLALTEQPPKFEFYDPKTPFFTSPRYLPPARLDKCKCKIKDAIISDGCSFSECTIEHSVIGISSRVSSGCELKIYETEEETSKLLFEGKVPIGIGQNTKIRNCIIDMNARIGRNAIIANTQGVQESDHPEEGYIRSGIVVILKNATNATIKHGTVI

SEQ ID NO: 56748 - protein, 450 aa, Legionella pneumophila str. Paris
MKHQLVGTKLMKKIHIKTPIPGPKSQQLMELRRQHVARGPFHATPIFVKQAKGSFVEDVDGNVFLDFSSGFGVVNTGHCPDSVVNAIKLQAEKFIHTGFNIIPYESYIKVCAKLNDHTPGHFEKKSLLLNSGAEAVENAIKIARAYTGKQAVICFDHAFHGRTYMAMTLTSKNKPYKHGFGPFPSEIYRAPFPYEYRWKGTNCVEECFNEFTDLANFRVGVENIAAVIIEPVLGEGGFIQSPALFLQKLREFCTTNDIVFIADEIQSGFGRTGNLFAMNTLGVPPDLTISAKGLGGGVVLAGVTGKAEIMDAAMEGGLGGTFGGNPLSCAAALEVFYIFEEGSLLQNVTHLAKALQSRLSGFKEKYKVVGDVRGLGVMQAIELVKDKNTKEPNKEAAVQLAQFCLEHGLIILTCGTYGNVIRLHMPLSTGVKDLETGLSIIEEGLKRLSI

SEQ ID NO: 56749 - protein, 463 aa, Streptococcus pneumoniae TIGR4
MNIFRTKNVSLDKTEMHRHLKLWDLILLGIGAMVGTGVFTITGTAAATLAGPALVISIVISALCVGLSALFFAEFASRVPATGGAYSYLYAILGEFPAWLAGWLTMMEFMTAISGVASGWAAYFKGLLSQYGIAFPQALNGTFNPQAGTFVDLLPILVLVLVTSLVLLNAKAALRFNSILVILKFSALALFVLVGIWNIKFDNWSNFAPYGFGQIYGASTGIMAGASLMFFGFLGFESISMAVDEVKTPQKNIPRGIVLSLSIVTILYALVTLVLTGVVHYSHLNVDDAVAFALRSVGISWAANYVSLVAILTLITVCISMTYALSRMIYSLARDGLVPAAFKELTKTSKIPKNATILTGLASAVAAGMFPLASIAAFLNICTLAYLIMLAYGLIRLRKEKGMPKAGEFKTPLVPLLPILSIIICLSFMLQYNMNTWIAFLVALLVGSIIYFTYGYKHSTIEE

SEQ ID NO: 56750 - protein, 310 aa, Legionella pneumophila str. Paris
MSSKLLTIQLLEELVHAAELNQEGKTADYIPELANVNQELTAIAVQPLGEKTLAYSNNPLHPVTLQSTGKMIPLIGLLEEFGADQLFEWVKVEPSGDDFASITRLEQFGPKPSNPMLNAGAIALCSRIPGVGEQQFRWLEHWVQKLFNQRLSINPLVFASEKRTGNRNRALAYLLKSRSNLGADVHETLDLYFALCSYEAMLDQMLYLPAVLANKGQDPDTGEQILSIETCKITLAIMATCGLYDETGTHMVKTGMPAKSGVSGYTIAVVPGKAGIVVLSPRVNAKGNSIRGEIMLEGLSKAMNWHFALP

SEQ ID NO: 56751 - protein, 394 aa, Pyrococcus abyssi GE5
MILMVTQEELIREARRNGMELYPIEKDTYELFFGPQHMATENFSIILKMDGNRVVKAIANPGFLHRGFEKLAEYRPWYTNIALLLRICVPESDVPEAIYSLAVDEIIGWEVPERAQWIRTTVLEMARVSAYLFWIMGLSFKLGVYTAGQWAAAYRERLMRLFEELTGARVYHIYTIPGGVRRDIPGDKWLRQLKDTVEYIKSKLPDFDNLVFENYITYRRMEGIGVMDKKFALAEGVTGPNLRATGVAYDVRKDDPYLLYPELDFEVPTLREGDALARALVRRYELEQDLYILEQLLEMGPPSGPYKVEDPRLKNLPRFKVPAGDAFAHVESTKGDFGAYVVSDGSHKPYRVHVRGPSIAHGIRVLEQLLVGARIADVPVILMSLDNCPPDIDR

SEQ ID NO: 56752 - protein, 471 aa, Sulfolobus solfataricus P2
MPSTAEDVLKFLKENNIKWVDLQFTDVPGRLHHITIPADEFDLESLKTGFGKLDGSSIRGFTSIYESDMVLLPVPETMTLIPWSPGVARVLCKVFWGGGKGRFERDPRFIAEEAEKYQTEQGYTSYYGPELEFFMFDKVKLDVSAPQSGTGYKIYAREAPWSDSGTFVIRFKEGYYPAPPVDQLMDVRVEIVDTLVKYFGYTIEATHHEVATAGQGEIDFRFSTLVDTADKVQTLKYVAKNIAAKHGLVVTFMPKPIYGDNGTGMHTHLSLWTKDGKKNLMYDPNDEYAEISQFGRYVIGGLLTHARALSAIVSPTVNSYRRLIPGFEAPVYIAWSKGNRSAVIRVPAYYRGMEKAKRIEYRPPDPSTNPYLAFAALLMAALDGVNKKIDPGDPVDENIYHLTPEKRRQLGIKELPRSLNEALDELESDKEFLKPVFNSSILDTYIDLKRDEARSLQGYPHPMELYYYLDS

SEQ ID NO: 56753 - protein, 214 aa, Pyrococcus abyssi GE5
MMLMPAKVVGEDKVKKQPSFVKPWLGLKYLFKKPVTIKIPYEKIDPAPKYRGFHTLDWKKCIGCNFCGQICPARAIEMTWIEVDGKMEKRPHPKIDYGRCTFCQFCVDVCPTGALGFIESYILTTTGDEEELQLFDWVPLPPDKFRELQEEYKDWRFPVEKIDFNEETKEVTYYLRNGEIFKFKILGYGLRPPKPPAKPKTQPKKEESQNQSKS

SEQ ID NO: 56754 - protein, 200 aa, Brassica napus
MALVVICGQPCSGKSTAAVALSEALKESETKQNVRIIDEDSFHLDRNQNYANMPAEKMLRGKLRSDVDRSVSRGDIVIVDSLNSIKGYRYELWCIARAAGIRYCVLFCDVDEDRCREWNKEREGRGEASYDDGIFEDLVRRFEKPERRNRWDSPLFELFPSRDRIEKSSPVVLEAVTYLTKTVDSKTQDVRILQPSIATQ

SEQ ID NO: 56755 - protein, 127 aa, Glycine max
MEQTFIMIKPDGVQRGLVGEIICKFEKKGFTLKGLKLITVDRPFAEKHYQDLSAKPFFNSLVDYIISGPVVAMIWEGKNVVLTGGKIIGATNPAASEPGTIRGDFAIDIGRNVIHGSDSVESATRKL

SEQ ID NO: 56756 - protein, 429 aa, Xanthomonas campestris pv. campestris str. ATCC 33913
MSDLDQVTLNAGDTSVVLPVLKPTLGNDCVDISKLTKETGLFTYDSGFTATASCKSAITYIDGDNGVLLYRGYPIEQLAEKSSFLEVSYLLMNGELPTADEFKKFDHEVTHHTMMHESLKNFLGGFRHDAHPMAMLAGSVASLSAFYHDTLDLNDPEQRRQAAIRLIAKVPTLAAAAYRYSIGWPIRYPRNNLNYVDRFLHMMFEVPSEPLEINPVVAKALDLLFILHADHEQNASTSTVRLVGSTGANPYASVAAGITALWGPAHGGANEAVLKMLEEIGTADNVESAVAKAKDKNSSFRLMGFGHRVYKNFDPRAKIIREMTHKVLGELGVNDPLLEVALKLEEAALKDDYFVQRKLYPNVDFYSGLIYKALNIPVEMFTVMFAIARTAGWVSHWLEQQVDPEMKIGRPRQIYTGYDKRDYTDAGKR

SEQ ID NO: 56757 - protein, 267 aa, Salmonella typhimurium
MAEPLTVSPELTANYAYFFDLDGTLAEIKPHPDQVVVPHKILQLLDRLAAHNAGALALISGRSMTELDALAKPFRFPLAGVHGAERRDINGKTHIVRLPEAVVREVEALLRSTLVALPGTELESKGMAFALHYRQAPEHEAALLALAQHVTQHWPQLALQLGKCVVEIKPKGTNKGEAIAAFMQEAPFAGRIPVFVGDDLTDEAGFGVVNHAGGISVKVGVGATQAAWRLESVPDVWRWLEQINYPQQEQQVMNNRRDGYESFSRSI

SEQ ID NO: 56758 - protein, 126 aa, Xanthomonas campestris pv. campestris str. ATCC 33913
MSQIIHTDQAPAAIGPYSQAVRAGNTVYFSGQIPLDPATGEIVPGDIGAQARRAFDNLKAVAEAAGGSLDKIVRLGLYLTDLGQFAAVNAVMQEYFQAPFPARSTIEVSGLPKGAGFEVDAVMVLD

SEQ ID NO: 56759 - protein, 178 aa, Triticum aestivum
MVGSGMQRGAPLVVGRVIGDVVDPFVRRVALRVGYASRDVANGCELRPSAIADPPRVEVGGPDMRTFYTLVMVDPDAPSPSDPSLREYLHWLVTDIPGTTGVSFGTEVVCYEGPRPVLGIHRLVFLLFQQLGRQTVYAPGWRQNFSTRDFAELYNLGLPVAAVYFNCQRETGTGGRRM

SEQ ID NO: 56760 - protein, 308 aa, Oryza sativa (japonica cultivar-group)
MSTCDSMKSPDFEYIDNGDSSSVLGSLQRRANENLRISEDRDVEETKWKKDAPSPMEIDQICDVDNNYEDPQLCATLASDIYMHLREAETRKHPSTDFMETLQKDVNPSMRAILIDWLVEVAEEYRLVPDTLYLTVNYIDRYLSGNEINRQRLQLLGVACMLIAAKYKEICAPQVEEFCYITDNTYFRDEDPALHLEFLANYVAELSLLEYNLLSYPPSLVAASAIFLAKFILQPAKHPWNSTLAHYTQYKSSELSDCVKALHRLFCVGPGSNLPAIREKYTQHKYKFVAKKPCPPSIPTEFFRDSTC

SEQ ID NO: 56761 - protein, 384 aa, Legionella pneumophila str. Paris
MMFGFLNMTVWGYLLTGFVLTHITTTAVTIYLHRYQTHRALTLHPLVSHFFRFWLWLTTGMTTAEWVAIHRKHHANTDMEGDPHSPQVFNIRKVFWQVPELYREASKDKDMIKKYSYGTPNDWIERKLYSPHANKGIFLMLALNLFLFGIPGLTLWAIQMMWIPLVAGVVNGIGHYWGYRNHESSDSSTNVFPWGLLIAGEELHNNHHTFASSAKFSIKWWEFDLGWFYIRCLSFLKLAKVKKLPPKLIIDKNKSHIDVDSVKAILGNRFQVISDYYKLVIFPTLRDMQYRIKNRDLKNARHLLKKPNEQLSHADQLRLKTLLKQHDNLQAVHNYRELLQQIWLKTSLSNKDLLNLIQKWCSQAEESGLLVLRQFASQLKSYSL

SEQ ID NO: 56762 - protein, 311 aa, Streptococcus pneumoniae TIGR4
MSYQDLKKCKIITAFITPFHEDGSINFDAIPALIEHLLAHHTDGILLAGTTAESPTLTHDEELELFAAVQKVVNGRVPLIAGVGTNDTRDSIEFVKEVAEFGGFAAGLAIVPYYNKPSQEGMYQHFKTIADASDLPIIIYNIPGRVVVELTPETMLRLADHPNIIGVKECTSLANMAYLIEHKPEEFLIYTGEDGDAFHAMNLGADGVISVASHTNGDEMHEMFTAIAESDMKKAAAIQRKFIPKVNALFSYPSPAPVKAILNYMGFEAGPTRLPLVPAPEEDAKRIIKVVVDGDYEATKATVTGVLRPDY

SEQ ID NO: 56763 - protein, 91 aa, Legionella pneumophila str. Paris
MKQKKIYVGNLPFGTTEEALSIQFSQYGKIEEMFLIKDRLTGQMKGFGFITFSAQQEAESALEMNGQPFDGRSLKVCMAQKKINSVSRSRW

SEQ ID NO: 56764 - protein, 391 aa, Staphylococcus aureus subsp. aureus COL
MVTQNKKILIITGSFGNGHMQVTQSIVNQLNDMNLDHLSVIEHDLFMEAHPILTSICKKWYINSFKYFRNMYKGFYYSRPDKLDKCFYKYYGLNKLINLLIKEKPDLILLTFPTPVMSVLTEQFNINIPVATVMTDYRLHKNWITPYSTRYYVATKETKQDFIDVGIDPSTVKVTGIPIDNKFETPINQKQWLIDNNLDPDKQTILMSAGAFGVSKGFDTMITDILAKSANAQVVMICGKSKELKRSLTAKFKLTRMYLILGYTKHMNEWMASSQLMITKPGGITITEGFARCIPMIFLNPAPGQELENAFYFEEKGFGKIADTPEEAIKIVASLTNGNEQLTNMISTMEQDKIKYATQTICRDLLDLIGHSSQPQEIYGKVPLYARFFVK

SEQ ID NO: 56765 - protein, 1420 aa, Cryptococcus neoformans var. neoformans JEC21
MSSPYSEDPGAATVVQSPASSSHTFEGELTNPYQQAKHDKTEDVPISYAKIFDQPGSIPLPNAGYHSLGVVWEDVTVHGAGGGKKYVESLDISVFKFFDFYSFMKKIFQITTGPTRPLIRNFSGVVEEGEVLLVLGRPGAGCSTLMRALANVNEPFVKIEGDISYSTIPAHEAKKFYDGEIIFNSEEDEHQPLLTVEETIKAALYLKEPRKKGDKEKRPEYVESLFSRILDTFGMPHTRKTKVGNQFVRGVSGGERKRVSLAEVLTTNAAVTCWDNPIRGLDSAVALHFYKVLRELSKSLGMVNIISTYQTAQDAWQCVDRVVVIYEGRQIFSGRANQAQAYFEYMGWYKKPRQTTPDFLTAVTSPNERQVREGFEGKVPQTPDEFERYFLDSQEYKELQQDIQNYKQRHAEANHSDEFRHAVKSSKHPGAGKATAYRVNFAQQVAILCKRQLQLTRSDMTSFVYRIGSNVLQAVLVGAVCYKPPNNSAGSFAIAGALFFCILYYTIFALGEVPATVNSRPLLKKHRALGFYHPAAHTLAQIVCDIPVYVFQTLLFSAIFYFMVGLSVGAKYFFTFWFVIFTMYETISVMYRMIGSWTPNLSVAIRYGCLALSVVLSASGFVLPPPRQLRWISWLRRATPCAWAFEALIANEFRARVLSCDVSDLIPYGEGYDDIAYQVCSIQGAQPGATTVPGMDYIAFVYGYQTSHIWRNVGILWAFFVGYVIMIVIGSSLLIRESPDSSQKVYKRGGKAAIMDPKEKAEEGKTAMEKVQGPKGSGGEVPVYTFEDVYYTVQVAGKDKPLLNGISGYVKGGSLTALMGASGAGKTTLLDTISLRKTTGKMEGKMTIDGKPLDTSFSRQTGFAMQADIHEPMSTVRECLQFSALLRQSNDRTREERLEFAENIIKLLELEDIADALIGAPGEDGLGVEERKRVTIGVELAADPEFLLFLDEPTSGLDSQASYEIVRFLKRIAASGLAVLCTIHQPSGDLFEMFDSVVLLAPGGHTVYVGETGENAETVVKYFGDRGAYCPPEANPAEFILGTVAPVGGTTIDWPGLWKESTEAAEVQRKINEFTSRNNLAVDPEKAITETQQKSGSDAYASSFMTQSKELIIRNFRAQWRDGSFWTTQLAILIFFGLFVGFYWFKIDHSPNNMSAASLGILVAIQGLPGIAMDIGINYLAKLDMFLARERLGIYSWQALVTSLLIVSIPVLFVGWNILFFCFYWTIDLIGTRADGVLIWLCFLSCAILNGSFGVLLGAVSPNRLSLPYILSLVWNLLNCLSWALVFYSGLPSPFHYFFSWLSPLRYLYGAMMTASLGDLTLNCIEEDLVTFYPPPGQTCYDYAANYLATTSGYLVDGNSTTSCQYCTSSTGYDYIQEMGYSLGTKWRDWAITIIWCLSNIFFCYLFTWLVKIRPLYKKS

SEQ ID NO: 56766 - protein, 152 aa, Prochlorococcus marinus str. MIT 9313
MAMERTFVAIKPDGVQRGLVGEILGRFERKGFKLVGLKQVTPSRDLAGEHYGVHRERPFFAGLVDFITSGPVIAMVWEGDGVIASARKLIGATKPLDAEPGTIRGDLAVNIGRNVIHGSDGPDTAQFEINLWFSAEELNAWTPSDQSWRIES

SEQ ID NO: 56767 - protein, 120 aa, Pseudoalteromonas tunicata D2
MTTETIFTKIINREIPATIVYEDDDTLAFEDINPQAPFHVLIIPKKAIATINDITEQDQHLIGKLYCVAAKLAKEKGFATSGYRVVMNCNEDGGQTVYHIHLHMLAGKAMGWPPYADKMK

SEQ ID NO: 56768 - protein, 447 aa, Paracoccidioides brasiliensis
MAPFVFAPHDIYVTRNYPDDSSNYKSSTHHGGFDLFQARDASKDLIFDILKKKVSEIDVHNCHPGEEDPFYVADLGQVYRQHIRWKKNLGRVKPFYAVKCNPDPQILRLMVQLGNGFDCASKAEIDYALDVGVDPSRIIYAQPCKTKSFLRYASQVGVKQMTFDNSDELYKIKEMCPDAELYLRILTDDSASLCRLSMKFGASLSVARSLLELAKELKLNVIGVSFHVGSGAEDPKSFVKAVEDSRFVFDQAAEVGFDLKVLDVGGGFSEDTFERFAATLSDALDEYFPPHIRIIAEPGRYYVASAFTLAANVIARRDVSLEMSDSDSTAGATEAYMIYLNDGVYGNFSNIIFDHQHPVPQILTMESRVCAPIEYSIWGPTCDGIDLICERIALPELDVGNWLYFENMGAYTKCSATRFNGFTDKHEVIYISTEPSATALLELSNEL

SEQ ID NO: 56769 - protein, 152 aa, Deinococcus radiodurans R1
MTTLTELLSNRWLWAAVFASLGAQVLKVLLILLLERRWHPGAFMETGGMPSSHSAMVSALSTGIGLTEGWDTPLFAIAATFALIVMYDASGVRHSSGVQARLLNELIEELRAVVREGFAPKPLRVLMGHTYSEVFVGTLIGIFAGWLAFRVL

SEQ ID NO: 56770 - protein, 669 aa, Pseudomonas putida GB-1
MNDCHLICANRLDDGAVVWLDAGHEWVETLQQAGTFDAQALVSATLAAEAAVLANQVVAPTPCEAWLVDGRPEPKSLRERLRARGPSVRSDLGKQAAGTPPSSIARMRPVLPVEAGQAGVYRYDRFEREFLKDRARQFEQQVARRLSGELDEEAFKVYRLMNGLYLQLHGYMLRVAIPYGTLSALQLRQLAYVAHTYDKGYGHLTTRQNIQFNWPRLADTPEILSVLADADLHCIQTSGNCIRNVTTDHFAGAAEDEVLDPRVHAEILRQWSTEHPEFTYLPRKFKIAITGSPKDRAAVRFHDIGILAQRNAQGEVGFQVYAGGGLGRTPIVGTRVREWLPERELLRYVEAILRVYNALGRRDNLYKARIKILVRELKPGRFIEMIEEEFASLPADHQYLEPAIVQGIHARFVQPAFEALPGLCDSFLRARADDNAFASWVRTNTHPHKKRGYICAVISLKPPGGIPGDISAEEMLALADLAEAYSLNEIRVSHEQNVVLPHIRLVDLYSVWQALRQAGLATSNIGLLSDTIACPGMDYCSLATARSVPVAQRIAQRFDAARQQDIGELKLNVSGCINACAHHHVAHIGILGLDKAGHENYQITLGGSAEEDAAVGTILGRSVPFEEVPDIVEAIVAIYLQLREDDERFLDTYRRVGIEPFKEVLRDAR

SEQ ID NO: 56771 - protein, 454 aa, Pyrococcus abyssi GE5
MELKPNVKEIPGPKARKVIEEHHKYMATTTNDPNEYFLVIEKAEGVYWIDVDGNVILDFSSGIGVMNVGLRNPKVIEAIKKQLDLVLHAAGTDYYNPYQVELAKKLIEIAPGDMERKVFLSNSGTEANEAALKIAKWSTNRKMFIAFIGAFHGRTHGTMSLTASKPVHRSRMFPTMPGVEHVPYPNPYRNPWGIDGYENPDELINRVIEYIEDYLFEHYVPAEEVAGIFFEPIQGEGGYVVPPKNFFKELKKLADKHGILLIDDEVQMGMGRTGRMWAIEHFDVVPDIITVAKALGGGIPIGATIFRADLDFGVSGVHSNTFGGNAVAAAAALAVIEELQNGLIENAQKLEPLFRERLEEMKEKYEIIGDVRGLGLAWGVEFVKDRKTKEYATKERNEIVVEALKRGLALLGCGKSAIRLIPPLIISEEEAKIGLDIFEEAIKVVSERHGYKIH

SEQ ID NO: 56772 - protein, 175 aa, Zea mays
  misc_feature (88)..(88): Xaa can be any naturally occurring amino acid
  misc_feature (115)..(116): Xaa can be any naturally occurring amino acid
  misc_feature (133)..(133): Xaa can be any naturally occurring amino acid
  misc_feature (153)..(153): Xaa can be any naturally occurring amino acid
  unsure (1)..(175): unsure at all Xaa locations
MASLSFVSSSHLTLRAPSPNNLRSSSPRPTSVSFSVKAQSVALSQDDLKKLAAEKAVESIKPGMVLGLGTGSTAAFAVDQIGKLLSSXQLHDIVGIPTSKRTEDQARSLGIPLVXXSNAPRIDLAIDGAERSXDPTLDLVKARGGALPEEKMXEAVAERFIVVAMIRTREGLRSG

SEQ ID NO: 56773 - protein, 415 aa, Arabidopsis thaliana
MDRINGLSDDIICHILSLLSFKEATSTSVLSMRWRYLFAFRPNLCLDDQEVGGGDSFIDFVDRVLVVTGNFPIRRISIKCRMSIDTGHVTRWMVDVLEHGVSYLDIDIISEDDIGFVPLEIFTCKTLVELKLARGFYAMVPDYVSLPSLKTLFLSSIWFCNRDCCPLGRLLSACPVLEELTIIGGCWQHIEFCRTVSSSTLKKLTITSSFHYEYWGITIDTPSLAYLEYSDLVPRHFPFVNLESLVEAKLALDLCSDSNPTNLIKGLRNVEVLELSSGYTSQILYDFREAIPVLSKLFRLSIKSNSRHYYIWNLLPILLEKSPKLETLVIKGPLSADRYEREYGLSCPVKVLEITEYGGKYEELEQMEHFLKKLPCLELVKVRASAINDKEKSRITKDLLMVPRSSNCNIKLKFC

SEQ ID NO: 56774 - protein, 337 aa, Oryza sativa (indica cultivar-group)
MAFSPLYRQPSPYYSPYPAQSTFLPPHVYLPQPPINATTYNFAQAPAAPAPPPHVNVPQPAMHAAAAPAPPLWLRTMTAANLDSEMGLIGKMMVQYPYVTIDVEFAGVVHHPPYTGSRPTPDEIYAAVKSNVDEVPAVQIGITLSDAEGNLPTRSSSSPEQEIAWEVVFSDFDAGRDPHVVDSVEFLKNQGIDFDLARRIGVTSTAFGEKLLAILPPPSRRGELTWSAFGGAYDMGYLVKMLTGGQPLPETRQQLMQLVKSRLGGGRIFDSKYLVEHDRQDLRNAGLRHTADVLGVRQQEGVKMLAGHKSVVAAAIFATIRSQGVHLLHEGVIDGIL

SEQ ID NO: 56775 - protein, 497 aa, Pseudomonas aeruginosa UCBPP-PA14
MTTLTRADWEARAKDLKIEGRAFVNGEYSNAASGETFDCLSPVDGRFLAKVASCDLADAEQAVKVARNAFDSGAWSRLAPAKRKQAMIRFADLLLENAEELALLETLDMGKPISDSLHIDVASAANSLRWSAEAIDKIYDEVAATPHAELGLVTREPVGVVAAIVPWNFPLLMSCWKLGPALATGNSVILKPSEKSPLTAIRIAQLAVEAGIPKGVFNVLPGYGHTVGKALALHMDVDTLVFTGSTKIAKQLMVYAGESNMKRVWLEAGGKSPNIVFADAPDLKAAAEAAAGAIAFNQGEVCTAGSRLLVERSIKDKFLPLVIEALKGWKPGNPLDPETNVGALVDTQQMNTVLSYIEAGHNDGAKLVAGGKRTLEETGGTYVEPTIFDGVTNAMKIAREEIFGPVLSVIEFEDAEEAVRIANDTPYGLAAAVWTSNLSKAHLTAKALRAGSVWVNQYDGGDMTAPFGGFKQSGNGRDKSLHAFDKYTELKATWIKL

SEQ ID NO: 56776 - protein, 274 aa, Oryza sativa (indica cultivar-group)
MNFRRNSAAGAAPAAMPFGPPPPPMAFSPLYRQPSPYYSPYPAQSTFLPPHVYLPQPPINATTYNFAQAPAAPAPPPHVNVPQPAMHAAAAPAPPLWLRTMTAANLDSEMGLIGEMMVQYPYVTIDVEFAGVVHHPPYTGSRPTPDEIYAAVKSNVDEVPAVQIGITLSDAEGNLPTRSSSSPEQEIAWEVVFSDFDAGRDPHVVDSVEFLKNQGIDFDLARQIGVTSTAFGDPLLAILPPPSRRGELTWSAFGGAYDMENHIDFCVVEYPHCK

SEQ ID NO: 56777 - protein, 333 aa, Oryza sativa
MACTIEDITDNFDPLDYDKALGDLLVGHEGNVQQYLVTVFDFVKRKTNFFKEPDAKRRILDAYKQVTGETDGFKAGFFGSAKPAAPKPADKPVPKASPSAGATLSSSEPEAASASSSEPPAAAAAAAVDNAAAAPEAEPQQQPEAGSSQDTELAAEKPDQNKGLKPNAGRGADLEAYSWSQTLQEVSVSVPVGRGLKAKQLDVAISKQHLRVGVKGQPPILDGALAEPIKADEAMWNLVDGVVELTLSKAEGMHWWSAVMAGGPAIDVQAVEPENSKLTDLDPETRQTVEKMMFDQRQKALGLPTSEETQKQEMLKRFMAAHPEMDFSNAKIM

SEQ ID NO: 56778 - protein, 650 aa, Aspergillus nidulans FGSC A4
MASAPTMANATTFNTTPMQTLLNPSDTALLETFIPGYSMASRILSTYLQIDLSSYIPYLIFMGLIAATARYIYSQLYNLFQEHCISTAEIRHDDEVYNYLMYWLAQQPFTNRTTHFVAGTRISGSSWCYEPDSDSDEEGFGGADEIDNEGNVVTDFDAYWAKATARDKLKKLRFTPSEGTHYFWFNGRPLAFIREKQDDKSSGGGYYGYGTKAPERLYISCIGRDPAVLKELLLEAQRYYVAKDKNNTVIYRGHKSGSYTEWSRCMARAPRALSTVVLDKAQKDAFIDDIKDYLHPRTRRWYNNRGIPYRRGYLLHGPPGTGKTSLCFAAAGLLGLELYLLNLSSKSLDEDELMALFTDLPTRCIVLLEDVDCAGMSQKRTPGSSSNDDNGNSASPELQEQGEGNSSGTTTGGTGVFEKQGVSLSGLLNVIDGVAACEGRILVMTTNHPEKLDPALVRPGRIDLSIAFGHSTTSDIKELFSAIYSTLEGDLRVSPAERLSPKLRARMAKRSSTSHSTNSTNANVVIHKETRKFSEEQIRLWAAEFAERVPAGEFTPAEIQGYLLNHKTDPERAIEEATRWVGEVKEKKAKTKAKSASANTAKVDGDQEEDKREVNGVKNEGKTQLTNGDAQAHTNMDKPCPTSICRETTN

SEQ ID NO: 56779 - protein, 468 aa, Yarrowia lipolytica CLIB122
MRWTNMLLLASAAVAESTFWVSPSAEQNCVGIYAGSEESPASISVYTPKLDNSSVINFMGHEGWMALAIYKYEDLPFIGDMGRKEWGYKYHCNSMNVQYKLCTHDEIGQYIVKQNYTGNTIFTTKVDLLEDTTFNYTVNETGLYCVTAHPNNEMNKFMSTVTVKDGNGQLSGYDYNKLAYHGVMSGLWAATLIGYLVLCFLRKNLLPVHKRLLALIAVNLAVSLLWTIYNAIYNAQGPTSFVKTLVVISAVISALRWALSMWLALYVAHGMHYFSTPLIQSAKKKAVAVTATFWVFESIVASMFYLIGMVQGTYVRMAIGACLCFVLYSTLYIFYNIYSWMNHTQKSYIDENMSVQIDQISKLRAVYLAFLLLFAFMVLFNIMVLLRGSIVGSTLNLIQTTNIAWVNEWKYRWFFVHDWIELANLLVVLAALWVLRPSRYFNQMMDGSGQISQKDYDEFELDEYDEGV

SEQ ID NO: 56780 - protein, 298 aa, Salmonella enterica subsp. enterica serovar Paratyphi A str.
MVRIACVGITVMDRIYYVEGLPTEGGKYVAKRYTEVGGGPAATAAVAAAKLGAQVDFIGRVGDDDTGNSLLAELESLGVNTRYTRRYTQAMSSQSAIMVDAKGERIIVNYPSPDLLPDADWLNDIDFSQWDVVLADVRWHDGAKQAFTLARQAGVMTVLDGDITPQDISELVALSDHAAFSEPGLARLTGMSEAIDALKKAQMLTNGHVYVTRGSEGCNWLEKAVVRHQPGFTVEVVDTTGAGDVFHGALAFGLASGYAIEEAVRFASGVAALKCTRPGGRAGIPDCEQTRSFLSLFV

SEQ ID NO: 56781 - protein, 501 aa, Pseudomonas putida GB-1
MTSPASPRPEDENLGVGANLAYGLQHVLTMYGGMIAVPLIIGQAAGLSAGDVGLLIAASLFAGGLATLLQTLGIPFFGCRLPLVQGVSFASVATMVAIIGNDGIGGMQVVFGAVIVSSLIGLLITPLFSRIIKYFPPLVTGIVITTIGLTLMPVTARWAMGGNSQAADFGSPANIGLAAFTLASVLLLSKLGSASLSRLSILLAIVIGTLAAMATGMADFSQALQGPWMAMPEVLHFGAPQFQVAAILSMLIVIVVTMVETSADILAVGEIIGTPVDSKRLGNGLRADMISSALAPLFGSFTQSAFAQNVGLVAVTGVKSRYVVASAGLILVTLGLLPVMGRLVAAVPTAVLGGAGLVLFGTVAASGIRTLAQVDYRNNMNLIIVATSIGFGMIPIAAPGFYHHFPAWFETIFHSGISSAAIMAILLNLLFNHLRAGNSDQQSVFVAASERTLRYRDIAGLNEGDVFRDGKLYDRDGNEVPIMEADEGHFKTGKTSVAHMH

SEQ ID NO: 56782 - protein, 385 aa, Kluyveromyces lactis NRRL Y-1140
MVNLNGIPPRGKRNYYLAIGLEGSANKLGVGIIKHPVLEKHEDSDLSYECDVEILANIRDTYVTPPGEGFLPRDTARHHRNWVVRIIRKALTEAKIDDPTKIDVICFTRGPGMGAPLHCVVIAARTLSLMWDIPLVGVNHCVGHIEMGREITGAKNPVVLYVSGGNTQVIAYSEKRYRIFGETLDIAIGNCLDRFARTLKIPNAPSPGYNIEQLAKQCKNKEKLVVLPYTVKGMDLSMSGILQYIDTLAKDLFKKNLKNKLLFDSRTGEQLVTVEDLCYSLQENLFAMLVEITERAMAHVNSNQVLIVGGVGCNVRLQEMMAQMCKDRSNGQVHATDDRFCIDNGVMIAQAGLLEYRTGHFVKDLSETIVTQKFRTDEVYIAWRE

SEQ ID NO: 56783 - protein, 393 aa, Rhodococcus sp. RHA1
MRAVTWQGKRKVSVDTVADPKIEHPTDAIIKVTTTNICGSDLHLYETLGPFMGEGDILGHEPMGIVEEVGTAAGNLKVGDRVVIPFQISCGDCFMCNLQLYTQCETTQVREQGMGAALFGFSKLYGEVPGGQAEYLRVPQAQFTHITVPEGPPDSRFVYLSDVLPTAWQSVEYAAIPEGGSVTVLGLGPIGDMAARVAHHKGARVIAVDNVPERLARAKARGIETLNLDEHGGDLADVIRDATDGRGTDSVIDAVGMEAHGSPIGKLAQQIVGYLPDAVAAPLMQKAGVDRLGALYSAIDIVRRGGTISIIGVYGGMADPIPMLTLFDKQIQLRMGQANIKKWVDDIMPLLGDDDPLGVDTFATHELPLEQAPHAYEIFQKKQDGAVKIQLKP

SEQ ID NO: 56784 - protein, 444 aa, Pseudomonas aeruginosa UCBPP-PA14
MTMNNEPQSSSLDNFWMPFTANRQFKARPRLLESAEGIHYIAQGGRRILDGTAGLWCCNAGHGRREISEAVARQIATLDYAPPFQMGHPLPFELAARLAEIAPPGLNKVFFTNSGSESADTALKIALAYQRAIGQGTRTRLIGRELGYHGVGFGGLSVGGMVNNRKAFSANLLPGVDHLPHTLDVARNAFTVGLPEHGAEKAEELERLVTLHGAENIAAVIVEPMSGSAGVVLPPKGYLQRLREITRKHGILLIFDEVITGFGRVGEAFAAQRWGVVPDLLTCAKGLTNGSIPMGAVFVDEKIHAAFMQGPQGAIEFFHGYTYSGHPVACAAALATLDIYRRDDLFQRAVELEGYWQDALFSLRDLPNVVDIRAVGLVGGVQLAPHADGPGKRGYDVFERCFWEHDLMVRVTGDIIAMSPPLIIDKPHIDQIVERLAQAIRASV

SEQ ID NO: 56785 - protein, 493 aa, Rhodococcus sp. RHA1
MTVTDDTAVITRPQIGPRQLFIDGQWREAGAGERFEIVDPSTGKPVTTVAEADADDLDSAVRAARTAFDDGRWSGLPGRERARILLRVAALVRERADEIVAVESVDVGKPVSLCRPVDVMTTAEQYEYCAALAQTAGGSNRETPLDAHAYTRREPLGVLGAITPFNFPLILSTSKIAPALAAGNTVVHKPAEDTPLSALLMAEILTEAGVPAGVVNVVTGKGSTVGEALLQHKGIDKIAFTGSTVVGRHAASVAGENLTPVTMELGGNAAHIVFEDADVDKAIGAIIKGFVFNTGQFCMGGPRLLVARPHYETVLGILGQAVPGVPVGDPFDPATVVGPMAGDKHVRKVEEYVQIARSDGGRIVAGGERLDLGGGYYYKPTVIADLPNTSRVVQDEIFGPVLTVQPFDTEDEAIALANSTEYGLASGLQTSNVARAHRVAARLQAGIVWVNDWAMLDPAVPFGGVKNSGFGREYGPEALESYSKVKSVVISLA

SEQ ID NO: 56786 - protein, 354 aa, Zea mays
  misc_feature (230)..(230): Xaa can be any naturally occurring amino acid
  misc_feature (239)..(239): Xaa can be any naturally occurring amino acid
  unsure (1)..(354): unsure at all Xaa locations
MATSSVLPFHLPSCARRASTAARASAAPVAAAAATTAQSLEESFGRKGLRFVADPAGGAPAAELSVRNGSSLHLRLGDGLVTSYKPKVQWKDDGCREVLHTVGGKGGVGLVLSDQASGGQSSLLDGAEWAVRDADSDSYDAVQVELGCTMGKLDISYVVTLYSLSMATAVIVRNTGSKPVALTGAVLSHIKFDKRSGTAVEGLRGCPYCSHPPPAAAFRLLSPAEAMKRXAPGWFGGRXGEEPRQGVWTIEEDLYTTLKKKVSRVYAAPPEERKKRVYSTAPSKFTTIDQYSGFGFRLVRMGLDDMYLCSPGGMYDKFGKDYFLCTGMASMLVPVVVNPGEEWKAAQVIEHDNL

SEQ ID NO: 56787 - protein, 336 aa, Mycobacterium bovis AF2122/97
MKLAIIAGDGIGPEVTAEAVKVLDAVVPGVQKTSYDLGARRFHATGEVLPDSVVAELRNHDAILLGAIGDPSVPSGVLERGLLLRLRFELDHHINLRPARLYPGVASPLSGNPGIDFVVVREGTEGPYTGNGGAIRVGTPNEVATEVSVNTAFGVRRVVADAFERARRRRKHLTLVHKTNVLTLAGGLWLRTVDEVGECYPDVEVAYQHVDAATIHMITDPGRFDVIVTDNLFGDIITDLAAAVCGGIGLAASGNIDATRANPSMFEPVHGSAPDIAGQGIADPTAAIMSVALLLSHLGEHDAAARVDRAVEAHLATRGSERLATSDVGERIAAAL

SEQ ID NO: 56788 - protein, 387 aa, Pseudoalteromonas tunicata D2
MSKGVKVFQSKLPSLGTSIFTQMSMLANQYQAINLSQGFPEFDTPDFLKQQITHAISVGLNQYSPSNGIAPLQQQIAGLIARRYGHALEPSAAITVTSGATEALFVAIHTLVRPGDEVIIFDPAYDSYQPAIELAGGLCQRIALTAPNYAIDWQYVTSKMHSNVRAIIINSPHNPTGKVLKEHDLQALKALLAQYPNCYLISDEVYEHMTFDGHQHLSILSVPELFKRAFVISSFGKTFHCTGWKIGYCVAPEQLTAEFRKIHQYVTFSSFTPAQHGLAAMLQHYPEHVDQLADFYQQKRDLLVSHLASSRFKVLPSEGTYFVLLDYSAISDLNDVDFCHWLTAEVGVAAIPLSVFYQDAPADKVVRLCFAKNDATLIAAAEKLCRL

SEQ ID NO: 56789 - protein, 426 aa, Methanococcus maripaludis
MDDSFDIYEIKARQVLDSRGNPTVEAEVLTAGGGYGHTIVPSGASTGTFEAVELRDKKEKYGGKSVLNAVSNVNDIIAQELIGEDARNQRLIDQIMLNLDGTENKGNLGANAILAVSLAVAKAAADTASLPLYKYIGGSNAYVMPAPMMNVLNGGQHAGNALDFQEFMIMPVGADSFAEAVRMCSETYQSLKKVVAEKYGKDAVNVGDEGGFAPPVKTIDEALAVLLEGVKKAGYEDEIVFTIDSAASEFYDEKSGSYMIAGEKVSTDKLIDIYKEMVEQYPIVSIEDPLFEEDFEGFKTATKELKGIQIVGDDLFVTNTKRLKKGIEMGAANSLLLKVNQIGTLSESIDAANMAFRNGYSLVVSHRSGESEDSTIADLAVALNAGQIKTGAPARGERTAKYNQLMRIEEELQISKYAGKDFKIPF

SEQ ID NO: 56790 - protein, 122 aa, Rhodococcus sp. RHA1
MDGVLTADNAADARARMIVEGANGPTSPEADAILQSNGVTVVPDILANAGGVVVSYLEWVQNLQAFSWTGAEVDRKLCVFMQNASRSVWALAAEKSLTLRRAAHVIGVGQVAEAHEARGLFP

SEQ ID NO: 56791 - protein, 396 aa, Micrococcus luteus
  misc_feature (112)..(112): Xaa can be any naturally occurring amino acid
  misc_feature (142)..(142): Xaa can be any naturally occurring amino acid
  misc_feature (161)..(161): Xaa can be any naturally occurring amino acid
  misc_feature (173)..(173): Xaa can be any naturally occurring amino acid
  misc_feature (207)..(207): Xaa can be any naturally occurring amino acid
  misc_feature (237)..(237): Xaa can be any naturally occurring amino acid
  misc_feature (242)..(242): Xaa can be any naturally occurring amino acid
  misc_feature (307)..(307): Xaa can be any naturally occurring amino acid
  unsure (1)..(396): unsure at all Xaa locations
MRHPIPDYLASLVTELGAVNPGETAQYIPVLAEADPDRFGIALATPTGRLHCAGDADVEFTIQSASKPFTYAAALVDRGFAAVDRQVGLNPSGEAFNELSLEAESHRPDNAXINAGALAVHQLLVGPEASRKERLDRAVEIXSLLAGRRLSVDWETYESEXAVSDRNLSLAHXLRSYGVLQDSAEEIVAGYVAQCAVLVTVKDLAVXGACLATGGIHPMTGERMLPSIVARRVVSVXTSSGXYDAAGQWLADVGIPAKSGVAGGVLGALPGRVGIGVFSPRLDEVGNSARGVLACRRLSEDFRLHLXDGDSLGGTAVRFVEREGDRVFLHLQGVIRFGGAEAVLDALTDLRTGAEKPGTGWDAAVYPRWQEAAADRAALSAATGGGAVHEAAAAAA

SEQ ID NO: 56792 - protein, 215 aa, Xanthomonas campestris pv. campestris str. ATCC 33913
MSEAKRLAAEKAIDYVEDGMIVGVGTGSTVAYFIDALGRIGHRIKGAVSSSEQSTARLRQHGIEVLDLNHTGTLSLYVDGADECDPNRCLIKGGGAALTREKIIAEASERFICIVDPSKQVPVLGNFPLPVEVIPMARSLVARQILALTGGQPVWRDGVVTDNGNVVLDVHNLHITDPVALERNLNQIPGVVCVGLFARRPADVVIVGGETPRVL

SEQ ID NO: 56793 - protein, 182 aa, Streptomyces coelicolor
MTEPTGITELLLSRIRDVADYPEPGVVFKDITPLLADPGAFAALTDALAEAAGRTGATKVVGLEARGFILGAPVALRAGLGFIPVRKAGKLPGATLSQAYDLEYGSAEIEVHAEDLTAGDRVLVVDDVLATGGTAEASLELIRRAGAEVAGLAVLMELGFLGGRARLEPALAGAPLEALLTV

SEQ ID NO: 56794 - protein, 336 aa, Arabidopsis thaliana
MEVERVQDISSSSLLTEAIPLEFIRSEKEQPAITTFRGPTPAIPVVDLSDPDEESVRRAVVKASEEWGLFQVVNHGIPTELIRRLQDVGRKFFELPSSEKESVAKPEDSKDIEGYGTKLQKDPEGKKAWVDHLFHRIWPPSCVNYRFWPKNPPEYREVNEEYAVHVKKLSETLLGILSDGLGLKRDALKEGLGGEMAEYMMKINYYPPCPRPDLALGVPAHTDLSGITLLVPNEVPGLQVFKDDHWFDAEYIPSAVIVHIGDQILRLSNGRYKNVLHRTTVDKEKTRMSWPVFLEPPREKIVGPLPELTGDDNPPKFKPFAFKDYSYRKLNKLPLD

SEQ ID NO: 56795 - protein, 306 aa, Prochlorococcus marinus str. MIT 9313
MVSPLPVSSATNRQQRLWAAVKAHREPLPAKQRRFKWGTTSFMLAMHVAATFALLPRFWSWQGLVAFAVLYWTTVLGVTLGLHRLVAHRSFVVPVWLERILVIMATLACQSGPIEWVALHRHHHRYSDQTNDHHDAGRGLWWAHSEWMLHEIPALDHMDRFAGDLLADPFFRWLDRWFLLLQIPLGLGLYWYGEVAQVHGGGLGLVLWAIPLRLVVVYHVTWFVNSATHAFGYRNFDSPDLSRNCWWVAVLSFGEGWHNNHHAYPSSARHGLRWFEFDITWQHVKALRRLGLARRVQQARYVSGAS

SEQ ID NO: 56796 - protein, 325 aa, Candidatus Kuenenia stuttgartiensis
MEIKKDDLLQMYYYLKLTRRLEDRVTSLYHQGKIMGGAWTSNGTEAVSVGYGYALEKDDIAAPYFRDMGVFLIRGISAKRIIAQYFGKKTGVTGGKEGNVHIGDMKYGVVGFPSHLADNYPVGAGVALAFKIRGEKKVVAACTGDGGTSRGDFHEGMNFASVRKLPIVFFCNNNQYAYSTPLRLQMNIKDVAERAAAYGMPGKIVDGNNVVEVYMAAKEAYEVARNGGGPTFIECKTMRMHGHSEHDSAKYVPRELLEEWKKKDPITNMERYLTEKNIAGKEELDGIDSRVKKEIDEAEAFAEESPYPDPADGLKGVYATSVETR

SEQ ID NO: 56797 - protein, 259 aa, Prochlorococcus marinus str. MIT 9313
MIAIHALSILALLPRFWSWQAITTLLVLYWVTACLGVTIGYHRLLSHRSFRVPHWLERFFATCGTLSCQHGPIDWVGLHRHHHKFSDTDPDHHNSHKGFWWSHMGWMFEPIPAMRVVPRLTVDLAADPYYRWLNKYFLLLQLPLAGLLFWIGSVSGAGGLALVLWGIPLRLTIVYHITWLVNSASHCWGTVAFDSGDNSRNNPWVAALTFGEGWHNNHHAFPHSAIHGLQRGQIDLTWQHIRLMRALGLARKIRLPITS

SEQ ID NO: 56798 - protein, 435 aa, Oryza sativa (japonica cultivar-group)
MASEKHFKYVILGGGVAAGYAAREFAKQGVKPGELAIISKEAVAPYERPALSKGYLFPQNAARLPGFHVCVGSGGERLLPEWYSEKGIELILSTEIVKADLASKTLTSAVGATFTYEILIIATGSSVIKLSDFGTQGADSNNILYLREVDDADKLVAAIQAKKGGKAVIVGGGYIGLELSAALKINDFDVTMVFPEPWCMPRLFTADIAAFYESYYTNKGVKIVKGTVAVGFDADANGDVTAVNLKNGSVLEADIVGVGVGGRPLTTLFKGQVAEEKGGIKTDAFFETSVPGVYAVGDVATFPMKMYNELRRVEHVDHARKSAEQAVKAIKGKESGESVVEYDYLPYFYSRSFDLGWQFYGDNVGDTILFGDSDPTSAKPKFGSYWIKDGKVLGAFLEGGSPDENKAIAKVAKTQPPVANIEELKKEGLQFASKI

SEQ ID NO: 56799 - protein, 315 aa, Arabidopsis thaliana
MGTALKLPIIDLSSPEKLSTSRLIRQACLDHGFFYLMNHGVSEELMEGVLMESKKLFSLPLDEKMVMARHGFRGYSPLYDEKLESSSTSIGDSKEMFTFGSSDGVLGQLYPNKWPLEELLPLWRPTMECYYKNVMDVGKKLFGLVALALNLKENYFEQVGAFNDQAAVVRLLRYSGELNSSGEETCGASAHSDFGMITLLATDGVAGLQVCRDKDKEPKVWEDVAGIKGTFVVNIGDLMERWTNGLFRSTLHRVVSVGKERYSVAVFVDPDPNCVVECLESCCSETYPPRFPPVRARDYFHERFSQTLASYSGSD

SEQ ID NO: 56800 - protein, 200 aa, Haemophilus influenzae R2866
MLDYKMFNPYEGLIFDMDGTLIDTMPVHAQAWTMVGERFGYEFDCQIMYNFGGATVKTIAGEMMKAANMPLDRIEDVLAAKRELSYQLIPTQSKLLPTFEIVKYFHQKKPMALGSGSHRKIIDMLMDKLAIAPYFNAIVSANDVKEHKPHPETFLRCAELIQANPSRCIVFEDADLGVQAGLNAGMDVFDVRTREIISPR

SEQ ID NO: 56801 - protein, 431 aa, Pseudomonas putida GB-1
MNRAQTLTGAMPSTLPFRLAQWRMLLAAMFCYLFFYTGRQTFGFAIPGIQAEFGLSKETLGWASTAMLWMYAVGQAINGNLADKFGGRRIMSIGAVLSCGANWVTSFAGGFLSLILPWGVNGYFQALGWAPGSRLLSNWWGAAERGKVYGFYVFAAGCASVLSYVTSVVVIDVLHLEWRWIFRLPVLLMLAGGIVFYLVARERPQDMGYPALDDTGVANAEDRANEASLGGEETSRQRYLAVLKNPRLLVAAVSLGFQNAARYGLIVWVPVHFLGANWQKGDSFIDPKWITIALPVGMAVGALSNGWVSDKLFGSKRYLAIMLYMVLGALTSLWMWSLPAHSAVGLLALFLCGFFIYGPASSFWALCPDLVGARRAGTATGIMNFASYLFAGLAEPLIGRMLDTTGNTSLIFIVVTSACACSALVALFVRR

SEQ ID NO: 56802 - protein, 464 aa, Pseudomonas putida GB-1
MHTTTSTAHSPAHSPTPHAPTQPDASTGRLRKSMGMTALVLFGLAYMVPLAVFTTYGLVTQMTKGHLPTAYLLTLAAMLLTAYSYGRMVQAHPYSGSVYTYTRKAFGSHIGFITGWTLLLDYIFLPLLSYLLIGIYMSEYFPAIHAWVWVAGSIALVTFLNLIGIESITRVNWILVVVQLVFIIVFVALSVLKLSGQAEPVSLLAPFHHEGFSVPLIMTGAAVLCLSFLGFDAVSTMAEETSNPTYRIPVAILAVSLIGGLLFLVVSYCAQMVFPDWGSFADPDSASVDVMRRVGGELLVTAFTATYVAGCFASAMVSQASVSRVLFAMGRDGALPRAFGQLATKKRVPATAILVVSLVSMIALVITLDTVANMISFGALFAFSAVNLAVVKHYLVDQKLRGGRNYLLYGAIPGLGFLSTLWLWSSLTSLSFTIGLCWLGMGLVVLMGLTRAFRVKLPELQMAE

SEQ ID NO: 56803 - protein, 219 aa, Kluyveromyces lactis NRRL Y-1140
MSFRGGNRGSRGGFRGNSRGGFGGRAAPQGPPDSVLEMGAFLHPCEGDIVCRSINTKIPYFNAPIYLENKTQVGKVDEILGPLNEVFFTVKCSDGVKAESFSEGDKFYIAPDKLLPIERFLPKPKVAGPPKPKRKRSGAPGGRGGFGGGRGGARGGSRGGFGGGRGGSRGGFGGSRGGFSGGRGGFSGGSRGGSRGGSRGGFGGSRGGSRGGFGGGRRF

SEQ ID NO: 56804 - protein, 366 aa, Oryza sativa
  misc_feature (317)..(317): Xaa can be any naturally occurring amino acid
  unsure (1)..(366): unsure at all Xaa locations
MAPSSLACSRKNKTKTNKLWFHHSALQVDPDEVNALAQLMTWKTAVAAIPYGGAKGGIGCAPGELSTSELERLTRVFTQKIHDLIGAHTDVPAPDMGTNSQTMAWILDEYSKFHGHSPAVVTGKPIVSLGGSLGRDAATGRGVMYATEALLAEHGKSISGSTFVIQGFGNVGSWAARIIHEKGGKVIALGDVTGSIRNKNGLDIPALMKHRNEGGALKDFHDAEVMDSSELLVHECDVLIPCALGGVLNRENAPDVKAKFIIEAANHPTDPEADEILAKKGVTILPDIYANSGGVIVSYFEWVQNIQGFMWDEEKVXNMELHKYMNNSFQHIKAMCKSHDCNLRMGAFTLGVNRVARATLLRGWEA

SEQ ID NO: 56805 - protein, 359 aa, Kluyveromyces lactis NRRL Y-1140
MKQCTRLFSQLDVKSLVMNTKVTSKEQIVNHDRQNTEIRKNRHAKRRDPDKVKTIINDLYQKLNKEYAPLKASDLSQVNFFFNKAKVKFEWSAPTFNDVPGEKVRRLMEKRQQAIQTIMDEENEFIASTTFKKGSMTLPVASEDVPQINSNKMYQGKTGGIPFELINQLPEIAFLGRCNSGKSTLLNSVTTEVTRNSLNEYANASKKAGFTKTINCFNVGGKFRIIDTPGYGTKGTVEQGKVTMDYLHKRRELRRSFLLISANNGFSEYDAQMIDLLVNDGIPFEIVFTKMDTIKDMAQVESIIEESNVLRLPTSPRFIFLNSMTNKRCQKRFGLDVLRYVVLEACGLLPGVRPSKIKK

SEQ ID NO: 56806 - protein, 212 aa, Brassica napus
  misc_feature (173)..(173): Xaa can be any naturally occurring amino acid
  misc_feature (187)..(187): Xaa can be any naturally occurring amino acid
  misc_feature (201)..(201): Xaa can be any naturally occurring amino acid
  unsure (1)..(212): unsure at all Xaa locations
MAMLETMSIIGTIMVLMLLLLLIIILFVCKPWRFLPRSRSSPFSTFKVGDLQRPLVSHDENLIQGQTSEASREFDLEEACFQNEGLLRSSLTEGRGVYKPRLPSSSSSPHLAQGESFDLQIISEPSDNALVGETLKHPADKVSSQEVQTYGSQQPDLEKDILSELSPRVVVKXQRSWLSLEVIAGPXVGLQYAGNSTSTSXLPVKLGRVSWK

SEQ ID NO: 56807 - protein, 461 aa, Burkholderia vietnamiensis G4
MVSGNEKDGLKRGLKNRHIQLIALGGALGTGLFLGIAQTIKMAGPSVLLGYAVAGVVAFFIMRQLGEMVVDEPVAGSFSYFADKYVGHFTGFLSGWNYWVLYILVSMAELSAVGIYVQYWWPGVPTWVSALVFYVAINLLNLASVKSYGETEFWFSIIKVAAIVGMIGFGGWLLVSGHAGPEASIANLWQHGGFFPNGVSGLVMSMAAIMFSFGGLELIGITAAEADDPKHSIPRATNQVIYRILIFYIGALAVLLSLYPWEKVVTGGSPFVLIFHALSSNLVANVLNVVVLTAALSVYNSGVYSNSRMLFGLATQGNAPKVLCSVNRRGIPLAALGASALATGVCVLVNYFMPGKAFEVLMGLVVSALIINWAMITLIHLKFRQAKRIAGEQTSFRSLGYPFTNYLCLAFMAGILVVMYLTPDLRLSVYLIPVWLAVLAIGYRFRQKNARYALGDGASAR

SEQ ID NO: 56808 - protein, 344 aa, Candidatus Kuenenia stuttgartiensis
MSMCENTFNKIYANVKKEAWMGQITYLEAIREAMDEEMSRDPGVFVLGEDVGVYGGAFRATEGFYEKYGEWRVLDTPLSESGFTGAAIGAALVGMRPIVEMQFADFISCAFDQLINVAAKFHYRMGTAVPMVVRAPYGGNIHGGAFHSQCIEGYFFNVPGLKIVAPSSVYDAKGLLKAAIRDNDPVLYCEHKYLYRRIKDTVPEDDYIVPIGMAKVVQEGTDVSVITYGAMVHTAIEAANEVKTKGVSVEIVDLRTLLPLDKKTIYESVKKTNKVIILHEQTKTGGVGAEVSALISEYCFDDLDAPVIRIAAPDTPVPYSPLMEEAFIPQTKDVVNTIDKIIRY

SEQ ID NO: 56809 - protein, 200 aa, Rhodococcus sp. RHA1
MPSCCPVGHVRTASLHTGGQEHFMSGDQRPHIVVMGVTGCGKTTVAQQLSELTGHRFLDADDLHPPSNVEKMAAGIPLTDDDRAPWLAVVRDRLQALSDQGRRGVVACSALRQSYRDILRDVSDPVLFVHLTGEREVIHGRMQARSGHFMPPALLDSQFALLEPLDADEFGVVLDVAPAPDAIARAAAEYLHEERKVATQ

SEQ ID NO: 56810 - protein, 416 aa, Candidatus Kuenenia stuttgartiensis
MTVDIIMPQMGESVAEGTILKWLVNEGDYVEKEQPLVEISTDKIDTEIPSPSAGIIKKILYKEGAVLAVQTVIAQIEEGEIKAQAGTVKKEQEEKERIEISETAAIAGEREMHEKRYSPLVKKLAKEYNVSLTEIKGSGEFGRVTKKDIMEYISSKREITASKEKIVKEAERETLIPLHPKRKITAERMALSRQTAALVTTVFEVDMTPVTKYRELNREAMKREGIHLTYLPFIAFAVVQALKEHVALNSSWTDNGILQKNYINLGIAVALEDGLVVPVIKDADKKDMFQLAREIQEIAVNARSKKLKPDDVRGGTFTITNYGVNGSLFGTPLILQPQSAILGVGAVVKRPVILGDADAIAVRSMVYLSLSFDHRVMDGAHADAFLHKVKDILETWGESLYEQKKPNPPGGYGGVW

SEQ ID NO: 56811 - protein, 522 aa, Spinacia oleracea
MSHPSTVTSEPSNLLDFVPKLGNFVLNSSLHGNNSNGYSSFSSNSVHFGGLATQNRYKFVNSLSFSKEGSNLKRILSDFNRVIRLHCDRIPLGFSSIGLNSGESNGVSDNGHGVLEDVRVPVNAVEPESPKRVLILMSDTGGGHRASAEAIKAAFNEEFGDDYQVFVTDLWSEHTPWPFNQLPRSYNFLVKHGPLWKMMYYGTSPRVIHQSNFAATSVFIAREVARGLMKYQPDIIISVHPLMQHVPLRILRGRGLLEKIVFTTVVTDLSTCHPTWFHKLVTRCYCPSNEVAKRATKAGLQPSQIKVYGLPVRPSFVRSVRPKNELRKELGMDEHLPAVLLMGGGEGMGPIEATARALGNALYDANLGEPTGQLLVICGRNKKLAGKLSSIDWKIPVQVKGFVTKIEECMGACDCIITKAGPGTIAEAMIRGLPIILNDYIAGQEAGNVPYVIENGIGKYLKSPKEIAKTVSQWFGPKANELQIMSQNALKHARPDAVFKIVHDLDELVRQKIFVRQYSCAA

SEQ ID NO: 56812 - protein, 408 aa, Leptospira interrogans serovar Copenhageni str. Fiocruz L1-130
MANINENYLKLKAGYLFPEISKRVKIYSEKNPSAKIIRLGIGDVTLPIVPSVVDAMVEASKEMGTVGGFHGYGPEQGYSFLLKSIADHDYGSLGIKIDESEIFVSDGSKCDCGNIQEIFSTDSKIAVADPVYPVYVDTNVMAGRTGEIGPDGRYSNLIYMPATKENGFQPEIPKEKADIVYLCYPNNPTGTVTTKESLKAWVEYAKKNNSIILYDSAYEAFISEPGVPRSIYEVEGAKEVAIEFRSFSKTAGFTGLRCAYIVIPKELKGRTRSGEEVSLNSLWNRRHTTKFNGVSYVTQKGAEACYSPQGKKEIQTSIAYYMANASKIRDGLKKAGYEVFGGVNAPYIWLKTSDNLSSWDFFDKLLNKAQVVGTPGSGFGPAGEGYFRLSAFGKKEDVEEAIARITSL

SEQ ID NO: 56813 - protein, 460 aa, Pseudomonas putida GB-1
MNAPFAPQRQTRDYQAADAAHHIHAFLDQKALNAEGPRVIVGGERLHLWDSEGKRYLDGMSGLWCTQLGYGRRDLTAAAATQMDQLAYYNMFFHTTHPAVIELSELLFSLLPGHYSHAIYTNSGSEANEVLIRTVRRYWQVVGQPSKKVMIGRWNGYHGSTLAATALGGMKFMHEMGGLIPDVAHIDEPYWYAEGGELTPAEFGRRCALQLEEKILELGAENVAGFIAEPFQGAGGMIFPPESYWPEIQRICRQYDVLLCADEVIGGFGRTGEWFAHEYFGFEPDTLSIAKGLTSGYVPMGGLVLSKRIAEALVERGGVFAHGLTYSGHPVAAAVAIANLKALRDEGIVRQVKDDTGPYLQRILREVFADHPLIGQVQGAGLVAALQFAEHKPTRKRFVNENDLAWQCRTFGFEEGVIIRSTLGRMIMAPALIANHSELDELVEKTRIAVDRTARLVGKL

SEQ ID NO: 56814 - protein, 396 aa, Rhodospirillum rubrum ATCC 11170
MSTVPAVMPTYSRVDLSFDRGEGAWLLANDGRRFLDFASGIAVTGLGHAHPHLVEALTSQAAKLWHCSNLFRIPGQERLAQRLVDGSFADSVFFTNSGAEAIEAALKLARRHQHVVRGETARYRTIVTRNAFHGRTLATVTAGGQAKHVKGFEPLVEGFDRVDFGDLDAARAAVTEETAAILVEPIQGEGGIFPAPEGYLSGLRRLADEHGLLLILDEVQTGVGRTGKLFAHEWDGIIPDVVAIAKGIGAGFPMGACLAREPYASALVAGSHGSTFGGNPLAMAVGNAVLDIILAEGFLDGVSARGADLIARLDGLVHRHPTILAGVRGRGLMIGLVCAAPNGVVLNALREQGLLAVPAEAGVVRLLPPMIIGEAEVTAAEEMIDRACVHLEREAA

SEQ ID NO: 56815 - protein, 497 aa, Pseudomonas putida GB-1
MYTLEFWQQRASDLYLPSQALINGKPVNAQDGATFAAINPATNKVLAQVAACGQTEVDLAVASARRAFEQGPWPRMAPGERKKVLLRLAELIMAHREELALLDSLNMGKPVMDAYNIDVPGSAHVFAWYGEALDKLYDQVAPTAPNALATITREALGVVAAVVPWNFPLDMAAWKLAPALAAGNSVVLKPAEQSPFSALRLAQLALEAGLPEGVLNVVPGLGEQAGQALGLHPDVDCLVFTGSTQVGKYFMQYSAQSNLKQVWLECGGKSPNLVFENCQDLDLAAEKAAFGIFFNQGEVCSANSRLYVQRAIHDEFVERLQAKARQWLPGNPLNPASRAGAIVDAEQTGRIEAAIARAGQEGARLVCGGRRLTLDGSDNYIEPTIFAGVEGRMKLAREEVFGPVLAVSAFDTEEEAVHLANDSIYGLAASVWSDDFNQVHRVARALKAGTVSVNTVDALDVTVPFGGGKQSGFGRDLSLHSFDKYSQLKTTWYQLRA

SEQ ID NO: 56816 - protein, 74 aa, Triticum aestivum
MRPQGHGDAAAAFIDGAPHRYLRDQQDDQATSMSLDEVSAAVSVLLGFAPPAMLPAPSSAKLNKLLLPKPFDRP

SEQ ID NO: 56817 - protein, 515 aa, Yarrowia lipolytica CLIB122
MPYIRCLGDCIGPINQLLNMSISISLPNGNKYEQPTGIFINNEWSEASDKGTIPVYNPSTGDEVVQVAAATAEDVDRAVVAARKAFQSWRDVPGEERAKLLDNFINLVSKNLDTVAAIEALDSGKPLQLNARGDIAGGLAVYKYYAGWADKVFGKTIVNTTKKLAYTLHEPHGVCGQIIPWNYPFLMAAWKIAPAIAAGNVVVMKLAENTPLSMLYLCNLFKEAGFPPGVINIFTGHGAKAGSRLAEHPDVDKIAFTGSTATGRIIMKLAATNLKAITLECGGKSPMIVLGDADLDQATKWAHAGIMTNQGQICCGVSRVLVHESIYDQFVDKYVEVVKQRSRVGDMFQDKILQGPQVSKVQQEKVLGYIEKGKEEGAKLVYSGAVAAEALEKGYFVPPTVFADVRDDMVISREEIFGPVVAIAKFSDVEDAINRANDSEYGLAASVYTKDLTEAHRISRRLESGQVFINMAHMGDYRMPFGGYKQSGIGRELGEYGLDTYTQCKAVHINMGMKL

SEQ ID NO: 56818 - protein, 425 aa, Campylobacter lari RM2100
MKNNKKAFEEACEYIAGGVDSPVRAFASVGSNPLFIKKGKGAYISDIEDNTYIDYVQSWGPLLFGHCDEDVEKACKKALEHGSSFGAPTLAETKLAKFILQDWPHLDKIRFVSSGTEATMSAIRLARGFSKKDKIIKFEGCYHGHSDSLLVSAGSGAATFNTPSSLGVLEDVAKNTLVAIYNDIDSVKNLVEKHSDIACIIIEPIAGNMGLVPAKKEFLQELQALCKKHQILLIFDEVMSGFRASYLGSYGIYNIQADIVTFGKVIGGGMPAAAFAARAEIMDLLSPLGGVYQAGTLSGNPLAMASGYASLKKARNYEGLYEKLEKLGKRLTQGLKEAANDCKIPLQVNCVGSMFGFFFCENPVNNYQDALKSDTKLFAKFHAQMLSKGIYLAPSQFETGFICESMDKKIIEKTIQAAQESFKTL

SEQ ID NO: 56819 - protein, 374 aa, Pseudomonas putida GB-1
MTTPLFRPIQAAVTRGKGAPFVLEQARIRAPQGDEVLVRIVATGMCHTDMIVRDQYYPVPLPAVLGHEGSGIVEAVGPLVQNLAVGDHVVMTYGYCGRCLACDAGQAAYCQDFFGRNFSGAGPEGEHALQDEQGHALNDHFFAQSSFATYALGRENNTVRVPKEAPIELLGPLGCGIQTGAGAVINSLRVTPGSAFAAFGGGAVGLSAVLAAQVAGAATIIAVDVVPSRLALALELGATHVVNSRETDPVAAIREITGGGVQFALESTGRPEVLRQAVDALGSRGALGVVGAPPLGTTAQFDVNDLLLGGKVIRGIVEGDSVPKKFIPELVNLYLQGRFAFDKLVRFYDFEQINQAAEDSEKGLTLKPIIRIQK

SEQ ID NO: 56820 - protein, 508 aa, Zea mays
  misc_feature (148)..(148): Xaa can be any naturally occurring amino acid
  misc_feature (170)..(170): Xaa can be any naturally occurring amino acid
  unsure (1)..(508): unsure at all Xaa locations
MEPAAASSLWGGLNYGIGLTLLAAVRVILCQALPGLQLHQYFVRHSRRLSRALASMLRPDLAVTVGECHRGRKRRKDAFKGRTGDVERRRRHARGPGRHLEAERVKGPDRLLLSMDDDEEITDEFTAATGTWRACTAPPREDSAPAYXGGRAPRADRRFYRLFFAERHRXDLVLGDYLTHVRREGRAVMVKNRQRKLFTNISGDGSWDSDGVWSHVVFEHPKTFATLAMDPDKKKEVMDDLDAFRNGKDYYARVGKAWKRGYLLYGPPGTGKSTMIAAMANHLDYDVYDIELTSVRTNTDLRKLFIETTSKSIIVVEDIDCSLDLTGKRKKKNKKEEDGENKKDGTTTKQQEEDKEKEDEKAGGSKVTLSGVLNFIDGLWSACGGERIIVFTTNHVEKLDPALIRRGRMDKHIEMSYCCVQAFKFLAKVYLDVDDHPRFDAVAALLREVDMTPADVAENLTPKAPGEDADSCLAALVEALEKAKEDALAKKAKGKEEAGSADELDDEE

SEQ ID NO: 56821 - protein, 1525 aa, Kluyveromyces lactis NRRL Y-1140
MDADSTSSLVEYQGFDHQVQEQIRDLARTLSRNSLKEQASQQESTGNVLASDDDGAKSIFSTRYEGVNPVFTDSDASGYDVRLDPNSDEFSSAAWIKNMVALANNDPEYYKHYTIGCCWKDLRAFGDSTDVAYQSTVLNLPGKIFSSVKRHFVKSKPEDVFDILKPMDGLLKPGDLLVVLGRPGSGCTTLLKTISSNIDGYNVDENSVISYNGLDPRTIKKHFRGEVVYNAESDVHFPHLSVYETLYNIALLVTPSNRIKGATREEFANHVTQVAMATYGLSHTRDTKVGNELVRGVSGGERKRVSIAEVTICGSRFQCWDNATRGLDSATALEFIRALKTSTDISGSTGVIAIYQCSQDAYDLFDKVCVLHEGYQIFYGNAKAAKAYFERMGYVSPSRQTTADFLTAVTNPAERIVNQEFVKEGRFIPSTAKQMEEYWRNSPEYKQLRGEIEEELNKDSTQTRQELIEAHIARQSKRQRKESPYIVNYGMQVKYLTMRNFLRIKKSYGITVGTIVGNTAMSLVLGSIFYKSMKDTTTNTFFYRGAAMFIAVLFNSFSSMLEIFSLYEARPIIEKHKRYSLYHPSADALASMLSELPAKIITAICFNLILYFMVNFRREAGPFFFYFLMNFLATLVMSAIFRCVGSATKTLSEAMVPASCLLLAISLYVGFSIPKKNLLGWSRWIWYINPLSYIFESLMINEFNGRDFPCAAYIPSGSGYENIGLYERVCNTVASQPGLSYVSGRAFIEEAYGYNPSHRWRALGIALAYFIFFTAFYLLFCEFNESAVQKGEILLFPKSVLKRAKKQKLIKAKHDVEAVQDSEGALTDQKLLQDSLVESNISSSSDKSVNVGLSKSEAIFHWRNVCYDVQIKKETRRILSNVDGWVKPGTLTALMGSSGAGKTTLLDCLASRVTMGVITGDMFVNGHLRDNSFPRSIGYCQQQDLHLSTSTVRESLRFSAYLRQPSSVSIEEKNNYVEDVINILEMQQYADAVVGVAGEGLNVEQRKRLTIGVELAAKPKLLLFLDEPTSGLDSQTAWSVCQLMRKLADHGQAILCTIHQPSALLMQEFDILLFLQKGGKTVYFGNLGEGCQEMINYFEKHGASKCPEGANPAEWMLDVIGAAPGSHATQDYHEVWRNSDEYQAVQKELDWMESELRKKPLDTSSEQSEFGTSLFYQYKVVTLRLFEQYYRTPSYIWSKLFLTIFSQLFIGFTFFKANLSIQGLQNQLFAIFTFTVIFNPACQQYLPLFVSQRDLYEARERPSRTFSWLAFIFSQITVEIPLNICFGTIAFFVFYYPIGFYNNASYAGQLNERGVLFWLFSVSFYVFISSMGQLCIAGLQYAEAAGNMASLMFTMSLNFCGVFGGSGVLPGFWIFMYRISPLTYFIDGVLSTGLANNPVTCANYEYVSFNPRSGETCGEYMADYIDKNGGYLLDSNATEDCNFCKISETNAFLTSFQSSYHRRWRNFGIFIVFIVFNWCGCVFLYWLARVPKKKNRVADERDPDHGKKIENVQKEKVEPQSNEQV

SEQ ID NO: 56822 - protein, 396 aa, Oryza sativa (japonica cultivar-group)
MLHLRNHLLPLLHAATSTASSSPLHLTHRLLSTAARSPFSVEHYLIATCGLTAAQARRASPKLSRLNSSSNPDAVLALLSSSAAGLDSLSLSRADLAAVVAAEPRLLRARPGTIARRIASLRGRANLSAPQIRSFLMSGRRGAPRLVRRLPEARVLGPLPRLLRHAPQDPQEMTQTAAWLLTFNPERLKIVVRRAEELGVPTSSWAFKDAVCTVARNNEGTIAARMEFLRGTLGCSMDKLRSAISRKPSILGFSEKTLRGKIEFLLTKVQLETEYILQRPVMLTLSLDKRLAPRHYVLQALVEKGLIKNDVDYYSCVCFGNEHFVARYIDRHEDALPGLTDAYAAVHAGKSPAQSLTQHLKTDRYRSHGNIYFSQISTSVNGRTTNDLIADNANAS

SEQ ID NO: 56823 - protein, 202 aa, Gibberella zeae PH-1
MAFLILVIGDLHIPDRALDIPAKFKKLLSPGKISQTLCLGNLTDKHTYEYLRSVSPDLKIVKGRYDVEATSLPLTQVVTHGSLRIGFLEGFTLVSNEPDLLLAEANKLDVDVLCWGGTHRFDAFEYMDKFFVNPGSATGAFMEGFSQEADEPTPSFCLMDVQGISLTLYVYQLRKDDKGNENVAVEKVTYTKPVEPSGGASS

SEQ ID NO: 56824 - protein, 378 aa, Rhodococcus sp. RHA1
MTTTRTGVAVIGTGTMGSAIMWRLSERGVPAVGLEQFTPGHDRGSGHGESRIFRTAYHEDPAYVPMLRAALRGWRELGEQTGEPVLTMTGGLSIGPSTGVIVGGSLEAAKVHALTQEILDPAEFATRFPTQRLREGDTAIWEKDAGVIRPELAITGAARRACELGASVRPESRVLNIEDGPGDTVLVRLDDEVIRADHVVVAAGAWIPGLLPAAQLPLTVERKILAWFPAEDPTQFGPDRFPVFLRDSPEGTWYGFPSMDGKTVKIALHLGGRETDPDELDRVVHDEDTAPLRDLVRRYLPGLGSRPVRAAVCMYTNTPDGHFVIGNPPAYRNVTVISACSGHGFKFAPVIGEIAADLSCGSTPEFPLELFDVNRFAD

SEQ ID NO: 56825 - protein, 817 aa, Rhodococcus sp. RHA1
MRSVPTGPPARHRRYASLTNWAEEDRIRCQELTGKDETMNDARTIDDHTAQLTPRAATPEALVEIEKRVLWLATSMIHHANRVRPNPTGLKVGGHQASCASMVSIMTSLWFEQLRPGDRVSVKPHASPVLHGINYLLGELDEKYLTTLREFGGLQSYPSRSKDPDPVDYSTGSVGIGATAPIWGAIARRYVNTQIGSAGTGRQYSLVGDAELDEGAVWEAILDTSVSELGEIVWIVDLNRQSLDRVVPNIAAGRLEAMFAAAGWQVITVKFGTLLESLFARTGGAALRTRILEMPNPEYQRLLRCDAEQVRVRLPGNGPDAAAIASLIADLDDDTLLRAIRNLGGHDLDALRAAYGQIDDTRPTVIIAYTIKGRGLPTQGHPQNHSSLLTVEQYEQLAAELGMDPANPWARFEAGSAAGRVCATTADRLRRNPVEPATPPAVPADIGRTPSGTSTTQAALGRALLDLSREAPDAAKRVVTVSPDVSSTTNLAGWLNKVGVWSPNERRNWFDDDAETIMHWREKPTGQHMELGIAETNLVGLMGELGATWSRWGQPLFPIGVMYDPFVERALEPWSYGIYAGGQSILVGTPSGVTLAAEGGAHQSIKTPSIGLEQPGCVSYEPAFAIDVEWTLLDSISRLGRPDGSSSYLRLSTRPVDQTLAAVPTDPAARERRRRQVVAGAYTLRHTEKPAVTLVGMGAMITETLTAADRLAEQGIAADVVCVTSPGLLFEAMQARRGLADGPSWILDQVFPADRAAPMVTVLDGHPHTLAFLAGINHVPGAALGVSKFGQVGSLDDVYLYHGIDTDSIVRAALDIS

SEQ ID NO: 56826 - protein, 578 aa, Debaryomyces hansenii CBS767
MFKQENGKKLESTRQLVDNGSNSSNNTANGSFTAKDKIDSNDLENHETPEDPDQIPSTNEIVENLPTLPEKSTKDYLSTSFFCLLIAFGGFVFGYDTGTISGFVNMTDFKRRFGTLDNGEYILTNIRTGLIVAIFNIGCAVGGIFLSKVGDIYGRRVGLMFSMLIYIVGTIIIIAASDKWYQVVIGRAITGLAVGCVSVLSPMFIGESAPKVLRGTLVCCFQLFITLGIFLGYCTTYGTKVYDDSRQWRIPLGLCFAWAIFLTIGMICMPESPRYLIEKNKIEEAKKSIGISNKVSAEHPAVYTEIQLIQAGIDREKLAGSASWTQLITGKPRIFSRVITGIVLQSIQQLTGNNYFFYYGTTIFQAVGLNDSFQTSIILGVVNFSSTFVGIYSIEKLGRRVCLLTGSVACSICFIIYSVLGSVALYPEGYDGPTDKPSGNALIFITCLFIFSFASTWAGGVYTIVSEIYPLRIRSKAMAVATAANWIWGFLISFFTPMITAAIHFYYGFVFTGCLIFSFFYVYFFVYETKGLSLEEVDELYSLKIPAWKSSDWVPPSTDNMAHDTGFASEAKPSDEQV

SEQ ID NO: 56827 - protein, 834 aa, Magnaporthe grisea 70-15
MAIKEKAYGILKDYAIEILILVCGAASGVQGGLQQFCFLAAWILFFDCILLFTFYTAILYIKLEINRIKRHVEMRKALEDDGLSRRVAENVASSNDWPAGKGSNTSLFGKQIKSTSVPKFKGMMVSGFIIINLLNLCSIPFRSTHSLSSLSTWAGGLGGVLNSPPVDPFKVAANGLDEILGEAKSTNTETIVTILTPIKYELEYPSVHYALPPPKSAVPPEADLGYGVGGRMVGGILKSLEDPVLSKWIVVALAMSVALNGYLFNAALMGIKDPNAATQPINPRELADAQKFNDTDQAMLPLGEYQPPTAPPTPRRQPSPGVEEESDSGRTQVDNSPLPPAVPRTAAEIDTILKEKRVYELSDEEIVAYSLKGKIPGYSLERSLKDCTRAVKIRRTIISRTKATSSITSLLDRSKLPYRNYNWEQVLGACCENVIGFMPLPVGVAGPLVIDGQSYFIPMATTEGVLVASASRGCKAINAGGGAVTVLTGDGMTRGPCVGFETLERAGAAKNWLDSDVGQAFMTKAFNSTSRFARLESMKTAIAGTNLYIRFRTTTGDAMGMNMISKGVEEALRAMAAPDEGGFTDMQILTLSGNYCSDKKPAAINWIEGRGKSVVAEAIIPGDIVRSVLKIDVDSLVEMNISKNLIGSAMAGAMGGFNAHAANIVAAVFLATGQDPAQVVESANCITIMRNLRGNLQISVSMPSIEVGTLGGGTILEPQSAMLDLLGVRGSHPTTPGDNARRLARIIAAAVLAGELSLCSALAAGHLVKAHMAHNRSTPATRSTTPAPPATGSGSGFMTPVGLAMTSAVEKATGGTLRSNKSSASLERQAAVGR

SEQ ID NO: 56828 - protein, 447 aa, Paenibacillus polymyxa
TIFQFPQDFMWGTATAAYQIEGAYQEDGRGLSIWDTFAHTPGKVFNGDNGNVACDSYHRYEEDIRLMKELGIRTYRFSVSWPRIFPNGDGEVNQEGLDYYHRVVDLLNDNGIEPFCTLYHWDLPQALQDAGGWGNRRTIQAFVQFAETMFREFHGKIQHWLTFNEPWCIAFLSNMLGVHAPGLTNLQTAIDVGHHLLVAHGLSVRRFRELGTSGQIGIAPNVSWAVPYSTSEEDKAACARTISLHSDWFLQPIYQGSYPQFLVDWFAEQGATVPIQDGDMDIIGEPIDMIGINYYSMSVNRFNPEAGFLQSEEINMGLPVTDIGWPVESRGLYEVLHYLQKYGNIDIYITENGACINDEVVNGKVQDDRRISYMQQHLVQVHRAIHDGLHVKGYMAWSLLDNFEWAEGYNMRFGMIHVDFRTQVRTPKQSYYWYRNVVGNNWLETRR

SEQ ID NO: 56829 - protein, 181 aa, Chlamydomonas reinhardtii
MGLRFTKALSRLFGKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNLANKT

SEQ ID NO: 56830 - protein, 333 aa, Oryza sativa (japonica cultivar-group)
MDSGGASDPSRQVRVRFLTKLPAPLRAPPTSIAVPADLTRMGLSEIVNSLLLAASPDHQAQPFDFLVDGELVRLPLQEFLLAKGISVERVLELEYVKAVAPRKQEDPCPHDDWVSAVDGSNPSFVLTGCYDGLARIWRDASECTHILEGHSDGITSARFINKGETEDRLHVVTASKDRSLRLFKICSGSWDNSIKLWSVEGSEEDGDTVSVKKRRTNSDSSGPEESLFEGSATSTFLGHTQCVSAVTWPERQTIYSASWDHSVRQWDVQTGKETWNMVSGKALNCLDCGGESSSLIAAGGSDPVLRWPLASVESHKDKIVEAFIVKVTARLSY

SEQ ID NO: 56831 - protein, 205 aa, Citrus unshiu
KLGDDEFGYMLANILKENNVDTSGVRYDSTARTALAFVTLRADGEREFLFFRHPSADMLLCESELDKNLIKQGSIFHYGSISLIAEPCRSTQLAAMNLAKESGSILSYDPNLRLPLWPSEEAARKGIMSIWDQADIIKVSDDEITFLTGGDDHNDDNVVLEKLFHPNLKLLIVTEGSKGCRYYTKEFKGRVPGVKTKAVDTTGAG

SEQ ID NO: 56832 - protein, 471 aa, Pseudomonas putida GB-1
MHRPCVPPCLGTGHVPVAPQLNTISRNEQFMNHSKITPAAPRMSQGSIGDKLRGAFGVGKTRWGMLALVFFATTLNYIDRAALGIMQPVLAKEMSWTAMDYANINFWFQVGYAIGFLLQGRLIDKVGVKRAFFFAVLLWSLATGAHGLATSAAGFMVCRFILGLTEAANYPACVKTVRLWFPAGERAIATGLFNAGTNVGAMVTPALLPLILAVWGWQAAFIAMGSLGLVWVVLWVLKYYNPEDHPSVRQSEVQYIQQDDEPEPTRVPFSRILRLRGTWAFAVAYAITAPVFWFYLYWLPPFLNQQYSLGINVTQMGIPLIIIWLTADFGSIGGGILSSWLIGRGVRATTARLVSMLIFACTMLSVIFAANASGLWVAVAAISLAVGAHQAWTANIWSLVMDYTPKHLVSTVFGFGSMCAAIGGMFMTQIVGSVLTATHNNYAVLFTMIPAMYFLALVWMYFMAPRKVESA

SEQ ID NO: 56833 - protein, 369 aa, Oryza sativa
MRPGGPPSLRAGLQQQQQQQPGTPGRSRRRPDLTLPLPQRDLTSLAVPLPLPLPPSSAPSSTSSSGSSSLGGVPTPPNSVGSAPPAPPPLSELERVRRIGSGAGGTVWMVRHRPTGRPYALKVLYGNHDDAVRRQITREIAILRTAEHPAVVRCHGMYEQAGELQMLLEYMDGGSLEGRRIASEAFLADVARQVLSGIAYLHRRHIVHRDIKPSNLLIDSGRRVKIADFGVGRILNQTMDPCNSSVGTIAYMSPERINTDLNDGAYDGYAGDIWSFGLSILEFYMGRFPLGENLGKQGDWAALMCAICYSDSPAPPPNASPEFKSFISCCLQKNPARRPSAAQLLQHRFVAGPQQQQQPQPQPLAPPPS

SEQ ID NO: 56834 - protein, 892 aa, Symbiobacterium thermophilum IAM 14863
MTKKWVYLFHEGRADMRMLLGGKGANLAEMTNIGLPVPPGFTITTEVCREYQKTKQLDPEVIEQVNAALTALEQQTGKKFGDPRNPLLVSVRSGAPISMPGMMDTVLNLGLNDETVVAMAELTGNERFAWDSYRRFIQMFSNVVLGIELHNFEAILEAHKKRNGFTQDIELQAEHFKAIVPEYKAVVEKHTGKPFPMDPREQLMAAIRAVFESWDNPRAQVYRKINKISDDLGTAVNVQAMAFGNMGDDSATGVCFTRNPNSGAKEFYGEYLPNAQGEDVVAGIRTPYPIAHLKETMPEVYQQLFDLCELLESHYKDMQDIEFTVERGKLYMLQCRAGKRTPIASIKIAVDLVKEGKISKEQAVLRVDPEQINNILHPAIDPKAKLDILAKGLAASPGAATGMCVFDPDRAAKLAGEGHKVILVRPETSPDDIHGMVVAQGILTSRGGMTSHAAIVSRGMGKPCVVGCEAIKVDLEAREFRVNGRVVKEGEVISIDGATGNVIYGEVPVVDPELSPEFRTLLSWADEIRTMGVRANADTPIDAAKAREFGAEGIGLCRTEHMFGQGGHHPERMAVAREMILAETTEERMVALEKLQEMQRQDFYEIFKAMNPFPVTIRLLDPPLHEFLPDAEDLAIEVAIMRERGETGSELQEKEALLKKVRALAEMNPMLGFRGCRLGMIYPEIYEMQVRAIFEAAAQCNKEGMVVEPEIMHPLVSIVTEFSFLREMTDRIAREVMEKHGVTFKYMVGTMIEVPRAAVTADEIAEHAQFFSFGTNDLTQTTFGFSRDDAEGKFLAQYVEQKVLPENPFVTIDRKGVGKMVEIACELGRKVRPDIKLGVCGEHGGDPSSIEFFQSCGLTYVSCSPYRVPVARLAAAQAAARAKGERATSSTV

SEQ ID NO: 56835 - protein, 6889 aa, Ralstonia solanacearum GMI1000
MSKNDQTLPRDPDTLVALLESLAATRPDDTAYVFLQDGDEGESRMTYAELHDAARRVAVHLLGNGCGQDDPVLLIFNPGLDYICAFFGCLYAGAIPVPAYPPAHARRLERLQAVAVDAGARFALTVSEELSRIASFETQQGKRLPVERWLAIDRADSDAGDWTDPGLDGSRIAFLQYTSGSTGAPKGVMVTHRNLFANVAAMTAEGRMGRDEVMVYWLPPYHDFGLIGGILQPLVLGCTVVLMRPAAFLLNPYRWLKAITDYRATVAGAPNFAFDLCVRSITPAQRATLDLSRLRVLASGAEPVRPGTLEKFTAAFAPHGFNPAAWFAAYGMAEATLLIAFGWAIRFQGQPRCLPFSRLALQKGMAVAADDEADRIALASHGSALTGHQLAIVDPETLRRCEPGRVGEIWVSGPSVAQGYWRRDEDSRRSFAGEMAEPADGERYLRTGDLGFLHAGELYICGRLKDLIILNGLNIYPQDVELAAFESHARLRENGTIAFAVDRDDTEQLVIVQELEFRQPVEPGMFECMASAVSMNVGVTPDVIVLVKAGAIPRTSSGKIRRQQCRADFLADRLPAMARWDRPVLAASPVPVAPGAPVLAAAREPVAVSAAVVEARLRAELAARLGLDAEAIDREQPFAFYGLDSMSAVQLAEALSVWMRVTVAPVVFWEHPNIARLAGFLAELSAAGQGDRHPAEAAPDAPAQAADAPIAIIGLGCRFPGADDADAFWDALDGQVDAIGAVPQARRAAGTFDEPRAELPSQVRLGGFLDRVDAFDAAFFSISPLEAARMDPQQRLALEVAWQALEDAGIAASGLAGSTTGVFIGISTHDYENLQDRAGSELSVYSATGNAGSIVANRLSYCLDLRGPSLAIDTACSSSLVAVHAACQSLRDGESTLALAGGVNLVLSTLSSEPFARAGMLSPDGRCKAFDASANGYVRGEGCGVVVLKRLSDALRDGDPVRAVILGSAVMQDGRGNGLIAPNGSAQAAVVRQALARARLRPEQIGYIEAHGTGTALGDPIELNALKSVFAHAPEAGRCAVGSVKTNIGHLEAAAGVASLIKVVLALEHETLPANLHYREPNPHCALDGSALSIVSRSQPWPGNAGRRHAGISSFGFGGTLAHMIVAQAPPAATAHGAQWPWHLLSLSAKTAPALEAMTEAVAGQLRDLPDAALADAAYTHQAGRNAFAWRRMLVARDREDAAEALRARDPRRVFTAQVRPAVPAPVVFMFPGQGAQQVGMARELYQEIAAFRAVVDRCAQVLRERAGFDLIQSLYGDGDPEASHLALTRTEAAQPALFVIEYALARLWMDWGMKPAALIGHSVGEYVAACLAGVFSLDDALVLVAERGRLMQSLPAGAMLSVALDEASLRAQLDGTLALAAVNGRQRCVVAGETTAVAALERRLDAQGISHRRLATSHAFHSHMTEPILPAFADSVARLTLRAPAIPFVSNLTGAWIEPAQATDPGYWAAHLRGTVRFADGLQTLMQGGPHAWIEVGPGQTLSALARPCAGDALVLPSLGGGEGPKSDLAVLLGSAGQLWLAGQALDWRALYAGQQRRTLRLAPYPFQRERHWLDAPAAPQQDAQASVEPSRAVTSMPVAAAMSSSVSNSASRAQAIQGALRGMVAKMLHADVARVDPDLPLLELGADSLMMVQAIGSIEQTYGVTVTVRQLFEELTTIAAIADYVDRQMPREARLEAAAEAPATVPAAAVMPMPAPAPAAPVAAIAVDARPDAVPPLAAIPALPQSSLERLLSQQLDALSQLTARQLALFQGGTVAATAGGPASVAGETSPVVPTVMPAAVPVVAPAPASTAAPGGTHKPYVPYQPVRVTAKADPFRDLSARQRAYLDGFVARYTERTRGSKALVQRYRPVLADNRVSAGFRFSTKEMLYPVVSERSEGAYLWDPDGNVYIDLTMGFGVNLFGHRPAFVQEALDAQLKTGLELGPQTRLAGEVAELVTRLTGLERVAFCNSGTEAIMLALRLARTVTRRDKIVVFAGSYHGWSDDTLMVADGAGTVAMAPGLQPGASAHTIVLDYGAPESLARIREHAHELAAVLVEPVQSRRPHWQPREFLHALRELTREHGIALIFDEIIMGFRLHPGGAQAWYGIEADMATYGKVIGGGMPAGMVAGSAAYLDAVDGGQWRYGDASYPQADTTFYAGTFCKHPLMLVAARAVLQRLAQEGPALQETLNARTAELVRRLNGVFADARVPVRAVHCGSSFRLLEASPSIDLLYYHLLAGGLYIWEGRGMFLSTAHSDADVDRVVEIFADSVRAMLDGGFFEDGAPTPPSGGGGRSPFAAARVGGPASTDAPVAPALAEAAVARLSAAPVPPATGGGIRFGISFFGHYASGYDAQKYRLLFEAARYADAGGFSSLWLPERHFHAFGGLSPNPSVLSAALARETSHIQLRAGSVVLPLHHPVRVAEEWSMVDNLSQGRVGIACASGWHPNDFVFAPEAFGSHRELMFQRIEQIQALWRGEPLRVRDGSSREIEVKLFPMPRQPELPIWITIVGNPDTYRRAGEIGAGILTNLMGQTVEALECNLALYRQALVEHGHGVERSRVSVLLHTFVCEDAAEARAVARAPFIHYLRSSVGLFQNMVDSLGLQADVSTLSEDDRDYLLSVAYERYVEHSALIGSPATCRALVERLQAIGVDEIGCFIDFGVDPDTVLGRLDQLALLKQSFETAAVDDDAAERYPLVPAQKGIWFECQISHEAALSYNTTTVLGLRGALDHAALARALQQVVDRHAALRSVVEADGEHQRVLPAVEVGLPLVDFSREADRDAAIGQWFVDNNHRPMDPGHGPLVRACLLRKGEAEHLLAITFHHVIIDGYSQEIVLQELAACYRAACRGGAPGLPAASPFREQVERHQAYLRSDRYQQDRAYWRGQFGSLPPSLELSGRHARPSAPSHRARRHHLTIDGERYARLQQLSRKLGGTLFMTMLAGVAVLLQRLSGQAQMVIGVPMVVGRAEGSEASLVGCTLNLVPVRCDGSGDPSFAEFLGRIKRSVLEAHAHADYPFGHLLRDLDLRASQRRPLAPVLFNLNRSLALPQFDALQAWLEQSPISFSPDDLTIDVMQLPDRLQVMFQYQEVLFEHEAIERMAAQFVQLLDGIVADPACSIGRLALLSAEERRQIVDVWNAGEPVPEPSETLHAVFEAQVRRTPEAIAVEHEGWRVSYAELNARANRVAHALIGLGVGPDARVGLCAERSVELVIGLLGILKAGGGYVPLDPSYPRDRLAYMLEDSAPVAVLAQSNTREPLGALSVPVLDLENPLEGEAEHDPQVTGLEPNHLAYVIYTSGSTGQPKGVLVEHRQVARLFTSTQPWFGFGAEDVWTLFHSFAFDFSVWELFGALLHGGRLVVVPKLTARSPQAFYALLCEAGVTVLNQTPSAFRQLMAAQQEAPAARHRLRQVILGGEALEVGALRPWYERAENAGTQLANMYGITETTVHVSYRALEAADAQGTGSPIGRRIPDLRVYVLDAHGEPVPVGVTGEMYIGGAGVARGYLNRPELTAERFVVNPFHGEGRERMYRTGDLGRWLPDGSLEYQGRADAQVKLRGFRIELGEIEASLSQCAGVREAVVTVREDVPGEQRLVAYYVSGEAIEAQALREQLQGSLPAYMVPAAYVRLAHLPLTSNGKLDRKGLPAPEGHAYASTAYEAPQGEVEQTLAGIWQTLLGVERVGRHDDFFALGGHSLQAVRLVTQVRVQLGAELGLTALFAQPSLSAVAQAIVRGQGSALQAITAADRSEALPLSFAQQRLWLLAQMEGGSEAYHIPVGLRLKGELDEDALGRALDRIVARHEALRTRFEVREGQAIQRVASADVGFALDRVDLQGQADREQTLAALSEREANTPFDLEQGPLIRGCLVKLGEQEHVLLITMHHIVSDGWSQGVLARELGALYEAYRSGGEDPLPALPIQYADYAVWQRRWLEGGELQRQGAYWEQALAGAPTLLSLPTDRARPAQQDYAGGSVEVVFDETLSADLKRLSQRHGTTLFMTVLAGWSALLSRLSGQEEVVVGSPVANRTRSEVEGLIGFFVNTLALRVNVGSATVSELLDRVKAKVLEAQAHQDLPFEQVVERVKPVRSLSHSPIFQAVFSWHNTEAVDLSLRALSLESLARENATAKLDIQLELAEADGRIVGTLNYATALFERSTAQRYADYLQRMLQAMVADDGQQVGRIALLGEAERAQVLQAWNATERAWPAATLPALFEAQVMRTPDAVALKHADQQVSYRELDARANRLAHHLRELGVAADVLVGLCVDRSIEMIVGLLGILKAGGAYVPLDPDYPQARLAYIFQDAMLSVLVSKRALAQRLPIAWTQVVELDDAEPAWADYPPTPPQVQGEPGQLAYVIYTSGSTGQPKGVAVTHQGVASLVYSQCERFGVSSQSRVLQFASISFDAAVSEIGMGLLCGACLVLAPAQALMPGAALTHLLDRERITHVTLPPAVLALMPEQALPADCHLIVAGEACPPSLVRLWSEGRTMINAYGPTEATVCATMSRALTAQDAPSIGGPIGNVRVYVLDAYLQPVPVGVTGELYIAGSGLARGYWQRAGLTAERFMANPFALGERMYRTGDLGRWLPDGSLEYQGRADAQVKLRGFRIELGEIEARLSQCAGVSEAVVTVREDAPGEQRLVAYYVSGEAIEAQTLREQLQSRLPEYMVPAAYVRLEHLPLTPNGKLDRKGLPAPEGQAYASTAYEAPQGEVEQTLAGIWQTLLGVERVGRHDDFFALGGHSLQAVRLVAQVRTQLGAELGLTELFAQPSLSAVAQAIVRGQGSALPAITVADRSGPLPLSFSQQRLWFLAQMEGGSEAYHIPVGLRLKGELDEDALRRSLDRIVARHEALRTRFVTEEGQAVQRVASADVGFALDCVDLQGQADREQALATLSEREANTPFDLAHGPLIRGRLVKLGEQEHVLLITMHHIVSDGWSQGVLARELGSLYEAYRAGNADPLPALPIQYADYAVWQRRWLEGGELQRQGTYWEQALAGAPTLLSLPTDRARPPQQDYAGGSVEVVFDAELSTGLRTLSQRHGTTLFMTVLAGWSALLSRLSGQGEVVVGSPVANRTRSEVEGLIGFFVNTLALRVEVGGATVSELLERVKAKVLEAQAHQDLPFEQVVERVRPVRSLSHSPVFQAALSWLNTEAVGLSLELEGLTIEGVDAGQAAAKFDLTLELRETSEGLAGSLDYATALFDRATIERYLGYLHRLLKAMAADDSQEVNRIALLDEGERTQLLESWNETKAPYPRASTIHGLFEAQVRRTPEAIAVVHEGQQVSYAELNARANRVAHALRRLGVGPDARVGLCAERSVELVVGLLGILKAGGGYVPLDPSYPQDRLTYMLEDSAPVAVLTQSNTREQLGALSVPVLDLDGPLEEAEHDPQVTGLEPHHLAYVIYTSGSTGRPKGVMNEHRGVVNRLWWAQQTYRLDASDRVLQKTPFGFDVSVWELFWPLLAGARLVMARPEGHKDPAYLAATIEQAGITTLHFVPSMLQLFLDQVEAGRCQGLRRMLCSGEALSHALQQRSLARFPHSELHNLYGPTEAAIDVTAWRCNAEIHPGVVPIGRPIANTQMYVLDGHQQPVPLGVTGEIYIGGIGVARGYLNRPELTAERFVVNPFHGEGRERMYRTGDLGRWLPDGSLAYQGRADAQVKLRGFRIELGEIEARLSQCAGVSEAVVAMREDVPGEQRLVAYHVSDEAIEAQTLREQLQASLPEYMVPAAYVRLEHLPLTPNGKLDRKGLPAPDGQAYASAAYEAPQGEVEQTLAGIWQTLLGVERVGRHDDFFALGGHSLQAVRLVAQVRTQLGAELGLTELFAQPSLSAVAQAIVRGQGTALPAITVADRGEALPLSFAQQRLWFLAQMEGGSEAYHIPVGLRLKGELDEDALRRSLDRIVARHEALRTRFEVQEGQAVQRVASADVGLTLDWADLSAEAASEHQLGLLAEAWARAPFDLEQGPLIRGRLVKLGEQEHVLLITMHHIVSDGWSQGVLARELGALYEAYRAGNSDPLPALPIQYADYAVWQRRWLEGGELQRQGTYWEQALAGAPTLLSVPTDRARPPQQDYAGGSVEVIFDETLSAGLRKLSQRHGTTLFMTVLAGWSALLSRLSGQEEVVVGSPVANRTRSEVEGLIGFFVNTLALRVEVGSATVSELLGRVKSRVLEAQAHQDLPFEQVVERVRPVRSLSHSPVFQAALSWLNTEAMVLKLDGLTIEHLADESYTAKFDLSLALREHDGRIAGSLDYATALFDRETIERYLGYLHRLLAAMVENDSQQVSRIGLLDEGERAQLLESWNETKAAYPDASTIHGLFEAQVRRTPEAIAVEHEGQQVSYAELNARANRVAHALRRLGVGPDARVGLCAERSVELVVGLLGILKAGGGYVPLDPSYPQDRLAYMLEDSAPVAVLAQSNTREQLGALSVPVLDLDRPLLEEAEHDPQVTGLEPHHLAYVIYTSGSTGRPKGVMVEHRGLSNLLDWYLEDLGLRSDDTVLLVSSYSFDLTQKNILGPLLAGGRLHLAGPFVPDALVAQIRREGITHINLSPSAFHALIDAAGAEGLGGLRRVVLGGEPIQPARLQGLPEPRPRFINSYGPTECSDVVAWHALDAELDRYRAASVPLGRSVRNVRLYVLDAHRQPVPTGVAGEIYVGGAGVGRGYRNLPELTGACFLADPFHGEGQARMYKTGDLGRWLANGSLEYLGRSDDQVKLRGFRVELGEIGASLARCDGVREAAVLAREDAPGEPRLVAYYVAEPGAAVEASALRRHMQAQLPEHMVPAAYVRLEHLPLTPNGKLDRRALPAPAADAYARRRYVAPQGDVETMLAELWQDLLGVERVGRHDDFFELGGHSLLAMSLMARMDELGLSADVRVLFTQPTLAGLAAEVEPMEIVL

SEQ ID NO: 56836 - protein, 304 aa, Triticum aestivum
  misc_feature (175)..(175): Xaa can be any naturally occurring amino acid
  misc_feature (186)..(186): Xaa can be any naturally occurring amino acid
  misc_feature (197)..(197): Xaa can be any naturally occurring amino acid
  misc_feature (212)..(212): Xaa can be any naturally occurring amino acid
  misc_feature (214)..(214): Xaa can be any naturally occurring amino acid
  misc_feature (226)..(226): Xaa can be any naturally occurring amino acid
  misc_feature (236)..(236): Xaa can be any naturally occurring amino acid
  misc_feature (240)..(240): Xaa can be any naturally occurring amino acid
  misc_feature (244)..(244): Xaa can be any naturally occurring amino acid
  misc_feature (249)..(249): Xaa can be any naturally occurring amino acid
  misc_feature (264)..(264): Xaa can be any naturally occurring amino acid
  misc_feature (281)..(281): Xaa can be any naturally occurring amino acid
  unsure (1)..(304): unsure at all Xaa locations
MEQYEKVEKIGEGTYGVVYKARDRATNETIALKKIRLEQEDEGVPSTAIREISLLKEMQHGNIVKLHDVVHSEKRIWLVFEYLDLDLKKFMDSCPEFAKSPALIESYLYQILRGVAYCHSHRVLHRDLKPQNLLIDRRTNALKLADFGLARAFGIPVRTFTHEVVTLWYRAPEIXFLGARQYSTPXVDVWSVGCIFXQEMVNQETTVPWVIXRXDELFKIFRVPGXPNEQTWPSVXPLPXDYKXAFPKXWQAEDLATVVPNLEXLGLGLLSKMLRFEPNKXLRQASLDMLKAWWAMTPWNDNFD

SEQ ID NO: 56837 - protein, 460 aa, Sinorhizobium meliloti
MPVEILMPALSPTMEEGTLSKWLKNEGDKVSSGDVIAEIETDKATMEVEAVDKGTIGKLLIAAGTEGVKVNTPIAVLLQDGEAASDIDSMKTEAPKAETPKPAAAEAPAASAAPVAAQPKADVPSDPAIPAGTEMATMTVREALRDAMAEEMRANEDVFVMGEEVAEYQGAYKVTQGLLQEFGARRVVDTPITEHGFAGVGVGAAMTGLRPIVEFMTFNFAMQAIDQIINSAAKTLYMSGGQMGAPIVFRGPSGAAARVAAQHSQCYAAWYSHIPGLKVVMPYTAADAKGLLKAAIRDPNPVIFLENEILYGQSFEVPKLDDFVLPIGKARIHRTGKDATLVSFGIGMTYAIKAAAELEAQGIDVEIIDLRTIRPMDLPTVIESVKKTGRLVTVEEGYPQSSVGTEIATRVMQQAFDYLDAPILTIAGKDVPMPYAANLEKLALPNVAEVVDAVKAVCYK

SEQ ID NO: 56838 - protein, 229 aa, Pyrococcus abyssi GE5
MNIEEMKKIAAKEALKFIEDDMVIGLGTGSTTAYFIRLLGDMIKKGEVSDIVGVPTSYQSRLLAIESGIPVATLDQVDAIDVAVDGADEVDPNLNLIKGRGAALTMEKIIESRAGMFIVLVDERKLVDYLCQKMPVPIEVIPQAWRAIVEELSIFNAEAKLRMGVNKDGPVITDNGNFIIDAKFPRIDDPLDMEIELNTIPGVVENGIFADIADIVIVGTKEGVKTLER

SEQ ID NO: 56839 - protein, 246 aa, Sulfolobus solfataricus P2
MRVGATLARAIALKYNKKLVPVNHGIGHIEIGYLTTEARDPLILYLSGGNTIITTFYKGRFRVFGETLDIALGNMMDVFVREVSLAPPYIINGIHVIDICAEKGNKLLKLPYVVKGQDMSFSGLLTAALRVVGKEKLEDICYSVREIAFDMLLEATERALALTSKKELMIVGGVAASVSLRKKLEELGKEWNVQIKIVPPEFAGDNGAMIAYAGMLAASKGVFIDVDKSYIRPRWRVDEVDIPWRN

SEQ ID NO: 56840 - protein, 371 aa, Triticum aestivum
  misc_feature (190)..(190): Xaa can be any naturally occurring amino acid
  misc_feature (238)..(238): Xaa can be any naturally occurring amino acid
  misc_feature (247)..(247): Xaa can be any naturally occurring amino acid
  misc_feature (253)..(253): Xaa can be any naturally occurring amino acid
  misc_feature (263)..(263): Xaa can be any naturally occurring amino acid
  misc_feature (287)..(287): Xaa can be any naturally occurring amino acid
  unsure (1)..(371): unsure at all Xaa locations
MAASSFLPLHLPASPRPATVAARAASGVASTVPAATTQTSQLEETFGRKGLRFGTDATGAPTAELSVRNGSSLQLRLNDGLVTSYRPKVSWEGGDGCRELLHTVAGAGAVKGGVGLVLNEASSSSSGGASLLGACEWSVADVDSDSYDAVQVELGCGVGGAKGAKLEVSYVVTLYPLSMATAVIVKNNGXKPVELTGAVLSHIKFDKRRGHGRGRGLRGCPYCSHPPPASGFALLTPXAEAMKREEXGWFGGXGGGEEPRQGXWTVEENLYTILKKKVSRVYAAPPXEERKKRIYSTAPSKFTTIDQSSGLGFRLVRMGFEDMYLSSPGGLYEKFGNDYFLCTGPASILVPVVVGPGKEWRGAQVIEHDNL

SEQ ID NO: 56841 - protein, 469 aa, Triticum aestivum
MSSSGGGGAGQQFRYTQTPSKVLHLRNLPWECTEEELVELCKPFGRIVNTKSGVGANRNQAFVEFTDVNQAISMVSYFASSSEPAQIRGKTVYIQYSNRQEIINNKSPGETAGNVLLVTIEGVQASDVTIDVIHLVFSAFGFVHKIATFEKAAGFQALIQYTDAPTASAAREALDGRSIPRYLLPDHVVSCHLRISFSAHKDLNIKFQSHRSRDYTNPYLPVNSSAIDSTLQPAVGADGRRVEAEGNVLLASIENMQYAVSVDVLHTVFSAFGTVQKIAIFEKNGGTQALIQYPDASTATIAKEALEGHCIYDGGYCKIHLSYSRHTDLNVKAHSDKSKDYTIPEGAHQAAPQPAGVPPTTAGWQGNSQAAGPYGPPGVAAQNQNTNGQMPNWNPGNSGYPPATGQYPGHMYSAPPQQYTATSGGFSAPPPPPHEMHPSHQMPPAHHGNQQRPASGAPGTGQPPPYYHH

SEQ ID NO: 56842 - protein, 973 aa, Adiantum capillus-veneris
MSSKTMTYSSSAAEPRSSSSSVVGSKHNRRVVVAQTTADAKLHAVFEQAQSEGDTGGSSFDYMRSIEDARGSVLSERVPAQAVTAYLQRMQRGGLIQPFGCMLALEEGSFRVIAYSENAAEMLDLMPQSVPSVGVQVLVLGIGTDARTLFTYASAAALEKASGAVDVSMLNPITVHCRSSSKPFNAIVHRIDVGLVIDFEPVRPADVAVWAAAGALQSHKLAAKAISRLQALPVGDIDLLCDSVVEEVRELTGYDRVMAYKFHEDEHGEVLAEIRRSDLEPYLGLHYPATDIPQASRFLFMKNRVRMICDCRALPVRVIQDKELRQPLSLAGSTLRAPHGCHSQYMANMGSIASLVMAVVVNDNDEDVSNRSQQPKMRRLWGLVVCHHTTPRAVPFALRSACEFLMQVFGLQLNMELELAAQMREKHILRTQTLLCDMLLRDAPIGIVSESPNIMDLVKCDGAALYYGKNFWLLGTTPIEAQIKDLAEWLLDVHRDSTGLSTDSLADAGYPGAAALGDAVCGMAAAKITTRDFLFWFRSHTAKEIKWGGAKHDPEDRDDGRKMHPRSSFKAFLEVVKRRSLPWEDMEMDAIHSLQLILRGSFQDIDDSDTKTMIHARLNDLKLHGMDELSTVANEMVRLIETATAPIFAVDAGGFINGWNAKVAELTGLTVEEAMSRSLVRDVVVNASMETAERVLDLALQGQEEQNVEIKLKTYGDQAIKGPVILIVNACSSRDFTDNVVGVCFVGQDVTGQKVVMDKFTRIQGDYKTIVQNPNPLIPPIFGADEFGYCSEWNPAMEKFSGWKREDVIGKMLIGEVFGSDLACCKLRGQDSMTKFMIILNAAMGGRDSDRFPFGFFDRYGKYAEALLIANKRTDSDGAITGVFCFLHTASPELQQALQVQKRSARTALDRLKEVAYMKQEIRNPLYGIVFTRKLLDNTNLTDEQKQIMETSSLCEKQLQNILDEDNFEKLDQ

SEQ ID NO: 56843 - protein, 416 aa, Pseudoalteromonas tunicata D2
MDHFNYRDNQLFAEGVSVQDIATQFGTPCYVYSRATLERHYHAFTDAAAGQHHLVCYAVKANSNLAVLNVLARLGSGFDIVSQGELARVVAAGGDPRKVVFSGVAKTAHEIRYALELGIKCFNVESEAELERISDVATELGQTAPISIRVNPDIDAKTHPYISTGLKENKFGIEIHRAVSVYQHAATLPGISIEGIDFHIGSQLTEVEPFLAALDKVLAIIKQLKTLNIHIKHLDVGGGLGVAYLAEEPPHPSSYVSQLVERLSEFSDLELVFEPGRAIAANAGILITQVEFLKQNQGKNFAIVDAGMNDLLRPSLYQAWQNIIAVSPRSGTPSSYDIVGPVCETGDFLGKDRELSLQQGDLLAVRSAGAYGFSMSSNYNSRPRVAEIMVDGATAHEIRKRETIADLYQGENKLPN

SEQ ID NO: 56844 - protein, 739 aa, Oryza sativa
  misc_feature (700)..(700): Xaa can be any naturally occurring amino acid
  unsure (1)..(739): unsure at all Xaa locations
VEAVVMPERYALGGACRVLAGMPAPLGATALDGGVNFAVYSAGASAASLCLFTPDDLEADEVTEEVPLDPLFNRTGNVWHVFIEGELHNMLYGYRFDGMFAPHCGQYFDVSNVVVDPYAKAVISRGEYGVPGPGGDCWPQMAGMIPLPYSTFDWQGDLPLRYPQKDLVIYEMHLRGFTKHSSSNVEHPGTYIGAISKLDYLKELGVNCVELMPCHEFNELEYFSCSSKMNFWGYSTINFFSPMIRYSSGGIRNCGRDAINEFKTFVREAHKRGIEVIMDVVFNHTAEGNEKGPILSFRGIDNSTYYMLAPKGEFYNYSGCGNTFNCNHPVVREFIVDCLRYWVTEMHVDGFRFDLASIMTRGCSLWDPVNVYGSPVEGDMTTTGTPLATPPLIDMISNDPILGDVKLIAEAWDAGGLYQVGQFPHWKIWSEWNGKGMGYEKYRDIVRQFIKGTDGFAGGFAECLCGSPHLYQAGGRKPWHSINFVCAHDGFTLADLVTYNKKYNSSNGEDNRDGENHNLSWNCGEEGEFAGLSVKRLRKRQMRNFFVSLMVSQGVPMFYMGDEYGHTKGGNNNTYCHDHYVNYFRWDKKEESSDLQRFCSLMTKFRKQCESLGLADFPTAQRLHWHGHQPGKPDWSETSRFVAFSTKDETKGEIYVAFNASHLPAVVGLPERPGYRWEPLVDTGKPAPYDFLTDDLPDRXTPSTCSLISSTPISTPCSATPPSSLNCSLMIERTKYSIV

SEQ ID NO: 56845 - protein, 275 aa, Aspergillus nidulans FGSC A4
MSTLFEVTSEESFGPHLASIPSDTLIVLYFHAPWAAPCAQMRAVLSALASQYPATTPPTVSFISVNAEELPDISEEYDVTAVPYVVLLRNGQVLETISGSEATKVRDAVERYAGAGSAGASANGAASAIPPALTAVPREDVNTPTTATQAPVAGAASGAGAAPALTPEQSKEALFARLSELVKAAPVMLFMKGTPSAPQCGFSRQLVGILRERSVKYGFFNILADEDVRQGLKEFADWPTFPQLWVNGELVGGLDIVKEELENDPNFLDSFSINK

SEQ ID NO: 56846 - protein, 513 aa, Synechococcus sp. WH 8103
MTIKNQVNPYFAEKKLNKIEKSKLEKDGLLVGSEIEKFAKIGWENMDETDLKLRLKWYGMFWRPKTPGKFMLRLRIPNGVLTSNQIRVVASIVERYGENGSCDITTRQNLQLRGILLCDLPEILRRLREAGLSSIQSGFDNPRNVTGNPLAGIDPNEIVDTRPYTTEVQNFLTNNCEGNSEYSNLPRKWNTAVAGSKDNFLLHNDIVFHPVENNGVMGFSIWIGGILSPQMNAYAFPMNVWVLPDEICNILDTVIRLWRDNGERENRTKGRFRMYLDEVGLVEFRSQVEKLYGTLTPDPGSIFENSPRSHFGINQQKQAGLYFAGIHVPVGRLTAEDLQDIATASLKYGNGEIRLTEDQNIIITGLTSERVEELKTDTLLQRFPLAPSNISAGTVSCTGNTYCSFALTNTKDQSLKAEKELDEELNLPEEIKVHWTGCPNTCGQAYMGAIGLTGTKAKNAEGVMGEGYTMTIGGSQGRNPTIGQVYRKAIPAAEIKAALKEVLISEFGATEER

SEQ ID NO: 56847 - protein, 251 aa, Fucus vesiculosus
MASRDDLVYMAKLAEQAERFDEMVDHMKAVAQQPKELSVEERNLLSVAYKNVIGSRRASWRVISSIEGKDTVSDQLPLIRDYKSKIETELTDICADILKIIEAELIPNSTSEEGKVFYYKMKGDYHRYLAEFQSADERKTSASDALDAYQLASDHANQDLPPTHPIRLGLALNFSVFYYEILNSPDRACGLAKAAFDDAIAELDTLSEESYKDSTLIIMQLLRDNLTLWTSDQGEAEEAPGNADGTVVEDL

SEQ ID NO: 56848 - protein, 262 aa, Hordeum vulgare
MAQPAELSREENVYMAKLAEQAERYEEMVEFMEKVAKTVDSEELTVEERNLLSVAYKNVIGARRASWRIISSIEQKEESRGNEDRVTLIKDYRGKIEVELTKICDGILKLLDSHLVPSSTAPESKVFYLKMKGDYYRYLAEFKSGTERKDAAENTMVAYKAAQEIALAELPPTHPIRLGLALNFSVFYYEILNSPDRACDLAKQAFDEAISELDSLSEESYKDSTLIMQLLRDNLTLWTSDISEDAAEEMKDAPKGESGDGQ

SEQ ID NO: 56849 - protein, 259 aa, Solanum tuberosum
MADSREENVYMAKLAEQAERYEEMVEFMEKVAKVDVEELTVEERNLLSVAYKNVIGARRASWRIISSIEQKEESRGNEDHVSSIKEYRVKIEAELSKICDGILSLLESHLVPSASTAESKVFYLKMKGDYHRYLAEFKTGARERKEAAENTLLAYKSAQDIALAELTPTHPIRLGLALNFSVFYYEILNSPDRACNLAKQAFDDAIAELDTLGEESYKDSTLIMQLLRDNLTLWTSDTTDDAEDEIREGSKQESGDGQQ

SEQ ID NO: 56850 - protein, 584 aa, Aspergillus nidulans FGSC A4
MKKLSTIFLNNRSEEAQCRLGRSGEQHHQEQLDREKQDEMNESPVPFVTWRSLALGAFVSIGGIIFGYDTGQISGFLEMDNFKRRFGQRQLDGTYAFNNVRSGLIVSMLSIGTLLGALMAGPLADRLGRKWSIAFWCIILHVGLIIQISSPHPKWYQFMMGRFVTGFGVGACSLLVPLYQGETSPKQIRGAMVCSYQLFVTLGIFVAYCINYGTEGMSNSASWRIPLGITFLWALLLGIGIIFFPESPRYDFRHGRADKARQTMSKLYGVPQNHRAIIEELTEIREQLEAESSSRGGFHGWIEMFQGPRMFYRITLGIVLQALQQLTGANYFFYYGTTVFNGAGISNVFVTQMILGGVNFGTTFFGLYVVEHFGRRKSLVTGGIWMFVNFMVFASVGHFSLNVEDPSATPGAGKAMVVFACLFITGFATTWGPMIWAIVAELYPSRYRAKAMAMATASNWLWNFLIGHREIRFFTPFITGDIDFAYGYVFAGCLFAAILIVYFFVLEGKGKTLEEMDMMYVMRVPPWKSSKWVPPPPEERVTTAHILDQRAAREFANEDESSKRNQVPAHQHIDQNDAGVGPSA

SEQ ID NO: 56851 - protein, 562 aa, Spinacia oleracea
MSAMALSSTMALSLPQSSMSLSHCRHNRITILIPSSSLRRRGGSSIRCSTISTSNSAAAANYQNKNIGTNGVDGGGGGGGVLDCVIVGGGISGLCIAQALSTKYSNLSTNFIVTEAKDRVGGNITTMEADGYLWEEGPNSFQPSDAVLTMAVDSGLKEELVLGDPNSPRFVLWNGKLRPVPSKLTDLPFFDLMSFPGKIRAGLGALGLRPSPPAHEESVEQFVRRNLGDEVFERLIEPFCSGVYAGDPSKLSMKAAFGRVWVLEQKGGSIIGGTLKTIQERKDNPKPPRDPRLPKPKGQTVGSFRKGLSMLPTAISERLGNKVKVSWTLSGIAKSSNGEYNLTYETPDGLVSVRTKSVVMTVPSYVASSLLRPLSDVAAESLSKFHYPPVAAVSLSYPKEAIRSECLIDGELKGFGQLHSRSQGVETLGTIYSSSLFPGRAPPGRTLILNYIGGDTNPGILDKTKDELAEAVDRDLRRILINPNAKAPRVLGVRVWPQAIPQFLIGHFDLLDAAKAALTDGGHKGLFLGGNYVSGVALGRCIEGAYESAAEVVDFLSQYSDK

SEQ ID NO: 56852 - protein, 266 aa, Burkholderia vietnamiensis G4
MTEAHRGTAVITGASSGIGAIYADRLARRGYDLILVARNRDRLAALAERITNDTRRSVEIVAADLNDRASLAAVEAKLKEDASITLLVNNAGVGTHAALLDSDVDAMTRMIDLNVTALTRLTYAAVPGFVARGRGAVINISSIVALSPETLNGVYGGTKAFVLAFSQSLHHELAERGVQVQAVLPGATATEFWQTGGLPLEHLPKEIVMSASELVDAALVGFDRGELVTIPSLHAADEWEAYDAARRAMAPHLSANAPAARYVVAR

SEQ ID NO: 56853 - protein, 389 aa, Glycine max
MADSASASASSSRMWCSIPERFQLHAAMLALQFGYAGFHVVSRAALNMGISKLVFPVYRNIIAFLLLVPFAYFLEKKERPAITLNFLLQFFLLALVGITANQGFYLLGLDNTSPTFASAIQNSVPAITFLMAVILRIEQVRLNRKDGISKVAGTIFCVAGATVITLYKGPTIYSPTPPLHSERPAVVDFGTLSLGDAKGKNWTLGCLYLIGHCLSWSAWLVLQAPVLKKYPARLSVTSYTCFFGLIQFLVIALIVERDAQAWIFQSGGEVFTILYAGVVASGIAFAVQIWCIDRGGPVFVAVYQPVQTLVVAIMASIALGEEFYLGGIIGAVLIVVGLYFVLWGKSEERKFAKEHAAITSTPEHSGIRSSSHAKTSLTQPLLPSSTENV

SEQ ID NO: 56854 - protein, 427 aa, Pyrococcus abyssi GE5
MGPGVLVKVDEKVEPRKAILLGLQHVLAMFGATVTVPLVVGTAVGLSKEEISIMIQAVLLAMGIATLLQTTIGSRYPIVQGSSFAFIPGLISIGKSLGMAATEGALIVGGIIEALIGGTGIVGKVKRLFTPLVTGVTIMLIGFSLADVAVKYFFNFYADPSGSSIPRATIVALVTFITTVYVALKAKGPIRAMPVIAGALVGYLVSVPLGLANFQLVKELPLVSLPRPFPWGIPEFNLTAIVTLLFAFMVSIIESVGDYHAISAIAEAPITNKHINRGIMSEGIACSIAGILGACGTTSYSENIGLVALTKVASRYVVQIGGIILVVLSLFPKFAGILASMPAPVLGGLTIALYGMISVTGLRLIKDKVELNDRNTLILATSLIVGLGAPQLPPKFLAHFPRIVASILESGMAIGAITAIVLDQLLR

SEQ ID NO: 56855 - protein, 550 aa, Burkholderia vietnamiensis G4
MTQMFEAGLGRREANYVPLTPIDFLVRAAEVYGARLAIVHGDVRRTWAETYTRAKQLASALARAGVGRGETVAALLPNIPAMVEAHFGVPMAGAVLNTINTRLDIASMLFMLRHGEAKVLIVDTEYAELAHRAALEVPGLKIVSVADAMPADPARFAGATDYEAFVASGDPDYTWTPPADEWEAIALNYTSGTTGDPKGVVYHHRGAYLAAISNILEWDMPKHAVYLWTLPMFHCNGWCFPWAIAARAGVNVCLRRFDAKTVFDLIRNERITHYCGAPIVQSAIANAPAELRAGIDHKVHAMVAGAAPAPAVIAKMKEIGFDLLHVYGLTEVYGPATVCAKQAHWDDLPDDERARLNARQGVRYHLEAGATVLDPDTMEPVPADGETLGEIMFRGNICMKGYLKNPHATDEAFQGGWFHTGDLGVLTPDGYIRIKDRRKDIIISGGENISSIEVEDALYRHPAVEVAAVVAMPDPKWGEVPCAFVELRNGMSATEDEIFAHCRQLLAGFKVPKVVRFGELPKTSTGKIQKFQLRNAVGSDKAIDLAGDKK

SEQ ID NO: 56856 - protein, 1140 aa, Adiantum capillus-veneris
MSSKTMTYSSSAAEPRSSSSSVVGSKHNRRVVVAQTTADAKLHAVFEQAQSEGDTGGSSFDYMRSIEDARGSVLSERVPAQAVTAYLQRMQRGGLIQPFGCMLALEEGSFRVIAYSENAAEMLDLMPQSVPSVGVQVLVLGIGTDARTLFTYASAAALEKASGAVDVSMLNPITVHCRSSSKPFNAIVHRIDVGLVIDFEPVRPADVAVWAAAGALQSHKLAAKAISRLQALPVGDIDLLCDSVVEEVRELTGYDRVMAYKFHEDEHGEVLAEIRRSDLEPYLGLHYPATDIPQASRFLFMKNRVRMICDCRALPVRVIQDKELRQPLSLAGSTLRAPHGCHSQYMANMGSIASLVMAVVVNDNDEDVSNRSQQPKMRRLWGLVVCHHTTPRAVPFALRSACEFLMQVFGLQLNMELELAAQMREKHILRTQTLLCDMLLRDAPIGIVSESPNIMDLVKCDGAALYYGKNFWLLGTTPIEAQIKDLAEWLLDVHRDSTGLSTDSLADAGYPGAAALGDAVCGMAAAKITTRDFLFWFRSHTAKEIKWGGAKHDPEDRDDGRKMHPRSSFKAFLEVVKRRSLPWEDMEMDAIHSLQLILRGSFQDIDDSDTKTMIHARLNDLKLHGMDELSTVANEMVRLIETATAPIFAVDAGGFINGWNAKVAELTGLTVEEAMSRSLVRDVVVNASMETAERVLDLALQGQEEQNVEIKLKTYGDQAIKGPVILIVNACSSRDFTDNVVGVCFVGQDVTGQKVVMDKFTRIQGDYKTIVQNPNPLIPPIFGADEFGYCSEWNPAMEKFSGWKREDVIGKMLIGEVFGSDLACCKLRGQDSMTKFMIILNAAMGGRDSDRFPFGFFDRYGKYAEALLIANKRTDSDGAITGVFCFLHTASPELQQALQVQKRSARTALDRLKEVAYMKQEIRNPLYGIVFTRKLLDNTNLTDEQKQIMETSSLCEKQLQNILDEDNFEKLDQGNVDLDTLEFTMGTVMDAVISQGMIRSREKGLQLIRETHVEIKNTRLFGDQYRLQQVLADFLTTAIRFTSSSDGWVGIKVVPTIKNMKDGLHIVHFEFRVSHPGSGIPEDLVQQMYDRSQEITQEGMGLSVSRKLVKLMNGDVKYTREAGVCYFLVTVELPLVQEDD

SEQ ID NO: 56857 - protein, 318 aa, Arachis hypogaea
VMHRDLKPESFLFANKKENSPLKAIDFGLSVFFKPGEKFSEIVGSPYYMAPEVLKRNYGPEIDIWSAGVILYILLCGVPPFWAESEQGGAQAILRGLIDFKREPWPSISESAKSLVKQMLEPDPKLRLTAKQVLEHPWIQMLRRAPNIPLGDAVKSRLKQFSMMNRFQKKALRVIADFLSNEEVEDIKDIFQKMDTDNDGIVSIEELKAEFQNFGSQLAESEIQMLLEAVNTNGKGTLDYGEFVAVSLHLKRMANDEHLRKAFSYFDKDGNGYIEPDELRNALMEDGTDDCADVANDIFQEVDTDKDGRISYEEFVAM

SEQ ID NO: 56858 - protein, 328 aa, Triticum aestivum
MAKFSFADADADEDPPPAAAGSDKRKRDGSPAPDDGAAGGGPPPKARRLEVAGGERGERAVAGCGREVGRVGAGGDGDAAGISMRIDPDLLDCSICFEPLCPPLYQCQNGHVACLSCWSRLSNKCHVCSHDAIFARNIALEKIVESIKSSCAYAKWGCCELVSYTQRNTHEESCFFAPLMCPIPGCGYRGFTGRWSGHFLVDHHSADFLHFVYGQSFEVNLEASLPFLVLLGEDDHLFLLLNKNMTPFGHAFSVVCLRTGDLNWKFSYEIEAASTRNPENCMQLKASVTNAKEWEGLHPTESFLLVPYDFCSSTNITLSVSVGRSASV

SEQ ID NO: 56859 - protein, 262 aa, Hypocrea lixii
MGHEDAVYLAKLAEQAERYEEMVENMKIVASEDRDLTVEERNLLSVAYKNVIGARRASWRIVTSIEQKEESKGNSSQVTLIKEYRQKIENELAKICDDILEVLDQHLIPSAKSGESKVFYHKIKGDYHRYLAEFAIGDRRKDSADKSLEAYKAATEVAQTELPPTHPIRLGLALNFSVFYYEILNAPDQACHLAKQAFDDAIAELDTLSEESYKDSTLIMQLLRDNLTLWTSSEAETPARLMPLLRRRPLLRLPSRRRRAQG

SEQ ID NO: 56860 - protein, 311 aa, Prochlorococcus marinus str. MIT 9313
MHHRPTLASKPYGGLSWKKVLGLLAMDSPSTTANGWIDEHHQGVRYGLQGRVLVDETSPYQRITVIDSSRYGKGLLLDGCWMTAEHQERHYHESLVHPALCSAAQLERVLVIGGGDGGTARECLRYQDVKHLDMVEIDRRVVELSQKHLPSLGSHAWSDPRLQLNLENGIAWVANATESSYDVILIDGSDPAGPAEGLFNQTFFEHCRRILRPGGVFATQSESPEAFRQVHIDTVRLIRQVFGYADPLYGWVPMYPSGWWSWTFAAIDGPRYRNPLPARAAAISAGCEIWSPRWQQGAFEAIPAFIERELT

SEQ ID NO: 56861 - protein, 588 aa, Capsicum annuum
MASFSVKFSATSSLTSSKRFSKLHATPPQTVAVPPSGAVEVAAERLEPRLEERDGYWVLKEKFRKGINPAEKAKIEKEPMKLFTENGIEDIAKISLEEIEKSKLAKDDIDVRLKWLGLFHRRKHQYGRFMMRLKLPNGITTSAQTRYLASVIRKYGKDGCADVTTRQNWQIRGVVLPDVPEILKGLDEVGLTSLQSGMDNVRNPVGNPLAGIDPQEIVDTRPYANLLSNLLSQYVTANFRGNLSVHNLPRKWNVCVIGSHDLYEHPHINDLAYMPATKDGRFGFNLLVGGFFSPKRCAEAIPLDAWVPADDVVPVCKTILEAYRDLGTRGNRQKTRMMWLIDELGVEGFRAEVVKRMPQKKLERESTEDLVQKQWERREYLGVNPQKQEGYSFVGLHIPVGRVQADDMDELARLAEEYGSGELRLTVEQNIIIPNIENSKIDALLNEPLLKQISPDPPILMRNLVACTGNQFCGQAIIETKARSMKITEEVQRLVSVTQPVRMHWTGCPNSCGQVQVADIGFMGCLTRKEGKTVEGADVFLGGRIGTDSHLGDIYKKSVPCEDLVPIIVDLLVNNFGAVPREREEAED

SEQ ID NO: 56862 - protein, 131 aa, Neisseria meningitidis Z2491
MDKNLLEAVKFDEKGLVCAIAQDAETKRILMVAWMNAEALQKTVETGFAHYYSRSRQKQWMKGEESGHTQKVRELRLDCDGDAIVMLIAQNGGIACHTGRESCFYKVWRGGAWETADAVLKDEKEIYGSTH

SEQ ID NO: 56863 - protein, 479 aa, Brassica rapa
MANIAGQLKRGISRQLSSVSLRRTFSRQFTRQASHDPRRINMRFSFGRQSSLDPIRRSPEGSGHPQLAVPDNLDATMQLLFVACRGDVEGVQDLLDEGIDVNSIDLDGRTALHIAACEGHVDVVKLLLTRKANIDARDRWGSTAAADAKYYGSMDVYNILKARGAKVPKTKRTPMVVANPREVPEYELNPQELQVRKADGISKSCQGIYQVAKWNGTKVSVKILDKDLYKDNETIEAFKHELTLLEKVRHPNVVQFVGAVTQNVPMMIVSEYHPKGDLGSYLQKKGRLSPSKVLRFALDIARGMNYLHECKPEPVIHCDLKPKNIMLDNGGLLKVAGFGLISFEKLSSDKSKVLNHGAHIDLSNYCVAPEVYRDEIFDRSADSYSFGVVLYEMIEGVQPFHPKPPEEAVKLMCLEGRRPSFKAKTKSCPEEMRELIEECWDVKAVVRPTFSEIIVRLDRIFVQCSKQGWWKDTFKFPWK

SEQ ID NO: 56864 - protein, 370 aa, Oryza sativa
  misc_feature (108)..(108): Xaa can be any naturally occurring amino acid
  unsure (1)..(370): unsure at all Xaa locations
MAAMARHLPAILLLSSALLLALASASASAAAPALAAFVDAASRRYLRDQQHHDQAASMSLDQVSAAVSVLLGFAPPPSLPAQSSSKLDKLLLPNPFDRPRAVFLLQIXGFHASVESITSEAGSIFKTTIDGLSDSATGLTDKDDLVIVHSDESPAVDSGSEYFDSDLTDLANWLGGSYEKVDGKLIIPLESGESLTLLITKEADMEFASSLISLRKTIKRGIQVHEDFSGGVMSPAELLVCHFKGIKALEEEYGSTEIVKQGTDVVRTAVTKAFDLLRGAYNGKIVGLVISTKEASPSLVGPASSLHISRWLKETSQTNTTIASSEILVRKSLAWITGIILLVSTLIGVCLLMNMPLTRDTLLYSNVKID

SEQ ID NO: 56865 - protein, 371 aa, Mycobacterium avium 104
MTSGSLEFTVSRSTRPATDAERETILAEPGFGKYFTDHMVSIEYDETEAGRGWHDARVIPYGPIELDPSAIVLHYAQEIFEGLKAYRWADGSIVSFRAQANAARLRSSARRLAIPELPEELFLESLRQLIAVDNAWVPAAGGEEALYLRPFVIATEPGLGVRPSKQYRYLLIASPAGAYFKGGISPVTVWVSTEYVRASPGGTGAAKFGGNYAASLSAQAEAAANGCDQVVWLDAVERRFVEEMGGMNIFFVFGSGGSARLVTPELSGSLLPGITRDSLLQLAIDAGFAVEERKIDIDEWQKKAAAGEITEVFACGTAAVITPVSQVKYGETEFTIADGQPGEVTMALRDTLTGIQRGTFADTHGWMTRLG

SEQ ID NO: 56866 - protein, 698 aa, Campylobacter lari RM2100
MVFPQSAVLEKAVDFCIQKHEGQFRKSGEPYAVHPILVASFVAFLSPVQSMIIAALLHDVLEDTNCNEEELSLNFGEEVTKLVQGLTKIVSIREDHLTRSNSNEKLAKSALTFRNMLLAGVEDVSVLVIKLCDRLHNMLTLNFLREDKQKRISEETLVVYAPIAHRLGISSIKNLLEDLSFKFLLPDEYAQIDNYINAKDQQIQLGFNEFISKIEMLFLENGFRQGSFVIHKRIKHNYSIYLKMQRKGVGLDEVLDLLGVRILVEKVYDCYLALGILHTHFNPLISRFKDYIALPKQNGYQTLHTTLFDAKNIIEAQIRTFDMHKTAEFGVAAHWKYKEGNITTPNLDWLADISMHGKEDGNAVQDCDAIELYEYAKDSLYIEDIAVYSPKGEIFTLPRGATALDFAYEVHTKVGLHAKTAFVNRVRVPLLTVLKNGDIVSIETSEEEFFRCSWIDSVKTGKARASIRDFCKQKKKELNNKIAINLLSTVFNKDSKLIEEWLEKENFNKKLRQIALDFNYFKDVIIALRKYMGQNQAAKFEQNEQKFESIVIGSNYKITTINFDYCCRPKRGDEIIAFRQSTGATIHHKLCEQAMKMIEDNKEMVFVFWNDSSIKSYKIIVSIENKKGSLADFLTTLAKMQINVLSINSADSEPVVANYFEVQVELPSNIDLENAKERLKSRYKILDFTSLNDAYNNH

SEQ ID NO: 56867 - protein, 200 aa, Aspergillus nidulans FGSC A4
MVRYDYLFKLLLIGDSGVGKSCLLLRFADDTYTESYISTIGVDFKIRTIELDGKTVKLQIWDTAGQERFRTITSSYYRGAHGICVVYDVTDMDSFNNVKQWLQEIDRYATEGVNKLLVGNKSDMEDKKVVEYTVAKEFADSLGIPFLETSAKNASNVEQAFLTMARQIKERMGTATVNNKPTVQVGQGQGVQSGSAGGCC

SEQ ID NO: 56868 - protein, 171 aa, Nicotiana glutinosa
LRDTRAPLLVNIYPYFSYSGNPGQISLPYSLFTAPNVVVQDGSRQYRNLFDAMLDSVYAALERSGGASVGIVVSESGWPSAGAFGATYDNAATYLRNLIQHAKEGSPRKPGPIETYIFAMFDENNKNPELEKHFGLFSPNKQPKYNLNFGVSGRVDSSVETNATASLISEM

SEQ ID NO: 56869 - protein, 793 aa, Lactobacillus reuteri
MEKREQMNVLWFDELHRSDVNLVGGKSSSLGEMTSAMKIPVPYGFATTTHAYRQFMAETGLNDQINKLLAEINDYENADELHRVCSHIRQMIVEAPMPSEIAMTIKKAYAALSEKMGETEPFVAIRSSATAEDLPNASFAGQQESYLNVRGAEMVLAKVQECYASLFTDRATYYRHKQHFPHEKVALSAAVQMMVFSKASGVMFSVNVANGNDAQIVIDTIWGLGEYIVLGKVTPDHFVINKNNLQVVERSVVPKAIELCQTPGGGVHEEPVPADRAIRPALTENQIHELAGYAKEIEKHYGCYMDMEFALDARTDRLWLVQARPETVWSNKNNKQATKESTVSMNKTKKILVKGLPASPGVSTGKVHVIADPKDIDEFEEGEILVTLMTSPDWVPAMKKAAAIITDNGGMTCHAAIVSREMQIPCIVGTKSCGQAVTEMLQDGEQVTVDAKNGVVYQGDLAEQFNGEKETTECHHAEYYAPTATRVMMNLGDPELAEKYAELPVDGIGLMREEFLWTTYIHDHPLYLIETGHPEKVVDMLADGIAKVARAIAPRPMVLRFSDFKSGEYRNLTGGDKYESHEPADLLGWRGASRYYDPKYIEAFKLELAAVKKVRREFQLKNLNVMIPFVRTVAEADKVTKLMAAAGLHRGPDFKVYMMAEIPSNIILADQFNKYVDGYSIGSNDLAMLILGCDRNNDTVAHLFDERNLAVKRAISHLIKAAHQDNKTVSICGQAPSEYPELASFLIQQGIDYISVNPDMVKETKQNVARIEQRIILDNATGKGRQAVENYAW

SEQ ID NO: 56870 - protein, 494 aa, Candidatus Kuenenia stuttgartiensis
MKGKNYINGAFVDSASSEVFESRNPAYCDEVLGTFPLSSADDVNNAVLAAKTAYDTWRKISRIRRGEYLDELAQLLKKDREAISQLVSKECGKGIAEGRADVTEGIHMVQYIFGTTRMPHGDIIDSEIVEKDSFMRRRPKGVVAAITPWNFPFAIPLWLICPSVVEGNTVVLKPSRETPCVANKIAEYVHAAGFPPGVINVIHGGCGDALVRHSDTQVILFTGSCEVGEGIKKIAAESYNKMCACEMGGKNAIIVLDGANMEIAVNASILSAFKTSGQRCTSAGRLILHVNMLEEFEKRFVELAKRIKIGNPLDEEVFMGPVINQAATEKILRYNDFAKNEGAEVLLDGSRLTGGGYDKGYFMSPFVYRMKNNPKSRVLHEEVFGPHVAIIPVESIDEAINVYNDTEYGLSCAVITEDFRKARRIRDDCEYGLGYVNLPTIGAEVHLPFGGLKKSGTGLPSASTLIDAVTHRTAWTVNHDLEIKMAQGLSAKLS

SEQ ID NO: 56871 - protein, 1102 aa, Acidobacteria bacterium Ellin345
MPRRNDISKILIIGSGPIVIGQSAEFDYSGAQACKALKAEGYEVVLANSNPATIMTDPEMADRTYIEPLTPEFLEEIIRIEAAMMPAGAGKFALLPTVGGQTALNLAVDLADSGVLDKYSVILIGAQLGAIKKAEDRLLFKDAMAKIGLDVPRSALINNLKDGLEFSGKIGFPLVLRPSFTLGGSGGGIAYNREELMDLLGKGLDLSPVHEVLLEESVLGWKEYELELMRDLADNVIVICSIENFDPMGVHTGDSITVAPAQTLSDREYQIMRDAAIKVIREIGVETGGSNIQFATNPENGRMIVIEMNPRVSRSSALASKATGFPIAKIAARLAVGYTLDEITNDITRKTPACFEPTLDYVVVKIPKWQFEKFPGADASLGPQMKSVGEAMAIGRTFKEALMKGIRSLETGKSIASEKVEERIITKRLVTAHPERLQYVRHALLHGWSVEKVHSLTKIDPWFLYQLKEIAQAHAHTEQHTMDEVGPDELRDLKRMGFSDERLAHLWKAKNGKGASRLVYEKRHASGIRPVYKRVDTCAAEFESFTPYLYSTYEEEDEAAPTDKKKVIILGSGPNRIGQGIEFDYCCCHAAFALRDDGYETIMVNCNPETVSTDYDTSDRLYFEPLTYEDVMEIYEHEASGGAPIGVIVQFGGQTPLNLALPLKASGVPVIGTSPESIDLAEDRKRFNKLLEELDIPQPPGSTATSLEEAVANANKIGYPVLVRPSYVLGGRAMMICYEQEEVERYMRQAVEYSQERPVLIDHFLEEATEVDVDCLSDGEDCVIGGIMQHIEEAGIHSGDSSCVLPSVDLSEQVLKTIREYTFKLARALKVIGLMNVQYAIQREKVYVIEVNPRASRTVPYVSKATGVPMAKIAARLMTGRKLREFLPQNIEQGADLATGNCYYVKSPVFPWGKFPGVDTVLGPEMKSTGEVMGVADNFGEAFAKAQLAAGQKLPTKGTVFISLNKRDKQHAAALAKKFVDLGFKIVATHGTADEMEDGGIEVERVFKVKEGRPNVVDLIKGDRIQMIINTPQGAEPWFDEKAIRRAAITARIPTITTLSAARAAVEGIAALQRGKTTVYALQELHRERRQGMPGQQVNGLR

SEQ ID NO: 56872 - protein, 324 aa, Hordeum vulgare
MSLQIGRTERARSPVFVFAHKRQLLHGRCSTIDNANCSTCSMKINSTCTLTALPIAALPGPRTTSHYSTAAANWCYATVAPRARSSTIAASLGTPAPSSSASFRPKLIRTTPVQAAPVAPALMDAAVERLKTGFEKFKTEVYDKKPDFFEPLKAGQAPKYMVFACADSRVCPSVTLGLEPGEAFTIRNIANMVPAYCKNKYAGVGSAIEYAVCALKVEVIVVIGHSRCGGIKALLSLKDGADDSFHFVEDWVRIGFPAKKKVQTECASMPFDDQCTVLEKEAVNVSLQNLLTYPFVKEGVTNGTLKLVGGHYDFVSGKFETWEQ

SEQ ID NO: 56873 - protein, 457 aa, Symbiobacterium thermophilum IAM 14863
MTQTTRYVRLVTEVPGPRSRELMARKERVVANALSIHVPVAIQEARGALVTDVDGNVFIDLAGGMGCMNVGHSHPRVVEAIQRSAAQFTHTDFSVIMYESYIRLAERLAALAPGDFPKKACFFNSGAEAVENAIKIARKYTGRRAIIALEGAFHGRTNLAMALTSKVKPYKEGFGPFAPEIYRVPTPYTYRRPAGMSEAEYVRFCADALERALITHVSPDEVAAIILEPVQGEGGFIPLHPDYLARVSQLARKHGFLIIADEIQSGFGRTGTFFASEQLGLVPDLICVGKSLAAGMPLSGVIGRAEVMDAPEDSTIGGTYVGNPVACDAAHAVLDIMEEEGLVSRARAIGDLMRRRFQELAVQLESIPGSRLQIGEIRGLGAMLGVELVTDRATRAPATAEAAEVVKRAWQRGVVVVKCGIYGNTLRMLLPLVITDDQLNEALDIIGQICTEIARGE

SEQ ID NO: 56874 - protein, 298 aa, Campylobacter lari RM2100
MDNNIIIGAMTALITPFKNGKLDEQTYHKLIKRQIANGIDAVVPVGTTGESATLTHEEHRICIEIALDACKGSSCKVLAGAGSNATHEAVSLAKFAQEHGADGILSVTPYYNKPTQEGLYLHYKEIAKSIDIPVLLYNVPGRTGCDLQTETIIRLFRDCENIYGVKEASGSIDKCVDLLAHEPRMMLLSGEDAINYPILSNGGKGVISVTSNLLPDMISKLTHFALEEKYIEAKKINDELYNINKILFCESNPIPIKAAMYIAGLTPTLEYRLPLCKPSDCNLAKIEAIMKNYDIKGF

SEQ ID NO: 56875 - protein, 2020 aa, Aspergillus nidulans FGSC A4
MDTVQETKSSASKADYGATSIPDVELVKGEVGIADQLEMPMKRKFNILSIIAVGYNISNSWVAIAASFAIAIQSGGALSLLYGIIVVTFAMLCTGVTLAELASVYPTAGGQYHFTSILASRRWSRGLSYFSGLAAIFSWICLGASIGLSGTNALMAIIIRWQPAYQPASWHYFLVYQLFNILVVVYNMYLANKTLWIYNIGSRSEVHVDSKEIWAIMTNGSGWSDGISFLTGLSTPQFMLSGIDATLHLAEECLDPERVVPKAVLATVIVGFLTAFPFAIAISYSYRDVAESLSTNTGFPIFFIWEKATHSPAAATVFMACLFVISCVAFNAVHQTASRLTWSFARDDALFFSKKLSPVHHSLGVPVNALVLDGILVFLVGIVYICSSTAFNSFISTTVIVAQVSFAIPALLVILRRRSSHFLPESRPFRVPNVVGYICNVVCIIWAVILTVFFCFPAALPVTGGNMTRAWDPCEHPSRTLVPGPNHASYQRDCDLHNCLHYPKESKTCNWIVIPPAWEALNCTTHRAGCSWVPVPVSPSGDVAPPGAVQQPSETVSRITDDNGAPSTAKEKAESSDITCASSEKDIDRDRKDIDQESELKITALARNLSRLSQKSGAVDGTNTFLDSSSDPELDPNSGQFNARKWTKNFLSVANRDPDRYPRRTAGVSFRNLSAFGYGTAADYQMDVANMWLKGFGWIRRKLGFVDRVRIDILRDFEGFVRSGEMLVVLGRPGSGCSTFLKTIAGETHGLWLDDGTDIQYQGISWDEMHSRFRGEVIYQAETEIHFPNLTAGETLLFAAQARTPANRFPGVTRDQYAHHMRDVTMAMLGLSHTMNTLIGNEFIRGVSGGERKRVSIAETILCGCPLQCWDNSTRGLDSSTALEFVRNLRLSTEYTGSTAIVAIYQASQAIYDVFDKAIVLYEGRQIYFGSASDARRFFVEMGFECPDRQTTGDFLTSLTSPTERLVRKGFENLVPRTPDEFAERWKQSAERKRLLEEIEAFQNEHPLGGSKYEEFTRSRAAEKAKGTRAASPYTLSYPMQIRLCLSRGFLRLKGDMSMTLATTIGNSIMALIISSIFYNMNGTTEKFFSRGALLFFAILLNAFSSALEILTLWQQRPIVEKHYKYALYHPSAEAISSMIVDLPAKVLVSIVFNIILYFMTNLRRTAGHFFVFYLFSFTTTLTMSNIFRWIGAISRSMAQAMVPSSIFMLILVIYTGFTIPVRNMHPWFRWLNYLNPIGYAFESLMVNEFSGRRFDCAMYVPDGPGYADVPLSSKICSGRGAVAGQDYIDGDTYLNTSFQYYRSHLWRNYGVLLAFMFFFLAAYIICSELVRAKPSKGEILVFPRGKIPAFAKEVRRDEEDAKTVEKPQLVGEKSDDHVGAISKQTAIFHWQDVCYDIKIKGENRRILDHIDGWVKPGTLTALMGVTGAGKTSLLDVLADRVTMGVITGEMLVDGRLRDDSFQRKTGYVQQQDLHLETSTVREALIFSAMLRQPASIPRKEKLAYVEEVIKMLGMEEYAEAVVGILGEGLNVEQRKRLTIGVELAAKPDLLLFFDEPTSGLDSQTAWSICSLMRKLADHGQAILCTIHQPSAILMQQFDRLLFLAKGGKTIYFGELGENMGTLIEYFEKKGSTPCPKNANPAEWMLEVIGAAPGSHADRDWSEVWNQSPEREQVRAELARMKAELLQKPEPPRTPEYGEFAMPLWSQFLICLKRMFQQYWRSPSYIYSKATMCVIPPIFIGFTFWREPLSLQGMQNQMFAIFMLLVIFPNLVQQMMPYFVTQRALYEVRERPSKAYSWKAFMMASICVELPWNILMAVPAYFCWYYPIGLYRNAGPGETVERGGTMFLLILIFMMFTSTFSSMVIAGIEHPDTGSNIAQLLFSLCLIFNGFWIFMYRVSPFTYLVSSVLSTGLSGAEVECSDIEILKIPPPDGQNCTSYLGPYAEGIHAKLLSDAPNGDCRLCSISSTNQFLASLSINPDDNWRNVGILFVYIVFNAFAAVFLYWLVRVPKKKSQQVKKQ

SEQ ID NO: 56876 - protein, 568 aa, Symbiobacterium thermophilum IAM 14863
MGISDQGGAFRVERPYLKAYPQGVRWELEFPEVPFYQALFEQAAKHPERTALIFMGKRVSYGELVDLIDRFGAALQRRYGIQKGDRVGIILPNSPQNVIATVACQRIGAIPVQFNPLYVAREIAYQVKDSGCRIMITLDLFWQKVREAGGVEAYIWTGAQDYLNFPLNILYRLKAKPPRIPPSEATHFMELLRESPQGIQIAPVNPREDVAVLLYTGGTTGVSKGVMLTHFNLTSNVTQIREWLQIGDEHHTTLAVLPMFHSYGFTAAVGMGLSCGFTLILVPRFDPGDLLKTIAKYRPSVFPGVPTMYIGLLNHPDIHKYDLRSIKLCVTGAAAMPVDLLRRFEQVTGATIMEGYGLTETSPVTHANPRFGKRIPGSVGLPYPGTDVRIVDLETGEDLPPGGEGEILIRGPQVMKGYWNRPEETAEVLKDGWLYTGDIGRMDDEGYLYIVDRKKDMIIAGGFNIYPREIDEVLYQHPAVLEACAVGVPDAYRGETVKAFVVLKPGAQATEQEILEFCRERLAAYKRPRSVEFLPELPKSTVGKVLRRVLAEQERSKMEQKQKAAVAD

SEQ ID NO: 56877 - protein, 360 aa, Glycine max
MLGVIRHKSIRHAFSAIRHLSSAAKEITVREALNSALDEEMSADPKVFLMGEEVGEYQGAYKISKGLLEKFGPERVLDTPITEAGFAGIGVGAAYYGLRPVVEFMTFNFSMQAIDHIINSAAKSNYMSAGQISVPIVFRGPNGAAAGVGAQHSQCYASWYGSCPGLKVLSPYSSEDARGLLKAAIRDPDPVVFLENELLYGESFPVSAEVLDSSFCLPIGKAKIEREGKDVTITAYSKMVGYALKAAETLAKEGISAEVINLRSIRPLDRSTINTSVRKTNRLVTVEEGFPQHGVGAEICTSVIEESFGYLDAPVERIAGADVPMPYAANLERMAVPQVEDIVRAAKRTCYRSVPLAASA

SEQ ID NO: 56878 - protein, 388 aa, Aspergillus nidulans FGSC A4
MVQFAFVSLWCLLLSYLSTKLPWLKTSIPALKNNIRPPSRDVIMTALPLAIFQLAGHILSSMATSQIPVSLVHTIKGLSPLFTVLAYRFLFRIRYAKATYLSLVPLTLGVMLACSTGFSTNFFGILCALVAALVFVSQNIFSKKLFNEAERAESDIQSAGRRKLDKLNLLYYCSGLAFILTLPIWLVTEGYPLFSDLMQDGAISLTNKAGSLDHGALFLEFVFNGVSHFAQNILAFVLLSMVSPVSYSVASLIKRVFVIVVAIVWFGNSTTPVQGFGIALTFLGLYLYDRNSHDDVADQKANADHFHFKNPILPLNTRGASKLRGSNGYAIPQGRPVDQHVLDRSFPISSNSKKDDGVGHARPRASSNTKAWLPPGTKQETTWQSSDS

SEQ ID NO: 56879 - protein, 523 aa, Perilla frutescens
MAATAVFKSTPGKTAIANYSSLEDVNSTSFKRLSFAASNVAGERITSPPRLRVRRSRAGGELERRSPVIVSPKAVSDSQNSQTCLDPDASRSVLGIILGSGAGTKLYPLTKKRAKPAVPFGANYRLIDIPVSNCLNSNISKIYVLTQFNSASLNRHLSRAYASNMGGYKNEGFVEVLAAQQSPENPNWFQGTADAVRQYLWLFEEHNVLEFLILAGDHLYRMDYERFIQAHRETDADITVAALPMDEKRPTAFGLMKIDEEGRIIEFAEKPKGEQLKAMKVDTTILGLDDKRAKEMPYIASMGIYVVSKDVMLNLLRDEFPAANDFGSEVIPGATAMGLRVQAYLFDGYWEDIGTIEAFYNANLGITKKPVPDFSFYDRSAPIYTQPRYLPPSKMLDADVTDSVIGEGCVIKNCKIHHSVVGLRSCIAEGAIIEDTLLMGADYYETDADRRFLAAKGGVPIGIGKNTHIKRAIIDKNARIGENVKIVNGDNVQEAARETDGYFIKSGIVTVIKDALIPSGTMI

SEQ ID NO: 56880 - protein, 520 aa, Perilla frutescens
MAAVASSSPMGFSKICGLNSVSELSGQCKPTVGFSKSELFGGAVCVKSISKNGGRGNARTRLPSARVVSPKAVSDTSSSLTCLEPDANFSELAFFLEWSGTRLYLLRKKRAKPAVPIGANYRLNDIPVSNCLNSNVSKIYVLTQFNSAFLNRHLSRAYASNMGGYKNEGFVEVFAAQQSPENPNWFQGTADAVRQYLWLFEEHDVLEYLVLAGDHLYRMDYEKFVQSHRETDADITVAALPMDEKRATAFGLMKIDDEGRIIEFSEKPKGEALKAMRVDTTILGLDDERAKEMPYIASMGIYVFSKNAMLNLLRDKFPGANDFGSEVIPGATSVGLRVQAYLYDGYWEDIGTIEAFYNANLGITKKPVPDFSFYDRSAPINTQPRYLPPSKMLNADVTDSVIGEGCVIKNCKIHHSVIGLRSCISEGAIIEDTLLMGADYYETDSDRRILAAKGGIPIGIGKNSHIKRAIIDKNVRIGENVKIINSDNVQEAARETDGYFIKSGIVTVIKDALIPSSTII

SEQ ID NO: 56881 - protein, 536 aa, Mycobacterium avium 104
MSDEPTQPPNPAGAAAPGVTRRRLLTTGAVSAALGVGIGGGATLLWSQSARSRGPWPWLQPDRNGAPPVAGLHLQFGKNAGTEVVVSWHSTDAVRNPRVVFGTPVSGFGRTVAADTRTYRDAKSGIEVRVNHARLTGLTPDTDYVYAALHDGAQPQQGTVRTAPMGRKPLRFTSFGDQSTPALAKMPNGRYATDNIGSPAAADTTMAIERIGPLFNLVNGDLCYANLAQNRIRTWSDWFENNSRSARFRPWMPAAGNHENELGNGPIGYGAYQAYFAVPDSGSSPETRGLWYSFTAGSVRVVSLSNDDVAFQDGGNFYVHGYSGGEQKRWLATELAAARRDPDVDWLVVCMHQTAISTADRTNGADLGIREEWLPLFDQYQVDLVLCGHEHHYERSHPLRGALGTDTRTPIPVDTRGDLIDATRGTVHLVIGGGGTSAPSNAMFFPEPRCRVLTGVGTFDPGLGRKAPIYVIEDAPWSAFRDRDNPYGFVAFDVDPGPAGGNTSIRATHYALTGPLGEMSVIDRFTLTKPRGDGAR

SEQ ID NO: 56882 - protein, 527 aa, Perilla frutescens
MDACCATLKSTSHLSNVSKSAFCGEKNGFWGEKIKGSLNNCARAYQFGKKLNLEKRGRKIKPGVAYSVLTKKNINETLMIPPPLFEKRGANPKIVAAIILGGGAGKQLFPLTSKAATPAVPVGGCYRLIDIPMSNCINSGINKIFVLTQFNSASLNRHISRTYTGNGVSFGDGFVEVLAATHTAGETGNQWFQGTADAVRQFTWVFEDAKAKDIDNILILSGDHLYRMDYMDFVQNHIDRNADITLSCAPVCDSRASEYGLVKIDSRGRIILFSEKPKEADRMAMEVDTSIIGLSPEEALKSPYIASMGVYAFKTDVLLKLLRWRYPTSNDFGSEIIPSSVKEHNVQAYIFRDYWEDIGTIKSFYDANLALTDEFPKFEFYDPKTPFYTSLRFLPPTKIDNCKIKDAIISHGCFLRECVCQHSILGERSRLDSGVELKDTLMMGADYYPTESEIASLLVQGKVPMGIGRNTKISNCIIDKNARIGKDVIIKNKDGVEEADRSEEGFYIRSGITIVVEKATINDGTII

SEQ ID NO: 56883 - protein, 653 aa, Coprinopsis cinerea okayama7#130
MTNGPVNGNTGIESQFSALGLGKSAYVPPHLRNQQRAASSPSPTPSNGRNGWSDRTGTPPPRGGFGGGFSDRGGRGGSFGSRDSRWAGPNRGSDYGGGRGDSRGDSGPQASFGYGVWRDGKHVVGGRNARLEKELFGTPDDPSKQHTGINFEKYDDIPVEATGAGVPEPVNSFTSPPLDPVLLENIGFAMYTTPTPVQKYSIPIVAGGRDLMACAQTGSGKTGGFLFPILSASFTEGPRPPPETAAPTYGRARKAYPTALILAPTRELVSQIHEEARKFAYRSWVRPAVVYGGADINQQLRQIERGCDLLSATPGRLVDLIERGRISLANVKYLVLDEADRMLDMGFEPQIRRIVQGEDMPGVNDRQTLMFSATFPRDIQMLARDFLKDYIFLSVGRVGSTSENITQKIEYVEDGDKRSVLLDILASQSKEDMGLTLVFVETKRMADMLSDFLIGNNMPATSIHGDRTQREREMALQTFRTGRTPIMVATAVAARGLDIPNVTHVVNYDLPSDIDDYVHRIGRTGRAGNVGVSTAFFNRGNKNIVRDLVELLREANQEIPSWLETVAHEAAFGSGGYRGGRGGRGRGGGRGGGNRDYRSNYSSGGGGGGGGYGGGGYGGYGGGGYGGGGYGGGPRGGYGGSSYGGGGGGNGWW

SEQ ID NO: 56884 - protein, 421 aa, Oryza sativa
  misc_feature (260)..(260): Xaa can be any naturally occurring amino acid
  unsure (1)..(421): unsure at all Xaa locations
GRVGNKHKKNLRRLSLNSPHHRRQLSFLPSSSIHGGGAVQGPGGGEGPVGAGAGRGDAMRDRLASLGRPKRLFIIVNPYGGKRGGRKIFQTEVLPLIEAAGILYTMQETKHRLHAQEIAHSLDLRKYDGIVCVSGDGVLVEVVNGLLQREDWNTAIKIPLGNHLGHKRPLDVTSVVQGKTRFFSVLMLTWGLVADIDIESEKYRWMGSARLDFYSLLRVVSLRRYNGRVLFVPAPGYEGLGDLVEQISSCKSNGASTGVXEDRSNDFNDETCAYAGPSIDEADHEWRSLDGPFVSVWVSGVPFASENVMTAPEAKFGDGYLDVGIIKDWPRSALAGLMFQMKDGSYVKSPYVDYVWPGCLALWPGMRVGSTTKGGIIDSDGEVIARGDGSHTGDEIEHLMAYGPPIQLTVDQGLATIFSPR

SEQ ID NO: 56885 - protein, 341 aa, Pisum sativum
MDHAGDAMRTDLMTITRYVLNEQSKRPESRGDFTILLSHIVLGCKFVCSAVNKAGLAKLIGLAGETNIQGEEQKKLDVLSNEVFVKALTSSGRTCILVSEEDEEATFIEPSLRGKYCVVFDPLDGSFNIDCGVSIGTIFGIYMVKDFETATLEDVLQPGKNMVAAGYCMYGSSCTLVLSTGSGVNGFTLDPSLGEYILTHPDIKIPNKGKIYSVNEGNAKNWDGPTTKYVEKCKFPTDGSSPKSLRYIESMVANVHRTLLYGGIFLYPGDKKSPNGKLRVLYEVFPMSFLMEQAGGQAFTGKQRALDLIPTKIHERSPVFLGSYDDVEDIKALYAAQEKTA

SEQ ID NO: 56886 - protein, 263 aa, Frankia sp. EAN1pec
MTDFRNRTALVTGASSGIGAAFAEALAARGADLVLAAPSEEKLRPVAERLRALHGVRVWMVPVDLAREDGPDLLVEQVRATGREIDVLVNNAGFGTYGRYEELPADRDHREVMVDVVAVERVTHLLLPAMVERGRGTVVNVSSTSGFQAVPYMAVYGASKAFVLSFSIALWAEYRSRGIRVLAVCPGPTDTNFFEVLGRRMSAGGRLRTTDEVVSAAFRGLDRGLPYVIDGRLNYLTSNASRLLGRGLVAGITARTLRPRGRP

SEQ ID NO: 56887 - protein, 202 aa, Prochlorococcus marinus str. MIT 9313
MSSKLRLGVAGPVGSGKTALVEAMCRRLRDQLQLAVVTNDIYTQEDAEFLTRVGALEPERIRGVETGGCPHTAIREDCSINRAAVEDLERNFPDLDVVLVESGGDNLAASFSPELVDLCIYVIDVAAGDKIPRKGGPGITRSDLLVINKIDLAVHVGADLEVMKRDTTRMRGERPWCFTNLRSGDGLESVLHFLLQQLPNRP

SEQ ID NO: 56888 - protein, 428 aa, Rhodospirillum rubrum ATCC 11170
MPLHRVEALGEPQDRTGKTFSGRTNGPISSPLTDTERRMSIPQNPAPVNLVGLSREEIAALLRDMGEKPFRAKQLWHWVYHRGETDFSAMTTLGTPLRAKLAETCVVARPHVVREQRSEDGTRKWLLRFPDGNEAETVYIPEDDRGALCVSSQVGCTLTCRFCHTGTQLLVRNLTAHEIVGQFMAARDAYGEWPSPTDESRQLSNIVLMGMGEPLYNYDNVAKAIGILLDNEGIAVSRRRITLSTSGVVPMIRRCGAELGVNLAVSLHAARDEIRDEIMPINRKYPLAELMAACREYPGASNARRITFEYVMLKGVNDSEADARALIKLVEGVPCKFNLIPFNPWPGSGFECPPIRHIERFANILFEAGYTAPIRMPRGRDILAACGQLRSDSLRERASLHKARLAAGVADDHAPAAAPLADTPGAVA

SEQ ID NO: 56889 - protein, 392 aa, Oryza sativa (japonica cultivar-group)
MEGSPSKSRGVTGPAHTDDGDWFSDVPDDIILNIMSFLTTRQAVQTCVLSRRWRNLWRSVPCINSDIDEFTRDSDSEGYYDEKTELAFIMFMERVMELRDPAALISTFQFRCKFELDEGFDDISDPEDINAWISHAVQKQARVLDIVVLCDKLYLDHSEFASRYLTRIEFTSVVLMEGFFKQLEMGCPAWESLFLDECAVNDVEISSQTLKVLTIKNTLFSSDKTTISTPSVTYLKLWRPVDSCVFNDMPLLVTSLLVLYHVQDSGDFFQNLRSLSAAKSLEFNYIGKELTMENNLQLYPKFNNLVRLTLGQWCLDANFYGLMVFLQTSPKLEKLTLKIEKEKTQRIIGKIEDRSFTCEHLTRVEIVCSEDDPLVKDVVTFFVNSGLTSAQI

SEQ ID NO: 56890 - protein, 216 aa, Glycine max
DFTLIISVLPFFFLLPLFPVLTFTTSIIVHFSIAPATLVTSDDPLSSLGKYFGQQIFFCNISVFHSISNFNPLGVSFHSDVATRMDNQKGMSISFETFTWKIENFSKQNTKKLQSKTFRIRGYKWRIRLYPLMKNVDHFSLYLMVADSLPPYGWNRNTHFKLALVNQLDGNKSVVKETQHEFYGGYRSWGSLFVNLSDFYDSKQSYLLNDTCIIEA

SEQ ID NO: 56891 - protein, 502 aa, Chorispora bungeana
MAIPMPTRQLFIDGEWREPILKKRIPIVNPATEEVIGDIPAATTEDVEVAVNAARRAFSRNKGKDWAKAPGALRAKHLRAIAAKVTERKSDLAKLEALDCGKPLDEAVWDMEDVAGCFEFYADLAEGLDAKQKAPVSLPMENFKSYVLKQPIGVVGLITPWNYPLLMAVWKVAPSLAAGCTAILKPSELASVTCLELADICREVGLPPGVLNVLTGYGAEAGGPLASHPGVDKIAFTGSFATGSKVMTAAAQLVKPVSMELGGKSPLIVFDDVDLDKAAEWALFGCFWTNGQICSATSRLLVHENIAPQFIEKLVKWSKNIKISDPMEEGCRLGPVVSQGQYEKILKFISTAKSEGATILHGGSRPEHQEKGFFIEPTIITDVTTSMQIWREEVFGPVLCVKTFGSEDEAIELANDSHYGLGAAVISNDTERCDRVSQAFEAGIVWINCSQPCFTQAPWGGVKRSGFGRELGEWGLDNYLSVKQVTLYTSNEPWGWYKSPSA

SEQ ID NO: 56892 - protein, 174 aa, Brassica napus
MAASVDPLVVGRVIGDVLDMYIPTANMSVYVGPKHITNGCEIKPSAAVKPPKVNISGNPDELYTLVMTDPDAPSPSEPNMREWVHWIVVDIPGGTNPSKGKEILPYMEPKPPVGIHRYIFVLFREISPVGLMVQQPPSRANFSTRMFAGHLDPWFTWGNCFTFNAQKEPASGRR

SEQ ID NO: 56893 - protein, 188 aa, Aspergillus nidulans FGSC A4
MKVFSSLCTFDYSWEEVSTANWRKYCPWNDKSTHVVGVDTLSRGVDPETGILRTERLITCNQSVPQWVSSLFGGSPTSHVYEVSYVDPISKKVTMCSTNLTWANVLNVRETVIYQPSVTNPSSKTEFQQEAKITALCGGWQKIKNKVEEASVERFRENAKRGREGFEAVLEMSRRVFSEQRALESSVA

SEQ ID NO: 56894 - protein, 225 aa, Triticum aestivum
MSAAVGGAEFHGFGGAAHLPRSRMLGRTVTVAPTGATPAGSGPSAAIIRAVSTPLNNDAKQFRRSKVEIIYENSNFLRDPLNDELISEAPSVNETAVQLIKLHGSYQHSDRQVRGQKNYSFMLREKNPSGKVPNRTYLAMDTLADEIWIGTLRLTSRQTFQLHGRRNKNLKRVLRTVRKNMGPGLGACGNPHKNVLAPAAPYGKKESFLPRKCGNIGDFLGPKGG

SEQ ID NO: 56895 - protein, 129 aa, Neisseria meningitidis Z2491
MSKTIIHTDKAPAAIGAYSQAVRAGDTVYMSGQIPLDPATMTVVGNGDFRAEARQVFKNLQAVAEAAGGTLADIVKLNAYLTDLANFAVFNEVMAEFIAEPFPARAAVGVASLPKGVQVEAEAVLVLNA

SEQ ID NO: 56896 - protein, 327 aa, Vibrio parahaemolyticus RIMD 2210633
MAELTLVEAVNLALHHEMEHDPNVVVLGEDVGDNGGVFRATVGLKQKYGLKRVIDTPLAEALIGGVAVGMATQGLRPVAEFQFQGFVFPAMEHLMCHAARMRNRTRGRLTCPAVFRAPFGGGIHAPEHHSESIEALFAHTAGFKVVIPSSPQRAYGLLLAAIRSNDPVMFFEPKRIYRTVKSEVIDNGEALPLDTCFTLRKGRDITLVTWGACVVESLQAAQTLSSQGIEVEVIDLASIKPIDTATIFRSLEKTGRLLVVHEASKTCGVGSELLARTAEHAMCLLKAPPKRVTGMDTIMPYYRNEDYFMVQEEDIVIAARELVEDWK

SEQ ID NO: 56897 - protein, 395 aa, Oryza sativa
  misc_feature (209)..(209): Xaa can be any naturally occurring amino acid
  misc_feature (219)..(219): Xaa can be any naturally occurring amino acid
  misc_feature (228)..(228): Xaa can be any naturally occurring amino acid
  unsure (1)..(395): unsure at all Xaa locations
MSDKCGNCDCADKSQKKGTSYGVVIVEAEKSHLKEVAAGEVMGGLSMDQAFVQAPEHRPKASVAEADGIPVIDLSPLLAAGDGDADGVDALAAEVGRASRDWGFFVVVRHGVPAEAVARAAEAQRTFFALPQERRAAVARSEAAPMGYYASEHTKNVRDWKEVFDLVPRQTPPPPTTAVADGDLVFDNKWPDDLPGFREAMEEYGEAVXEELAFKLLEXLIARSLGLXPDRLHGFFKDDQTTFIRLNHYPPCPSPDLALGVGRHKDAGALTVLYQDDVGGLDVRRRSDGEWVRVRPVPHSFIINVGDIIQVWSNDRYESAEHRVAVNVEKERFSIPFFFNPAGHTMVEPLEEVVSDESPARYNPYNWGEFFSTRKNSNFKKLDVENVQITHFRKN

SEQ ID NO: 56898 - protein, 364 aa, Vibrio parahaemolyticus RIMD 2210633
MNVQALPMHRFIDHDGNLVGQLPNWADIETLVGFYRDMVLTRTYDQKAVALQRTGKLGTYPSHLGSEAIGIAVGRALKTDDVFVPYYRDMPAMWCRGIGMEKNLQYWGGDERGSDFAPEGSPIPSRDLPFCVPIATQCTHAVGVASALKIQGNHEAALVMCGDGGTSKGDFLESINCAGTWNIPLVFVVNNNQWAISVPRSLQCAAEFLSEKAKGAGIPGITVDGNDVVAMYDATMTALERARKGKGATLIEAVSYRLSDHTTADDATRYRNADDVQTAWQFEPVSRLKTFLINQGAWSDEQEQQWQSDCKEQVELAVERYLNLPQQAPETGFDYLYESLPQELHAQRDELINKAMRMQGGKHG

SEQ ID NO: 56899 - protein, 296 aa, Glycine max
MGTAARRRQKGDAYKKIKSRCCYDVASKLSHTANKYGRHTFTASRKEETYRMRASNSSSSISIAKRYFFFFLLFIFFALRSSSGDCSEYHHHHSPMATIGGLHDSQGSQNSVETEALARFAVDEHNKKQNSLLEFARVVRAQEQVVAGTLHHLTLEAIEAGEKKLYEAKVWVKPWLNFKELQEFKPAGDAPSFTSADLGVKKDGHQPGWQSVPTHDPQVQDAANHAIKTIQQRSNSLVPYELHEVADAKAEVIDDFAKFNLLLKVKRGQKEEKFKVEVHKNNQGGFHLNQMEQDHS

SEQ ID NO: 56900 - protein, 426 aa, Neisseria meningitidis Z2491
MENSLKEAALKFHELPVPGKISVTPTKSLATDKDLALAYSPGVAAPCMEIHADPQNAYKYTAKGNLVAVISNGTAVLGLGDIGALAGKPVMEGKGVLFKKFAGVDVFDIEIDEKDPQKLVDIIAALEPTFGGINLEDIKAPECFYIERELRKRCKIPVFHDDQHGTAIITAAAVLNALRFTGRKIEEATLVCSGAGAAAIACLNQLLDLGLKRENVTVCDSKGVIYQTREDKDRMDESKQFYAIEDNGQRVLADAVKGKDIFLGLSGANLLTPEILNTMNEKPIVFAMANPNPEILPPLAKETRPDVVIGTGRSDFPNQVNNVLCFPFIFRGALDVGATTINEEMKRACVYALADLAMEEVTEEVVAAYGKKFEFGAEYLIPTPFDSRLLPRVATAAAKAAMESGVATRPIADLEAYAAKLSEWKL

SEQ ID NO: 56901 - protein, 228 aa, Gossypium populifolium
  misc_feature (115)..(115): Xaa can be any naturally occurring amino acid
  misc_feature (178)..(178): Xaa can be any naturally occurring amino acid
  unsure (1)..(228): unsure at all Xaa locations
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHXGSVAKINPAAPLDKVCILSCGISTGLGATLNVAKPAKGSTVAIFGLGAVGLAAAEGARIAGAXRIIGVDLNPNRFEEAKKFGCTEFVNPKDHNKPVQEVLAEMTNGGVDRSVE

SEQ ID NO: 56902 - protein, 451 aa, Streptomyces avermitilis MA-4680
MATTASVHPVDEVPPIRQLAAFGLQHVLAMYAGAVAVPLIVGSAMKLSAADLAYLITADLLVCGIATLIQCVGFWRFGVRLPIMQGCTFAAVSPMVLIGTTGGGLPAIYGSVIVAGLAIALLAPVFGKLLRFFPPLVTGTVILIIGVSLLPVAGNWAAGGQGAKGFGEPKNLALAGFVLLVVLGVQRFAPAFLSRIAVLIGIVVGLAVAVPFGFTDFGGVGDADWLGISTPFHFGTPTFHASAIASMLVVALVTMTETTGDLIAVGEMTDRGVEPRMLADGLRADGLSTVLGGVFNTFPYTAYAQNVGLVGMTRVRSRWVVAAAGGMLVLLGLLPKLGAVVAAIPAPVLGGAGLVMFGTVAASGLKTLARVDFKDNDNLTVVAVSVAVGMLPVGVPTIYAQFPDWFQTVMNSGISAGCLTAIVLNLLFNHLPGKAGSPAKAAEPDEASGTA

SEQ ID NO: 56903 - protein, 199 aa, Coccidioides immitis RS
MASGPATQSLKCVVTGDGAVGKTCLLISYTTNAFPGEYIPTVFDNYSASVMVDGKPISLGLWDTAGQEDYDRLRPLSYPQTDVFLICFSIVSPPSFDNVKAKWYPEIEHHAPGVPIILVGTKLDLRDDKATNENLRAKKMEPVSYEQALAVAKEIKAQKYLECSALTQRNLKSVFDEAIRAVLNPRPVAKPKAKRCSIL

SEQ ID NO: 56904 - protein, 65 aa, Brassica napus
  misc_feature (14)..(14): Xaa can be any naturally occurring amino acid
  unsure (1)..(65): unsure at all Xaa locations
MVTKTEERELNQLXNQVENGGGGIWEYLCLVRKLKVRRSEIVLKHGLSILNDSGKRFSLGPDGIR

SEQ ID NO: 56905 - protein, 228 aa, Glycine max
MDSALSRLHLHNLPPLSSAAHRPLLQPLAAAASFYRSSPPLPRLRLSPLLAANTLTANDVSPRSGLYTVGDFMTKKEDLHVVKPTTSVDEALEILVENRITGFPVIDDNWKLVGVVSDYDLLALDSISGHGLKDNNMFPEVDSTWKTFNEVQKLLSKTNGKLIGELMTTAPMVVRETTNLEDAARLLLETKFRRLPVVDAEGRLVGIITRGNVVRAALHMKQANQKKA

SEQ ID NO: 56906 - protein, 227 aa, Schizosaccharomyces pombe
EDEEFARQQLLSRKEEEEEEDEEASDFEDSFADFSDGEADDLDESRWRKEAAKEHNSLLAVGYKNDRSYVVRNNKIGVFKHVDEKGLKFQTALNNLSTPKGKSLRPSKLMLHNQDSSILFQTENAPHSLYHMDIEYGKIVDEWKVHDDVPLVTFTPDNKFAQMTAEQTLIGLSNNSIFRIDPRVEGNKLVAEQFKQYATKNDFSSAATTENGYIAVASNKGDIRLFD

SEQ ID NO: 56907 - protein, 272 aa, Oryza sativa (indica cultivar-group)
MATSLDMSLDDMIKNNRNSRGRGRGRSQGGGRGRGDGQRFSYGSGRGRGAGTFRGRGSFNKTKDIVWRQDLFEDSMVAAGLSVTESSTKLYISNLHYGVTKEDIQELFSEMGHLKHCAVHYDNNRRPTGSAEVIFTRRSEAVAALKRYNNVRLDGKPMKIEVIGADLGMAAPSAPRVSVVPGARGRGQREVVMMPGGSGFGRGAAGSSNFIPGWKRNNFAQRGGQGRGRGRGRNNFGRGRGRGYVRKGPVEKSAEQLDKELDSYHSGAMNVD

SEQ ID NO: 56908 - protein, 223 aa, Vicia faba
MAFYNEEEKTEDYLFKIVLIGDSAVGKSNLLARFARDEFYPNSKSTIGVEFQTQKMEINGKEVKAQIWDTAGQERFRAVTSAYYRGAVGALLVYDISRRQTFDSIGRWLNELHTHSDMNVVTILVGNKSDLKDAREVPTPEGKALAEAQGLFFMETSALDSSNVVSAFQTVVKEIYNILSRKVMMSQELKKQDTPWTENGKTVVLQEGDREVEVESKKGCCSS

SEQ ID NO: 56909 - protein, 418 aa, Candidatus Desulfococcus oleovorans Hxd3
MPMSKAFENRLFPVLDKVAAHYGTPFHIYDEAGIRGTGKALLDAFSSVPGFREYYAVKALPNPRILDIMRSMGFGFDCSSIPELVLARRAGAIGEEIMFTSNNTSAEEFEAALADSGCILNLDDISLIYKVPKLPDLVCFRYNPGERRTGNAIIGNPVEAKYGVAHDQILEAYRKVRDMGARRFGLHAMLASNERNHTYMVTTAEMLLDLVRDISDTLDIQFEFVNIGGGLGISYRPGEPPLDLPAMGAQISDVFERFGRERRYMPRLYIESGRYMTGPHGALVTRVINRKHIYRTYVGVDACMSALMRPAIYGAYHHISLPTKSGGPVETVDVVGALCENNDKFAVQRELPVAAEGDLMVIHDTGAHGIAMGFNYNGRMRPMELLLREDGSVELIRRAETVEDYFATLAFEKSVLRP

SEQ ID NO: 56910 - protein, 604 aa, Coprinopsis cinerea okayama7#130
MSHPPAPDTTSPALSLVGTTLPEDFDPTSFDSVTVARGWFSMFQSAVANQSIPGAVMGLFIPEATGIQVWWRDMLALTWDFRTFIGHSKIRRFATDRLFGPTAQFEVDLHDLELVTAESDSALPPAFIQPEPDFAWIQLFFSFKTKSGLGSGIARIVPVGVTDANGLQDAKNWKAHTIYTNLEALAGHPEAIGLFRNQQLDHGDWELSRRKEIDCEGEAQKPVVLIVGAGHNGLAVAARLKMLGMKSLIIEQSERVGDGWRNRYGALCLHQPIWNQDLPYLPFPPNWPLYVPAAKMSNWLEHYAEIMELNVWLSSSIRDIRQDPDSQKWDVSIVRKLKGVDGTVLEETRRFHAVHHLILAIGEGNGLPEIPHIEGLHKFKDNGGVVLHSTEYKRASEYAGKRVIVVGASSSAHDICAECYRNNIGLYSENSRMQTQEIAELDKCLLARLHKAGFKTNLGVLEAGFTYIIPTGGGALYLDSGACNLIADGKIKLKSDSQIKEFTERGLIFEDGSELEGDVVVFATGHGNSRERLRHLLGDDLAARFTGLWGLDEEGEIIGAWRDVGIERLWCMRGGFVFGRFFSKHVALQIKAQEEGLFGQRYRV

SEQ ID NO: 56911 - protein, 139 aa, Brassica napus
GRVGAVAVAINGGLITPVLQDADKLDLYLLSQKWKELVGKARSKQLQPHEYNSGTFTLSNLGMFGVDRFDAILPPGQGAIMAVGASKPTVVADKDGFFSVKNKMMVNVTADHRIVYGADLAAFLQTFAKIVENPDSLTL

SEQ ID NO: 56912 - protein, 429 aa, Coprinopsis cinerea okayama7#130
MSMEFPDIPSGLFPTLRVLGTTLPPEFDASAIDAKEIAREWFLEFQHASSQPDPSALVNLFLPESTGVQVWWRDMLALTWDFRTFVGRDAIRNFALDRVVGAAARSEVKMEDLRLAETTSKDALGPVFKRPSPDMAWIQFFFRFKTVSGIGSGIVRVVPVGVSSVDGLSDAGNWKAHTIYTNLEGLIEHPEAVGSLRNQEPSHGHWESNRRKEVECEGAGVEGKPTVLIVGAGQCGLALAARLKMLGLKSLIIEQNERVGDNWRNRYEALCLHDTVWMDHMPYLPFPPNWQVYTPATKLANWLEHYAEIMELNVWLSSSTQRVAQDPETKKWDVTIVRKVRRADGTTTDVVRHFSAIPHLVMATGSGSGIPEIPLIDGMDIFKAHGGTVLHSTQHKRAADHQGKKVVVVGACTSAHDICADYHYNNIGK

SEQ ID NO: 56913 - protein, 292 aa, Rhodospirillum rubrum ATCC 11170
MKKQVFMGAAVAIVTPFRDGKVDYQKLRELIEFQIAHKIDAVVVCGTTGESSALSHDEHISVVRFVVETVKRRVPVIAGAGSNNTQHAVDLSVELEKVGADALLSVVPYYNKTSQRGLVTHFSTIARAVAIPIILYNIPSRTSFNMTPETIREIAENETVVGIKECNLYQVGEIVKLCGPEFSIYSGDDSTILPVLAYGGKGVISTMANIIPEETHDIVSYFMRGDIEGARRAQLRALDLISALFVDVNPIPLKTAMNLMGMNVGPCRLPLVDMGNRETELLVRALKDYGLT

SEQ ID NO: 56914 - protein, 228 aa, Gossypium populifolium
  misc_feature (115)..(115): Xaa can be any naturally occurring amino acid
  unsure (1)..(228): unsure at all Xaa locations
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHXGSVAKINPAAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 56915 - protein, 587 aa, Streptomyces avermitilis MA-4680
MHPCSPRLVGVPAPDRFGVLMGTQWNAVDGRIRTTARGHAVLNSPRLNRGTAFTRQERQELGLVGLVPPQVLTQDQQAARAYTQFRSQPNDLAKNVYLTALRDRNEVLFHRLLGDHLAEMLPIVYTPTVGTAIERYSYEYRRPRGVYLSVDAPEDIERTLRASGLGADDVDLIVATDGEAILGIGDWGVGGIDIAVGKLAVYTAAAGVDPARTLAVMLDVGTNRQELLDDPLYLGNRHPRVDRESYDAFIDAYVTAATELFPDALLHWEDFGPANARRILDRYREKVRTFNDDIQGTGAVNLAAVLSGVRAGGVPLRDHRVVLFGAGTAGIGIADQLRDALIADGLTPQEATDRIWAVDRHGLLAEDQQGLHDFQLRYVRRGAEIAGWRRDDALGGVPLAEVVDRVRPSVLIGASGQGGAFTEDIVRAMAAHTDRPIILPMSNPTRLAEAVPADLLTWTDGQALIATGSPFDPVEVDGVTHHIGQANNALVFPGLGLGAVVARAERITDGMLVASARAVAEQTDATAPGVPVLPLIDRLRDTSAAVAVAVARAAVEDGVARETVDDAVEERVRAAMWQPEYPPIEAV

SEQ ID NO: 56916 - protein, 514 aa, Symbiobacterium thermophilum IAM 14863
MIPPYRPEPLSDFRNPAVTAAFEQALAAVKTQLGKRYPMIIAGRRVESGESIVSVNPSQPDQVVGYAARGGVAEAEAAVQAALAAFPAWADTPADVRARILFKAAAIMRRRRHELSAWMCHEVGKNWAEADADTAEAIDFLEYYGRQMLKLAAPQPLTPYPGEENHLYYRPLGVGVVHSPFNFPLAILTGMTAAAIVTGNTVVVKPSTEAPVIAAKLFEILEEAGLPAGVANLLYADPVEMGDYLTTHKEVRFINFTGSRQVGCHIYELAAKVQPGQVFLRRVIAEMGGKDAIIVDGTADLDEAAAGIVTSAFGFSGQKCSACSRAVVTADVYDQVLEKVVARTRALKVGPATEKDTDVGPVAAERFQKKILEYIEIGKAEGRLVLGGNALPGGYYVEPTIFADVAPTARIAQEEIFGPVLAFIKARDFDDALRIANNTPYGLTGSVYSRSRENLEQARRRFRVGNLYFNRKSTGAIVGVHPFGGFNMSGTDSKAGGPDYLLLFTQAQAVSEKL

SEQ ID NO: 56917 - protein, 186 aa, Mycoplasma pulmonis UAB CTIP
MLHFIKSASNSQSWYNHDKVEICFIGRSNVGKSSLINSLSNSAVSKVSNTPGRTQLINFFEDDQKNVYVDLPGYGFAQMPKDKLEKMHQMIDEYLQNRKNLKTIVLLFDSRRGILDQDLDFINWAQQAKKNIILLATKIDKLNQAQKHKLLVSLKELNLEKSVLLVSSLKRTNIDNLKKLLASEFK

SEQ ID NO: 56918 - protein, 228 aa, Gossypium rotundifolium
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPPKGSTVAIFGLGAVGLAAAEGARIAGASRIIGVDLNPNRFEEAKKFGCTEFVNPKDHNKPVQEVLAEMTNGGVDRSVE

SEQ ID NO: 56919 - protein, 464 aa, Arabidopsis thaliana
MSRLLQTPFLPSVSLPTKTRSSVTGFRVKPRIIPIQAKIREIFMPALSSTMTEGKIVSWVKSEGDKLNKGESVVVVESDKADMDVETFYDGYLAAIMVEEGGVAPVGSAIALLAETEDEIADAKAKASGGGGDSKAPPPASPPTATVVAPVAVEKKIAAPPVAIKAVAASAVHPASEGGKRIVASPYAKKLAKELNVELAGLVGSGPMGRIVAKDVEAVAAGGGVQAAVAVKEVVAVPGVELGSVVPFTTMQGAVSRNMVESLAVPTFRVGYTISTDALDALYKKIKSKGVTMTALLAKATALALAKHPVVNSSCRDGNSFVYNSSINVAVAVAIDGGLITPVLQNADKVDIYSLSRKWKELVDKARAKQLQPQEYNTGTFTLSNLGMFGVDRFDAILPPGTGAIMAVGASQPSVVATKDGRIGMKNQMQVNVTADHRVIYGADLAQFLQTLASIIEDPKDLTF

SEQ ID NO: 56920 - protein, 771 aa, Mycoplasma pulmonis UAB CTIP
MKKLITDLNLNDKKVLIRLDLNVPLKGKKITSLKRIEESIPTIKYVQERGGKIILLSHLGRVKTKEDKEKKSLSIVVEALASLLNSPVKFVDQTRGKKLESAIEKLKPGDVLLIENTRFEDLNNNAESNNDPELGKYWASLGDVFINDAFGTAHRAHASNVGIASNIKESALGILVQKEVNALWKLMEQQEKPFVAILGGSKVSDKINVLEKIIDKVDRLIIGGAMAYTFLKAQGIGIGDSIYEQDKIEFATEFLKKYNHKIILPIDHALAKKFKNAKPIFNNENPLEIPQTFIGMDVGPKTIELIHKYIKGDTKLGISPAKTIFWNGPMGVTEFEEFQSGSLAVVEAISQLVGAYSVVGGGDSIAIIEKLNAQMLFSHISTGGGASLEFIESKVLPGIDAIQNYEQTYEQYDSQVQSQDFSQNFDSPLVEETFSQSTSENFSDFASSTQEHFATSENQNTLINNYENPGFDSQDMFKTEEQNDSTSSFLTSTNPFSSEFSNEFKTSDFQDLKQTQETETQETLIPHTFEYTTDDLRHTLEQYVRETSFQTRESTFPTEEASFETLEETSFQTLEESFPTQSFEQVEQTSEKNMEVSTENFENASSQTNSFTVSDIPKTTSTFEDLETPETQNTTLEEVALETSNFEAQNLETPNLQTSNFETSNLETSNFETSNFETSTFESFNTGNFSTPSSTFEDLDLQSATFQTNDESERSTQENFEPTEVIESDLLAMKTTELEQEITNNTSRDILSEDEVAAPHKKRFWFFGRKR

SEQ ID NO: 56921 - protein, 149 aa, Aspergillus nidulans FGSC A4
MFSRTAISFTLRRSLFRPQLSPQFPNQLPSVLQARLLSTETKAAIDKAVASAPVVLFMKGTPETPQCGFSRASIQILGLQGVDPKKFVAFNVLEDPELRQGIKEYSDWPTIPQLYLNKEFIGGCDILMSMHQNGELSKLLEEKGVLVAE

SEQ ID NO: 56922 - protein, 234 aa, Mycobacterium tuberculosis
MSPAEREFDIVLYGATGFSGKLTAEHLAHSGSTARIALAGRSSERLRGVRMMLGPNAADWPLILADASQPLTLEAMAARAQVVLTTVGPYTRYGLPLVAACAKAGTDYADLTGELMFCRNSIDLYHKQAADTGARIILACGFDSIPSDLNVYQLYRRSVEDGTGELCDTDLRAAFILATLGLRRLGSNVFRSNAHGIQRPRGPSARHRPVHADHGPGRRTRTWCAAGFSSASRT

SEQ ID NO: 56923 - protein, 55 aa, Brassica napus
MTLYIRREASKLWKRVCSEIATEIGLLADNWKYLLAGLLCQYIHGLAARGVHYIH

SEQ ID NO: 56924 - protein, 1472 aa, Yarrowia lipolytica CLIB122
MESTPPDYTGLDPTIDAEIRSIAESVHKDRVDDYDTEKGTVGNEKLLRSDTVQPNLDVNPYIDNSDPQLDPLSDEFNARKWIKTVLGLKQRFGATKHITAGVSFKNLAAYGYGGGSQYQKTFSNSVLAIGPMIMELFGGNKGTKVQILRHFDGLVRAGETCVVLGRPGSGCTTFLKSVACETYGFHIEDKTEWNYQGVPRKVMTKNARGEIVYNAEVDVHFPHLTVGDTLLFAALARTPHNRLEGVSREQFAKHTRDVTMATLGLTHTMDTKVGNDFVRGVSGGERKRVSIAESVVCGAPLQCWDNSTRGLDAANATEFIRSLRLSAEMMGSSMFVSLYQASQEAYDLFDKVCVLYEGRQIYFGLAKEAKQFFLDLGFECADRQTTGDFLTSLTNPIERIIQPGWENKVPRTPDDFEKCWMESQARQKLLQEIEEFNTEFQLGGESQDHFMELRKESQARHTRVKSPYTISWPMQTRLCLWRGFLRIKGDMSTDISIVVGNFIMALVLSSMFYNMQQTTDTFFSRGALLFFAILLNAFSSVLEILSLYEQRPIVEKQTRYALYHPFTEALASILTTFPTKILTLLAVNLTLYFMTYLRREPGPFFIFFLFSLLCTLAMSMIFRCMAAITKTLEQALAPASVIILALVIYTGFSLPITYMHGWARWINWLNPVAYGFEAVMVNEFRNRDYGCASYVPTGGEYDQIDLQYKSCSVVGSVPAESSVNGDRFLGLAYQYYNAHLWRNMGILFGFIFFFGFCYLVAVEYIQGAKSKGEVLVFRKSYLKKIKKHAANDEEAGAMMAGEKSEEPASEDSSINIQAQKGIFQWKDVCYDTKVKDGERRLLDHVDGWVKPGTLTALMGASGAGKTTLLDVLADRKATGVITGDMLVNGEPRDESFQRKTGYVQQQDIHTSTATVRESLEFSALLRQPSSISVKDKLAYVDEVIRILEMEAYAEAIVGVPGEGLNVEQRKRLTIGVELAAKPELLLFLDEPTSGLDSQTAWSIIKLLKKLAANGQAILCTIHQPSAILFQEFDRLLFLASGGRTVYYGDIGPESTILTSYFERNGADPCPKEGNPAEWMLEVIGAAPGSTAKRDWPVVWNESSERAAKRAELDEMAQTVERTQTNNTERDASGYSDSDQFAVGQWTQFKIVTKRLYQRFWRTPSYLWSKIFLCTASAIFIGFSFFKAPSDIQGMQNKMFSFFMLFLIFNTVVEQIIPQFDQMREQYEARERSSKTYSWQVFMASNMVVELSWQFLMGVIVFFCFYYPVGFQWTAEHNNSVHERGALFFLYVLLLFLYNSTFAHMMIAGIGNKDTAANIGNLLFSLMLLFCGVLATKEQMPGFWIFMYRVSPLTYFVGGMLATGIGRAPVTCSGNEIVRFQTFPGKSCGEYMQGFIQALGDNGGYLLNPAANELCEYCPMKSSDTYLSMVDVSYTQRWRNWGIIWAYPVFNVAMAFLLYYVCRVPKKSKAQKA

SEQ ID NO: 56925 - protein, 326 aa, Magnaporthe grisea 70-15
MVDRPNKPSALASTPGLPPQAQVSITHDKSRVEAVLPTGESVEVLLYGATVLSWKKNGQEKLWLSEGAKLDGSKAVRGGIPLVFPVFGTAPDHEATSALPQHGFARTSTWEFLGKSTSESAGEGDGAPRSMADLSVKLDFGLSSANLDEKTRALWPHPFGLLYSVTLDRDALTTSLIVTNEGDKPIEVQVLLHTYLRVKDINNVTIEGLENASYIDKVDNASTKTQDTAPLAINGETDRIYTPVGGPRAPVTVLEGGQKTFEVVRDGNLDDVVVWNPWTEKANSIGDFEPKVGFNNMLCIEPGAVRAWQTLEAGDALEGAQTIRAW

SEQ ID NO: 56926 - protein, 360 aa, Oryza sativa (japonica cultivar-group)
MSTSNNGGPTVAVKLYIDKEKKKVLFAESDKEFVDVLFSFLTLPLGTIVRLLGKQSQIGCLDELYKSVEALSEDYFQTKACKAMLLRPRNAAGSHCDRLKVKVDDTNERLIYVCPTSSCDARSFSSFWGVCNSCTVTTTLILREKPVDCRTVESNDDGVFVKSDLKFIIFDDLHVAPASTSTMFPLLGKFGLLEQRNIEEKVLELNSHKIINLLKRALVGYDFVDLVFGLLSLPLGSTIKAYGQVTSGGSSGLDNLYRSINGSGIGCVKQECQSLLLSPMLAPFFGCGSSVLLQVQESPIKSCSLRVIRAAKIPNEMLVKKELTLDRTQVFHLLLQVLKLLRAALVTRNALSSVLLPPKK

SEQ ID NO: 56927 - protein, 555 aa, Schizosaccharomyces pombe 972h-
MNRFITSILVVFISMSGWLQGADTGSISGILGMRDFQSRFADRYNPISNSYSYSAWRQALLTGTINAGCLFGAMLSSPFTERIGKKYSICFFSGVYIIAELLLVTAVPSWIQVLVGKILAGVGIGALSVLSPGYQSEVAPPQIRGAVVATYQIFSTGAALVAACINMGTHKLRKTASWRTSFGINMLWGILLMVGVLFLPESPRYLIYKGRDEEALRIMCNMAELSPESEIIQTNFNTIKSDIEIEMAGGKARWIEIFGKDIRYRTCLGFLVMLFRELIGNNYYFYYATQVFKGTGMTDIFLPAVILGAINFGTTFGALYTIDNLGRRNPLIFGAAFQSICFFIYAAVGDRKLIYKNGTSDHRAGSVMIVFSCLFLFSYCCSWGPMGWVIVGETFPIRYRSKCASVATSGNWLGNFMISFFTPFINNAIGFKLGYIYACINLFSSFMIFFLAKETKGLTLEEVNDLYMSNIKPWESYKYVREIESHRIHFSKEEEKREREKSKGIRGQEEEFIENADEDNNDSSSSSGSVVSAVKPRRSAVSNDRFSEDSHPTYI

SEQ ID NO: 56928 - protein, 362 aa, Triticum aestivum
MAASHPSTEMAASPMVRPTVQELAAAGAEEPPRQYVLPEQDRHGDLLAADEFPEPIPLVDLSRLTDADEAERLRAALQTWGFFLATNHGIEDSLMDAMTSVSREFFRQPAEERQKCSNLVDGNGKDYQVEGYGSDKVVSDDQVLNWSDRLHLRVEPEDERNFAKWPSHPESFRDVLQEYASRIKKIRDLVLRSIAKLLEIDEDYFVNQISNKAPGFARFNYYPPCPRPDLVLGLRAHSDGGLLTILFNDDTVGGLQVQRDGRWYNVPAKPHTLLINLADCLEIMNNGIFTSPVHRVVTNVEKDRLSLAVFYAVDAETMLEPAPGLLDDKRPPRYKKMVAKDFVAGLFEHFRQGKRFIDTLKI

SEQ ID NO: 56929 - protein, 415 aa, Acidobacteria bacterium Ellin345
MFDLLKKILDGQNQFASGGLLLMILGSVGVFLRSLPSQLWSWIMRQSTMSITVKDDDQAFAWVKEWFLEQKFLKRVRRLDLDTSLRGAEAAMVPAPGRHWFMRGGRPYWVWFWRTENTKGYNQRRMESFMIETIGRDQQVLRQFVAEVVACHKKKLRTASYLYLYDDGWDRVESYWPRRLDSVLLKPGEKEHLIQDLERFRASRDRYRRLGVPYHRGYLFYGPPGTGKTSLVSALAARFGMSVYIVNLSELNDRTLKTAMNWVSDNSVILFEDIDCMNASTRRSQAGGAPRSETADDPKEKSAIDKMGVSLSGLLNVLDGFSAPENVVYAMTTNDISGLDAALLRPGRIDYKLYLGEACESQKVELYRRFFPESSEEEARAFAQANWAETMAEFQGLLLALEQEVGTTEVGVVQS

SEQ ID NO: 56930 - protein, 131 aa, Zea mays
  misc_feature (62)..(62): Xaa can be any naturally occurring amino acid
  misc_feature (96)..(96): Xaa can be any naturally occurring amino acid
  unsure (1)..(131): unsure at all Xaa locations
SSRPGTNTKAEGTSLFLRPRSSRLRQMSRARARAGEGLGKGGAERHRKVLRDNIQGVTKPAXRTVRRRGGVKRISGLIYEETRGGLKIFLENVIRXDGVTYTEHARRKTVTAMYVVYWLERHGRRLYGFRG

SEQ ID NO: 56931 - protein, 249 aa, Mycobacterium avium 104
MGETATLVLLRHGESEWNSLNLFTGWVDVGLTDKGRAEAVRSGELLAEQGLLPDVLYTSLLRRAITTAHLALDAADRLWIPVRRSWRLNERHYGALQGLDKAETKARYGEEQFMAWRRSYDTPPPPIERGSTYSQDADPRYADIGGGPLTECLADVVVRFLPYFTDVIVPDLRSGKTVLIVAHGNSLRALVKHLDQMSDDDVVGLNIPTGIPLRYDLDARLRPLVPGGTYLDPEAAAAGAAAVASQGGG

SEQ ID NO: 56932 - protein, 546 aa, Synechococcus sp. CC9605
MGTQRVTDDLDRLLELLPEAVREQLRPVEARQQLLEVVLDLGRVPEARYPGRALALGSTPLSREDLAVVVARLGQFGGDNRAGIERTLHRISAIRNRQGDVVGLTCRVGRAVFGTVAMVRDLLDGGQSLLLMGRPGVGKTTALREIARVLADELERRVVVIDTSNEIAGDGDIPHPAIGRARRMQVARPELQHQTMIEAVENHMPEVIVIDEIGTELEAQAARTIAERGVVLVATAHGNALANLIKNPTLSDLVGGIQAVTLGDEEARRRRSQKTVLERAAEPTFPVAVEMHSRQRWAVHTDVAATVDQLLRGLKPRVQERELTPEGGVQLVDPPQSSGLLRPPSQRSFADQPVSVPVPMPAASDREVSAAEKPASPETSAEHLQVLCCGVPPRVVEEAIRSHGWKARVVEDLSEADVVLSVRLGLSRQPSLRRQVRDLGIPILVIKSDTLPQVTRAMARLLRRQATETAPEVTPPDQASQDDELAALEECRLAVEQVVMPQGRPVELLPRSERVLRMQADLVRRYRLRSDVFGEAEMSRLRVFPR

SEQ ID NO: 56933 - protein, 367 aa, Cryptococcus neoformans var. neoformans JEC21
MPVPVPQIFQYDYVPETKEDLEWADLATIDLSKFNNPEGRKELAQTLLEAIRTKGFFYVINFGIPQEKVDRQYALGSKFYDLPLEEKSKYVPDLENGEYNGYRPAGRSVLGGGIRDRIEVYNIPKFDGYHERNHPDVIEQNIHEIEEFARSLHTNVLDPLHVLVALALELPEDYFTNLHKYSDPSEDHLRYMMYRHFSPEETKIIESNDGLYTLGHTDLGTLTLLFRQPVAALQIRDHETGNWKWAKPLDGSLTVNTCDALSFLTGGYIKSTVHRVSIPPKDQQQYDRLGLLYFARPQNDLPLATVDSPLLKREGFDKNEFERGGYKVPTMGEFVQVKQKWQQTKRVAHREGDGSQILPGFEGKYHD

SEQ ID NO: 56934 - protein, 633 aa, Arabidopsis thaliana
MSASWADVADSENTGSGSSNQNSHPSRPAYVPPHLRNRPAASEPVAPLPANDRVGYGGPPSGSRWAPGGSGVGVGGGGGYRADAGRPGSGSGYGGRGGGGWNNRSGGWDRREREVNPFENDDSEPEPAFTEQDNTVINFDAYEDIPIETSGDNVPPPVNTFAEIDLGEALNLNIRRCKYVKPTPVQRHAIPILLEGRDLMACAQTGSGKTAAFCFPIISGIMKDQHVQRPRGSRTVYPLAVILSPTRELASQIHDEAKRFSYQTGVKVVVAYGGTPINQQLRELERGVDILVATPGRLNDLLERARVSMQMIRFLALDEADRMLDMGFEPQIRKIVEQMDMPPRGVRQTLLFSATFPREIQRLAADFLANYIFLAVGRVGSSTDLIVQRVEFVLDSDKRSHLMDLLHAQRENGIQGKQALTLVFVETKRGADSLENWLCINGFPATSIHGDRTQQEREVALKAFKSGRTPILVATDVAARGLDIPHVAHVVNFDLPNDIDDYVHRIGRTGRAGKSGLATAFFNDGNTSLARPLAELMQEANQEVPEWLTRYASRSSFGGGKNRRSGGRFGGRDFRREGSFGSGRGGYGGGGGGYGGGGGYGGGGGYGGGGGYGGGYGGASSGGYGGEPPSAWD

SEQ ID NO: 56935 - protein, 249 aa, Synechococcus sp. CC9605
MNDRPLLVFDFDGVIVDGMAEYWWSAWHACLRLEAAPEGLTPDQVPDAFRQLRPWVHQGWEMVLLAAELPVLNLPVWLQSYGEAQASALQRRGWQPEQLQTALDASRDQAVRQNRSAWLALHRPFPGLVERLQQLEAEGVDWSVLTTKTQAFTAELLNGLGLNPWRLDGREAGAKPQVLLQLQQQRRLSGFVEDRRATLEAVRLTPGLEQLPCFLVSWGYLRPQDQSGLPPGIALLHPDRFRAPLAQWP

SEQ ID NO: 56936 - protein, 144 aa, Oryza sativa (japonica cultivar-group)
RRRGSSANRSRGKGEVDLSRRPKKEAMNSRSTRTSLFDGIEEGRIRATSYSSHEIDENENDQAIDGLQDRVSILKRLSGDIHEEVETHNRMLDRMGNDMDSSRGFLSGTVDKFKMVFETKSSRRMGTLVASFVALFLLVYYLTR

SEQ ID NO: 56937 - protein, 208 aa, Triticum aestivum
MEGVVVRRVIPSDNSCLFNAVGYVMEHNKNKASELRQVIAAAVASDPEKYNEAFLGKPNEAYCAWIMDPEKWGGAIELSILSEYYGREIAAYDIQTTRCDLYGQGKNYNERAMLIYDGLHYDALAMSPAEGAPEEFDQTIYVVDQNRSIGPVEGLALNLAKEAHRKRSYTDTANFTLRCGVCQIGVIGQKEAVEHAQATGHVNFQEYK

SEQ ID NO: 56938 - protein, 226 aa, Arabidopsis thaliana
MNNLVEASEYDFGEESDLFKAPEPIIEEPMLAVDPLSQELVELGDLGSLQSDQQLIDKAFYDCEQDLLVKSAMESPLSEVLDIKNISLVAKMDNDVKSTSVVVSDVPIPKSVSSGNLSSMDMVEHKDAVIQGFPDFPPVDYGMRRAFSESDIQTLGTGNTGLVQSQLDRIIISCTSEDRREKLSRYRNKKSKRNFGRKIKYACRKALADSQPRIRGRFAKTEEMQK

SEQ ID NO: 56939 - protein, 262 aa, Oceanicola granulosus HTCC2516
MSADLSPIDKAKFAAARRATDYVEDGMRVGLGTGSTAAWLVKCLGEMVREDGLRLTGVPTSSRTAALAREVGIKVVSLDEARWLDLTIDGADEYDSNLNLIKGGGGALLQEKIVATASDQMVVIADISKQVDTLGAFPLPVEVIPFGWQTTKVLIEETLIGLDVLGRDTSLRLNGERPYVTDEGNYILDLHLNRIGNARQLSLVLNQIPGVVENGLFIDVCDAVVIGYGDGRVEVRDINEGTVEESRIDFLETENLFTDLAD

SEQ ID NO: 56940 - protein, 454 aa, Oceanicola granulosus HTCC2516
MGDYDYDLFVIGGGSGGVRAARQAAATGARVGLAESSRMGGTCVIRGCVPKKLMVFASGYRELVEDAKGYGWEIDEGRFDWPAFRQSLHGELDRLEGVYRKLLDNSGVEIHDTHASLEDGHTVRLESGGTKSARVILIATGGRPVRPAQLGDAEHGLVSDDIFDLEELPKELLILGGGYIACEFACILNGLGVKVSQFYRGAQILRGFDEEARGLIAESMKEHGIDLHVGTNIVEMDRTGDGRTWVKATNGAEHEFDAVLFATGRAPNTETLNLAAAGIETGRRGQIVVDEYSATSCPSVYAIGDVTDRLQLTPVAIREGMAFVDTVFRDKPTPVDHELVPSAVFTQPELGTIGMTEEQARDLEPVEVYCTSFRPMQTAFIGRPDRVLMKLIVSRATRRILGCHIVAPEAGEMIQLAGIAIKMGATKEDFDRTVAVHPTMAEEIVTMREPVRAG

SEQ ID NO: 56941 - protein, 540 aa, Frankia sp. EAN1pec
MGVARGEAGWDFFISYTAVDTAWAEWIAWQLEDAGYRVLIQAWDSVPGSNWAVRIQQGTTESDRTIAVLSASYLRSVYGQNEWHAAHAADPGGFARTLLPIRVEDCPRPGLLGQIVSIDLFGHPADVARQHLLDAISTARAGRAKPTAAPAFPPRPALPPQQPSARTAPPFPGPDPTASLDQPALRTHARSDRLLHGPQRRVSLAVVLLVITGTVFLASSARDRNPSATSAHSAAPPTSAPTPSLSGSPLRDHTDSVRSVAFSRDGRTLASASQDGTARLWDIAERTSQPLTGRIAVWSVAFSPDKHTLASANGDSTVQLWDVAEGTLPHPVASLPGHSDAVGSVAFSPDGRTLASASDDHTVRLWDVATGTTTHTLTDHTGPVNSVAFSRDGRTLASASDDHTVRLWDVAEGTLLRTLPGHTEPVMSVAFSPDRRTLASASQDNTVRLWDVAARTAPRLVGSLSDHTHWVMSVAFSPDGRILASASQDRTVRLWDVAARTTTHTLTGHTGPVFSVAFSLDGRTLASASDDNTVRLWDMS

SEQ ID NO: 56942 - protein, 396 aa, Oceanicola granulosus HTCC2516
MEMTMTLHNAQQRDPRLVPAPFGSRLDTYIALSDFDRPTLVVDLDRVEQQYRALSAGLGRATIHYAVKANPAEEVIARLVALGSHFDAASRGEIALCLAQGARPRDISFGNTIKKPSDIAWAWDRGITLFAADSEEELEKIAEHAPGARVYIRLIVETSEADWPLTRKFGCDASKALELLDYATDLSLEPVGFSFHVGSQTRRAEMWIPALDALAATWRAAQAAGHELSVLNIGGGFPAFYGEEIEAPEAYARAVMGLVTERFGEVAHIMAEPGRGMVAEAGTIVAETMLVSRKSDRDVHRWVYLDIGRFSGLAETEGEAIRYQLETGRDHEAMGPCILAGPSCDSADVLYEKRPVMLPLGLKSGDRVLIRNTGAYTSTYSSVGFNGFPPLDVVCI

SEQ ID NO: 56943 - protein, 174 aa, Silicibacter sp. TM1040
MPASFTPKTRGSETSDKKTSSQTLDTNMSAARATVGDVLASKNGELYWINPEDTVAKAVEVLRDRGIGALLVKNAQGDLVGILSERDIVRRLADTPGATLPQTVEGLMSRDVITATTDQSVVEVLRLMTDGRFRHMPVLEQEQLVGMITIGDVVNFRLTALEYEALQLKQLIVG

SEQ ID NO: 56944 - protein, 432 aa, Agrobacterium tumefaciens str. C58
MSAAFKNKKRTFVMGRQNRSIPMRKVMEEFHKVRRLPQYVFEQVNRLKASARAAGADIIDLGMGNPDLPTPKAIVDKLCEVVQDPRTHRYSSSKGIPGLRRAQAGYYARRFGVKLNPDTQVVATLGSKEGFANMAQAITAPGDVILCPNPTYPIHAFGFLMAGGVIRSMNVEPDESFFGPLERAVRHSIPKPLALIVNYPSNPTAHVASLDFYKDVIAFAKKHEIIVLSDLAYSEIYFDDNNPPPSVLEVPGAIDVAVEFTSMSKTFSMPGWRMGFAVGNERLIAALTRVKSYLDYGAFTPIQVAATHALNGDGSDIAEVRSVYRRRRDVMVDTFGKAGFEVPPPAATMFAWAKIPEKFRHLGSLEFSKLLVEKADIAVAPGIGFGEMGDDYVRLALVENEHRIRQAARNLKRFLSSADETMHNVVSLNAHR

SEQ ID NO: 56945 - protein, 190 aa, Zea mays
MGSASSPPSHRRWSWGSALAGAATTAAATALVLCRPRDPRFELISISLSAFHFRPPAALDIGLTLTVHATNPNVVPVRYGPSTVSILYGGAHLGTARLDAGEQPATSCRLLHLPARLDGVELAHRARALLSDVARRHMELDAAVEIAGEAAVLLWSRPFSVRIDSHITVDPVFLEVVEQENRSEMQLYLA

SEQ ID NO: 56946 - protein, 65 aa, Triticum aestivum
  misc_feature (62)..(63): Xaa can be any naturally occurring amino acid
  unsure (1)..(65): unsure at all Xaa locations
MPATPTIIGALLGLGTQMYSNALRKLPYMRHPWEHLLGMGLGAVFVNQLVKFDEKLKEDLDXXLT

SEQ ID NO: 56947 - protein, 130 aa, Glycine max
MAYGRSRASSVLDGFTLNPLPYPVLLILSLIFIFLGVSWYFSYEEVVETAEQQLGWLLFCTPVVLILIVRWLSSMENSYWFFSASLPGERRGRTHQGLSEGSSPWGVAALILVLLIMVQYQSNFLDSWFV

SEQ ID NO: 56948 - protein, 397 aa, Pseudomonas aeruginosa
MWYHGILQPTLWQLIVATLALTHVSIISVTLYLHRHSAHRSVQLHPALKHFFRFWLWLTTGMNTRAWTAVHRRHHACCETPDDPHSPRFKGLLTVLLRGAELYRAEARNPETLQTYGRGCPDDWLERRLYSRFPNAGLGLMLGVDLVLFGVAGLTVWALQMIWIAFWAAGVINGLGHAFGYRTFECPDDSSNLLPWGVLVGGEELHNNHHAYPGSAKLSVQAWEFDLGWAWICLLRALGLAQVNRGLPTIQWDCDKRALDLEASGVILRNRLLVMAQYGKRVMRPLAREESARCDAATRHLLRRASRLLVRDPDRLSDLQQSLFHSAVGRSQVMQLACAHRLALQRTWSDAGADLGEVHAALKRWVTEAEASGIRPLREFAGLLCSYSLYAPRQIVP

SEQ ID NO: 56949 - protein, 438 aa, Fervidobacterium sp. YNP
MIRRSDFPKDFIFGTATAAYQIEGAANEDGRGPSIWDVFSHTPGKTLNGDTGDVACDHYHRYKEDIQLMKEIGLDAYRFSISWPRIMPDGKNINQKGVDFYNRLVDELLKNDIIPFVTLYHWDLPYALYEKGGWLNPDIALYFRAYATFMFNELGDRVKHWITLNEPWCSSFLGYYTGEHAPGHQNLQEAIIAAHNLLRAHGHAVQAFREEVKDGKVGLTNVVMKIEPGDAKPESFLVASLVDKFVNAWFHDPVVFGKYPEEAVALYTEKGLQVPDSDMNIISTPIDFFGVNYYTRTLVVFDMNNPLGFSYVQGDLPKTEMGWEIYPQGLFDMLVYLKERYKLPLYITENGMAGPDKLENGRVHDNYRIEYLEKHFEKALEAINAGVDLKGYFIWSLMDNFEWAYGYSKRFGIIYVDYNTQKRILKDSALWLKEFLKS

SEQ ID NO: 56950 - protein, 65 aa, Arachis hypogaea
DPELLVFIPFTSNVKIKSISIVGGADGTSPAKMRAFINRDGIDFSDAQSMQAIQVIGSLKGFQGI

SEQ ID NO: 56951 - protein, 719 aa, Elaeis guineensis
EIPYNIGFLQVATLSLQGNRLTGKIPEVIGLMQALAVLDLSENELVGTIPPILGNLSYTGKLYLHGNKLTGPIPPELGNMTKLSYLQLNDNKLVGTIPAELGKLEELFELNLANNNLEGPIPQNISLCTALNKFNVHGNRLNGSIPLQFQKLESLTYLNFSSNNFKGKVPWELGRIINLDTLDLSNNHFSGPIPDSIGDLEHLLELNLSRNNLNGPLPTEFGNLRSGQTIDISYNKLSGPIPEELGQVQTIDTLILNNNDLYGEIPVQLTNCFSLSSLNLSFNNFSGDVPLSKNFSRFPQESFLGNPMLCGNWLGSSCGQDLHGSKVTISRAAVVCITLGCITLLSMMLVAIYKSSQPKQFIKGSNRTVQGPPKLVVLRMDMAIHTYEDIMRITENLSEKYIIGYGASSTVYKCVLKNSKPIAIKRLYSQYPHNLHEFETELETIGSIRHRNLVSLHGYSLSPHGNLLFYDYMENGSLWDLLHGPSKKVKLDWDTRLKIAVGAAQGLAYLHHDCNPRIIHRDVKSSNILLDENFEAHLSDFGIAKCIPAAKTHASTYVLGTIGYIDPEYARTSRLNEKSDVYSFGIVLLELLTGKKAVDNDSNLHQLILSKADDNTVMEAVDFEVRSPAWIWGCQKAFQLAICAQRSDRPTMHEVARVLVSLLPVPSLKPGLVPQKPMDYAHYLAAGPDVKIKRTHDDNSSSDGQWFLRFGEVISKNTL

SEQ ID NO: 56952 - protein, 315 aa, Aspergillus oryzae
MAANYWASTQRRHWLFTKERLADIRESFRERDKAAHSQFPLPDQRLLNIYFSQQLIKLGKRMSTRQQALATAQVYIKRFYTKNEIRHTNPYLVVTTAFYLACKMEECPQHIRFVVAEARNFWPEFIAPDVSKLGECEFALISEMNSQLIVHHPYRTLSELQPELSLTSDEVALAWSVINDHYLTDLPLLYPPHVIAVMAIIVAVVFKPSQTSFHGTAAPLAGAMRDGGMNILAALGDKNGAGPPPRIQKLVGWLAESEVDIRAVIECTQELVSLYEIWENYSEKHCKELLGRMVKSKNLDKIGAVCFCVAFREFG

SEQ ID NO: 56953 - protein, 317 aa, Silicibacter pomeroyi DSS-3
MSEFTHIPTIALGTRPDAEIAAEFRAAYGSTGFGYVTDHGIDTTLTEALFEASRRFHALPLATKMAIAVDRSHRGYIPINSSTDVNSTLATVTKPNQSASFMMMREDAVADPDEYLSGPNRWPDLEGFRDTLERYSAAMSALGRRLMAIALDAAGVSDPSILSAFDRPTLWLRLLHYPPQPPASPDDLYGSAPHTDFGCLTLLAQDGVGGLQVRTPAGHWVDVPHRPGALVVNVGDMLHRMSNGRLRSTPHRVINTSGRERFSCPFFYDPHVSTVIEPLPGTGAPKYPPLVFGDFLRSELEAAYDAHKPACAAANSP

SEQ ID NO: 56954 - protein, 245 aa, Zea mays
MKEVVLHVYDVTNSDSEKTNNTILQINRIFKDRIGLGGIFHSAVQVYGEDEWSFGFCESGSGVFSCPIGKNPMYTYRERIVLGETECGIAAVNRILRELSREWPGHSYDLLSRNCNHFCDVLCERLGVPKLPGWVNRFANAGDTAVVVAENTAVKFRQAKTEIVNASRVAYRFMAGLTSKNQASPESPGNNQNRGSPSFQGAWFKNIVSAGAKPSSSGSTRTHFQDADDGTPLQHQSSTEQSTQL

SEQ ID NO: 56955 - protein, 352 aa, uncultured bacterium
IGAANNLLAAMIDNHIFQGNELGIDPKTIVWRRCVDMNDRQLRFVVDGLGGAKNGCPREDGYDITVASEVMAILCLSSSISDLKARLGKIIVGYKYDGSAVTAADLKAQGAMTAILKDALKPNLVQSLEGTPAFIHGGPFANIAHGCNSVLATRMALKCGDYVITEAGFGADLGAEKSMDIKRRTTGLRPSAVVVVATVRALKMHGGLKKDSLGSEDLDALEKGLPNLLRHVSVMTDVYKVPCVVAINRFPIDTEAELSLVAKRCKELGVNSVLSEVWAKGGQGGIALAEEVVRLCDIPSRVELTYEDEDSLETKIEKIVKRIYGGSSVSYAAGVKTKLKKLEAMGFSKCPV

SEQ ID NO: 56956 - protein, 352 aa, uncultured bacterium
VGAANNLLAALLDNHIQQGNQLRIDIKRITWKRAVDMNDRQLRHIVCGIGGRMQGVPREDGFEITVASEVMAILCLSSDIIELKERLAKIIVAYTYEGKPVTAGDLKAEGAMAALLKDALKPNLVQTLEGTPALIHGGPFANIAHGCNSVAATKMAQKLADYTVTEAGFAADLGAEKFMDIKCRMNGFKPDAVVVVATVRALKYHGGMSKDQLTEENLEALEAGLPNLLQHVNNIKHVFGLPCVVAINAFPSDTQAELDLVERRCNELNVNVALSEVWAKGGEGGMALAEEVVRLCDEPNNFRCAYELDISIEDKLKAICKKVYHADHVELDPNARKQAKELTELGFGELPI

SEQ ID NO: 56957 - protein, 474 aa, Ashbya gossypii ATCC 10895
MLGQICRVTARTGGAAKAHWAGAARARQFHSSWRRLQEIRDPYETLGVAKDASASQIKKAYYKLAKQFHPDINKDEGAEKKFHDLQNAYEILSDENKRRQYDQFGAAAFSQGGAGAGGAGGFQGGFGGFSGFGDFGEFGGLNFEDLFGAAFRGGARGAGRQGGAQFVREFKGDSIQVPFKLSFRDAVFGLKDVPLRYAVYDQCGTCSGSGLKAGAQRSVCGGCHGTGTQVHVRAGFQMASTCSQCSGEGYSIRRGDRCGTCSGEGVVFNRNKEVKMDFPHGLQDGDVVKVPGQGSFPHIQVDPKTAHTMRLRRGDLLVQVQVERDPRFQIKNNYDIWYVQEIPITTAALGGTVSIPTVDGDQIRLKVIPGTQPDQVVSIPNKGVPRGLSGARGDMKVQYRIVMKKPQSKAEKFLWEALADVTGDKTARRTENIDAAMAGTAAPGVASSPDEPSTLRKLEKFISNAFKTIRGDQH

SEQ ID NO: 56958 - protein, 343 aa, uncultured bacterium
ANNLLAAALDNHLQQGNELGIDPKRIIWKRCLDMNDRALRNIVIGMGKRVDGVVREDHFIITVATEVMAILCLAEDIFDLQERLSKILVAYTYEGKPVTAADLKCVGAMTVLLKDAIRPNLIQTLEHTPAIVHGGPFANIAHGCNSVRATKTALRSADYVVTEAGFGADLGAEKFLDIKCRMAGLKPDATVLVATVRALKYNGGIPKDQLSEENLEALEKGICNLGKHIENLQKFGLPLVVTLNRFVSDTDAEIEFIRKYCEARGCKLTVSEVWAKGGEGGAELAAEVLNLLENVESKYHPIYDTALPITEKIETIATEIYGAKNVEYSAEAKKAIADISALG

SEQ ID NO: 56959 - protein, 343 aa, uncultured bacterium
ITSANNLLAAALDNHLQQGNELGIDPKRIIWKRCLDMNDRALRNIVIGMGKRVDGVVREDHFIITVATEVMAILCLAEDIFDLQERLSKILVAYTYEGKPVTAADLKCVGAMTVLLKDAIRPNLIQTLEHTPAIVHGGPFANIAHGCNSVRATKTALRSADYVVTEAGFGADLGAEKFLDIKCRMAGLKPDATVLVATVRALKYNGGIPKDQLSEENLEALEKGICNLGKHIENLQKFGLPLVVTLNRFVSDTDAEIEFIRKYCEARGCKLTVSEVWAKGGEGGAELAAEVLNLLENVESKYHPIYDTALPITEKIETIATEIYGAKNVEYSAEAKKAIADIS

SEQ ID NO: 56960 - protein, 336 aa, uncultured bacterium
ICNNLLCAMLDNHLLQGNELRIDPKRVVIKRCLDMNDRALRNITVGLGKRLDGVVREDHFCITVATEVMAILCLAENLEDLKARLGKIIVAYNYDNEPVTAEQLKAVGAMTVLLKDAIRPNLIQSLENNPVFVHGGPFANIAHGCNSVRATKLALKAADLVITEAGFGADLGAEKFLGIKCRMAGIKPDAVVLVATARAMKYNGGIPKDELNKENVEALKKGIVNLGKHIENLKKYNVPVVVTINKFVADTDAEVAAIREFVEDKGCRFAISEVWEKGGEGGIELAKQVLDAVEEGSPNFKFLYEDSLSLKEKIETISKEIYGADGVEYSPEANNV

SEQ ID NO: 56961 - protein, 238 aa, Cryptococcus neoformans var. neoformans JEC21
MSTSWDNARRHARALETALDSKLSTYSKLAASIARGSSLGGSSSRDELSMEEEGIGGYKLVEEEIEELLSKLEQAIEDLTSLINSPSQPPSTSMQHSAQTHRDNLDDYRRDFVRTRNNVEQTIRRSNLLGSVRKDISDYKSGRSGTTDALLQDRSRIDSSHRMIDDTLNQAYATREDFAQQRTFLASIDSRMGGVLNQMPGINSLITMIRTRRRRDTVIMGCVIGLCVVLLLGYMFGF

SEQ ID NO: 56962 - protein, 462 aa, Arabidopsis thaliana
MDLLRNIPDELICHILSFLTTKEAALTSVLSKRWRNLLAFVSNLHIDDSIFLHPEEGKRDRNEIRQSFLDFVGRILALQGNCPVKKVSIKFLFKLDSDRVDGWISNVLARGVSELDLSIDLCMDEYFLLSSKRFESKNLVRLKLHRLCIGQREKTVGWLAGEIFLPMLKTLELDYVGFYGDLLFLRALPALEELVIVDAFWFTTFTDVTVSNPSLKTLTMSSNIYSGSISFDTPSLVYFSHFKYVAKDYPLVNMENLLEARINLGVTEGQIRRAREPNNNDEVVLRFPNVGKLMNGIRNVQCLDLSANTLEMLSLSCESMPVFKNLKSLSIKSAENRGWQAMPVLLRNCPHLETLVLEGLLHFVTDKCGDACDCVSREEKGRSLTSCPVKTLEIKEFHGTMEEMYMITHFLDYFPCLKELKIYIEGNDHAQREVSEVIAEKIKLYNKSSSSNVQLMVSGYHE

SEQ ID NO: 56963 - protein, 183 aa, Arachis hypogaea
MATRRYAFGRVDEATHPDSMRATLAEFASTFIFVFAGEGTGLALDRIYKDEAFSAGELLSLALAHAFALFAAVSASMHVSGGHVNPAVTFGALIGGRISVVRAIYYWVAQLLGSIVASLLLRLVTNNMRPGGFHVTSGLGAGHGLILEIVMTFGLMYIVYATAIDPKRGSIGAIAPLAIGLML

SEQ ID NO: 56964 - protein, 250 aa, Yarrowia lipolytica CLIB122
MSVVEITSDSHFSELTSSLAPTTLVAVYFHTPWAAPCAQMNSVFKSLSTLHSSVLFLSVNADELPEISESFDISAVPYFVMLRDGTILKELSGADPKELAATISALSESDAKPAESESAAAAAPTSSTADAPASSSTDAPEPAEETEEELNARLAKLVKAAPVMLFMKGTPAAPQCGFSRQLVAILREHHVRFGFFDILKDDAVRQGLKKFSDWPTFPQLYIGGELQGGLDIVKESIQEDPEFFEKAVAE

SEQ ID NO: 56965 - protein, 425 aa, Silicibacter sp. TM1040
MLNAEISIRRNAAISRGVGMQTQVYVSRAEGAEVWDVEGHRYIDFAAGIAVVNTGHCHPKVMEAVRSQSAAFTHTCHQVLPYESYIRLAERLNDKVPGNFDKKTAFVTTGAEAVENAIKIARAATGRSAILAFGGGFHGRTFMGMSLTGKVAPYKKGFGAMMPDVYHVPFPVDLHGISTADALGAIDRLFKADLDPDRLAAIILEPVQGEGGFYPAPKELMHALRELCDAHGILLIADEIQTGFARTGHLFAMEGYDVAPDLTTMAKGLAGGLPLAAVTGRAEVMDAAAPGGLGGTYGGNPLGIAAAHAVLDVIEEEDLCTRANALGARLKQRLSAIQERVPEIADIRGPGFMVAAEFNTTDGSAPNPEMANAIRTEALERGLVLLTCGVYGNVIRFLAPITIPDAVFSEALEILEASILAAKDA

SEQ ID NO: 56966 - protein, 172 aa, Lotus japonicus
AACKFLKRRCIPNCIFAPYFRSDECKKFAKVHKVFGASNVSKILVEVPEEQREDTVNSLAYEAEARLKDPVYGCIGAIAMLQRKMVELQHDLAIAKDRLAHAAATAAATTTATTTTTTAFSGDILNSHVSLPPFPEFSTCCDFNDNFSHNSSSQSWRTHETVDDFVQIPYIF

SEQ ID NO: 56967 - protein, 489 aa, Silicibacter sp. TM1040
MSTPTSLSLRDPSLLETRAYVNGQWINGATTFDVIDPATGRLVAEVADLDVAAAAKAVDAAHAAGPSWAALAGKERSSILRRWHDLLVENADDLATILTAEMGKPWAEARGEILYGASFIEWFAEEAKRIYGDVIPGPQRDKRIMVLKQPIGVVGSITPWNFPNAMIARKVGPALAAGCTFVARPAELTPLSALAMAVLAERAGIPAGVFNVIPSNDAPGVGRELCTNPKVRKITFTGSTRVGRILMEQASGTIKKMSLELGGNAPFIVFDDADLDAAVEGAMIAKFRNNGQTCVCANRIYVQASVYDAFAEKLAGEVKSLQVGNGFDDATTAGPLINEAALRKVEAHISDAVGKGARIVTGGHRSDLGGTFFEPTVLRDVNPHMVVCHEETFGPLAALVRFDSEEEVIALANDSEFGLAAYFYARDLSRVWRVAESLESGMVGANTGLISTEVAPFGGIKQSGLGREGSKYGIDDFVELKNICLGGMS

SEQ ID NO: 56968 - protein, 349 aa, Sauromatum guttatum
MISSRLAGTALCRQLSHVPVPQYLPALRPTADTASSLLHRCSAAAPAQRAGLWPPSWFSPPRHASTLSARAQDGGKEKAAGTAGKVPPGEDGGAEKEAVVSYWAVPPSKVSKEDGSEWRWTCFRPWETYQADLSIDLHKHHVPTTILDKLALRTVKALRWPTDIFFQRRYACRAMMLETVAAVPGMVGGVLLHLKSLRRFEHSGGWIRALLEEAENERMHLMTFMEVAQPRWYERALVLAVQGVFFNAYFLGYLLSPKFAHRVVGYLEEEAIHSYTEFLKDIDNGAIQDCPAPAIALDYWRLPQGSTLRDVVTVVRADEAHHRDVNHFASDVHYQDLELKTTPAPLGYH

SEQ ID NO: 56969 - protein, 496 aa, Ashbya gossypii ATCC 10895
MLRNVCRPAMRRSFHQTAWMSANKKHDVVVIGGGPGGYVAAIKAAQLGFDTACVEKRGRLGGTCLNVGCIPSKALLNNSHLLHQMQHDAKQRGIDVKGEVTVNMPQFQKAKDTVVKQLTGGIEMLFKKNGVTYYKGLGTFESESSIKVSPVEGLEGAVAEETILEAKNIIVATGSEVTPFPGITIDEERIVSSTGALSLKEVPKRLVVIGGGIIGLEMGSVYSRLGSKVTVIEFQPQIGATMDGEVASTTQKFLKKQGFDFHLWTKVLSAERNGYVVDIKAENVKTGKVESFQADVLLVAIGRRPYIEGLGAENIGLDVDKRGRLVIDEQFNTKFPHIKVIGDVTFGPMLAHKAEEEGIAAAEYIKHGHGHVNYGNIPSVMYSHPEVAWVGKTEEQLKEAGIAYKVGKFPFMANSRAKTNLDTEGFVKVLIDAETERLLGAHIIGPNAGEMIAEAGLALEYGASAEDIARTCHAHPTLSEAFKEANLAAFSKSINF

SEQ ID NO: 56970 - protein, 120 aa, Triticum aestivum
MPVPLAPYPTPPAPYTPPANGVQSQLVCSGCRNLLVFPVGATSVCCAVCNAVTAVPPPGTEMAQLVCGGCHTLLMYIRGATSVQCLCCHPGQSALGNNQVAHVQLGELRGATGVTNLEQE

SEQ ID NO: 56971 - protein, 697 aa, Coccidioides immitis RS
MAGCSYARSLAASLRSSQSIIFAANSLRSPPQNFSIRGCFRAPKASLHLTSRSRLQNLSLLGLQPIKCEKHIHTQQFQPFVPPPPSSLGKPTAAKTYRRTRKWLRRLFYLSLSVGTIYAIDSYFYASCLTRTARTFALGILVALDYKLNFRPNPPLASSIAAVHARNAERLSELLRTNGGLYLKIGQAIAMQSAILPPEFQKMFSRMFDDAPQNDWKDVARVIEEDFGKPAEEVFGVSFSGDPSRGVMERTARASASVAQVHWAKLSDGREVAIKIQKKEIATQVKWDLWAFKIITWVYSRVFDIPFYSLVPFVSERLFLETDFENEADNAERMAKLVAAEPRLRNRVYIPKVYRELSSKRVMTAEWIEGVRLWDKDSITRPWRGGWRQGSPGCHGTPLDLPGAKLTPRRPSYSTSTPERLKPGREYWKGRARRGGLGLSLNEVMTTMVDLFSAQMFLWGWLHCDPHPGNWFVRRQPNGKAELVLIDHGLYVHMEPNFRHQYARLWKALLTFDNNSITKIVNDWGVNNADLFASATLLRPYQGGERTTSKALEGLSKKDRAKLQYEMQQAMRKAVREILGDETRWPRELIFISRNMRIVQANNQFLGSPVNRIKITGTWASRALVESADLPLLEKIKNYGRHIVFRFVLLSSDILFYWYRIRQMLGWGGGMEDEIEAQMQHMARDMGVELSQPIFEG

SEQ ID NO: 56972 - protein, 351 aa, uncultured bacterium
ITVANNLLAALIDNHIHQGNKLRIDTRQILWKRCMDVNDRSLRNIVVGLGAKGDGFVREDHFVITVASEIMAIFCLASDMKDLKKRLSEIIVAYNLDGEPVTAGELNAVGAMAALLKDAIKPNMIQTLEHTPAIVHGGPFANIAHGCNSIIATKTAMRLADYTVTEAGFGADLGAEKFLDIKCRKAGLKPDAVVIVATIRALKYNGGVAKADLTNENIEALKNGSCNLIKHVENIKSYGLPVCVTINKFVSDTDAEVECLKEILGKLDVPFSVSEVWAKGGEGALDLAKDVMKLADSENNFHYLYPDDMGIKEKIETLATKIYGAGNVEFAPAALKQIAKIEELGFKECPV

SEQ ID NO: 56973 - protein, 352 aa, uncultured bacterium
ITSANNLLAAVLDNHLQQGNALNIDPKRIIMKRCLDMNDRALRNIVIGMGKRMDGVVREDHFIITVASEVMAILCLAEDLQDLKARLSRMIVAYTRDGKAVTPADLKCVGAMTVLLKDAIRPNLIQTLEHTPAFVHGGPFANIAHGCNSVRATRTALRSADYVVTEAGFGADLGAEKFLDIKCRMAGLKPDAVVLVATVRALKYNGGVEKAALSEENLDALKKGIVNLGKHIENLKKFGFTPIITLNRFVSDTEAEIEYVRSFCHEQGCELTVSEVWAKGGEGGIPLAEAVLRQLENNSNDYHPIYDTSLSLKEKIETISREIYGAAAVEYTAEAAKALETAEKEGFGGLPV

SEQ ID NO: 56974 - protein, 464 aa, Agrobacterium tumefaciens str. C58
MTMTAYDYDLFVIGGGSGGVRSGRVAASLGKRVGIAEEYRYGGTCVIRGCVPKKLFVYASQFPEYFEDAEGFGWSVGERRFDWKKLIAAKDKEITRLEGLYRKGLENAKADIFDSRAELVDAHTVKLTKTGETYTAERIVIAVGGTPNEHKALPGHELTISSNEAFDLEEPPKSILIAGGGYIAVEFANIFHGLGVETTLIYRGKEILSRFDHDMRKGLHEAMEAKGIRIILEDIIEEVSKDGAGGFVARTKQGSSLHVGLVMLALGRDPNTKGLGLENAGVKVDARGAIIVDDYSRTNVPSIFALGDVTDRVQLTPVAIHEAMCFIETEYKNNPTKPDHELIATAVFSQPEIGTVGLSEEEAGKKYRELEVYRAQFRPMKATLSGRQEKTIMKLIVNASDRRVVGVHILGHEAGEMAQLLGITLKAGCTKDDFDRTMAVHPTAAEELVTMYAPSYRVVNGERV

SEQ ID NO: 56975 - protein, 357 aa, uncultured bacterium
VTSAHNTISALLDNYLYQHRKDGFSLREIFWKRVLDVNDRSLRNVVTGLRGDGVVSETGFEITPASELMAILCLATSEKDLQRRIENIVLGITSDGKPFRVRDLGVAGAITVLLRDALNPNLVQTTEHTPAFIHGGPFANIAHGCSSVLATKMAMTFCDYVVTEAGFGADLGAEKFFDIKCRKTGLKPRLVVIVATTQGLKMHGGVSLEHIMEPNADGLTEGLKNLNRHIRNMQGFGQPVIVTLNRHDTDIDEEIDIVRKNCEDLEVGFAVNEAFLKGGEGATELAQTVIDTIERQQPLPIHFTYKEADCLEDKIEKVCKRIYGASDVEYSKTAKKKLEALRAIFTDDDGAIAHYPV

SEQ ID NO: 56976 - protein, 231 aa, Agrobacterium tumefaciens str. C58
MDARQMKIKAAEAALSHVQDGMRLGIGTGSTAEEFVRLLAEKVAAGLKVEGVPTSERTARLCVELGVPLKSLDELPELDLTIDGADEVDHVLRLVKGGGGALLREKIVAAASGRMIVIADQSKVVETLGAFPLPIEINPFGQVATRIAIEKLAARSGLSGELTMRSSGDGAFMTDGGHLILDASFGRIPDAEALARELNTIPGVVEHGLFINLASLAIIAGPEGARMMQAV

SEQ ID NO: 56977 - protein, 416 aa, Triticum aestivum
  misc_feature (111)..(111): Xaa can be any naturally occurring amino acid
  misc_feature (210)..(210): Xaa can be any naturally occurring amino acid
  misc_feature (285)..(285): Xaa can be any naturally occurring amino acid
  misc_feature (299)..(299): Xaa can be any naturally occurring amino acid
  misc_feature (359)..(359): Xaa can be any naturally occurring amino acid
  unsure (1)..(416): unsure at all Xaa locations
NKFVQKSRLVPVRNSRDIVDPRVRLIVKGASERGAKRIRLHILTDGRDVLDGSSVGFVETIEKDLAQLREQGVDARIASGGGRMYVTMDRYENDWSVVKRGWDAQVLGEAXYKFPNALEAVKTLRAEPKANDQYLPPFVIVDESGKSVGPIVDGDAVVTFNFRADRMVMLAKALEFPDFDKFDRVRVPKIKYAGMLQYDGELKLPASTWXSPPLIERTSGEYLVRNGVRTFACSETVYLGLFPFFWNGNRFGIILTRPGKSFLKFPRERGFIFNEPPKMNGFEIXRKIRNSFLVGNLDXVRIYLSNGGLVWVPLVIFNPTFVVCKAADEAVKMVLDAVEQVGGIYLVTADHGNAEDMVXRNKAGEPMLDKSGSIQILTSHTLQPVPVAIGGPGLHPGVRFRSDIPRPPARAAARNH

SEQ ID NO: 56978 - protein, 352 aa, uncultured bacterium
ITSANNLLAAMLDNHIQQGNQLGIDPRQIVWKRCLDMNDRALRNIVVGLGAKADGMVREDHFVITVASEIMAILCLANDMHDLKERLGRIIVAYSFEGKPVTADDLQATGAMAALLKDAMKPNLIQTLEHTPAIVHGGPFANIAHGCNSVRATKACLKLADITITEAGFGADLGAEKFFDIKCRMAGLKPDAVVLVATVRALKYNGGVPKTELTTENLDALKKGIVNLEKHIENLQKYKVPVVVTLNSFVTDSDAETNYVREFCESRGCEFALSKVWEHGGEGGVELAKKVLQVLETKESDFEPLYEDSLSLKDKIYKVATEIYGAKDVAYSAAAERELKRITELGMGDFPV

SEQ ID NO: 56979 - protein, 493 aa, Xanthomonas axonopodis pv. citri str. 306
MNALTSATAAATDTPAWHGCIFNGDWVPGRGGSLPIHEPATGALLHEVGKADLSDLAAAIAQAKQAQRAWSATPPRERAAVFHRAAQAMQARSAEAALLIARETGGILPKAQREVDESVVFYQQAAAMPLQASGQMLPTSAGQLSLARRLPLGVIGVISPFNFPLILSLRSVAPALAMGNAVILKPDPRTPYTGGVIIAQVLEQAGLPKGLLHVLHGDAQLGQALVESPDVPMIAFTGSTAAGRCIGEIAGRHLKKVSLELGGNNAVIVLDDADLDKAASAVAFGAYMHQGQICMATGRVLVHRSVAQALTQQLAEKARHLPVGDPVSGTVALGPIIDQRQLQRVVDIVNDSVAAGAVVEAGATHEGLFYAPTVLSNVRPGMRAFDEEVFGPVINITVFDTDDEAAELANQGEYGLAAGILSASVSRALALGEKLHTGLLHINDQTVADEVVNPFGGTGASGNGTSVGGPADWEQYTHWQWLTIKNEVPQYPF

SEQ ID NO: 56980 - protein, 507 aa, Methanococcus maripaludis S2
MKDIKCFQKTGNILKFEELRAKLKINDKNDVSPLEIKVIDENSEQYGISKETLMENAGRAVYEEIVNLNVDFSKTYLFCGTGNNGGDGFVIARHLANNFATFVVLIGNERKIKTSETQRNFNTVKNMEFFGNLDYANILDDERAVELLKTIEKELENKQNDHILIIDAMLGTGITGILKNPYSTIVDYLNVLKSKYSKKLKMVSVDIQTGNLNADLEVILHKRKFENKNKNFVVKDIGIPKYIENMVGKGDFYLLNERKQNSHKGQNGNVLVIGGSKEYHGAPVFSALAASKFADIVTVASVSNVMNTVSNYPELMPYELTGDYIVQNHVDELLELSKNYDCVVLGSGISVNSDTKEFVNSYLNETNGKVVIDADAIKLIDYSNFKFKNNFIFTPHKKEFEYIENYIESSGFKSTVVLKGSLDIIFNSNNIKMNITGNQGMTVGGTGDILCGIIGAIYACNDAFPSACCGTYINGYCGDLLEKEYGYYYNSTDIIKILPKALKELLY

SEQ ID NO: 56981 - protein, 353 aa, uncultured bacterium
IGAANNLLAAMLDNHIQQGNALGIDIKKITWKRCVDMNDRQLRFVVDGLGGRANGTPREDGFDITVASEIMAVFCLATSMADLKERLSRIIVAYTYVDQPVTAGDLKATGAMAALLRDALKPNLVQTLEGTPAFVHGGPFANIAHGCNSVMATRMAMRMGDYTVTEAGFGADLGAEKFLDIKCRMAGLVPDAVVVVGTVRALKMHGGLDKKQLANEDLAALEKGIPNLLRHVHNITNVYHLPCVVAINRFPADTDAEIDFIVRKCRELGVNTILSTVWAEGGKGGEDLACEVVRLCEEEKGSFTFSYELDASIEEKLEAVTKKIYGGAGVALTPAARKQAERLTQLGFDKLPV

SEQ ID NO: 56982 - protein, 153 aa, Streptococcus pyogenes
PMAYVLWNHFMNINPKTSRNWSNRDRFILSAGHGSAMLYSLLHLAGYDLSVEDLKNFRQWGSKTPGHPEVNHTDGVEATTGPLGQGIANAVGMAMAEAHLAAKFNKPGFDIVDHYTFALNGDGDLMEGVSQEAASMAGHLKLGKLVLLYDSND

SEQ ID NO: 56983 - protein, 575 aa, Phaeomoniella chlamydospora
MGVQHDGIAGRQPIQDMLTPDEQYCIVEEPLGHARPVRIVTIGAGASGINVARNVKEHMKNVEFQMYEKNSEIGGTWTENRYPGCGCDIPSHNYQYSWAPNPRWNQYYSSQGEILTYFQDAAEKSGLIQFIKFQHKVVEAVWNESRGVWQFKIENLATGETFQDYAHFFINASGYLNNWKWPDIAGLQDFQGDLMHSASWKPGTELYDKSVAVIGCGSSGIQLVANIQPMVKHLTTFIRQPTWVTAGFGSKYAAPGGTNFNFTEEQKREFEENPKSYLEYRKAVEHELNCRFKMLHKDTPEQAAAMEFATNEMIKRLGGPNELSDFIIPKFSVGCRRPTPGQGYLEALVAPNVSVITGTEISHATSNGLVLSDGQIINVDVIICATGFDLSFRPRFPIIGRDEVSLAESWSERPTAYLSMTPADMPNYFMFLGPNAPVGHGSAIPIIEHLTKYMLKMIYKAQTEGYKSFVPLQDAIDEFVEHADTFLERMAWASKCRSWFKNGKETGPVTALHPGSRIHWFHLLGNIRHEDWEWKTVQRNRWAFLGNGFSVREGGGRDLTWYFDQPEEGYEGLIY

SEQ ID NO: 56984 - protein, 601 aa, Flavobacteria bacterium BBFL7
MKDIRNIAIIAHVDHGKTTLVDKILHHCEIFRENETTGELILDNNDIERERGITILAKNVSVMYKGTKINIIDTPGHADFGGEVERVLNMADGVLLLVDAFEGPMPQTRFVLQKAIDLGLKPCVVVNKVDKENCTPDEVHESVFDLMFELGAEEWQLDFPTVYGSAKNNWMSDDWQNETTNIEPLLDMVIEHVPAPKVEEGTTQLLITSLDFSNYTGRIAIGRIKRGSIKEGQNVTLCKRDGSMTKTKVKEVYVFDGMGKAKAQEVMAGDICAIVGLEGFEIGDSVADFENPEAMETIAIDEPTMSMLFTINDSPFFGKDGKFVTSRHINDRLTKELEKNLALQVHDTGSADKFMVFGRGVLHLSVLIETMRREGYELQIGQPQVIIKEIDGVKCEPIEELTIDLPETVSGKAVEMVTLRKGEMTSMAPKGERMVCEFKIPSRGIIGLRNQLITATAGEAIMNHRFVGFEPYKGEIAGRINGSMISMETGTSIPYSMDKLQDRGKFFIHPGEEIYGGQVVGENSRPDDLAINLTKTKKLSNVRSAGNDDKVKIAPPIKFTLEEALEYIQKDEYVEVTPNYLRIRKIYLDENERKRKAKELS

SEQ ID NO: 56985 - protein, 188 aa, Triticum aestivum
VTLQNKVVQKSRLPPVRNSRDIVDPRVRSPTMAGSRPGGLVAGAWAAMMSLGLNGYLESTGKIMEVSRKIQKGIDDISGLFVIGKPDMTVVAFGSDAVDIFEVNDIMSSKGWHLNALQRPNSLHICVTLQHTAIYEEFLKDLEDSVNTVKANPGPISGGMAPIYGAAGKMPDRGTVKELLVEFMDSSC

SEQ ID NO: 56986 - protein, 204 aa, Oryza sativa
TRREGHRGRSGSHGRPQFLVFSSHPNMPSAGSVSSSSVQGEVDNESSPVHTTGELSLHANTHEEAGNQSPGMLTYDADQDAVVSSGNSTPVSSPRFFNRRHSTGQSTPVNNDRAGPSDLQSFSDSLKSRLNAVSMKYKESITKSTRGWKERLFSRHSSVADLGSEVRREVNAGIASVSRMMERLATLLRLLPLVLQQPDQISML

SEQ ID NO: 56987 - protein, 153 aa, Streptococcus pyogenes
SMAYVLWNHFMNINPKTSRNWSNRDRFILSAGHGSAMLYSLLHLAGYDLSVEDLKNFRQWGSKTPGHPEVNHTDGVEATTGPLGQGIANAVGMAMAEAHLAAKFNKPGFDIVDHYTFALNGDGDLMEGVSQEAASMAGHLKLGKLVLLYDSND

SEQ ID NO: 56988 - protein, 180 aa, Lotus japonicus
QAACKFLRRKCMPGCIFAPYFPPEEPQKFANVHKIFGASNVTKLLNELLPHQREDAVNSLAYEAEARVRDPVYGCVGAISYLQRQVQRLQKELDSANADLLRFAYNELPQVTLPPVPPTITTIQQMVPSQRQYGGRFGNFEGTGFYRQSATTFSFPYALPWTDISSGGEGGIGGEGGGNL

SEQ ID NO: 56989 - protein, 167 aa, Lotus japonicus
HKVFGASNASKLLMKIPAHKRLDAVVTLCYEALARVRDPVYGCVGHIFFLQQQVMNLQAELTYVQARLATMQPLPIPVAPSLQNPQSSSPTSFHSSSDHSATNVDLQSASNMYMHFDPLQPHSTSLELSNFFNTSDQQLEDGELQALAREFVSRYLPGVRFQPSDSH

SEQ ID NO: 56990 - protein, 537 aa, Oryza sativa (indica cultivar-group)
MAVSLLVVLLVVLAIVVPLLYLVLLPAGNTTRNGAARWEDDGGDGRRRRRLPPSPRGLPLLGHLHLLGALPHRALRSLAAAHGPVLLLRLGRVPVVVVSSAAAAEEVMRSRDVEFASRPRMAMAELLLYGGRDVAFAPYGEYWRQAPRICVVHLLSARRILSFRRVREEEAAALVGRVRAAAADVVDLSDLLIAYSNTVLTRIAFGDESARGGGGGDRGRELRKVFDDFARLLGTEPMGELLPWFWWVDALRGIDGKVQRTFEALDGILERVIDDHRRRREGGRLMDDDGGGDHRDFVDVLLDVNETDKDAGIQLGTVEIKAIIMDMFVGGSDTTTTMIAWTMAELINHPRAMHKAQNEIRAVVGNTSHVTKDHVDKLPYLKAVFKETLRLHPPLPLLIPREPLADAQILGYTIPAHTRVVINAWAIGRDPAAWGQQPDEFSPEKFLNGAIDYKGQDFELLPFGAGRRGCPGIVFGVSAMEIALASLLYHFDWEAAATDHRRRGSQAWALPVDMSEVNGIAVHLKYGLHVVAKPRMP

SEQ ID NO: 56991 - protein, 1527 aa, Aspergillus oryzae
MAPVSTAGEAVARVAYLTSDIVVSVQPSLQTDSWFSKPLKALKQEKARSILPKGVPDVVSVRYNEDPLLSAFHPLQTGDVVSVVSSSSVLLSSIPHLYRLANFPIVIHVALEPSPFPDYSVISSIRQCGFAFLHSETVQEAQDISITAHALARKSGKGVIHFFDPANSARDEPIAEEDVNVIQSVLNLGGHHATHSTGLGAQTLYTDSGRVATVTDEVVENTKTPEGAATPAQPSQTPSSVSVDNSSVGSSRRDSSVDSRATSSAATTVDASSVRAVSAADIFEWTSQIWRTLSVLVGRNYSAVEYTGPSDAKSALFIFGSTGVFVDALSKEDTASELKNIGLITARLYRPWVGGQIVNSIPASVEKIAVLEQVRKTTRWGPSFMDLLSSLTPTTAGGRAPQIVGYRLGYVEPSTAIQALRGIAQNLDTPSPIQNLEVGSSKVPTLETALEQPHLENAYLKILNQLFGERLHIANQLDSKHAGVSSTIAASPEYGFGSLIARMEHRRRFVREVEEASKAGTFATDAPKTSLSNWALSAGDAAKANRLAPDVIDHLSKDDSPLAKQLLESKKLFFDESRWLVGSDAWAYDLGNSGVHHVLASGANVNMLVIDSQPYSERTAADPTRRKKDIGLYAMNYGNAYVASVAVYGSYTQVLQAMAEAEQFKGPSVVVAYLPYNQEDDSALTVLQETKKAIDLGYWPLYRWNPGNEENNEPKFSLDSERIKRELEEFLRRDNQLSQLMNRHPKFSSVLSESYGTEVRALQKRKAKDSYEKLLEGLFGAPLTILFASDNGNAQNLAKRLGNRGRARGLKTMVMAMDDYPAEDLSTEENVVFITSTAGQGEFPVNGRGLWEFVKNSGDLDLSTINYSVFGLGDSHYWPRKEDKIYYNKPAKDLDARVAFLGGRKLTDIGLGDDQDPDAYQTGYSEWEPRLWQSLGVDKVEGLPEEPAPLTNEDIKIQSNYLRGTIAEGLLDESTGAISASDQQLTKFHGTYMQDDRDVRDERKAQGLEPAYSFMIRCRLAGGVATPTQWLQMDAISSSHGNETMKLTTRQTFQFHGVIKRNLRGAMRAINKALMTTIAACGDVNRNVMCSSLPELSFFHREAHTVAQKISDHLLPSTTAYHEIWLKDDDDKKIQVAGDAVVDHEPLYGPTYLPRKFKITIAIPPHNDTDVYAHDIGLIAIKGSDGHLEGFNILAGGGMGSTHNNKKTYPQTGRMFGYVPADQAHIVCEKIMLVQRDHGDRQNRKHARLKYTIDDMGVEVFKEKVEALLPDGLRFAEPRPFKFASNVDTFGWLKDEKGLNHFTFFIENGRIEDTADFQMRTGLRELAKLDKGEFRLTGNQHLILSSVKDEDLPAIKELMAKYKLDNTSFSGMRLSSSACVAFPTCGLAMAESERYLPVLISKLESTLEEVGLARDSIVMRMTGCPNGCARPWLAEAAFVGKAYGAYNMYLGGGYHGQRLNKLYRSSIKEDEILDIMKGLLKRYALERNTDGEEPERFGDWCIRAGVIKETTDGRNFHEGVAEDEDDE

SEQ ID NO: 56992 - protein, 1035 aa, Arabidopsis thaliana
MSLTERLYNHLSLFDLLLSLLGLFVFCCLREKLTNKRGPMLWPVFGITLEFFFHINDVYGWVTRSLKKCRGTFLYRGVWLDGSYGAVTCVPANVEYMLKTNFKNFPKGTFFKSRFNDLLEEGIFNADDDSWKEQRRIIITEMHSTGFVEHSFQTTQHLVRKKLLKVMESFAKSQEAFDLQDVFLRLTFDIICLAGLGADPETLAVDLPQVPFAKAFEEATESTLFRFMIPPFIWKPMRFLDTGYEKGLRIAVGVVHGFVDKMIVDRICELKEEETLDNRSDVLSRIIQIESHKRENEIDPSTIRFFRQFCTSFILAGRDTSSVALSWFCWVIQKHPEVENKIICEIREILRQRGDSPTSKNESLFTVKELNNMVYLQAALSETLRLFPPIPMEMKQAIEDDVLPDGTFVRKGSRVYFSIYAMGRMESIWGKDCEIFRPERWIQAGKFVSDDQFKYVVFNAGPRLCIGKTFAYLQMKMIAASVLLRYSIKVVQDHVIAPRVTTNLYMKYGLKVTITPRSLEEKKLESCNFFDMFSRLKKCFHPIYAVAAQTDTPWLVSVMRAEEKPIFLALLYLKSPPLEISSVRNSQTESYLTSPIWQSIGSDARVHSVTKKLGPTIWPVFGITPEFFFHRNDVYGWATRCLKKCRGTFLYNGIWLGGSYGAVTCVPANVEYMLKTNFKNFPKGAFFKERFNDLLEDGIFNADAESWKEQRRIIITEMHSTRFVEHSFQTTQDLVRKKLLKVMESFARSQEAFDLQDVLLRLTFDNICIAGLGDDPGTLDSDLPLVPFAQAFEEATESTMFRFMIPPFIWKPLKFFDIGYEKGLRKAVDVSMSLSTRWLWIKHPEVENKIIREISEILRQRGDSPTSKNESLFTVKELNDMVYLQAALSETMRLYPPIPMEMKQAIEDDVFPDGTFIRKGSRVYFATYAMGRMESIWGKDCESFKPERWIQSGNFVNDDQFKYVVFNAGPRLCLGKTFAYLQMKTIAASVLSRYSIKVAKDHVVVPRVTTTLYMRHGLKVTISSKSLEEKIHVQD

SEQ ID NO: 56993 - protein, 531 aa, Arabidopsis thaliana
MLCTGSNASTIIQEQKHQQDSASADHRSTLLGLETELKKDSRSLLFSCCCLALAWAAALPRASAAARSALTLASAFTLSLASTAAFSVFSLASAYAPALLCFCETFGSLKGYEVENHMNASVTMLEEAIMYSSFSSKKRIRHSSSLTNDLIEEILSRLHSKSVARFRCVSKQCASMFASPYFKKLFQTRSSAKPSLLFAIADYGIEEDYSMKFFSSPQLENTYEKTSSTLVAAAEFHVKFSPDKSIPIYLSEDPRYVSIGYASGLIYNYCGRYVGRPLICNPNTGRYAILPYRYTYRKAYSFFGFDPIDKQYKALSLPYVDGPGRSKVLTFGAGDLTWRNIKSHTEDISYRYYEYVIVCFDVTSEKFTFVGVQKFCLLINYKGKLDVIYWEDDVDIHEICYFAKDLDEYLDENLDADATNELHVWVLEDVEKQEWSKYAYTWTDDTFFHRHLSIAGATASGEIVFSMRKYTSKQPFYVFYFNPERNTLQRVEIQGFGEAFRTTCSVRTFVNHIEDLDVNDLEQLNYIGTRR

SEQ ID NO: 56994 - protein, 209 aa, Aspergillus oryzae
MASTSAVGSYSNPLKKFKLVFLGEQSVGKTSLITRFMYDSFDNTYQATIGIDFLSKTMYLEDRTVRLQLWDTAGQERFRSLIPSYIRDSSVAVVVYDISNAKSFQNTRKWIDDVRGERGNDVIIVLVGNKTDLNDKREVTTAQGEEEAKKNGLMFIETSAKVGHNVKQLFRRIAQALPGMEGEGSRGESQVIDVNINPKETTTNDGCAC

SEQ ID NO: 56995 - protein, 113 aa, Synechococcus sp. WH 7805
MRFVASLVLALLIGLMSPLSANATDAVRGGQIFTTNCAACHAGGGNIIKAERTLREADLKAHLPNYLGAHESAIVAQVTYGRNAMPAFVDVLSESEIADVAAYVEEQSSQGWS

SEQ ID NO: 56996 - protein, 374 aa, Vibrio parahaemolyticus RIMD 2210633
MNQNKPPFIWLNILIFSASFVLTFIVMPWYAYHYGLGWEHLIWGILAFSFTNLSITAGYHRLWSHKTYEAHPVLRAIFAIGGAFSLQNSALHWSSDHRVHHKHVDNNDKDPYSAKRGFWYSHIGWMLRDYNKSKENEYTNCRDLKRDSIVMWQHNYYVPLALLTNIGFPVALGLIYGDVWGMLLVVGAARLFLSHHTTFFINSLAHVWGKQTFTDKNTARDNGVLAFFTFGEGYHNFHHIFENDYRNGVYWWHYDPTKWLIKSCSWLGLTSKLRTTSTFRIEKARATQLLKKAKEKLESKPNAQTVLDQLQQEFDALVHHMQEYYEARKELLGEKTANVVKKYECSVSKLKYQQLKTEFERQQRSWNLMIRRYA

SEQ ID NO: 56997 - protein, 787 aa, Neisseria meningitidis Z2491
MQFSYSWLKTQADTELSSDKLEHLLTMSGLEVEEAETAAPAFAGVVIAEVKSVEKHPDADRLNVTRVDVGTGELVQIVCGAPNVKAGIKVPCSLPGAVLPGNFKIKPTKMRGVVSNGMLCSTDELGLPDDGVNGLHILPEDAPVGTNIREYLDLDDTLFTLKITPNRADCLSVKGIAREVSALTGCAFRQPEIRKMPSEGGKTRAVKIDAPADCGRFISRVIENVNAKAATPDWMKQRLERSGIRSISVLVDIGNYVMLEIGQPMHVFDADKLSGSLHIRRAREGETLECLNEKTVSLSENTLVVADEKGALSLAGLMGGAASAVSDGTQNIVLEAAWFAPEIIAGKSRQYGFGSDSSFRFERGVDYRLQADAIERATELVLQICGGAAGEMVEAQGELPEVKQVGLRLGRLKTVLGVDIPSEQVETILQHLGLQPEKTAEGFRVTAPSFRFDIEIEADLIEEIGRVYGYENIPDDYTSGRLKMLELPETRRPRFAVYNEMAARGYREVVSYAFVNEQWEQDFAANADPIRLQNPLAAQYAVMRSTLIGGLVEILQNNLNRKQNRVRVFEIARVFGKGSDGRFVQNERIGGLWYGAAMPEQWGGKTRNADFYDIKADVENLLKNKAVEFVKTGYPALHPGRAANIVSDGKVIGFVGELHPKWLQKYDLPQAPLVFEIDMAAVLECGKTRYRAVSKFQPVRRDLAFVMPEAMSHDDLLLVLKGAANKLVQEISVFDVYRGMGLPEGMKSVAVKVILQDMENTLTDEAVEPLIGKLIGAATAAGARLRS

SEQ ID NO: 56998 - protein, 98 aa, Schizosaccharomyces pombe 972h-
MADATKNPIADLSESEQLELSKFIESEQQKVKLQQAIHQFTSTCWPKCIGNIGNKLDKSEEQCLQNCVERFLDCNFHIIKRYALEKFGFLFCWLGFSC

SEQ ID NO: 56999 - protein, 187 aa, Scenedesmus vacuolatus
AGGIAEMAGMGEDIRERTDALDAAGNTTAAIGKGFAIGSAALVSLALFGAYITRAKIDLIQSSILDPKVFAGLLVGAMLPYWFSAMTMKSVGKAALAMVEEVRRQFNTINGLMEGTARPDYSRCVKISTDSSLREMIAPGALVMLSPIIVGMLFGTRTLAGMLAGGLVSGVQMAVSMSNTGGAWDNA

SEQ ID NO: 57000 - protein, 116 aa, Geobacillus stearothermophilus
MHHLIQEITKEQLRTDLPDFRPGDTVRVHVKVVEGNRERIQVFEGVVIKRRGAGISETFTVRKVSYGVGVERTFPVHTPKIAKLEVIRRGKVRRAKLYYLRELRGKAARIKEKTAQ

SEQ ID NO: 57001 - protein, 344 aa, Bacillus halodurans C-125
MKVKVAINGFGRIGRMVFRKAVENKQFDVVAINASYPAETLAHLIKYDSVHGPFQGTVEIKNDALVVNGKEIKLVNSRDPRVLPWKDLEVDIVVEATGKFKTKETAGYHLEAGAKKVIITAPGKNEDVTVVVGVNENDYKPEEHHVLSNASCTTNCLAPVAKVLDEAFTIQSGMMTTVHAYTNDQKNIDNPHKDLRRARACGQSIIPTSTGAAKAISKVLPQLEGKLTGMALRVPTPNVSLVDLVVQVKEDVTPEKVNHVLKQAAAGSMKGILGFTEEPLVSIDFNGNEHSAIVDGLSTMVMEDTNQVKVLAWYDNEWGYSTRVVDLVELVAKELKKPAKVIAS

SEQ ID NO: 57002 - protein, 284 aa, Rubrobacter xylanophilus DSM 9941
MSVPRIDGETSLVGLIGHPVSHSLSPQMHNASFAALGLNYVYVPLDVPPEELEAGVRGLRALGFRGFNVTMPHKERVCALVDRLDEAARISGAVNTVAVEEDGSLLGMNTDGSGFLLACREAGVEPSGRVALVAGAGGAAAAVAVALLRAGLSELRIANRTPGRALGLRERLGGLGGRVEVFPLSGLAEAAGGADILVNATYLGMRAGDPLPFPEELLRPGVAVCDAVYRPGKSTALVRAARRRGLAAVPGELMLLYQGVEAQRAWTGVDPDVGAMRRALSGEG

SEQ ID NO: 57003 - protein, 352 aa, uncultured bacterium
IGAANNLLAAMLDNHIQQGNALNIDPRRITWRRAVDMNDRQLRNIVDGLGARTDGTPRQDGFDITVASEVMAVLCLASSITDLKERLARIVVGYTYDNNPVTAGDLKAQGAMAALLKDALKPNLVQTLEHTPAFIHGGPFANIAHGCNSVTATRMALKLGDYAITEAGFGADLGAEKFLDIKCRMASLKPDAVVIVATVRALKSHGGVAKANLAEENLEALEKGLPNLLQHVRNITEVYHLPCVVAINRFPTDSEAELKLVEEKCRELGVNVALSEVWAKGGKGGKALAEEVVRLCEQKNNFEFCYDLDLPIMDKLNTIARRIYHAEGVDLLASAPKQLKQLEELGYDKLPI

SEQ ID NO: 57004 - protein, 352 aa, uncultured bacterium
ITSANNLLAALLDNHIQQGNELGIDTRNVVWKRCLDMNDRALRNIVIGLGAKTDGFVREDHFVITVASEIMAILCLSNDIKDLKERLSRIVVAYDLSGKPVTAGDLKAVGAMAALLKDALKPNLIQTLEHTPALVHGGPFANIAHGCNSVRATKAALKMADYCITEAGFGADLGAEKFFDIKCRQAGLKPDAVVLVATVRALKYNGNVPKDKLGEENLDALKIGIANLEKHIENLQKYGVPIVVTLNAFVSDTEAEISFVENFCKERGCEFALSKVWEKGGEGGIELARKVLDTLENKKSDFKVLYPDDMPLKEKIETIAKEIYGAASVNFAPAALKQLDKITDMGFGKLPV

SEQ ID NO: 57005 - protein, 256 aa, Agrobacterium tumefaciens str. C58
MTPNVRPLVAGNWKMNGTRASLDQIKAMAEGVKGALSEKVDALICPPSTLLYVATALCDDSPLLIGAQDCHQNDTGAHTGDISAEMIADCFGTHVIVGHSERRTDHAETDHLVRAKASAAHQVDLIAIVCIGETADERKAGQTLDILKRQLAGSLPDEATAENTVIAYEPVWAIGTGLTPTTQDVREAHAFMRDELVKRFGDAGKTMRILYGGSVKPANALELMGVENVDGALIGGASLKAADFLSIYAAYEQLTA

SEQ ID NO: 57006 - protein, 375 aa, Botryotinia fuckeliana
MEEEVAALVIDNGSGMCKAGFAGDDAPRAVFPSIVGRPRHHGIMIGMGQKDSYVGDEAQSKRGILTLRYPIEHGVVTNWDDMEKIWHHTFYNELRVAPEEHPVLLTEAPINPKSNREKMTQIVFETFNAPAFYVSIQAVLSLYASGRTTGIVLDSGDGVTHVVPIYEGFSLPHAIARVDMAGRDLTDYLMKILAERGYTFSTTAEREIVRDIKEKLCYVALDFEQEIQTASQSSSLEKSYELPDGQVITIGNERFRAPEALFQPSVLGLESGGIHVTTFNSIMKCDVDVRKDLYGNIVMSGGTTMYPGISDRMQKEITALAPSSMKVKIIAPPERKYSVWIGGSILASLSTFQQMWISKQEYDESGPSIVHRKCF

SEQ ID NO: 57007 - protein, 356 aa, uncultured bacterium
VTSAHNTISALLDNYLYQHRKDGFSLREIYWKRVLDVNDRALRNIVTGLRGDGVVSETGFDITPASELMAILCLATSEDDLRRRIENILLGITSDGKPFRVRDLGVGGAITVLMRDALSPNLVQTTEQTPAFIHGGPFANIAHGCSSVMATKMAMTFSDYVVTEAGFGADLGAEKFFNIKCRKAGLQPQLVVIVATTQGLKMHGGVALDHIKEPNADGLREGLKNLNRHINNMQGFGQPVIVTLNRFDSDTDEEIDIIRKNCEDRGVGFAVNEAFLKGGEGAVELAQKVVDTIERIQPLPINFTYPQSETIEGKIEKVCKRIYGAAAVEFTKTGKKRLEAIREIFADDKEISRYPI

SEQ ID NO: 57008 - protein, 336 aa, Desulfotalea psychrophila LSv54
MTDSIELIQGIGREGMQVNRYIAEDIALLRGSMEPLLCDILEYGLLSGGKRIRPLLVLMAARLCGNNGLETYRLATGFEYLHAATLFHDDIIDHSDLRRGQESIAKKFGMEAAILAGDFLHTRAMIFVGEMVGAEGLRRFGKATSAMVDGEFLQLRNAQEYNISELDYYRAVMGKTGVLIAAACELGALYGGGSEAEIAALRSYGEKLGSAFQIVDDLLDYQGDTALTGKAVGNDLAEGKMTLPLILALSQAKKRGDTPAVCRVEKILADENLRAESFTEISAFIEKYNGFAEARDHAEADISFACQQLHIFKSRDIQDEMNLLVGLGHYILSRKK

SEQ ID NO: 57009 - protein, 87 aa, Oryza sativa (japonica cultivar-group)
SSTTLQARILALNASYFLKNGGHFVISIKANCIDSTMPAEAVFASEVEKLKADQFKPSEQVTLEPFERDHACVVGGYRMPKKQKGTS

SEQ ID NO: 57010 - protein, 161 aa, Cryptococcus neoformans var. neoformans JEC21
MSASKVYVGNLSWNSTDDTLLQVFSAYGTVTDCIVMKDRETGRSRGFGFVTYGSPQEAEAAIAAMNEQELDGRRVRVNMANSRGSGGGGYGGGYNSGYGGGYQQQQGGYQQGGGFNQGYGGGYGGSGYGGGAQGGYGGGYGGQQGGYEQGGQQQGGYNGGY

SEQ ID NO: 57011 - protein, 345 aa, uncultured bacterium
NLLAAMLDNHIQQGNALGIDVKKITWKRCVDMNDRQLRFVVDGLGGRMNGTPREDGFDITVASEIMAVFCLASSMADLKERLSRIIVAYTYDDQPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLANEDLAALEKGIPNLLRHVNNIRNVYQLPCVVAINRFPTDTDAEIDFIVRKCRELGVNTILSTVWAEGGKGGEDLAREVVRLCEEEKGNFTFSYELDASIEEKLEAVTKKIYGGSGIALTPAAKKQAERLTALGFDK

SEQ ID NO: 57012 - protein, 182 aa, Cryptococcus neoformans var. neoformans JEC21
MSASKVYVGNLSWNSTDDTLLQVFSAYGTVTDCIVMKDRETGRSRGFGFVTYGSPQEAEAAIAAMNEQELDGRRVRVNMANSRGSGGGGYGGGYNSGYGGGYQQQQGGYQQGGGFNQGYGGGYGGSGYGGGAQGGYGGGYGGQQGGYEQGGYGGNQGFDAQQGYGGAAGGYGQQQGGYNGGY

SEQ ID NO: 57013 - protein, 355 aa, uncultured bacterium
IGAANNLLAAMIDAHIQAGNELNIDPRKITWRRAVDMNDRQLRNIVDGLGGKPHGTPREDGFDITVASEVMAIFCLATSISGLKERLGRIVIGYTYDDKPVTAGELKAAGAMAALLKDALKPNLVQTLEGTPAFIHGGPFANIAHGCNSIMATKMALNFGDYAITEAGFGADLGAEKFLDIKCRLAGLKPNAVVIVATVRALKNHGGVPKAQLNEENLEALEAGLPNLLQHVENITNVYKLPCVVAINAFPTDTEAELKLVEDKCKELGVNAVLATHWANGGDGAIELAKEVVRLCEEGTGAEDFEFCYADELSLREKIETIAKRIYRADGVLFAGNAEKQLKQLEDLGFGNMPV

SEQ ID NO: 57014 - protein, 208 aa, Synechococcus sp. CC9605
MGGFFIVQTAWARILKMTPTEQNFLSLLCGEYSNQQQALDNPPFFAHIFLRYRPLEHLQEGSILLEQSYAVDPKHPYRLRMIRAEEQSPGIIKLWNHTFREPSRFSGATFDKYCRQTIQKSDLICLDQCHYQVEYKSGGYYGSIEPGCRCMVTRNGQETVLASTFHLQEDTLKTLDRGHDPKTNERVWGAIAGEFKFRRTKSWEAKWE

SEQ ID NO: 57015 - protein, 153 aa, Streptococcus pyogenes
PMAYVLWNHFMNINPKTSRNWSNRDRFILSAGHGSAMLYSLLHLAGYDLSVEDLKNFRQWASKTPGHPEVNHTDGVEATTGPLGQGIANAVGMAMAEAHLAAKFNKPGFDIVDHYTFALNGDGDLMEGVSQEAASMAGHLKLGKLVLLYDSND

SEQ ID NO: 57016 - protein, 153 aa, Streptococcus pyogenes
PMAYVLWNHFMNINPKTSRNWSNRDRFILSAGHGSAMLYSLLHLAGYDLSVEDLKNFRQWGSKTPGHPEVNHTDGVETTTGPLGQGIANAVGMAMAEAHLAAKFNKPGFDIVDHYTFALNGDGDLMEGVSQEAASMAGHLKLGKLVLLYDSND

SEQ ID NO: 57017 - protein, 153 aa, Streptococcus pyogenes
PMAYVLWNHFMNINPKTSRNWSNRDRFILSAGHGSAMLYSLLHLAGYDLSVEDLKNFRQWRSKTPGHPEVNHTDGVEATTGPLGQGIANAVGMAMAEAHLAAKFNKPGFDIVDHYTFALNGDGDLMEGVSQEAASMAGHLKLGKLVLLYDSND

SEQ ID NO: 57018 - protein, 156 aa, Glycine max
  misc_feature (52)..(52): Xaa can be any naturally occurring amino acid
  misc_feature (142)..(142): Xaa can be any naturally occurring amino acid
  unsure (1)..(156): unsure at all Xaa locations
ANLKISCSAVTAVHRANASMIAPFTGLKSMAGCPLAKTANHITSIASNGGRXHCMHVWPPLVKMKFETISYLPDHDDAQLAKEIEYLLTIGWIPYFEFELEHGIAYREHDMSPRYYQRRYWYTLTCQFLTALIATTVSYELXQARTEYSIGYIRII

SEQ ID NO: 57019 - protein, 153 aa, Streptococcus pyogenes
PMAYVLWNHFMNINPKTSRNWSNRDRFILSAGHGSAMLYSLLHLAGYDLSVEDLKNFRQWGSKTPGHPEVNHTDGVEATTGPLGQGIANAVGMAMAEAHLAAKFNKPGFDIVNHYTFALNGDGDLMEGVSQEAASMAGHLKLGKLVLLYDSND

SEQ ID NO: 57020 - protein, 486 aa, Pseudomonas putida
MRQIENFIAGEFVAAASGKRFDKRSPVDNRIICSISEAGRSEVDAAVSAARSALHGEWGSLSTDQRIELLLCVANEITRRFDDFVEAEMSDTGQPEHVMKHVFIPRGAANFKVFADVIKSVASESFKMDTPDGRGALNYSIRRPKGVIGVVCPWNAPFMLMTWKVGPALACGNTVVVKPSEESAQTAALLGEVMNAVGIPKGVYNVVHGFGPDSAGEFVTRHPQVDAITFTGETRTGTAIMKAASEGMRDVSFELGGKNAGIVFADADFEAAVESFSRSVFLNTGQVCLGTERVYVERPIFERFVQALKVKAEAVKYGRPDDHQANYGPLISQEHKQKVLSYYRKAVEEGATLVTGGGVPQMPGELAEGAWVQPTIWTGLPETAAVVQEEIFGPCCHISPFDSEDEVVEKANATDYGLSTTIWTSNLARAHRMAGRIDVGITWINSWFLRDLRTPFGGSKQSGIGREGGVHSLEFYTETRNVCVKL

SEQ ID NO: 57021 - protein, 210 aa, Schizosaccharomyces pombe 972h-
MLENNGSVILMEPDHLRTAVNRSMTSREGRTKNRFNPITGARLAAGVVALSADKRKVLLVSSAKKHPSWVVPKGGWEADESVQQAALREGWEEGGLVGHITRSLGSFKDKRPTDTIDRRKKYLKQLMSKSSGNDVSTNTELGAEAEKLLLPPRAECEFFEVIVERLEDNYPEMRKRRRKWMSYQEAKEALTSRKDILAALEKSSIIKEEN

SEQ ID NO: 57022 - protein, 212 aa, Triticum aestivum
  misc_feature (184)..(184): Xaa can be any naturally occurring amino acid
  unsure (1)..(212): unsure at all Xaa locations
ASGMSIRSSSAHKISRVPDFRSQVRPTISICEKSYAVQKSEEIFNVAQELMPGGVNSTVCTFISVVGQPIVYDSVKVSNMWDVDGNEHIDYVASWGPAIMGHADDVVNHALIEPVKKGSSSGAPCALENVLHLMVISTVPSIEMVRFVNSASESSMGPLRLVSAFIGRENIIKFEGCSHGHADXFLVKAGSGVAALGLSVFPGVRKGIHRVP

SEQ ID NO: 57023 - protein, 427 aa, Pseudomonas syringae pv. syringae B728a
MKTQIQAIHAREILDSRGNPTVEVDVTLECGAMGRASVPSGASTGAHEAVELRDKDTQRYSGKGVLKAVSNVNTEILESLRGMNAIDQEQIDHLMIKLDGTSDKSRLGGNAILGVSLAVARAAASALNLPLFQYLGGEQAARMPVPMFNILNGGVHANWQGPDFQEFMIAPTGAGSFKEALRWGSEVYHELKAVLKDAGYSTAVGDEGGFAPALKKNSDAIELIIKAIERAGYTPGSQIEIAIDPASSGFYENGLYHLRSEGRKVDAQELINLYSSWVDKYPIAVLEDGLAEDDWSGWKLLNAALGDRIELVGDDLFVTNVERIQRGITENVANAVLIKPNQIGTLTETKAAIEMAYGANWGAMVSHRSGETVDSSIADLTVAMGTGHLKTGAPCRGERVEKYNQFLRIEEDLGSRAFYAGHDAFVR

SEQ ID NO: 57024 - protein, 349 aa, Schizosaccharomyces pombe 972h-
MAEFIRTQIFGTCFEITTRYSDLQPIGMGAFGLVCSAKDQLTGMNVAVKKIMKPFSTPVLAKRTYRELKLLKHLRHENIISLSDIFISPFEDIYFVTELLGTDLHRLLTSRPLETQFIQYFLYQILRGLKFVHSAGVIHRDLKPSNILINENCDLKICDFGLARIQDPQMTGYVSTRYYRAPEIMLTWQKYNVEVDIWSAGCIFAEMIEGKPLFPGRDHVNQFSIITELLGTPPMEVIETICSKNTLRFVQSLPQKEKVPFAEKFKNADPDAIDLLEKMLVFDPRKRISAADALAHNYLAPYHDPTDEPVADEVFDWSFQDNDLPVETWKVMMYSEVLSFHNMDNELQS

SEQ ID NO: 57025 - protein, 118 aa, Brassica napus
MFAAENGLKGDPRLEAISAAIRVVPNFPKKGIMFQDITTLLLDHKAFKHTIDIFVDRYKDMQISVVAGVEARGFMFGPSIALAIGAKFVPLRKPGKLPGKVISESYELEYGHDRLEIH

SEQ ID NO: 57026 - protein, 352 aa, uncultured bacterium
ITSANNLCAAMLDNSIKQDNELNIDPEKVVWKRCVDINDRVLRNIIVGRGRDVDGVEREDHFVITVASEIMAILCLANDYADLKDRLGKIIVAYTYDGKPVTAKDIKAVGSMAALLKDAMKPNLIQTLEHTPALVHGGPFANIAHGCNSVRATKTALKMADYVITEAGFGADLGAEKFLDIKCRKADLKPDAVVLVATVRALKYNGGMPREDLQTEDLDALSKGIVNLEKHIENIQQYDVPVVVTLNQFGTDTDAEIEFVKNFCEEHDCDFASAKVFKEGGEGGIELAKKIIETIETKPSNYHPLYTDDMSIKEKIETVATKIYGADGVTYSDEANEAIAKIEELGFDDCPV

SEQ ID NO: 57027 - protein, 319 aa, Bacillus halodurans C-125
MKRIGVLTSGGDSPGMNAAIRAVVRKAIYHGVEVYGIYQGYAGLISGDIRKMELGSVGDIIHRGGTILYTARCEEFKTLEGQKKGIEQLKKFGIEGLVVIGGDGSFAGAQKLTEHGFPTVGVPGTIDNDIPGTDFTIGFDTALNTVIDAIDKIRDTATSHDRTYVIEVMGRNAGDLALWSGLADGAETIVIPEADHDIDQIISRLQRGQERGKKHSIIVVAEGVGSGMDFGREISERTGAETRVTVLGHIQRGGSPTGFDRVLASRLGAKAVDLLLEGQAGVTVGIENNKLVHHDITEVLQRKHSIDLDMYRLSQELSI

SEQ ID NO: 57028 - protein, 502 aa, Arabidopsis thaliana
  misc_feature (458)..(458): Xaa can be any naturally occurring amino acid
  unsure (1)..(502): unsure at all Xaa locations
MAIPMPTRQLFIDGEWREPILKKRIPIVNPATEEVIGDIPAATTEDVDVAVNAARRALSRNKGKDWAKAPGAVRAKYLRAIAAKVNERKTDLAKLEALDCGKPLDEAVWDMDDVAGCFEFYADLAEGLDAKQKAPVSLPMESFKSYVLKQPLGVVGLITPWNYPLLMAVWKVAPSLAAGCTAILKPSELASVTCLELADICREVGLPPGVLNVLTGFGSEAGAPLASHPGVDKIAFTGSFATGSKVMTAAAQLVKPVSMELGGKSPLIVFDDVDLDKAAEWALFGCFWTNGQICSATSRLLVHESIASEFIEKLVKWSKNIKISDPMEEGCRLGPVVSKGQYEKILKFISTAKSEGATILHGGSRPEHLEKGFFIEPTIITDVTTSMQIWREEVFGPVLCVKTFASEDEAIELANDSHYGLGAAVISNDTERCDRISEAFEAGIVWINCSQPCFTQAXPWGGVKRSGFGRELGEWGLDNYLSVKQVTLYTSNDPWGWYKSPN

SEQ ID NO: 57029 - protein, 433 aa, Magnetospirillum magnetotacticum MS-1
MWISVGEPPGLASLLELAKGCAFILVTAVMLLVLLRRWEGELNRRGRALEQSNRDLSELNARLSGIMRDSQDLIAAWDRDKRLTAFNPRYQSVCWSFFQTDVKIGMPLEEIFAKAPDRLRLFSECWDRTLAGESFVQLQSLSADGDTGWFETSYGSLAGADGRPCGGFHIVRDVTDRVRAEENGRLHAENLAKTVETLTEANAELERFAFVASHDLQEPLRTIACFAQLVERDYGEGLDDRGREYLDLVTGGAIRMNQLINDLLAYSRISRSEGRMAEISAMSACESALTNLREAIDSSRAEITVIPLPNVTADSVMLIQVFQNLIGNAIKYRKEGCAPHIQVAAVRQDRQWLFSVSDDGIGFDPKEQDVFELFRRLHPHSSYAGTGVGLTICKRIITRLGGHIWVESNPGAGSVFRFTLPLADESLPVPPQS

SEQ ID NO: 57030 - protein, 148 aa, Oryza sativa (indica cultivar-group)
MARKNLLLLGVLLSALLFFFLDVAHARELAEASESEGKNVKPTGGSGVEDQKWGGAHGGGYGYGGGYGGGGYGHPGYGGGYGGGYGHPGYGGGYGGGYGQGYGGGYSHPGHGGGYGGGYGGGYGGGYGGGGGYGGGGGYGGGHGGGWP

SEQ ID NO: 57031 - protein, 245 aa, Oryza sativa (japonica cultivar-group)
MDSDHWISRLMAAKRQYALQRAQNHHHATATATATAASHSHLDRYGYDDVEPEDEVRPDFPCPYCYEDHDITSLCAHLEDEHPFESKVVACPVCSARISKDLLDHITLQHSYLFRLQRHHRLRRVAVPSNHALSLGGRDLQETYLKVLLGNSSRSSGTNAASSVTDSLLSSLVLNLSSSEAEDTAKFSALAVVENNWFKRTLPSKTWKASSDSNLSQEERERRRRRAAVRSSFVQHLLVSTLFDD

SEQ ID NO: 57032 - protein, 1126 aa, Sinorhizobium meliloti 1021
MAARQRIIPVRREYNRWVANQTLEDYALRFTAKSARRFSSARISQTAIGAISFLALEAIGGAITMSYGTTNAIVAILVASLMILIVGLPISRYAIRHGVDIDLLTRGASFGYIGSTITSLIYASFTFILFAIEASIMSGALELALGIPLWIGYIVSAVMVIPLVTHGVKLISRFQLVTQPFWIVLNVLPFAFIAFADWEKVGLWLAYAGIHHTSGPPGTLASFHLVEFGAASAVIFALTAQIGEQVDFLRFLPPDGERKLRHRIAVFLAGSGWVIVGAPKLLAGSFLVVLALSTGVPSTRAADPAQMYYTAFGYIFPSDTAALLLMAAFVVVSQLKINVMNAYAGSLAWSNFFSRLTHSHPGRVIWLVFNVAIALLLMELGIYRLLEETLGIFSIVAMAWLSTISADLFVNKPLGLAPPGIEFKRAHLYDINPVGLGTMGVSTLFALVAHFGAAGEIAASLAPYIALVTAFVVSPLIAWWTEGKFYLARKPRKSWLAESEITCSICEHPFEPEDMAWCPAYAAPICSLCCSLDSRCHDMCKPKARLNTQVATVAKAVLPETVVAKLATRLGRYAISAVISITGIGVILAMIAHQTTAASPETAEVVERTIAIVFFVFAILAGVVSWFYVLAHDSRVVAEEESSRQNTALLKEIAAHKKTDAALQDAKERAESANRAKSRYVVGLSHELRTPLNAVLGYAQILERDETIPPPRQGAIKAIRRSADHLSGLIDGLLDISKIEAGKLQVYSNEINIQDFLDQIVDMFRPQAQAKGIAFEHNRAASLPQYVRTDDKRLRQILVNLLSNALKFTERGHIRFDVAYRSQVASFTIEDSGRGISEKDLPRIFEPFQRGEAEYRMPGLGLGLTITRLLTQTLGGEISVTSEKDKGTAFKVRLMLSAVDRPAALKDPVRNIKSYHGPRRTIIVVDDNADHRDLMRELLAPLDFTVLAAASGAACLALAEHTEPDLFLIDISMPGMSGWDLVTRLREAGQSAPAIMLSANIGDGSAAGAIGHDDALAKPFGLRQLTDKLAIHLKLEWIYDDGPKETSGTDKTTAVASPGHHHLKELIELGEIGYVRGIEAKLTEIALNPDNRAFAEAARAYVGAFDLAGYDAFLKRLLAGEANARA

SEQ ID NO: 57033 - protein, 344 aa, uncultured bacterium
GAANNLLAAMLDNHIQQGNALGIDVKKITWKRCVDMNDRQLRFVVDGLGGRMNGTPREDGFDITVASEIMAVFCLASSMADLKERLSRIIVAYTYDDQPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLANEDLAALEKGIPNLLRHVNNIRNVYQLPCVVAINRFPTDTDAEIDFIVRKCRELGVNTILSTVWAEGGKGGEDLAREVVRLCEEEKGNFTFSYELDASIEEKLEAVTKKIYGGSGIALTPAAKKQAERLTA

SEQ ID NO: 57034 - protein, 1172 aa, Magnaporthe grisea 70-15
MASTESILQGVNVLGTVNESQRKILTPPALAFLALLHRSFNERRKQLLERRKLRQAEIDKGVLPDFLPETRHIRENSTWKGAAPAPGLVDRRVEITGPTDRKMVVNALNSNVWTYMADFEGEYLGSNAPTWENMINGQVNLYDAVRRQVDFKQGSKEYKLRTDRTLPTLIVRPRGWHLEEKHVTIDGEPISGSLFDFGLYFFHSAHEAVKRGFGPYFYLPKMESHLEARLWNDAFNLGQDYIGMPRGTIRGTVLIETILAAFEMDEIIYELRDHSSGLNCGRWDYIFSTIKKFRQHPNFVLPDRSAVTMTVPFMDAYVKLLIQTCHKRGVHAMGGMAAQIPIKDDKEANDRAMDGVRADKLREVRAGHDGTWVAHPALAAIASDIFNKHMPTPNQLFVRREDVHITAMDLLNMNVPGKITEDGIRKNLYIGLGYMEAWIRGVGCVPINYLMEDAATAEVSRSQLWQWVKHGVSTAEGKKVDKSYALRLLREEADKMAKSLPAGNKMQLASQYFATQVTGEDYADFLTTLLYNEITTPGSARPASKFPWQKRNAANLFSHHLFQCARGQERKGGNVPHRQPRIVHFLSYPPTLANMVFFPPEYIPKLPFDPPDSMTIEEFIKNETCGRRPLAESRNPFTCGLTGKTYSILQVQQRTDFLSRALGKRMGWSPNQDTPWEKVVGIFSANTIDYQTVAYAVHRLNGIVTPANAVYSVPELAHQLKSSGASALVTCALLLDTALAAAKEAGIARDKIFVMWMPGPAPSTPVVSVDDLIREGSSLPQLERLRWARGTGARQTAFLCYSSGTSGLPKAVMISHRNVIANVLQYNVFDGPSLAKRGVTTQAILGLLPFSHIYALVVINHAGTWRGDEIITLPKFELATFLGAIQKFKISMLYLVPPIIIQMVKNHDKLKQYDLSSVHSVFSGAAPLGEETVGNLNKIYPDWVVVQGYGMTETATVVSGTSEDDIYTRSSGSLLPGVKAKVMDPNGNEVTQLDTPGELWVQSPSVTLGYLNNEKATHETFVWDEDGRWIRTGDEVLFTLSPGGNEHLVILDRIKELIKVKRHQVAPAELEAHLLDHPAVEDCSVIQIPDDHSGEVPKAFVVKNAAYSKGKSDNDLAREIEKHVEEHKASYKWLRGGVEFVAEIPKSPSGKILRRLLRDREKEKRRSQGSKL

SEQ ID NO: 57035 - protein, 587 aa, Magnaporthe grisea 70-15
MASARALARLAPQQARLSQVAQPAMRLQSQYRYMSMRTRRPVYSTPVTLQSQLQIQRRLESTEAPAATLSPQQPPKKKFRKLRFLWRLIQLSLIGGLGYTAYSIYQERHPDEPADPDPNRKTLVILGTGWGSVSLMKNLDVENYNVIVISPRNYFLFTPLLPSCTTGTIEHRSIMEPVRTILRNKKAKVKYYEAEASSIDPDRKVVKIFDTSEVKGDMAETEVPYDMLVVGVGAENATFGIPGVREHSCFLKEIGDAQLIRKKIMDCVETAAFKDQTPEEIDRLLSVVVVGGGPTGVEFAGELADFFEEDIKKLIPEISDRFKVTLVEALPSVLPSFSKQLIEYTESTLKEEKINIETKTMVQKVTDKSVEATTTRPDGTKEKRVMPYGLLVWATGNAVRPLVKDLCARIPAQKDSRRGLAVNEYLVVQGARDIWAIGDCAVAGYGPTAQVASQEGAFLARLFNNMAMTETLETKIQELSSSLNVKQADRAPAEVSAEIAEYERKLRRIKDIRPFKYSHQGSLAYIGSDKAVADISWLDGNFATGGRLTYLFWRSAYLSMCFSARNRILVINDWVKSKIFGRDVSRE

SEQ ID NO: 57036 - protein, 269 aa, Oryza sativa (indica cultivar-group)
MSSAAGEPSSSSAAAAAISCSSSNDDEKPPPSLEGKELRRVAEEEPAAAARPEKLTEASSRAAEAEEEEVVEDEEDDDEEDEGKVAEAIDLGPRVSIKEQLEMDKEDESLRRWKEQLLGSVDLNSVGESLEPDVRITSLCILSPGRPDVLLPLPVEPSNSKEPWFTLKEGSTYRLKFTFSVSSNIVSGLRYTNTVWKAGIRVDKTKEMLGTFSPQLEPYTYVTPEETTPSGVFARGSYSAKTKFVDDDRKCYLEINYTFDIRRDWPCKS

SEQ ID NO: 57037 - protein, 153 aa, Streptococcus pyogenes
PMAYVLWNHFMNINPKTSRNWSNRDRFILSAGHGSAMLYSLLHLAGYDLSVEDLKNFRQWGSKTPGHPEVNHTDGVEATTGPLGQGIANAVGMAMAEAHLAAKFNKPGFDIVDHYTFALSGDGDLMEGVSQEAASMAGHLKLGKLVLLYDSND

SEQ ID NO: 57038 - protein, 153 aa, Streptococcus pyogenes
PMAYVLWNHFMNINPKTSRNWSNRDRFILSAGHGSAMLYSLLHLAGYDLSVEDLKNFRQWGSKTPGHPEANHTDGVEATTGPLGQGIANAVGMAMAEAHLAAKFNKPGFDIVDHYTFALNGDGDLMEGVSQEAASMAGHLKLGKLVLLYDSND

SEQ ID NO: 57039 - protein, 665 aa, Streptococcus pyogenes MGAS8232
MKKPFYITTPIYYPSGKLHIGSAYTTIACDVLARYKRLMGHEVFYLTGLDEHGQKIQTKAKEAGISPQTYVDNMAKDVKALWQLLDISYDTFIRTTDDYHEEVVAAVFEKLLAQDDIYLGEYSGWYSVSDEEFFTESQLKEVFRDEDGQVIGGIAPSGHEVEWVSEESYFLRLSKYADRLVAFFKERPDFIQPDGRMNEMVKNFIEPGLEDLAVSRTTFTWGVPVPSDPKHVVYVWIDALLNYATALGYGQANHANFDKFWNGTVFHMVGKDILRFHSIYWPILLMMLDLPMPDRLIAHGWFVMKDGKMSKSKGNVVYPEMLVERFGLDPLRYYLMRSLPVGSDGTFTPEDYVGRINYELANDLGNLLNRTVAMINKYFDGTVPAYVDNGTAFDADLSQLIDAQLADYHKHMEAVDYPRALEAVWTIIARTNKYIDETAPWVLAKEDGDKAQLASVMAHLAASLRVVAHVIQPFMMETSAAIMAQLGLAPVSDLSTLALADFPANTKVVAKGTPIFPRLDMEAEIDYIKAQMGDSSAISQEKEWVPEEVALKSEKDVITFETFDAVEIRVAEVKEVSKVEGSEKLLRFRVDAGDGQDRQILSGIAKFYPNEQELVGKKLQIVANLKPRKMVKKYISQGMILSAEHGDQLTVLTVDSSVPNGSIIG

SEQ ID NO: 57040 - protein, 464 aa, Streptococcus thermophilus
MNEKLFREIMEINPIYARPGENTEAPRFKMPTDAMLPETAYQTVHDESMMDGNARLNLATFVSTWMDERADKLYREAFDKNAIDKDEYPETARIETYCWTMLADLWHAPKPKETIGCSTTGSSEACMLGGLALKRRWQEKRKAEGKPIDKPNLVMSSAVQVCWKKFCNYFDVEPRYVPISLEHKVLDGYELEKYVDENTIGVVAIMGVTYTGMYEPVDKIAKVLDGIQEKTGLDIQIHVDAASGGMIAPFLQPDNVWDFRLERVASINTSGHKYGLVYPGLGWVVWRDCQSLPDSLIFRVSYLGGTMPTFALNFSRPGAQILLQYWAFLRYGFEGYKKVQGATSDVARYLANEIKKIGPFELWNDASDIPVFAWMMKKDQKHNWGLYDLSDRLRMKGWLVPAYPMPTNLTDLTVQRIVVRNGLGMDLADQLINDMKTEVAYLEKLDQPTTGKSSQWLPSLISRE

SEQ ID NO: 57041 - protein, 153 aa, Streptococcus pyogenes
PMAYVLWNHFMNINPKTSRNWSNRDRFILSAGHGSAMLYSLLHLAGYDLTVEDLKNFRQWGSKTPGHPEVNHTDGVEATTGPLGQGIANAVGMAMAEAHLAAKFNKPGFDIVDHYTFALNGDGDLMEGVSQEAASMAGHLKLGKLVLLYDSND

SEQ ID NO: 57042 - protein, 352 aa, uncultured rumen bacterium
IGAANNLLAAMLDNHIQQGNALGIDPRRITWRRAVDMNDRQLRNIVDGLGARTDGTPRQDGFDITVASEVMAVLCLADGITDLKERLARIVVGYTYDNQPVTAGDLKAQGAMAALLKDALKPNLVQTLEGTPAFIHGGPFANIAHGCNSVTATRMALKLGEYAVTEAGFGADLGAEKFLDIKCRMANLKPDAVVIVATVRALKHNGGVAKADLGQENLEALEKGMPNLLQHVSNITDVFHLPCVVAINRFPTDTEAELKLIEDKCRELNVNVALSEVWARGGEGGRALAEEVIRLCDQKNDFTYSYDLDLSIMDKLNAIATRIYHADGIDLVGSAPKQLKQLEELGHGGLPI

SEQ ID NO: 57043 - protein, 424 aa, Synechococcus sp. WH 7805
MTARSLPSTGAVTGLKETLDFFRDPQFAQKRFTAYGEVFETRLLNQRLVFIRGEQPIADLFAQGDALEGWWPESVRQLLGNRSLANRSGEGHKARRRVVGQLFSAAALSRYTPSIAALVEELAEELIQAKAPVQLVPCMRRFAFAVIATTVLGLDASDRQALFADFEIWTRALFSIPVAIPGTPFAKALEAKKRLLLRLQQVLAQTSTRRGGLDLLSGGLDEAGIPLTDDDLVEQLLLLLFAGYETTASSLSCLMRALLLNPEVEQWLLPELLDQSWPNLDARSCPRLDATVLEVMRLTPPVGGFFRRTKDTVQLGGVAIPPNRVIQVALSPDLGDGSCDLADIRPQRHLDGSFTATLLPFGGGERVCLGKALAELEIRLMAVGLLQRVRLELTPDQDLTLQQIPSPSPRGGLLVRASARDTSR

SEQ ID NO: 57044 - protein, 576 aa, Oryza sativa (japonica cultivar-group)
MAVEGRRRVPLPLPPPTRRGKQQQQQGGERARRVQAGDALPLPIRHTNLIFSALFAASLAYLMRRWREKIRTSTPLHVVGLAEILAICGLVASLIYLLSFFGIAFVQSVVSNSDDEEEEEDFLIDSRAAGPVAAQATPPPAPAPFSLLGSACAAPKKMPEEDEEIVAEVVAGKIPSYVLETRLGDCRRAAGIRREALRRTTGREIRGLPLDGFDYASILGQCCELPVGYVQLPVGVAGPLVLDGERFYVPMATTEGCLVASTNRGCKAIAESGGATSVVLQDGMTRAPVARFPSARRAAELKGFLENPANFDTLAMVFNRSSRFARLQRVKCAVAGRNLYMRFSCSTGDAMGMNMVSKGVQNVLDYLQDDFPDMDVISISGNFCSDKKSAAVNWIEGRGKSVVCEAVIKEEVVKKVLKTNVQSLVELNVIKNLAGSAVAGALGGFNAHASNIVTAIFIATGQDPAQNVESSQCITMLEAVNDGKDLHISVTMPSIEVGTVGGGTQLASQSACLDLLGVKGANRESPGSNARLLAAVVAGAVLAGELSLISAQAAGHLVQSHMKYNRSSKDMSKVAS

SEQ ID NO: 57045 - protein, 351 aa, Oryza sativa (indica cultivar-group)
MLFLPQQLLLHASSNSSPCLNIPEVNLSTGLHPLGSFHGDVQQQEIISGMPDQSWRQLLLGGLVGDHEKYGVATALLSKGLDDEASMPHEASAAAYDFYGHGGGAGDEILQASPEASSCKSQLSQMLLQAAASSPRSCVTTSGLGSSMMEFSNTAAVAPAAEPELTRKHHAGQSDNSSECNSTETGSALKKARVQASSSAQSTLKVRKERLGDRITALHQIVSPFGKTDTASVLQETIGYIRFLLGQIEALSYPYLGQCCSANPMQQQTGIMAGERSTDGLFSEFPAGQDAEKDGKKQQAKKDDDLRSRGLCLVPVSCMPHLAADNDVVVGSDFWAGGGGGAPPLAGMNLR

SEQ ID NO: 57046 - protein, 410 aa, Bacillus halodurans C-125
MATTREEALHIHRENQGKLESKSKVPVRNARDLSLAYSPGVAEPCKEIFEDVETVYEYTMKGNMVAVVSNGTAVLGLGNIGPEASLPVMEGKAVLFKSFAGVDAFPICLRTTDVDQIVETVKLLEPTFGGVNLEDIAAPSCFEIEERLKKETNIPVFHDDQHGTAIVTLAGLINALKLTGKRMSEIKVVANGAGAAGIAIIKLMQRMGVRDIIMCDSKGAIYDGRPYGMNDMKAEVAKWTNRDKIDGGLGDVLKGADVFIGVSVAGALTKEMIENMNDDPIIFAMANPVPEIMPEEAKAAGAKVIGTGRSDFPNQVNNVLAFPGIFRGALDARATHINEEMKVAAVHAIADLVAEEDLDPDYVIPAPFDPRVAPAVAAAVAKTAMETGVARRKVDPAEVEAKTKKLAIIE

SEQ ID NO: 57047 - protein, 257 aa, Brassica napus
VDVSAGITSSRKRRPKAKTHSAETTLNDKTAKTDQTASRDTPPSTEEIDPMQGLAMDDELKDVEFLPPIVSLDEFMESLDSEPPFESPHGNSEMQVSASEISDSEVRPHSKSPKGSPKEQSDKDSPTPNPEKIDEVSPKSDVSVKVDDDVSGLEKTPSPVDIKGEKVWHGLLQLSMSSVVPVTGIFRSGEKADTSEWPAMLEVKGRVRLSGFGKFIHELPKSRSRTCPGGRSTTRFQTKYPRECVYHGNMSVVVDVC

SEQ ID NO: 57048 - protein, 256 aa, Vibrio parahaemolyticus RIMD 2210633
MRRPVVMGNWKLNGSKAMVTELLTGLNAELEGVEGVDVAVAPPALYIDLAERLIAEGGNKIILGAQNTDLNNSGAFTGDMSPEMLKDFGATHIIIGHSERREYHNESDEFIAKKFNFLKENGLTPVFCIGESEAQNEAGETEAVCARQINAVIDTYGVEALNGAIIAYEPIWAIGTGKAATAEDAQRIHASIRALIAAKDEAVAAQVIIQYGGSVKPENAEAYFSQPDIDGALVGGASLDAKSFAAIAKAAAAAKA

SEQ ID NO: 57049 - protein, 432 aa, Ashbya gossypii ATCC 10895
MITTQSTVQNTASKRRESVHKNVYDHLVLKVPEAPVTPPPRLIDAPLPWKATAGRIVPASLRKYLPEIDLKVTVTCLVWYVTSSVSSNLSKAILHEFPHPVGLTELQFLTNGLMCLGFLVLVNYLHRPSWKATWVSQNMRNFPDGILPPYLNGSFCECIQQRFLVVDRKAVIATLPMGMFQFMGHFTSYKATSLIPVSLVHSVKSLSPIVTLCWYRFAKKKQFHRITYCTMLPLVAGVILISSPSGGSKSVGASVEDLRLVLGLFFAAVSMAIFVSQNLFAKSILTVRKRELLPSQKSLAGLGGASPFQLDKITILFYCSCIGFLLMLPVFLVGEAFAASSVFADISLRVLCLMGVYGFTHFLQAMLAFQLIGMLSSVNYSIASIMKRVVVIGVALTWESQLSGRQLLGLVMTVIGLYGYDKWGNKTQPHPS

SEQ ID NO: 57050 - protein, 151 aa, Schizosaccharomyces pombe 972h-
MSTEQTFIAVKPDAVQRGLIGYIISKFELKGYKLRALKFLVPSRDLVEEHYAEHKGKPFYEKLVGFMASGPVCAMIWEGKQAVKTGRLMLGASNPLDSAPGTIRGDYGIDLGRNVCHGSDSIESANREIKLWFQPSEIQVYDRTIEPWIYE

SEQ ID NO: 57051 - protein, 337 aa, Ashbya gossypii ATCC 10895
MKQDLFHDLRRLIVARRSTPAAPACSISQMPPTKDDDPQRPTCAFQDVYSRYTDLLHSHVLAARDLYLYYNGDADGPSPRADFSATYNTLMSCLADGRKLVFVACGKSFRIIAKTVATCHSLGIPAAVLHPTEAMHGDIGIVADGDALLLCSHSGETDELLHLAAYLRSARLAPASPLIAVTGDPASTLARRAHHVITVFQPPHLRERVVQDGLNAPTIATTLMLLALDCLVLALSDGGSPCARRRRADAFAARHPGGSIGSHAAAPAPEYPEQSAARAATVAHYAGSETLPEFLHMIVTHDYVRVRGHLHSATALRHRYARASRDGIPWTQIMSDL

SEQ ID NO: 57052 - protein, 611 aa, Sinorhizobium meliloti 1021
MNLVKPLAAAPSVTQGPLPASRKVYKPGDIHPDIRVPMREIALHPTSGEPPVTVYDSSGPYTIENADIRIDAGLPRLRSDWVLKRGDVESYDGRAVKAEDNGFATGERLTPEFPVRNRPLRAKPGKAVTQLAYARAGIVTPEMEFIAIRENLGRKAAKEALARDGESFGASVPDFVTPEFVRQEVAAGRAIIPANINHPEAEPMIIGRNFLVKINANIGNSAVTSSMAEEVEKMVWATRWGADTVMDLSTGRNIHNIREWIIRNSPVPIGTVPLYQALEKVNGIAEDLSWEVFRDTLIEQAEQGVDYFTIHAGVRLHYIPLTVDRVTGIVSRGGSIMAKWCLHHHRESFLYEHFEDICDICRAYDVSFSLGDGLRPGSIADANDRAQFAELETLGELTKIAWAKDCQVMIEGPGHVPMHKIKENMDKQLAVCGEAPFYTLGPLTTDIAPGYDHITSGIGAAMIGWFGTAMLCYVTPKEHLGLPDRNDVKTGVITYKIAAHAADLAKGHPAARTRDDALSRARFEFRWEDQFNLSLDPETARNFHDETLPKEAHKVAHFCSMCGPKFCSMRISHDIRAEAQKEGLEAMAAKYRDGGDLYMPLDQSNAAPAGE

SEQ ID NO: 57053 - protein, 195 aa, Magnaporthe grisea 70-15
MVLKDISRKVSRIQESSLSDYQIRDLNDEINKLMREKHMWEVQIRNLGGPNYTRAGGAKVYDEAGKEIGGAGRGYRYFGRAKELPGVKELFEAARAKKGDEKPLEARDDLRKQVDAAYYGYSPDEEDDELLAYEAAKEKEAFENLADNRKGEQLPPGWEPLPGDNGDGKGWELPTVEEVQQELINRRKQRLLNQL

SEQ ID NO: 57054 - protein, 353 aa, uncultured bacterium
IGAANNLLAAMLDNHIQQGNALGIDVKKITWKRCVDMNDRQLRFVVDGLGGRANGVPREDGFDITVASEIMAVFCLASSMKDLKERLGRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLAEEDLDALEKGIPNLLRHVHNIKEVYQLPCVVAINRFPTDTDAEIDFIIRKCRELGVNTVLSTVWAEGGKGGEDLAREVVRLGEEEKGNFTFSYDLDMTIEEKLEAVTKRIYGGAGVALTPAAKKQAERLTALGFDKMPV

SEQ ID NO: 57055 - protein, 129 aa, Methanococcus maripaludis S2
MDKNIKEIIKNMDLKFRNIDGKKLLLAISTDKQKNVLMTAFMSEESLEKSIETGYMHYYSTSRDKIWKKGEESKNVQKIIDVYRDCDGDALLFTVEQTGWACHEGYMSCFHNKIDLNTGDSTVIGTKLD

SEQ ID NO: 57056 - protein, 604 aa, Crocosphaera watsonii WH 8501
MLDPKINKLLNPSAITVPSIPETVLSQRMQITDDLSQLLDILPSSISHCLKEHPNCDRLVEVVMDLGRVPEARFPGESIYLGDVPVSAADLEYSIQRVGIFSGDNRAGIERTLHRISAMRNRGGDIIGLTCRVGRAVFGTISMIRDLVETGQSLLLLGRPGVGKTTALREIARVLADDFDKRVVIIDTSNEIAGDGDIPHPAIGRARRMQVATPELQHKIMIEAVENHMPEVIVIDEIGTELEALAARTIAERGVQLVGTAHGNQIENLLKNPTLSDLIGGIQAVTLGDDEARRRGSQKTVLERKAPPTFEIAIEMLERQKWVIHEDVANTIDILLRSGHPKPQVRTVDEKGEVQITQEEPDITPNPASFGRNSGGIVQQPKGWRASGKMTPVTPFAGKRGSNLSSASEFDRLLDASWTQPEPKGDKIRVPGPNGEDFPVYIYPYGIGRSQLEQVIEVLNLPIVLTKDLDNADVVVALRSHLKNQSKLRQVAKMRQVPIHGVKSNTIPQITRTLQRLLGMDEAKTPETADLRLFTRGGNDDELEALEEARLAVEQIVLPKGQPVELLPRSPKVRKMQHELVEHYRLQSDSFGEEPNRRLRIYPA

SEQ ID NO: 57057 - protein, 352 aa, uncultured bacterium
IGAANNLIAAMLDNHIKQGNELDVDLNNIIWRRCVDMNDRQLRNVVDGLGTAGDGVAREDGFDITVASEVMAVFCLATSLDDLKERLGRMVVAYSRAGKPITVADIKAEGACTALLKDAIKPNLVQTLENNPAFVHGGPFANIAHGCNSVQATMTAIKMTDYVVTEAGFGADLGAEKFIDIKCRYAGFNPSCVVIAATVRALKHHGGVAKADLNNENLEALEAGLPNLLQHVSNVKDVFGIAPVVAINAFPTDTEAELKLVQDKCAELGVNAVLAEHWAKGGEGAKALAEEVVRVCDQPNDFKFCYDVEMGIEEKIEAIAKRIYHADGVDYTPKAKKQLAQLNELGFDKLPI

SEQ ID NO: 57058 - protein, 407 aa, Flavobacteria bacterium BBFL7
MKFAIIRERKNPPDRRVVFTPEQLGRLNHAFAKAQFTVESSPIRIFSDAQYAASGIDVQEDVSSADVMIGVKEVPMDALIPQKKYFFFSHTIKKQPYNRELLRTILDKKIELYDHETIVKKNGARLIGFGRYAGIVGAYNGFRALGLRDGLFELPKVESLPDYKALKAELKRIKCDLPPINIAMTGVGKVAGGIIEVLEELHIHALKPKEYLQLGQFNNVQTVYTQLDVVDYYTRKDGYKPTKTECYNNPELLKSDFMKYAHVTDMLITGHFYGNGAPYFFTREDMKSDDFNINLVADVSCDIDGPIACTIRPSTIADPIYAYDASTEKEVPFKTAGAITVMAVDNLPCELPKDASEGFGEMFEKHVIPAFFNGDKNGILERAQMTTSEGKLTERFSYLQDFVDGKE

SEQ ID NO: 57059 - protein, 139 aa, Methanococcus maripaludis S2
MACENELERTFVALKPDTVERKLVGRVIQRFEDRGFEIVEMRMLTLTMEMAEEYYGEHKGKEFYERLIKFMTSGRIVAMVIKGERAISTVRKMLGNTCPCDAEPGTIRGDFGLYTPANIIHASDSLESAEREIDLFFGR

SEQ ID NO: 57060 - protein, 352 aa, uncultured bacterium
IGAANNLLAAMLDNHIQQGNSLNIDPRRITWKRAVDMNDRQLRFIVDGLGGRINGTPREDGFDITVASEIMAVLCLASDITDLKDRLSRIIVGYTYDEQPVTAGQLKAAGAMTALLKDALKPNLVQTLEHTPAFIHGGPFANIAHGCNSVIATKMALRLGDYCVTEAGFGADLGAEKFLDIKCRMAGLKPDAVVIVATVRALKHHGGVPKTELSQENLPALEKGLPNLLQHVENITKVFGLPAVVAINRFPQDSEAELELIEKKCRELGVNVALSEVWAKGGEGGKALAEEVVRLCEQKNDFRFSYDLDMSIKDKLDAIAKKIYHADGVDLIQNAPKQLKQMESLGFDKMPI

SEQ ID NO: 57061 - protein, 267 aa, Camellia sinensis
MDPNLTEVSQLFERFKAAFMRNDFDTCDNLLSQLKVLLTKFRSLPPLFEETPKAIHELTLARDIYEHAVVLSVKIEDQDAFERDFFQLKPYYTDACGRLPPSPQEYPILGLNLLRLLVQNRIAEFHTELELLSATALENPCIKHAVELEQSFMEGAYNRVLSARQTVPHETYVYFMDLLAKTVRDEISGCSEKAYDSLSINDARKIEMFSSVQDLFEYIKEEHPEWEIKNGFVIFQRAKESAPCKEIPSLQLINQTLSYARELERIV

SEQ ID NO: 57062 - protein, 352 aa, uncultured bacterium
ITSANNLLAAILDNHIQQGNELNIDTRNIVWKRCMDMNDRVLRNIVVGLGNKSDGTVREDHFVITVASEIMAVLCLAEDLKDLKEKLGRIIVAYDYSGNPITAKDLKCVGSMAALLKDAIKPNIIQTLEHTPAIVHGGPFANIAHGCNSVRATRFALKMADYVITEAGFGADLGAEKFFDIKCRKAGLKPDCVVLVATIRALKYNGGVAKNDLSAENLDALKKGIVNLEKHIENLQKYKVPVIVTLNAFSSDTERETAFVKKFCEDRNCEFALSRVWESGGDGGIDLANAVLKTLSEKKSEFKPIYDDDLPLKEKIITVAKEIYGAKDVSFSKESEKMLSKLTDLGFAGLPV

SEQ ID NO: 57063 - protein, 204 aa, Synechococcus sp. CC9605
MDKNLALAEFAKTLAGVYDNIEQSQKDPKDFARINIFFRPLPWHIFEGPGFYSEQCYDYAPWDPYRQGIHRLTTHEDTFVVENYGFTNPRRLAGAGRDPQIMNAINSTTLKERCGCAMHFHRKEKGHYIGKVEPGKNCLVPRDGKLTYLVSEVEVDQENWISRDRGFDPNTDEQIWGSEHGLLRFKRTQSFSAEINEEWLNSKT

SEQ ID NO: 57064 - protein, 519 aa, Yarrowia lipolytica CLIB122
MLTNLTIVLITLLVTYTVLTRTALRIQRARKAKQMGATLPPRVNNGILGWYGLWLVIQNARSMKLPHTLGKRFANGPTWLTPVAGNEPINTIDPENVKAILATQFKDFCLGIRHRALSPSIGDGIFTLDGEGWTHSRALLRPQFSRQQISRVHSLERLMQILFKLIRKENGEYFDLQNLFFMFTLDSATEFLYGASVDTLADLLGEPVEGDHGGVGEEVRKAYQQSINNAQDISAIRTRLQGLYWIAGNIYQRNLYQKSNKGVKDFSQFFVDKALNTSKEKLKEMEDSDNYVFLYELVKSTRNPVVIRDQLINILVAGRDTTASLLSFTFYTLGRRPDVLKKLRAAILEDFGTSPDEITFESLKRCDYLRYVLNEVLRLYPSVPINARSATRDTTLPRGGGPDGKQPVFVYKGQMVAYCVYWMHRDKKYWGEDALEFNPDRWDPKVQPQNKGWEYLPFNGGPRICLGQQFALTEAGYVVTRMLQEFDTVHCKNQKEEEHPPYALDLTMRHGEGVWVSMK

SEQ ID NO: 57065 - protein, 531 aa, Yarrowia lipolytica CLIB122
MLQLFGVLVLALTTALLAQLAYNKYEYNRKVKQFGCGELTVAKNGFLGWKGIRAVLHVLKTKKGPAALKERIDAYGRTYVFHIGPAPVISTMEPENIKAMLATQFKDFSLGTRYRSLAPTLGDGIFTLDGHGWTHSRALLRPQFAREQVSRLDSLEAHFQILKMCVDKEMREKGNDPRGFDIQNLFFLFTLDSATEFLFGSSVDSLVDFLDDPSVRTGDHGGVDEAARKGFNNSFNHAQELCALRSRLHTLYWIVGSVVKKEPFERYNKEIKTFVDFFAAKALKARKEKDMSLMDNDQYIFMYELVKETTNPVTLRDQMLNILLAGRDTTASMLSWIYFRLARDPKLYAKLRSAILEDFGTTPEAITFESLKQCDYLRYVLNEALRLYPVVPINGRTATRDTTLPRGGGPDQSQPIFIPKGQTVSYSVYWTHRDPRFWGEDAEEFIPERWDPRNGNIGRGWEYLPFNGGPRICLGQQFALTEVGYVLSRLVQTYETLETCDHKPLPPLYNHALTMCHEEGVWVKMYKGEKA

SEQ ID NO: 57066 - protein, 113 aa, Yarrowia lipolytica CLIB122
MSHKQAGQPNNILFVKNLPYESTSDELYELFGRFGAVRQIRAGSEKDTRGTAFVVYEDIDDATEAVKTLSGFNYKNRYLVALFHSLEQMDKTAENLEARRAKLEELKKEHGLE

SEQ ID NO: 57067 - protein, 450 aa, Magnaporthe grisea 70-15
MATKSVLMLGSGFVTRPTLDVLTDSGIKVTVACRTLESAKKLSAGVQHSTPISLDVNDDAALDAEVAKHDLVISLIPYTFHATVIKSAIRQKKHVVTTSYVSPAMMELDQAAKDAGITVMNEIGLDPGIDHLYAIKTIEEVHAAGGKIKTFLSYCGGLPAPESSDNPLGYKFSWSSRGVLLALRNAASFYKDGKVTNVAGPELMATAKPYFIYPGFAFVAYPNRDSTPYKERYQIPEADNIVRGTLRYQGFPQFIKVLVDIGFLSDEEQPFLKEAIPWKEATQKIVKASSASEQDIVSTIVSNATFESTEEQKRIVAGLKWLGIFSDKKITPRGNALDTLCATLEEKMQFEEGERDLVMLQHKFEIENKDGSRETRTSSLCEYGAPIGSGGYSAMAKLVGVPCAVAVKFVLDGTISDRGVLAPMNSKINDPLMKELKEKYGIECKEKVVA

SEQ ID NO: 57068 - protein, 228 aa, Magnaporthe grisea 70-15
MSHCHDEHGGDDHHHHHGEDGHDHSDDLTPALQNSLYTRIEFDKIVTLNEDAHNSGLAVVKKTWAERLTPTPELASDADEQLLMHVPFTGQVKLHSILVRTSDSDSAPRTLRVFANRPESFDFSAAESETPLQEIELSRTSAVQELNVKRAKFGGVARLSLFFVDNFGDGDEDVTRLSYLGFKGEWMPLGRAPANILYEAAANPSDHALKGTSVNAMGSGIGGRGPGA

SEQ ID NO: 57069 - protein, 591 aa, Magnaporthe grisea 70-15
MPSKFAHLPLSTSGPLDCALSGTAILNHPFFNKGSAFTAAERRDFGLLGLLPQNIQTLEQQANRAYAQYSSRPDDLAKNTFLTSLKEQNEVLFYRLLHDNLPEMFGVVYTPTEGDAIQNYSRLFRRPEGCFLNVNDVDRVREDLQRWGRPEDVDYIVVSDGEEILGIGDQGCGGILISIAKLVLTTLCAGLHPNRTLPVVLDCGTDNQGLLDDPLYLGLRERRVRGEKYDSLVREFVAAARDLFPRAVIHFEDFGVTNARRILDTYRPRAPVFNDDVQGTGCVVLAAIMAGMHVAGLKIQDLRMVVFGAGSAGTGIADMVRDAIAEESGCGKDCAAEQIWLVDKPGLLTTATQNDTAQTPYAKKPWGEGHGTDLLAVVDEVRPNVLIGTSTVPGAFTEEIVRAMAKHAPRPIIMPLSNPTRLHEAVPADLMAWTDGKALVATGSPFAPVKLDGGREVEIAECNNSVVFPGIALGSVLSRARLVTDSMLVGAVKAVAAMSPALKDPAGSLLPGVDEVRNVSVAVASGVIRAAVQEGVATEEGIPRGKDDGDLEEWVREQMWNPVYRELRKVGGGDATREAKGELKQAGTLEG

SEQ ID NO: 57070 - protein, 768 aa, Aspergillus oryzae
MKEKETEPTVAVTTGAAIDEAAPDVAISHLKQLKKEHEWDPNLPEDLIDNSPYPEVRAAVPNYDEGGHTNTIRAWVIGLVLSTVASGMNMLFSLRQPYIVIPSYVVQVVAYPIGVGWAMLLPNKTFNVFGLKFNLNPGPFSKKEHAIAVLMANASFGGGTAYATDILVAQRAFYKQRFGWGFELLLCICTQMLGFGFAGFFHRFLVAPAAMIWPSTLINTSIFSALHDRSLPDPRKVAGWTIGRYRMFLYCLVGSFVWYWFPGYIAPFLSVFAWVTWIKPQSPVVNQLFGGWTGLSLLPITFDWTQISGFNFSPLISPWHAHANTLIGMVVFYWICTIGLHYNNAYWFKHLPISDSSSYDNTGSVYDVSRILTPEFTFDDAKYKEYSPLFLSTTFALCYGLSFAGVIAVLLHAILFHGKEVLARVKTFRKTEDDVHARLMARFKPVPLWWYGALFLTMLGIGLGVSLGYPTHLSWWAFFVSLIMAIVWTLPVGIVQAATNIQLGLNVLTEFVIGYMQPGRPMAMMLFKTFGYISMSQGLYFCQDMKLGHYMKIPPRVTFAAQMVATLWTSIVQIAVMNWALGSIDGICDKDQPNHYSCPNGRVFFNASVIWGVIGPARMFSPGQLYSGLMWFWLAGAILPVLIYLGARIWPRSKIRYLSAPLIFTGAGLIPPATPLNYLSWGIVGFIFNKWIRSRWRGWWMQYNYVLSAGLDVGLTLSTIVIFLCLQLTDTTFPSWWGTRIATDTMDAAGTAVEITGEKFGPTTWPSG

SEQ ID NO: 57071 - protein, 1273 aa, Bordetella pertussis Tohama I
MASTTLGVKVDDALRDRLKAAAQKLNCTPHWLHKQAILSYLDRIERGHLPAEMAHLGRDERGEDEDAGASADAMPPFFEFGQDVQPQSVLRAAITAAYRRPEPECVPLLLGQARVAGPEKVHAMASKLVHALWAKRSGGGVEGLIQEFSLSSQEGVALMCLAEALLRIPDRATRDALIRDKIVHGDWRSHMGGSQSLFVNAATWGLMITGKLVAVSSEQSLSKALTRLIGKGGEPLVRKGVNMAMRMMGEQFVSGQTISEALANNRKMEARGFRYSYDMLGEAATTAADAERYYAAYEQAIHAIGKAAAGRGIYEGPGISIKLSALHPRYARAQRDRVMAELLPRVKALTLLARQYDIGLNIDAEEADRLEISLDLLEALCFVPELDDWNGIGFVIQAYQKRAPFVIDYVIDLAKRSRHRLMVRLVKGAYWDTEIKRAQVDGLEGYPVYTRKVYTDVAYLACARRLLAAPEATYPQFATHNAYTLSAIYQMAGQNYYPGQYEFQCLHGMGEPLYEEVVGPLAQGKLNRPCRIYAPVGTHETLLAYLVRRLLENGANTSFVNLIGDDSITVEQLVADPVEAASRIVPLGAPHEKIPLPRELYGSVQQGARANSAGLDLTNEHRLGSLSAALLASAATDWRAWPMLGEGDPGWDPASAVEVANPANLRDIVGHVMQATPQHVEQALRDAANAAPIWQSTPVPERAQCLRRAAQLLEEQMQTLLGLIVREAGKSLPNAIAEVREAVDFLRYYADQAEREFDNDTHRPLGQVLCISPWNFPLAIFTGQVAAALAAGNTVLAKPAEQTSLIAGQAVAILRAAGVPAGAVQLLPGRGETVGAQLVASPQVRGVMFTGSTEVARIIAGALAERLDDQGHTIPLIAETGGQNAMVIDSSALAEQVVFDVLTSAFDSAGQRCSALRVLCLQEDSADHVLTMLRGAMRELRVGNPDRLSVDVGPVIDAEARNGIQGHIEAMRSSGRPVDQVELAGECRYGTFVPPTLIEIDHIGELTREVFGPVLHVLRYRRDDLDGLIEQINATGYGLTFGVHTRIDETIARVTEQVHAGNLYVNRNIVGAVVGVQPFGGEGLSGTGPKAGGPLYMYRLLATRPAGLPPALDPAAPMPQALALPGPTGETNTYRVEPRGAVYCVAATEAGARAQWAVVSQTGNHAWFADTPAARAWIDGLDARLREQAALLEDSEFDEADFQAVLFEGDGDALRALNMRIAQRPGPLVSVHGLSADALAAGASYAPDRLLAERSISVNTAAAGGNASLMTIG

SEQ ID NO: 57072 - protein, 586 aa, Oryza sativa
MERVLKSARESGSLNLSNRSLREVPKEVYNNLDTGAQDEKWWEGVDLQKLILAHNNLEVLREDLRNLSSLVVLNISHNNISSLPAAIGDLPLLKSLDVSSNQINALPEEIGFATALVKVDCSNNCLTDLPVSLARCLELSELNASNNTISVLPDELAGCSKLFRLNLEGNKLVTLSDKMFMSWTMLTEMNAAKNLLTAIPDGIGALSKLIRLDLHQNKITLIPPSIKDCSSLAEFYMGNNLLTFIPEDIGMLSNLGILDLHSNQLKEYPVGACRLKLSFLDLSNNSLSGLPAELGTMTTLRKLLLTGNPMRTLRSFLVSGPTTALLKYLRSRLSSDEGASGSGSTPTKDDQIAAARRLSLSSKELDLSGLGVTSVPPAAWETNDVMKLDLSKNSIEDLPNELSLCSSLQSLILSNNKIKRWPGTVFSSLASLSLLKLDNNPLAEILATDLEALSKLEVLDLSGSASSLPEPSAVSKLPHLKELYLRRMKLHGFPDSLLGLKLLRILDLSQNYLTSVPEGIKDLTSLIELDLSDNNITTLPPELGLLEPNLQVLKLDGNPLRSIRRTLLERGTKAILKYLKEKLPAE

SEQ ID NO: 57073 - protein, 151 aa, Emericella nidulans
MSTSARRRLMRDFKRMQTDPPAGVSASPVADNVMTWNAVIIGPADTPFEDGTFRLVMHFEEQYPNKPPGVKFISQMFHPNVYGTGELCLDILQNRWSPTYDVAAILTSIQSLLNDPNTSSPANVEASNLYRDNRKEYIKRVRETVEKSWEE

SEQ ID NO: 57074 - protein, 444 aa, Silicibacter sp. TM1040
MTDFTFTRRDFPGDFLFGCATSSYQIEGHQYGGAGPTHWDSFAATPGNVVRSEDGARACDHYHRFEEDLDLAAAAGFECYRFSTSWARVLPEGRGTPNAEGLDFYDRLTDAMLERGLKPCATLYHWELPQPLADMGGWRNRDVSNWFAEFTEVIMSRIGDRMYSVAPINEPWCVGWLSHFLGHHAPGLRDIRATARAMHHVLLSHGRAIEVMRGLGMNNLGAVFNFEWAEPLDQSAQAQAAAETYDAIYNRFFLGGVFKGAYPEAALRGLEPHLPQGWQDDFATITQKVDWCGLNYYTRKVIGPDNGPWPHYAELVGELPTTQMGWEIYPDGLYKFLKRTAEDYTGGLPLIVTENGMANPDVLLEGEVPDAARIAYVEAHLARVRQAIAEGVPVKGYFLWSLLDNYEWALGYEKRFGLVHVDFETLKRTPKASYRALQRALTAS

SEQ ID NO: 57075 - protein, 589 aa, Schizosaccharomyces pombe 972h-
MLLSVRGVPVEIPSLKDTKKSKGIIRSGWVMLKEDKMKYLPWTKKWLVLSSNSLSIYKGSKSESAQVTLLLKDIQKVERSKSRTFCFKLRFKSSTKNFEIQACELSVADNMECYEWMDLISSRALASKVSSPMNPKHQVHVGIDNEGNYVGLPKEWILLLQSSSITKQECMEEPKAVIQALDFYSKQLDTTSETKDSFSFCKETLPRSSTTSYSIRDADKHHKLTTSGVTKMNITERCKPKTTIQTDKKHIIRPFIEDKSHVESIMTGKVTKVPVKADSKNTLSRRMTDRQALAMLKDSVTSHDPVEYFNVKHKLGQGASGSVYLAKVVGGKQLGIFDSVAIKSIDLQCQTRKELILNEITVMRESIHPNIVTYLDSFLVRERHLWVVMEYMNAGSLTDIIEKSKLTEAQIARICLETCKGIQHLHARNIIHRDIKSDNVLLDNSGNIKITDFGFCARLSNRTNKRVTMVGTPYWMAPEVVKQNEYGTKVDIWSLGIMIIEMIENEPPYLREDPIRALYLIAKNGTPTLKKPNLVSKNLKSFLNSCLTIDTIFRATAAELLTHSFLNQACPTEDLKSIIFSRKANTHIN

SEQ ID NO: 57076 - protein, 241 aa, Oryza sativa (japonica cultivar-group)
MGKGKVHPSPSPAAGAGEETAEAVLMRLLPAAVVAMAAGLGAEGKEVLAYLVLASMRSSSAARWGQAEVGKGGGGGGSGRVGHHAPELGCGCFGCYTAYWSRWDGSPERDRDAIHRAIEAFEDHLSRKEEEEVVGGGKGASSRRRKKRSGKDKAKAKVPPAASAGQPPPPPPNQEETSAAAAAASPPKSILDGEEEEEEEMKNTAAAAVAGAGDGGVVEEERRRRGWGVLSWKVWNLWGSH

SEQ ID NO: 57077 - protein, 490 aa, Schizosaccharomyces pombe 972h-
MSIAICGGGIAGLSTAFYLARLIPKCTIDLYEKGPRLGGWLQSVKIPCADSPTGTVLFEQGPRTLRPAGVAGLANLDLISKLGIEDKLLRISSNSPSAKNRYIYYPDRLNEIPSSILGSIKSIMQPALRPMPLAMMLEPFRKSKRDSTDESVGSFMRRRFGKNVTDRVMSAMINGIYAGDLNDLSMHSSMFGFLAKIEKKYGNITLGLIRALLAREILSPAEKALKAALLAEPKTAELSNSMKSTSMFAFKEGIETITLSIADELKKMPNVKIHLNKPAKTLVPHKTQSLVDVNGQAYEYVVFANSSRNLENLISCPKMETPTSSVYVVNVYYKDPNVLPIRGFGLLIPSCTPNNPNHVLGIVFDSEQNNPENGSKVTVMMGGSAYTKNTSLIPTNPEEAVNNALKALQHTLKISSKPTLTNATLQQNCIPQYRVGHQDNLNSLKSWIEKNMGGRILLTGSWYNGVSIGDCIMNGHSTARKLASLMNSSS

SEQ ID NO: 57078 - protein, 109 aa, Rubrobacter xylanophilus DSM 9941
MITSEDIRERGVPDFKPGDTIRVEYRVVEGNRERTQAFEGLCIARRGSGISQTFVVRKNSFGVDVERIFPLHSPKIAGIKVISRGAPRRAKLYYIREKVGRKARVKKAR

SEQ ID NO: 57079 - protein, 357 aa, uncultured bacterium
VTSAHNTISALLDNYLYQHRKDGFSLREIFWKRVLDVNDRALRNVVTGLRGDGVVSETGFDITPASELMAILCLATSEEDLQRRIENIVLGITADGKLFKVKDLGVAGAITVLLRDALSPNLVQTTEHTPAFVHGGPFANIAHGCSSVVATKMAMSYCDYVVTEAGFGADLGAEKFFDIKCRKTGLQPRLVVIVATTQGLKMHGGVDLEQINEPNKKGLTEGLKNLNRHIRNMQGFGQPVVVTLNRHDTDLEEEIDIVRKNCEDLDVGFAVNEAFLRGGEGATELAQTVIDTIERQQPLPIHFTYKEADCLEDKIEKVCKRIYGASAVEYSKTAKKKLEALRATLPMKTGPLPTYPV

SEQ ID NO: 57080 - protein, 351 aa, uncultured bacterium
ITSVHNLLAALLDNHIQQGNVKRIDSRSVVWKRCMDMNDRALRNIVVGLGSKSDGFVREDHFVITVASEIMAVLCLAEDLKDLKRRLGRIIVAYDLDGNPVTAEDIQAVGAMTALLKDAIRPNIIQTLEHTPAIVHGGPFANIAHGCNSVIATRTALKLADYCITEAGFGADLGAEKFLDIKCRQAGLTPSAVVLVATVRALKYNGGIPKDQLGTENLDALGKGIENLGKHIENIQSYGLPVVVALNAFVSDTDAEIEFVKEYCASKNCTMSVARVWEKGGEGGTELAELVIKATEEKSDFKFCYPDELSITGKIEAVAKKIYGADGVDIASSAAKQIAKIEEMGFGNLPV

SEQ ID NO: 57081 - protein, 133 aa, Glycine max
RVSLQHTLSCRQNLPPTTHSHGRLKHSFSLSFPSQNLQPLLKPKRVIPKAFFSAPQIQSHHKTRALRAVLSQNAVKTSVEDTKNAHFQHCFTKSEDGYLYCEGLKVHDIMESVERRPFLVNECMTLVVLFLPF

SEQ ID NO: 57082 - protein, 170 aa, Mycoplasma pulmonis UAB CTIP
MNLEKFIKDVKDFPKQGINFKDISPLLANGQALNYTIKKMAELAKDADIIVGPDARGFLFGTPTAAFLSKPFIMVRKKGKLPGEVIKHEYDLEYGKDILEIQKGVIKPGDKAIIIDDVLATGGTTKAIIDLLESQGAKVIKIILLLELTNLNGRSKFGSLQVESLVKVSV

SEQ ID NO: 57083 - protein, 352 aa, uncultured bacterium
IGAANNLLAAMLDNHIQQGNSLGIDVKQITWKRAVDMNDRQLRRIVDGLGGRAQGVPREDGFEITVASEIMAVLCLASDLKDLKGRLARIIVGYTYDGKPVTAHDLKAEGAMTALLKDAIKPNLVQTLEGTPAFVHGGPFANIAHGCNSVIATHTALKLADYVITEAGFAADLGAEKFLDIKCRVSDLHPSAVVIVATVRALKYHGGIPKAELNAENLEALEKGLPNLLQHVSNIKNVFGLPCVVAINAFPTDTEAELKLVEKKCREQGVNVALSEVWAKGGEGGIALAEEVVRLCEQPNSFTFSYPLEMSIEEKLETICKKIYHADGVTLDANARKQAEQLTALGFDKLPI

SEQ ID NO: 57084 - protein, 353 aa, uncultured bacterium
IGAANNLLADMLDNHIQQGNALGIDVKKITWKRCVDMNDRQLRFVVDGLGGKANGTPREDGFDITVASEIMAVFCLASSMKDLKERLSRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVIVGTVRALKMHAGLDKKQLVNEDLAALEKGIPNLLRHVNNIKNVYKLPCVVAINRFPTDTDAEIDFIIRKCRELGVNTVLSTVWAEGGKGGEDLAREVVRLCEEEKGNFTFSYELDASIEEKLEAVTKKIYGGAGVALTPNAKKQAERLTELGFDKMPV

SEQ ID NO: 57085 - protein, 353 aa, uncultured bacterium
IGAANNLLAAMLDNHIQQGNALGIDVKKITWKRCVDMNDRQLRFVVDGLGGRMNGTPREDGFDITVASEIMAVFCLASSMADLKERLSRIIVAYTYDDQPVTAGDLKATGAMAALLRDALKPNLVQTLEGTPAFVHGGPFANIAHGCNSVMATRVAMRMGDYTVTEAGFGADLGAEKFLDIKCRMAGLTPDAVVVVGTVRALKMHGGLDKKQLANEDLAALEKGIPNLLRHVNNIRNVYQLPCVVAINRFPTDTDAEIDFIVRKCRELGVNTILSTVWAEGGKGGEDLAREVVRLCEEEKGNFTFSYELDASIEEKLEAVTKKIYGGSGIALTPAAKKQAERLTALGFDKMPV

SEQ ID NO: 57086 - protein, 528 aa, Oryza sativa (japonica cultivar-group)
MASVETWVGFGSALAGVGLLWSRMPEHVHDEARYIISSLVPMAISYFNPYEQITVSEYGEERFRRNKMFDAVSTYLSRVCAGGACKLKAELCNNGRDDPIVTLDENQEVVDSFDGARMWWRLCPKASKNKGAITVTYYPGEADKPRCFKLVFHKRHRQLVLNSYLPSVVRRWRELTAMNRQRRLFTNHANEAKKSVWTSVPYNPPATFDMLAMDHAKKVEIVDDLTTFQKGKEYHSKVGKAWKRGYLLHGPPGTGKSTMIGAMANFLDYDVYDLDLTSVKNNSELRKLFLDTTDKSIIVIEDIDAIEVELTTKRKGKKAANGDEIHDKRMLIEFSDKNDEKSKVTLSGLLSFVDGLWSACGSERIFMFTTNHIDRLDPALIRPGRMDKHIEMSYCRFEAFKVLAKSYLDITEHSLFAEIERLLDDTDTTPADVANNLMLRSKRNGEISRLLDEIDGAPRADVAKWCKRKRDTDECLAGFVEILKKSKMESATTPMDSMEEAKEERPNAKESYKMGRIYDENYRLGNAS

SEQ ID NO: 57087 - protein, 153 aa, Streptococcus pyogenes
PMAYVLWNHFMNINPKTSRNWSNRDRFILSAGHGSAMLYSLLHLAGYDLSVEDLKNFRQWGSKTPGHPEVNHTDGVAATTGPLGQGIANAVGMAMAEAHLAAKFNKPGFDIVDHYTFALNGDGDLMEGVSQEAASMAGHLKLGKLVLLYDSND

SEQ ID NO: 57088 - protein, 376 aa, Vibrio vulnificus YJ016
MTQDKFIKSRAAVAWGPKQPLSIEEVDVMLPRKGEVLVRIVATGVCHTDAFTLSGDDPEGVFPAILGHEGGGIVEMVGEGVTSVSVGDHVIPLYTAECGQCKFCLSGKTNLCQAVRETQGKGLMPDGTTRFYKDGKPIFHYMGCSTFSEYTVLPEISLAKVNKEAPLEEICLLGCGVTTGMGAVINTAKVKQGDTVAIFGLGGIGLSAIIGARMAGASRIIAVDINDRKFELAKQLGATDCINPKEHDQPIQEVIIEMTDGGVDFSFECIGNVNVMRQALECCHKGWGESVIIGVAGAGQEISTRPFQLVTGRVWRGSAFGGVKGRSQLPAIVEQYLAGEFGLQEFITHTMPLEGINDAFELMHSGESIRSVVHFE

SEQ ID NO: 57089 - protein, 1188 aa, Pisum sativum
MKPLYSTNTLLLLLALFLLHLGPSHSSSSSSSSTSSSQLLYFKQSLPNPSLLHDWLPYKNPCSFTGITCNQTTVTSIDLTSIPLNTNLTVVATYLLTLDHLQVLTLKSSNITSSPISLSHTKCTSSLTTIDLSQNTISSSFSDLAFLSSCSGLKSLNLSNNQLDFDSPKWTLSSSLRLLDVSDNKISGPGFFPWILNHELEFLSLRGNKVTGETDFSGYTTLRYLDISSNNFTVSIPSFGDCSSLQHLDISANKYFGDITRTLSPCKNLLHLNLSGNQFTGPVPSLPSGSLQFLYLAENHFAGKIPARLADLCSTLVELDLSSNNLTGPVPREFGACTSVTSFDISSNKFAGELPMEVLTEMNSLKELTVAFNEFAGPLPESLSKLTGLESLDLSSNNFSGTIPRWLCGEESGNNLKGLYLQNNVFTGFIPPTLSNCSNLVALDLSFNYLTGTIPPSLGSLSKLRDLIMWLNQLHGEIPQELSNMESLENLILDFNELSGTIPSGLVNCTKLNWISLSNNRLTGEIPSWIGKLSNLAILKLSNNSFSGRIPPELGDCPSLIWLDLNTNFLTGPIPPELGKQSGKVVVNFISGKTYVYIKNDGSKECHGAGSLLEFAGINQEQLRRISTRNPCNFTRVYGGKLQPTFTLNGSMIFLDVSHNMLSGTIPKEIGEMTYLYVLHLSHNNLSGSIPQELGKMKNLNILDLSYNKLQDQIPQTLTRLSLLTEIDFSNNCLSGMIPESGQFDTFPVGKFLNNSGLCGVPLPPCGSDSGGGAGSQHRSHRRQASLAGSVAMGLLFSLFCVFGLIIIAIETRKRRKKKEAAIDGYIDNSHSGNANNSGWKLTSAREALSINLATFEKPLRKLTFADLLAATNGFHNDSLIGSGGFGDVYKAQLKDGSVVAIKKLIHVSGQGDREFTAEMETIGKIKHRNLVPLLGYCKVGEERLLVYEYMKYGSLEDVLHDPKKAGIKMNWSVRRKIAIGAARGLAFLHHNCIPHIIHRDMKSSNVLLDENLEARVSDFGMARLMSAMDTHLSVSTLAGTPGYVPPEYYQSFRCSTKGDVYSYGVVLLELLTGKRPTDSADFGDNNLVGWVKQHAKLKISDVFDKELMKEDPNLEIELLQHLKVACACLDDRPWRRPTMIQVMAKFKEIQAGSGMDSQSTIATEDEGFNAIEMVEMSIKEVPELIKH

SEQ ID NO: 57090 - protein, 396 aa, Brucella abortus
MMFRTLDDANVQSKRVLVRVDLNVPMANGEVTDLTRIERIVPTIAELSRKGAKVILLAHFGRPKGVASDENSLKHVVKPLSKVLDHSVHFAEDCIGDKAKPAVDALKDGDVLLLENTRFHKGEEKNDPEFVQALAANGDLYVNDAFSAAHRAHASTEGLANVLPAFAGRAMQAELEALEKGLGNPARPVVAIVGGAKVSTKLDLLSNLIEKVDALVIGGGMANTFLAAKGLDVGKSLCEHELASTAREIMAKAETTKCAIILPVDAVVGWHFAADTPHQTYGVDSVPGDAMILDAGELSTDLIASAIDDAATLVWNGPLGAFELSPFDTATVKVARHVAKRTKEGKLVSVGGGGDTVAALNHAGVADDFTYISTAGGAFLEWMEGKPLPGVDVLKK

SEQ ID NO: 57091 - protein, 46 aa, Cicer arietinum
GRGRGSGGGRGGGRGGGRGGGRDQKVSAEDLDAELERYHAEAMQIN

SEQ ID NO: 57092 - protein, 319 aa, Staphylococcus aureus subsp. aureus Mu50
MRRLFSIGEALIDFIPNVTNANLKDVQTFTKQIGGAPCNVSCTVQKLGQQAYMITQLGNDAFGDSIIETISSIGVDVSKVYRTNEANTALAFVSLTEAGERDFSFYRKPSADMLFEPSFVNDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 57093 - protein, 118 aa, Synechococcus sp. WH 5701
MLASLMRRLLSFFAVCLALLLGAAPSFAADAAHGGQIFSANCAACHMGGGNVVNAERTLKADALTAYLANYSSDHEAAIAAQVTVGKNAMPAFLGKLTETDIADVSAYVEEMAAKGWA

SEQ ID NO: 57094 - protein, 225 aa, Oryza sativa (indica cultivar-group)
MTSIVVINALETRKRPSTDFMETIQKDVNPSMRAILIDWLVEVAEEYRLVPDTLYLTVNYIDRYLSGNEINRQRLQLLGIACMLIAAKYEEICAPQVEEFCYITDNTYFRDEDPALHLEFLANYVAELSLLEYNLLSYPPSLVAASAIFLAKFILQPTKHPWNSTLAHYTQYKSSELSDCVKALHRLFSVGPGSNLPAIREKYTQHKILHAADVIDLNMVIQREA

SEQ ID NO: 57095 - protein, 120 aa, Pisum sativum
MAGSSEEGQVISCHSVDAWNDILHRGNESKKLIVVDFTASWCGPCRFIAPFLGELAKKFTNVIFLKVDVDELKSVAQDWAVEAMPTFVFVKEGTILGKVVGAKKEELQQTIERHVASSNA

SEQ ID NO: 57096 - protein, 495 aa, Silicibacter sp. TM1040
MTDWKAAASALYDGGFRPMFINGKWCESQSGEVIEARNPASGALLATVPKGGAADVDAAVAAARAAFEGPWSKWTPFERQALLLRIADRFEAEWETLCLSDTLDMGMPIQRTLANSRRVLGMLRFYAGQAVTIHGHTIPNSFPGEIHSSTVREPVGVVGAIIPWNAPIAGSIWKIAPAIATGCTVVLKPSEEASLTVLMIARIMQEAGLPDGVLNIVTGYGAAAGAALAAHSGVDKIVFTGSTATGQAIARAATGNLKRVSLELGGKSPVIVCRDADIEKAVPVAAMAVFANSGQICIAGSRLFVAREIHDEFVRRVAEFAANLRIGHGIEESTDVGPIISARQAERIAGYLAAGPSEGAEILTGGARVKGAGFEGGHFIEPTVFGGVTDEMSIAREEIFGPVISALPFDSLDEVVERANATPYGLAAGVFSTHLGTAHKLAHRLKAGSVWVNMYHAIDPAVPFGGVKMSGYGREGGTEHMEEYLDTKAIWINTD

SEQ ID NO: 57097 - protein, 530 aa, Zea mays
  misc_feature (484)..(484): Xaa can be any naturally occurring amino acid
  unsure (1)..(530): unsure at all Xaa locations
MDAAATAVSSSGDAPVLLLALAVSLLLLAAAVWSSRRRGQGHGNGNGAPSPPSRPLLGHLHLLGKPLHRSLAALAAAHGAGGQLAPLLSLRLGARRALVVSERGVAEECFTAHDAALAGRPRVLAGDRLGYGYTMLVWASHGDHWRALRRLLAAEIFSAARVAARAADRRSEVAALVTSLAALHLHCGGGAVSLRPRLFELVLGVMLRALTGERAHGGDVRTFQGIVEETFAVSGAPSVGDFFPALRWVDRLRGVDAALVRLQARRDAFVGGLVQDQRRRRRDAGDGRGRHAAEKQSIVDELLSLQETDPEYYTDTIIKGVVLMLLTAGTDTSALTTEWAMALLLTHPEAMRKARAEIETSVGTARLVEESDIANLPYLQCVVKETLRLRPVGPVIPAHEAMEDCTVGGFHVERGTMVLVNAWAIHQDPKLWDAPEEFRPERFLDAAGTVTAVTTPMLPFGLGRRRCPGEGLALRLISLTLASXVQCFEWDVGEGGVVDMTEGVGLTMPMAMPLAAVCRPREFVKSMLST

SEQ ID NO: 57098 - protein, 151 aa, Schizosaccharomyces pombe 972h-
MSTTARRRLMRDFKRMQQDPPAGVSASPVSDNVMLWNAVIIGPADTPFEDGTFKLVLSFDEQYPNKPPLVKFVSTMFHPNVYANGELCLDILQNRWSPTYDVAAILTSIQSLLNDPNNASPANAEAAQLHRENKKEYVRRVRKTVEDSWES

SEQ ID NO: 57099 - protein, 227 aa, Oryza sativa
  misc_feature (70)..(70): Xaa can be any naturally occurring amino acid
  misc_feature (84)..(84): Xaa can be any naturally occurring amino acid
  unsure (1)..(227): unsure at all Xaa locations
SFSGRQTSGSWTKLRKPYELGACPAFGKKTGAFRETERDHCREWNTKRQEKGEPTYDNNIFEDLVSRFEXPDRPIRWDSPLFEXFPSRDGVMESSPVIAEAVSYLTKKVDSKTRDVKVLQPTIATQTARTTEANSLYEMDKATQEVINAIVEAQSCGLGLPVNKISLGPDLPTICLQRSVGLPELRSLRRTFIKLAGQYSLSGPPPPADADSATRMFVDYLNREISS

SEQ ID NO: 57100 - protein, 375 aa, Agrobacterium tumefaciens str. C58
MDVRAAVAIQAGKPLEVMTVQLEGPRAGEVLIEVKATGICHTDDFTLSGADPEGLFPAILGHEGAGIVVDVGPGVTSVKKGDHVIPLYTPECRECYSCTSRKTNLCTSIRATQGQGVMPDGTSRFSIGKDKIHHYMGCSTFSNFTVLPEIALAKINPDAPFDKVCYIGCGVTTGIGAVINTAKVEIGSTAIVFGLGGIGLNVLQGLRLAGADMIIGVDINNDRKAWGEKFGMTHFVNPKEVGDDIVPYLVNMTKRNGDLIGGADYTFDCTGNTKVMRQALEASHRGWGKSVIIGVAGAGQEISTRPFQLVTGRNWMGTAFGGARGRTDVPKIVDWYMEGKIQIDPMITHTMPLEDINKGFELMHKGESIRGVVVY

SEQ ID NO: 57101 - protein, 352 aa, uncultured bacterium
IGAANNLLAAMLDNHIQQGNSLGIDPKQITWRRAVDMNDRQLRNIVDGLGGKAQGVPREDGFDITVASEVMAVLCLATDIIDLKKRLGNIVVGYTCGGKPVTAHDLKAEGAMTALLKDALKPNLVQTLEHTPAFVHCGPFANIAHGCNSVTATRMALKLADYIVTEAGFAADLGAEKFFDIMCRAADLHPSAVVVVATVRALKYHGGVPKEDLNKENLEALEAGLPNLLQHVSNIKDVFGLPCVVAINAFSADTKAELDLVEEKCRELGVNVALSEVWAKGGEGGTALAEEVVRLCELPNDFKPAYELDGTIEDKISAIAHRIYHAKHAMLLPAAKKKAQRLEELGFGGLPV

SEQ ID NO: 57102 - protein, 356 aa, Prochlorococcus marinus subsp. marinus str. CCMP1375
MQTVLSLETSCDESAAALVKFNEGKFEILANSIASQANEHAKWGGVVPEIASRRHLESLPFLIQEVFSQSGINFSDVNAIAATVAPGLSGALLVGSVTARTLSCLHDLPFLGIHHLEGHLCSALLSENPPVPPYLVLLVSGGHTELIQVDRNFTYKRVGRSHDDAAGEAFDKVARLLGLSYPGGPAIEKFAKKGDPASFHFPKGRVSKPEGGFYPYDFSFSGLKTAVLRKVESIRSEGKQIPLANLAASFENVVSEVLVERSVKYAFDHGLHSLVMVGGVAANTCLRKMMVSKAEDKAIDVYMAPKAFCTDNAAMIGTAALVRLISGTSPSSLELGVSARFELDQSDLLYKSEPPF

SEQ ID NO: 57103 - protein, 352 aa, uncultured bacterium
IGAANNLLAAMLDNHIQQGNSLGIDPKAITWKRAVDMNDRQLRHIVDGLGGKAQGVPREDGFDITVASEIMAVLCLAADLKDLKARLARIIVGYTYDGKPVTAHDLKAEGAMTALLKDAIKPNLVQTLEGTPAFVHGGPFANIAHGCNSVTATHTALKLADYVVTEAGFAADLGAEKFLDIKCRLSDLHPDAVVIVATVRALKYHGGVPRSELSAENLDALEKGLPNLLQHVGNIKDVFGLPCVVAINAFPTDTEAELKLVEARCRELGVNVALSEVWEKGGKGGIALAEEVVRLCDQPNDFRFAYPLDISIEEKLETICRRIYHADGVLLEAGAKKQAQQLTELGFDRLPI

SEQ ID NO: 57104 - protein, 440 aa, Agrobacterium tumefaciens str. C58
MARWITARWCANGRTMAPTDKSQNHGPALAAGLFDISENDLLIGGLSVRDIVAETGTPCFLYDNSAMRQAYRDLETALSGFADIYYSVKANPLPAIISLFREEGAGAEIASVGEYRAAVKAGVAPDNIIFAGPGKSMAELREVIEGGIGEIHIESAEEIARIEAINRPVKASIRINPVPDAQAGAMRMGGKATAFGFDEEELENVLKLFANVRHIDLVGIHIYGGTQILDADMLVSQWRHAIALAGRMAQMLGKPLETIDLGGGLGIPYFAGETSLDLAKVAAAIPDLKALLKAHPLIADAHVIVEPGRFLAGPGGLYVVEVNSVKTSRGTTFVVTDGGMHHHLAASGNLGQIVKRNYPIVAPAMMQAAHDETATIVGPLCTPLDTLARNATLPKLNAGDLLAILQSGAYGASASPGGFLSHTVAKEVLVEDGAFEVIGR

SEQ ID NO: 57105 - protein, 724 aa, Pseudomonas putida
MANSEVRSVCPYCGVGCGIVMSVADGKVGKISGDKLHPSNFGRLCTKGLTAHQPLSASGRMADAYLRQQRSQPPVRTSMDQAIAATAERLRGIIDQHGPDAVALYVSGQMSLEAQYLANKLAKGFIRTRHIESNSRLCMASASSGYKLSLGADGPPGSYQDFEHADVFLVIGANMADCHPILFLRLLDRVKAGAKLIVVDPRRSATADKADLFLQVRPGSDMALLNGLLHLLHRNGHTNPDFIARHTEGWDEMPAFLDDYTPERVAAITGLAEADIIKAAEWIGSANNWMSCWTMGLNQSIHGTWHSNAICNLHLATGAICRPGSGPFSLTGQPNAMGGRDMGYMGPGLPGQRSALVEDDRAFVERQWQLPPGSLRSEGGEGTVALFGQMKAGEVKACWVICSNPVASVANRQQVIDGLRKAELVITQDAFLDTETNRYADILLPAALWAEGEGVMINSERNLTLMPRAVEPPGQSLPDWQIIARVACAMGYADAFDYPNAEAVYEEIRRFHNPSTGYDLRGIGYAELRTQPRQWPCAPGSEQHRSPLRYLNDGSSQALLLDARGRRPALAFPTASGKAHFFARPWLPAAEVPDDDYPMVLNTGRVQHQWHTLTKTGKVPALNKLEPGPYLEIHPEDAARLGVAEKDQVAVRSRRGQAVLPARISDRVMPGNCFAPFHWNDLIGEQLAINAATCDAVDPLSLQPAFKHCAVALERVAGERIDAL

SEQ ID NO: 57106 - protein, 153 aa, Streptococcus pyogenes
PMAYVLWNHFMNINPKTSRNWSNRDRFILSAGHGSAMLYSLLHLAGYDLSVEDLKNFRQWGSKTPGHPEVNHTDGVEATTGPLGQGIANAVGMAMAEAHLAAEFNKPGFDIVDHYTFALNGDGDLMEGVSQEAASMAGHLKLGKLVLLYDSND

SEQ ID NO: 57107 - protein, 153 aa, Streptococcus pyogenes
PMAYVLWNHFMNINPKTSRNWSNRDRFILSAGHGSAMLYSLLHLAGYDLTVEDLKNFRQWGSKTPGHPEVNHTGGVEATTGPLGQGIANAVGMAMAEAHLAAKFNKPGFDIVDHYTFALNGDGDLMEGVSQEAACMAGHLKLGKLVLLYDSND

SEQ ID NO: 57108 - protein, 95 aa, Zea mays
  misc_feature (74)..(74): Xaa can be any naturally occurring amino acid
  misc_feature (86)..(86): Xaa can be any naturally occurring amino acid
  unsure (1)..(95): unsure at all Xaa locations
MAWIRMVLAAEATRDSRVPRHSLPPCPLDLTRVRILTLNASYFLKNDGHFVILIKGNCIDSTLSAETVFAVEVXEKLKAHQFKHAXQVTMEPYEH

SEQ ID NO: 57109 - protein, 438 aa, Bordetella pertussis Tohama I
MRRVSHRTLSVSLLLGGAALVALVSLGFTQLADLALHWNRQWTAAHGWLALIVTPCALAVLCWLTLRLAPYASGSGIPQVIAGLSLPPGGAQQRLVSLVQALWKIPLTFLAMLAGASVGREGPSVQVGAALMLAWGQLWRRLGVPLRGFHSQELIAAGAAGGLAAAFNAPLAGVIFAIEELGRGTVLRWQRLVLIGVLAAGFLVVAIAGNNPYLGTFAGQALAHNMLWWTLVCCVVNGILGGVFARLLGKGAAGAAPQRWRERVRRHPVATAFGLGLALACLGLLTGGAVYGTGYDQAAALLSGHDGVPDGFGLAKLAATVASYWAGIPGGIFTPALTTGAGIGEQISHWAGPGVDTRVLVLVSMAAFLAAATQAPLTASVVVMEMTGSQPMLFWLLVGALGASVVSRQFCPRPFYHLAAGRFRRTAVVEAGRKASTE

SEQ ID NO: 57110 - protein, 1481 aa, Aspergillus oryzae
MALPREERSLHGHANIHVNQTTGPAIDKAESSDTIGADSEDGIEQEGQAKITTLARTLSRISQTNSGTEGLNPFLNTSDPELDPNSDQFNSRKWTKTLLHITSRDPERYPRRTAGVSFRNLNAFGYGTAADYQATVSNVWLKAAGWLRGLFGNGNKVRIDILRNFEGFVNSGEMLVVLGRPGSGCSTFLKTIAGETHGLWLDKGTDIQYQGISWDEMHSRFRGEVMYQAETEIHFPQLTAGDTLLFAAKARAPANRLPGVSRDQYATHMRDVVMAMLGLTHTMNTLVGNEFIRGVSGGERKRVSIAETTLCGSPLQCWDNSTRGLDSSTALEFVKNLRLSTDYTGSTAIVAIYQASQAIYDVFDKVIVLYEGRQIYFGRARDAKRFFIEMGFDCPERQTTGDFLTSLTSPTERLVRKGYEHLVPRTPDEFAARWRDSLERKQLLADIEAFQNEFPLGGSKKEEFSRSRAAEKAKNTRASSPYTLSYSMQIKLCLQRGFLRLKGDMSMTLSTVIGNSILALIISSVFYNLNETTDSYFSRGALLFFAILLNAFASALEMLTLWQQRPIVEKHDKYALYHPSAEAISSLIVDLPAKAPVSIVFNLILYFMTNLRRTPGHFFVFYLFSVTTTLTMSNVFRWIAAVSRSLAQAEVPASIFMMILMIYTGFTIPVRDMHPWFRWLNYINPIAYSFESLMINEFAGRKFHCATYVPSGPGYDNAPLDSKICSGKGAVAGQDYIDGDRYLEVAFEYYPSHLWRNFGILLGFLFFSLVAYIVASELVRAKPSKGEILVFPRGKIPAFAKKVHREADPEDVLTSEKLKVGSEQDDHVGAIVKQTSIFHWQDVCYDIKIKGQDRRILDHVDGWVKPGTLTALMGVTGAGKTSLLDVLANRVTMGVITGEMLVDGRMRDDSFQRKTGYVQQQDLHLETSTVREALIFSALLRQPASTPRKEKLAYVEEVIKMLNMEEYAEAVVGVLGEGLNVEQRKRLTIGVEIAAKPDLLLFFDEPTSGLDSQTAWSICSLMRKLVDHGQAILCTIHQPSAILMQQFDRLLFLAKGGKTVYFGDLGPNMRTLIKYFEDKGSPKCPPNANPAEWMLEVIGAAPGSRADQDWSDVWKHSRERAQVQQELLQMKQELLQRPQPPRTAGYGEFAMPLWAQFFICLQRVFQQYWRCPSYIYAKAAMCIIPPLFIGFTFWREPTSIQGMQNEMFSIFMLLVIFPNLVQQMMPYFAMQRSLYEVRERPSKAYSWKAFMLASIVVELPWNMLMAVPAYFCWYYPIGLFRNAYPTDSVTERGGTMFLLVLIFMLFTSTFSSMMIAGIDHPETASNIAQLMFSMCLIFCGVLASPDVLPRFWIFMWRASPFSYLVGSVLAVGIAGAPVHCSDIEVLHIPPPGGQNCSGYLEAFTTMAKSTLLNPEADSDCQVCSLSTTDQFLAGVHIKYSELWRNVGILFVYIVFNTVAAVFLYWLVRVPKKRALKKAKKE

SEQ ID NO: 57111 - protein, 431 aa, Bacillus cereus ATCC 14579
MSTIIDVYAREVLDSRGNPTVEVEVYTESGAFGRAIVPSGASTGEHEAVELRDGDKSRYLGKGVVNAVNNVNEIIAPEIAGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEVAVYDGVKSFYNIKR

SEQ ID NO: 57112 - protein, 469 aa, Oryza sativa (indica cultivar-group)
MSSNLAASRRSSSSSSVAAAAAKRPAVGEGGGGGGKAAAGAAAAKKRVALSNISNVAAAAGGGGGGGPPGKAGNAKLNLAASAAPVKKGSLASVRNVGTNRASAVKSASTKPAPAISRHESAAQKESVLPPKVPSIVPTAALAPVTVPCSSFVSPMHSGDSVSVDETMSTCDSMKSPEFEYIDNGDSSSVLGSLQRRANENLRISEDRDVEETKWKKDAPSPMEIDQICDVDNNYEDPQLCATLASDIYMHLREAETRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDEDPALHLEFLANYVAELSLLEYNLLSYPPSLVAASAIFLAKFILQPAKHPWNSTLAHYTQYKSSELSDCVKALHRLFCVGPGSNLPAIREKYTQHKIYAADVIDLNMMIQRDS

SEQ ID NO: 57113 - protein, 509 aa, Bacillus cereus ATCC 14579
MRKPTALIILDGFGLREETYGNAVAQAKKPNFDGYWNKFPHTTLTACGEAVGLPEGQMGNSEVGHLNIGAGRIVYQSLTRVNVAIREGEFDKNETFQSAIKSVKEKGTALHLFGLLSDGGVHSHMNHMFALLRLAAKEGVEKVYIHAFLDGRDVGPKTAQSYIDATNEVIKETGVGQFATISGRYYSMDRDKRWDRVEKCYRAMVNGEGPTYKSAEECVEDSYANGIYDEFVLPSVIVNEDNTPVATINDDDAVIFYNFRPDRAIQIARVFTNEDFREFDRGEKVPHIPEFVCMTHFSETVDGYVAFKPMNLDNTLGEVVAQAGLKQLRIAETEKYPHVTFFFSGGREAEFPGEERILINSPKVATYDLKPEMSIYEVTDALVNEIENDKHDVIILNFANCDMVGHSGMMEPTIKAVEATDECLGKVVEAILAKDGVALITADHGNADEELTSEGEPMTAHTTNPVPFIVTKNDVELREDGILGDIAPTMLTLLGVEQPKEMTGKTIIK

SEQ ID NO: 57114 - protein, 522 aa, Cytophaga hutchinsonii ATCC 33406
MPSGIPFIVGNEAAERFSFYGMRAILAVFMTSYLHMTESTATEWAHTFNSAVYFTPILGAFLADIFIGKYRTILYLSVLYCFGHLVLALNESKDGLFWGLTLISIGAGGIKPCVSAHVGDQFGIKNKHLIERVFSIFYFAVNFGSLFSTLLIPYLLEHYGPAYAFGLPGILMFVATFIFWSGRNKFVHVPPFGKAYFKTVFGKEGLSAIGRLIFIYAFIAIFWALYDQHASTWVYQSKSAFLNKDINLFGLVEFTLLPSQIQAANPVLVLVLIPAFAFFIYPALNKIITLKPLIKILLGMFMCVLAFLVAAYIEKRISSGIETSVWWQFLAYLILTMAEVMVSITALEFSYTQAPNQMKSTVMGIFMFSISLGNILVAVISNYNNLHEEVKTVEIGTKTYISIKDYTPVKGEKIEFEDGTGLFILQQNSKTSLMDTIPLGGTYLVGDVDAVSNRFTLEDNGWHAIQTIKKSELPKGYKVVFHRFKHQSYFYMYALLMFVTAVLFIGVALKYKGKTYIQGEAV

SEQ ID NO: 57115 - protein, 328 aa, Bacillus cereus ATCC 14579
MDLDVSGRNVFRAALNNSEVEVVAINDLTDAKTLAHLLKYDTVHGTLNAEVSANENSIVVNGKEIKVIAERDPAQLPWSDYGVEVVVESTGRFTKKSDAEKHLGGSVKKVIISAPASDEDITVVMGVNHEQYDAANHNVVSNASCTTNCLAPFAKVLNEKFGVKRGMMTTIHSYTNDQQILDLPHKDLRRARAAAENMIPTSTGAAKAVALVLPELKGKLNGGAVRVPTANVSLVDLVVELDKEVTVEEVNAAFKAAAEGELKGILGYSEEPLVSIDYNGCTASSTIDALSTMVMEGNMVKVLSWYDNETGYSNRVVDLAAYMTSKGL

SEQ ID NO: 57116 - protein, 331 aa, Ustilago maydis 521
MVLYVIGLGLADENDITLKGFHAVKSSERIYLESYTSILMVTGFKERLEALYQKPVILAHRETVELEAESILEGAATCNVSFLVVGDPLSATTHTDLILRAKQSSPPIPVKIIHNASIMTAIGSSGLAGYNFGQTVSVPFWTEDWKPDSWLERIGENLHIGLHTLALSDIKVREQSAQDMSRGILRYQDPRYMLIPQLISQLISAANSHKVDYLDPNRTLAIALCRMGSEDERIVSGTLSELLDMANPSPEQAQAEGAEDDADEMASEAELDKRRAARAEARAKNVFGEPLHSLVIVGKRLHPLERDYAANYACPGSKFVQVANDVYGCKE

SEQ ID NO: 57117 - protein, 503 aa, Acinetobacter sp. M-1
MHYVDPNQSGSKIHFKDQYENFIGGQWVAPVKGVYFDNISPVDGKSFTRIPRSSAEDIELALDAAHKAKKEWNKSSPTTRSNLLLKIADRMEANLEMLAVAETWDNGKPVRETLAADIPLAIDHFRYFAGCIRAQEGGISEIDEDTIAYHFHEPLGVVGQIIPWNFPILMAAWKLAPALAAGNCVVIKPAEQTPVGILLVAELIQDLLPAGVLNIVNGYGAEVGRPLATSPRIAKIAFTGSTQVGQLIMQYATENIIPVTLELGGKSPNVFFADVMDHDDDFLDKTLEGFAMFALNQGEVCTCPSRALIQESIADQFMEKAIERVKRIKLGHPLDTDTMVGAQASLEQQEKILRCIDTGRQEGAEVLLGGHGRQEVGNGYYIEPTIFKGHNNMQVFQEEIFGPVLSVTTFKDFDEAIQIANDTMYGLGAGVWSRSTHTAYRAGRAIEAGRVWTNCYHIYPAHAAFGGYKKSGVGRENHKMMLDHYQQTKNLLVSYSTKAMGFF

SEQ ID NO: 57118 - protein, 311 aa, Ashbya gossypii ATCC 10895
MSAIFGNSTVAAMVGQGQGLNYWQVLANVKTVQPQLNVLEQFWAAWYSYMENDVLATGLLFFVLHEFMYFARSLPWFIIDQMSWFRKYKIQPTKTPSAKEQWHCLKSVLLSHFLVEAIPIWTFHPLCQKLGISVEVPFPTWKTVATEIALFFVLEDTWHYWAHRVFHYGVFYKYIHKQHHRYAAPFGLCAEYAHPVETMLLGFGTVGMPVLYVLYTGKLHLFTLCLWITLRLFQAVDSHSGYDFPWSLNKFLPFWAGAEHHDLHHHYFIGNYASSFRWWDYTLDTEAGLEAKTTREERMKKRAELRGKKLN

SEQ ID NO: 57119 - protein, 371 aa, Arabidopsis thaliana
MAEADDIQPIVCDNGTGMVKAGFAGDDAPRAVFPSVVGRPRHHGVMVGMNQKDAYVGDEAQSKRGILTLKYPIEHGVVSNWDDMEKIWHHTFYNELRIAPEEHPVLLTEAPLNPKANREKMTQIMFETFNSPAMYVAIQAVLSLYASGRTTGIVLDSGDGVSHTVPIYEGFSLPHAILRLDLAGRDLTDYLMKILTERGYMFTTTAEREIVRDIKEKLSFVAVDYEQEMETSKTSSSIEKNYELPDGQVITIGAERFRCPEVLFQPSFVGMEAAGIHETTYNSIMKCDVDIRKDLYGNIVLSGGTTMFSGIADRMSKEITALAPSSMKIKVVAPPERKYSVWIGGSILASLSTFQQVKIDQILFRILLHAN

SEQ ID NO: 57120 - protein, 160 aa, Prochlorococcus marinus subsp. marinus str. CCMP1375
MTEDLKNTSPSKEESNEIEESSKATPKATRETKPKDSPSKTKLSAQALIAQFEKSQQKKKVPEVYVGDTVRVGVRISEGNKERVQPYEGVIIAKRHGGLNQTITVRRIFQGVGVERVFMVHSPQVASIKVERRGKVRRAKLFYLRDRVGKATRVKQRFDR

SEQ ID NO: 57121 - protein, 343 aa, Synechococcus sp. WH 5701
MTILLAGDIGGTKTLLATYRLEADGLVQLRCERFASAAWDDFSALVRQFLAGGKAGSEAPSHGCLAIAGPVQDGRVRLTNLPWELDELELASSCGLERLELVNDFAVLIYGLPHLGQSQQALVREGLPQPGPLAILGAGTGLGVAIGVPGPQGLIALASEAAHGEFAPRLEREWRLKQWLQQDLSLERVSIERIVSGTGLGHVFRWFLHDAGAGAPHGLAEAAEAWALAELSGAAERPDLPALVAAAAAAADPTASAALDLWLGAYGSVAGDLALQSLCRGGLWLGGGTAAKLLPQLRSQAFLAPFAAKGRLTPVLEQIPLRALIDPEAGLFSAACRARMLLG

SEQ ID NO: 57122 - protein, 348 aa, Staphylococcus aureus subsp. aureus Mu50
MTYNIVALPGDGIGPEILNGSLSLLEIISNKYNFNYQIEHHEFGGASIDTFGEPLTEKTLNACKRADAILLGAIGGPKWTDPNNRPEQGLLKLRKSLNLFANIRPTTVVKGASSLSPLKEERVEGTDLVIVRELTSGIYFGEPRHFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDAADELEQHIYNMIEHGQTTADLGGKLNTTDIFEILSQKLNH

SEQ ID NO: 57123 - protein, 344 aa, uncultured bacterium
IGAANNLLAAMLDNHIQQGNSLNIDPRRITWKRAVDMNDRQLRFIVDGLGGRINGTPREDGFDITVASEIMAVLCLASDITDLKDRLSRIIVGYTYDEQPVTAGQLKAAGAMTALLKDVLKPNLVQTLEHTPAFIHGGPFANIAHGCNSVIATKMALRLGDYCVTEAGFGADLGAEKFLDIKCRMAGLKPDAVVIVATVRALKHHGGVPKTELSQENLPALEKGLPNLLQHVENITKVFGLPAVVAINRFPQDSEAELELIEKKCRELGVNVALSEVWAKGGEGGKALAEEVVRLCEQKNDFRFSYDLDMSIKDKLDAIAKKIYHADGVDLIQNAPKQLKQMES

SEQ ID NO: 57124 - protein, 602 aa, Oryza sativa (indica cultivar-group)
MDSDYGVPRELSALQKARALYRPDLPPCLQGTTVKVEYGDAAIAADVAGAHVISHAFPHTYGQPLAHFLRKTAAVPDATVITEHPLVRVGVVFSGRQSPGGHNVIWGLHDAIKAHNANSKLIGFLGGTDGLFAQKTLEISDEVLSSYKNQGGYDLLGRTRDQIRTTEQVNAAMTACQALKLDALVIIGGVTSNTDAAQLAETFAESKCSTKVVGVPVTLNGDLKNQFVETTVGFDTICKVNSQLISNVCTDALSAEKYYYFVRLMGRKASHVALECALQSHPNMVILGEEVAASKLTIFDITKQICDAVQARAEKDKNHGVVLIPEGLVESIPELYALLQEIHGLHDKGVSVENISSHLSPWASALFEFLPPFIRKQIETEKLLAQLVEAEMNKRLKEGTYKGKKFNAICHFFGYQARGALPSKFDCDYAYVLGHVCYHILAAGLNGYMATVTNLRSPVNKWKCGAAPITSMMTVKRWSRGPAASQIGKPAVHMASIDLKGKPYELLRQNSSSFLMEDIYRNPGPLQFEGPGGETKPISLCVEDRDYMGRIKQLQEYLEKVKSIVKPGCSQDVLKAALSAMASVTEMLTIMSSPSFSGQATI

SEQ ID NO: 57125 - protein, 351 aa, uncultured bacterium
ITSANNLLAALLDNHIQQGNVKRIDSRSVVWKRCMDMNDRALRNIVVGLGSKSDGFVREDHFVITVASEIMAVLCLAEDLKDLKRRLGRIIVAYDLDGNPVTAEDIQAVGAMTALLKDAIRPNIIQTLEHTPAIVHGGPFANIAHGCNSVIATRTALKLADYCITEAGFGADLGAEKFLDIKCRQAGLTPSAVVLVATVRALKYNGGIPKDQLGTENLDALGKGIENLGKHIENIQSYGLPVVVALNAFVSDTDAEIEFVKEYCASKNCTMSVARVWEKGGEGGTELAELVIKATEEKSDFKFCYPDELSITGKIEAVAKKIYGADGVDIASSAAKQITKIEEMGFGNLPV

SEQ ID NO: 57126 - protein, 352 aa, uncultured bacterium
IGAANNLLAAMLDNHIYQGNELDIDTRRIVWRRCVDMNDRELRNIVAGLGGKAHGVPREDGFDITVASEIMAAFCLATSLDDLKARFARIVVAYNRKGEPVTAGQLGAQGAMTALLKDALKPNLVQTLEGTPAFVHGGPFANIAHGCNSVMATNMARHFGDYVVTEAGFGADLGAEKFLDIKCRLTGIRPSAVVIVATIRALKYNGGVPKAETGTENLEALEKGLPNLLKHVENITQVYKLPCVVALNRFVADTDAEIELVTRKCAELGVNVKMSEVWGKGGEGGIELAEEVVKLCEQPNDFSFSYDLDLPIKDKIKAIATRIYGADDVVYAGKVEQEIANLEALGFGNLPI

SEQ ID NO: 57127 - protein, 207 aa, Rhodobacter sphaeroides 2.4.1
MSHGPLRVGIGGPVGAGKTTLTEKLCAALAHRCSMAVITNDIYTREDAEALMRAQVLPAERIRGVETGGCPHTAIREDASINLAAVADLRRTFPDLDLILIESGGDNLAATFSPELADLTIYVIDTAAGQDIPRKRGPGLARSDLLVVNKIDLAPHVGVDLARLEADTQAARGQRPYVMARMRAGVGVEAIVAFLEREGGLQLLPQD

SEQ ID NO: 57128 - protein, 352 aa, uncultured bacterium
ISAANNLLAAMIDNHIFQGNELGINPGTVVWRRCVDMNDRQLRFVVDGLGGAKNGVPREDGYDITVASEVMAILCLATSISDLKKRLGRIIIGYSYEGNAVTAADLKAEGAMTAILKDALKPNLVQSLEGTPAFIHGGPFANIAHGCNSILATRMALKCGEYIVTEAGFGADLGAEKFMDIKCRITGLRPKAVVVVATVRALKMHGGLKKDNLGTEDLAALENGLPNLLRHVSVMTDVYKIPCVVAVNRFPTDTEAELELVEKKCRELGVNVVLSEVWGKGGEGGIALAEEIVRLCKKESKLELTYEDSDSIETKISKVVKRIYGGSSVSYAPGVRTKIKKLEAAGFASVPV

SEQ ID NO: 57129 - protein, 202 aa, Oryza sativa (japonica cultivar-group)
MEVEASYSYGFLPSGRHQPYAPPPPHPAEEGELWEYFPCPFCYIEVEVPFICNHLQEEHCFDTRNAVCPLCADNIGRDMGAHFRVQHSHLLKRRKPSRPSSSWPTPSNNSDPYFEGPPQYMMNNRTYQDPAPDPLLSQFICSMAQTDTNSDNTNTEIAVSAVSHDQRLSQRVTLTDDASKLELKERLQRIEFVKEIIMSTIL

SEQ ID NO: 57130 - protein, 310 aa, Thermoplasma acidophilum DSM 1728
MSTSSYIDQIKNEISEKVKGRAIIAVSGGQDSSLLSVLASQVLGDRLLCVFVDTGLIRIGEVDRVRKFFEEHAMNYRIVDASKRFLEALKGITDPEEKRKIIGKMFIDVLNEEAENFHAEYLLQGTIAPDWIESGGQKRDTIKSHHNVGGLPKEMKLKLVEPLRDFYKDEIRAMSRELGLRTDLQPFPGPGLAVRIVGEITPEKLDLLRRATRIVEDKIESALKPEERPWQYFAVLLPVKTTGVHGDRRAYGYTVAVRMIDSIDAMTGTFTKPSWDLLEDIANTITDEIPDINRVVYDITNKPPATIEWE

SEQ ID NO: 57131 - protein, 351 aa, uncultured bacterium
ITSANNLLAALLDNHIQQGNVKRIDSRSVVWKRCMDMNDRALRNIVVGLGSKSDGFVREDHFVITVASEIMAVLCLAEDLKDLKRRLGRIIVAYDLDGNPVMAEDIQAVGAMTALLKDAIRPNIIQTLEHTPAIVHGGPFANIAHGCNSVIATRTALKLADYCITEAGFGADLGAEKFLDIKCRQAGLTPSAVVLVATVRALKYNGGIPKDQLGTENLDALGKGIENLGKHIENIQSYGLPVVVALNAFVSDTDAEIEFVKEYCASKNCTMSVARVWEKGGEGGTELAELVIKATEEKSDFKFCYPDELSITGKIEAVAKKIYGADGVDIASSAAKQIAKIEEMGFGNLPV

SEQ ID NO: 57132 - protein, 499 aa, Arabidopsis thaliana
MATRLLRTNFIRRSYRLPAFSPVGPPTVTASTAVVPEILSFGQQAPEPPLHHPKPTEQSHDGLDLSDQARLFSSIPTSDLLRSTAVLHAAAIGPMVDLGTWVMSSKLMDASVTRGMVLGLVKSTFYDHFCAGEDADAAAERVRSVYEATGLKGMLVYGVEHADDAVSCDDNMQQFIRTIEAAKSLPTSHFSSVVVKITAICPISLLKRVSDLLRWEYKSPNFKLSWKLKSFPVFSESSPLYHTNSEPEPLTAEEERELEAAHGRIQEICRKCQESNVPLLIDAEDTILQPAIDYMAYSSAIMFNADKDRPIVYNTIQAYLRDAGERLHLAVQNAEKENVPMGFKLVRGAYMSSEASLADSLGCKSPVHDTIQDTHSCYNDCMTFLMEKASNGSGFGVVLATHNADSGRLASRKASDLGIDKQNGKIEFAQLYGMSDALSFGLKRAGFNVSKYMPFGPVATAIPYLLRRAYENRGMMATGAHDRQLMRMELKRRLIAGIA

SEQ ID NO: 57133 - protein, 471 aa, Streptococcus mutans UA159
MMTIFRKKNTNLDKTEMKRHFKVIDLIFLGLGSMVGTGIFTITGIGAAKYAGPALIISIIVSAIAVGISALFYAEFTSRIPANGGAYSYLYATLGEFPAWLAGWYIIMEFLTAISSVASGWGSYFKGLLSSYGIELPSLLNGTFNPAKNNYIDLLPALVIFLVTGIVLLNSKIALRFNSSLVVMKFSALALFIIIGLFYIKPENWSNFAPFGFGKIYGGQTGIMAGASLMFFAFLGFESISMAVDEVQKPQKNIPKGIIASLTIVTILYVSVTLVLTGIVHYSKLNVADAVAFALRQAGLVWAANYISVVAILTLITVCISMTFALARTVYSISRDGLLPKQLGIVTKHSKVPKNATLLVGFASMICAGVFPLSSIAEFLNICTLAYLIMLAIAIIKLRKDQGQPKIGEFKTPFIPFLPIVSIVICLSLMSQYKSVTWIAFGISTSIGFLIYFAYGYRHSTIFIKNNPKIR

SEQ ID NO: 57134 - protein, 193 aa, Escherichia coli
GIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQEYRD

SEQ ID NO: 57135 - protein, 1075 aa, Salmonella typhimurium LT2
MPKRTDIKSILILGAGPIVIGQACEFDYSGAQACKALREEGYRVILVNSNPATIMTDPEMADATYIEPIHWEVVRKIIEKERPDAVLPTMGGQTALNCALELERQGVLEEFGVTMIGATADAIDKAEDRRRFDIAMKKIGLDTARSGIAHTMEEALAVAADVGFPCIIRPSFTMGGTGGGIAYNREEFEEICERGLDLSPTNELLIDESLIGWKEYEMEVVRDKNDNCIIVCSIENFDAMGIHTGDSITVAPAQTLTDKEYQIMRNASMAVLREIGVETGGSNVQFAVNPKNGRLIVIEMNPRVSRSSALASKATGFPIAKVAAKLAVGYTLDELMNDITGGRTPASFEPSIDYVVTKIPRFNFEKFAGANDRLTTQMKSVGEVMAIGRTQQESLQKALRGLEVGATGFDPKVSLDDPEALTKIRRELKDAGADRIWYIADAFRAGLSVDGVFNLTNIDRWFLVQIEELVRLEEKVAEVGITGLNADFLRQLKRKGFADARLAKLAGVREAEIRKLRDQYDLHPVYKRVDTCAAEFATDTAYMYSTYEDECEANPSIDRDKIMVLGGGPNRIGQGIEFDYCCVHASLALREDGYETIMVNCNPETVSTDYDTSDRLYFEPVTLEDVLEIVRIEKPKGVIVQYGGQTPLKLARALEAAGVPVIGTSPDAIDRAEDRERFQHAVDRLKLKQPANATVTAIEQAVEKAKEIGYPLVVRPSYVLGGRAMEIVYDEADLRRYFQTAVSVSNDAPVLLDRFLDDAVEVDVDAICDGEMVLIGGIMEHIEQAGVHSGDSACSLPAYTLSQEIQDVMRQQVQKLAFELQVRGLMNVQFAVKDNEVYLIEVNPRAARTVPFVSKATGVPLAKVAARVMAGKSLTEQGVTQEIIPPYYSVKEVVLPFNKFPGVDPLLGPEMRSTGEVMGVGRTFAEAFAKAQLGSNSTMKKQGRALLSVREGDKERVVDLAAKLLKQGFELDATHGTAIVLGEAGINPRLVNKVHEGRPHIQDRIKNGEYTYIINTTAGRRAIEDSRVIRRSALQYKVHYDTTLNGGFATTMALNADATEKVTSVQEMHAQIKKS

SEQ ID NO: 57136 - protein, 467 aa, Oryza sativa
MAALLHLQSSATAAAAPSFLLLRRRGGGVTAPAGSSRRRRACFRVEAKIREIFMPALSSTMTEGKIVSWTASEGDRLAKGDPVVVVESDKADMDVETFHDGFLAAVLVPAGESAPVGSAIALFAESEDEIPAAQSKAASLSSSSSSSPPPPPPQESTPPPPPPPPPAPVAAAVSAPAPPSPASQGGLRVVASPYARKLAKDLNVDLNSITGSGPGGRIVAKDVEAAAAAPKKAAPVAAARPDVPLGSTVPFTTMQGAVSKNMVESLAVPTFRVGYTFTTDALDALYKKIKPKGVTMSALLAKATAMALVQHPVINSSCRDGKSFTYNSSINIAVAVAIDGGLITPVLPDADKLDIYSLSRKWKELVDKARAKQLQPHEYNSGTFTISNLGMFGVDRFDAILPPGTGAIMAVGSSQPTLVGTKDGSIGIKNQMQVNVTADHRVIYGADLAAFLQTLSKIIEDPKDLTF

SEQ ID NO: 57137 - protein, 476 aa, Agrobacterium tumefaciens str. C58
MDIWTRDFAMQTFVENFENSDRLRQRARNIIPGGAHTYAKGDDQYPVLSPGFIERGYGCHVWDVDGNEYIEYGMGNRAVGLGHAYADVVEAARAELYRGCNFTRPSKIEVDCASTFLDTVQTAEMVKFCKNGSDATSAAIRLARAVTGRDLIARCSDHPFFSTDDWFIGTTEMNAGIPEAIQNLVLGFSYNDLASARSLFDRFKGRIAAFILEPSRGDPPRDQFLHKLQKLCHENGALFILDEMITGFRWDAGGAQKTYDIVPDLSCFGKALGNGFSISALAGKREFMERGGIDQTDAPRVFLLSTTHGAETHAMAAAIATMKVYTHEPVVPHLVRQGNSLRAAISQIAIAHGLDSYFGIQGHSACLSYFTLDQTGKPSQAFRSLFLQETIRRGLLAPSLVVSYTHEDEDIAKTLDAIDGALVVYRKALEYGVDKFLTGRPSDVVFRRFNGNAQHQAGHGLVMADMPGLSESIRKP

SEQ ID NO: 57138 - protein, 474 aa, Ustilago maydis 521
MLSLTVPRLALRAAAPSRQFAAAAGVGAVRFASTKSLKDAVAEIIPAKQEQLKKLKAEHGESKLGEIQLQHLLGGMRGLKVMLWEGSVLDSETGITFHGKSIPDSQKVLPTAADLGLNGNEILPESMLWLLLTGNVPSKDEVKGLSAELAAKGALPAHVEKIIDSFPKTLHPMTQFAAAVAALNHDSKFAAAYAKGIKKTEYWAPVLEDSIDLIAKLPAVAARIYYNVFGRGDGKQAIDSNLDLIGNYSNMIGYGDNQGMTDYLRLYIAIHGDHEGGNVSAHTAHLVGSALSDPYLSYSAALLGLAGPLHGLANQEVLGWALSMQEAVGENASEEQIKEYLWSTLKSGRVVPGYGHAVLRQPDPRFTALSKFCDTRPELRDSSIVKLVQKVSQVAPGVLKEHGKTKNPFPNVDAASGCVLYQYGLTEFTYYTVIFGISRAIGALPQLVADRYLGMPIERPKSMSMDSLEAFLKK

SEQ ID NO: 57139 - protein, 565 aa, Oryza sativa (japonica cultivar-group)
MDEEARAAGCSPAPPRAPAASCGAAAELCLCSPTGVEGIEQVPGCPCFEDAGAVVVSGEAPEGPGVLCSEDGAELKLAEQGALDVRLGSPAVGIHEQQLLHRGTSGSDEAGAINEISPVEVSPSEASSNLDTAGAIGGSPLMLESLPETSDTRGCEQEVMPGVVVGSSNRDASSEVGVESERGSDADGRNGLGEGELVSSVDGGGAEKSSKVTGVLSEEGVDGMETALEPCVASVGSITQVEEGVDRMETSLDDSEASDGSTTQDFDTDVETESSGSSIEEQDMGYGVHIPHTEQAICEVARGNKSSEVKSSDRMSSVTLPTLILASGAAMLPHPSKVLTGGEDAYFIACDGWFGVADGVGQWSFEGLYARELMDGCKKAVMESQGAPEMRTEEVLAKAADEARSPGSSTVLVAHFDGQVLHACNIGDSGFLVIRNGEIYQKSKPMTYGFNFPLQIEKGDDPFKLVQKYTIDLQEGDAIVTATDGLFDNVYEEEIAAVISKSLEAGLKPSEIAEFLVARAKEVGRSATCRSPFSDAALAVGYLGYSGGKLDDVTVVVSVVRKSEV

SEQ ID NO: 57140 - protein, 182 aa, Brassica napus
  misc_feature (40)..(40): Xaa can be any naturally occurring amino acid
  unsure (1)..(182): unsure at all Xaa locations
MAYSMLSSAAVVTSPAQATMVAPFTGLKSSSAFPVTRKAXNNDITSIVSNGGRVNSMQVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 57141 - protein, 465 aa, Glycine max
MMAHLLHTPFIPSSSALRRAAPIPHRKTTTPLVVRAKIREIFMPALSSTMTEGKIVSWTKSEGDKLSKGDSVVVVESDKADMDVETFYDGYLAAIVVEEGGVAAVGSPIAFLAETEDEIPQAKSKASSSSSSSSAPAPATAPAPAPPVESQPEKVAAPVAAAVAAPVVASSHPASEGGKRIVASPYAKKLAKELKVELGRIVGTGPMGRIVAKDVEAFAAAGNVAAAVAPALGKSAAPAGVELGSVVPFTTMQSAVSRNMAESLAVPTFRVGYTITTDALDALYKKIKSKGVTMTALLAKATALALVKHPVMNSSCRDGNSFTYNSSINIAVAVAIDGGLITPVLQGADKIDVYSLSRKWKELVDKARAKQLQPHEYNTGTFTLSNLGMFGVDRFDAILPPGTGAIMAVGASEPTVVATKDGRIGMKNQMQVNVTADHRVIYGADLASFLQTLSQIIEDPKDLTF

SEQ ID NO: 57142 - protein, 107 aa, Leptospira interrogans serovar Lai str. 56601
MNNDLKQKIDGLIGSNKVFLFMKGTPEAPMCGFSAGVSNVLRSLGIQFGSFNVLSDETIRQGIKEYANWPTIPQLYINGEFIGGHDIVVEMAKTGDLQKKAGILSAG

SEQ ID NO: 57143 - protein, 269 aa, Prochlorococcus marinus subsp. marinus str. CCMP1375
MTNPIRNVTPGGSGGGAATLALIVSFTGILLLTQALFIVPAGQVAVVTTLGKVSGGARRPGLNFKVPFVQSTFPFNVQTQVRPEEFESLTKDLQVISATATVKYALKPSEAGRVFRTISYNDREIYNRIIKPSLLKALKSVFSKYELVTIASSWSDISSIVEKTVAEEISQFDYVDIQGLDLTGLEIAEEYRAAIEQKQIAEQQLLRAQTEVKIAEQEAIRYDTLNRSLDDQVLFKLFLDKWDGKTQVVPALPGTNGSNTPVIVGGRRN

SEQ ID NO: 57144 - protein, 433 aa, Prochlorococcus marinus subsp. marinus str. CCMP1375
MTNAFNTSNSQAVFHAAQELMPGGVSSPVRAFKSVNGDPIVFDRVKGAYAWDLDGNRFIDYVGSWGPAICGHSHPEVIASLQEALEKGTSFGAPCELENKLAEMVIEAVPSVEMVRFVNSGTEACMAVLRLMRAFTGRDKLIKFEGCYHGHADMFLVKAGSGVATLGLPDSPGVPRSTTSNTLTAPYNDLEAVKNLFAENPDAIAGVILEPIVGNAGFIQPEPGFLEGLRELTKENGSLLVFDEVMTGFRISYGGAQGRFGVTPDLTTMGKVIGGGLPVGAYGGRKDIMSMVAPAGPMYQAGTLSGNPLAMTAGIKTLEILQQEGTYERLASITNRLINGICESAKQAGIPITGSSISGMFGFYLCEGPVRNFEEAKQTNSDYFGKLHRAMLAKGVYLAPSAFEAGFTSLAHSEEDIDSTLKAFNECFNELSQ

SEQ ID NO: 57145 - protein, 353 aa, uncultured bacterium
IGAANNLLAAMLDNHIQQGSALGIDIKKITWKRCVDMNDRQLRFVVDGLGGRANGTPREDGFDITVASEIMAVFCLAASMADLKERLSRIIVAYTYDDQPVTAGDLKATGAMAALLRDALKPNLVQTLEGTPAFVHGGPFANIAHGCNSVMATRMAMRMGDYTVTEAGFGADLGAEKFLDIKCRMAGLVPDAVVVVGTVRALKMHGGLDKKQLANEDLAALEKGIPNLLRHVHNITNVYHLPCVVAINRFPTDTDAEIDFIVRKCRELGVNTILSTVWAEGGKGGEDLAREVVRLCEKEKSNFTFSYELDASIEEKLEAVTKKIYGGAGVALTPAAKKQAERLTQLGFDKLPV

SEQ ID NO: 57146 - protein, 367 aa, Triticum aestivum
MTTSQDVVVSEMGIGPGGAAMPGSGAAGLFACRSAASAGAMSMGQTYRDLAAAASRSANCTWAELEAMRAASPTRSRPGTDVDELTAWMRKHPSALGKFDQIASASKGKKIVMFLDYDGTLSPIVANPDAAYMSDAMREAVRDVAKHFPTAIVSGRCRDKVHNFVGLSELYYAGSHGVDIKGPGSNPESVLCQPASEFLPMIDEVYKVLVEKTKSTPGAKVENNKFCLSVHFRCVDEKRWNFLAEQVKAVIKDYPMLKLTQGRKVFELRPSIMWDKGKALEFLLESLGFASCSDVLPVYIGDDRTDEDAFKVLRKRGQGVGILVSKCAKETSASYSLQDPAEVMEFLLRLVDWKRRSSAPPMVRPRV

SEQ ID NO: 57147 - protein, 427 aa, Arabidopsis thaliana
MRTTMSNLPKELVEDIVSRVPLHCLRAMRLTCKNWNALLESQSFKKMHIRKEEEAARELGENRMIVMMDYNVYLMGIIVNENLSIKSLGKLTCLHGSKQVKISQVFHCEGLLLCILKDDDTKIVVLNPYLGQTRWIQTRKYHRTSEWEGRDVYNYALRYETNSGNRSPKILRFIDDFHHHPENPALRYETYDFDTDLWTTLDVSPHWRIISRCGGVSLNGNTYWGAVERNASAYIGHMICFDFTRGGFGPLIPLPFKARGLVFAPLSSDRAEKIAALFRTSKKVVIWITTKIDATNVTWSNFFTIYISNLERNLSCKSFFTIYISNLERNLSCKSFFIDMEKKVAMVFDKEKGKKVAHNIINIIGEAGCVRKLVLKESGDKSCWPLVCSYVPSTVQIKQHNRGKRQKKVIRKGIDIDMRHDKRIKVD

SEQ ID NO: 57148 - protein, 351 aa, uncultured bacterium
ITSANNLLAALLDNHIQQGNVKRIDSRSVVWKRCMDMNDRALRNIVVGLGSKSDGFVREDHFVITVASEIMAVLCLAEDLKDLKRRLGRIIVAYDLDGNPVTAEDIQAVGAMTALLKDAIRPNIIQTLEHTPAIVHGGPFANIAHGCNSVIATRTALKLADYCITEAGFGADLGAEKFLDIKCRQAGLTPSAVVLVATVRALKYNGGIPKDQLGTENLDALGKGIENLGKHIENIQSYGLPVVIALNAFVSDTDAEIEFVKEYCASKNCTMSVARVWEKGGEGGTELAELVIKATEEKSDFKFCYPDELSITGKIEAVAKKIYGADGVDIASSAAKQIAKIEEMGFGNLPV

SEQ ID NO: 57149 - protein, 1430 aa, Cryptococcus neoformans var. neoformans B-3501A
MVPPARAHTHNTTNTKQAQLSSAYHELANELGTDNISVVGNYTLGRVIGQGTYGSVHLATHRLTGTRAAVKKVPKSFTPHLTRELHHHRRLHHPHIVHLHEIIATESHIWLVTELCSGGELFDYLVERGRILEGEARRLFGELTLAVGWLHMHGVVHRDLKLENVLLDGELRIKLGDLGFAREWQKGRLMDTYCGTTGYASPEMLACQKYLGVETDIWSLGIILYTLLCGGLPFDDDDERVMKELIQKGEYEEPDWLSQEARDLIRGMLQHDPSKRLSIREILTHPWFKMTIVDKVYPNGDVPSIPPSPNPTSPTAAGDDFFAESALRQQQQQQSRLTPHVAGRSPLSTHLPTTPRQNSGSSEAENGDSRTERKASNMQRLNSAEFSTTEKELEQLHLCTSRPAATATGSGAISPRSISSPSMRGKTLRTLPEGQVDVDETPAGLPPPLSLIDEHPHLPVALHSRTPSRTKRRSVSSTLSLERRLSHHSSHNSYITFPPEDYLSKLDPSLLPNPDSSSSSTTTPPARSFTTPSETRLLRQLDDLGLDVGQLKHSVETDACDASAGLWWLLRQKQEERGETDEVVRRREKEVVRREEKVAEYAKEERRKAREAERERERIPTSPMGILGTRPGKRDSIEKSSEGLRFKEEQPPSIPTTPSYTSVIDLGPPVLPVDVDVDVERTAVGRDAPREAAGEEMKSWKRVESPQSVAISSQSSLDPAPTLPPPAAAGGGGAAGAKTQKEDGRDQAGLDPVAVATPMSNANSSTGASTVAKPEPNVNASANANTSANPRLKAKSPSMNMLQRATSVLGGVGKKGDDKDKDKNGMNEKREESTNDSLHPKRGGSSSPNKLKKPMPAGMKGLTSTLSRSESESEGLLAGGGGGGGGGDSPAVSASGSKTVTPGSSPRRKGLTPQGTPRGGLRDAGAKDSSGERASGNGNGNAGGGNEKGKGGKKDSLWTTFRHLFYEDRRRRKRESVTPSASSPLLLPPSDIKLPAGAVVLSRGANSRTSQFKRSNVGYAPSTGSRRTSLDGNRPVYSRRSSSVHTTSRRSSVGSLHFQDHQAMISDLSRRASQRSHGSQTPTSDREYLDYPSAAAPISRPGSSHSIRGGVGGGSRRSSFSVRSPSLHPETFSASAGGPTSTRFKSSVPPPASPLLGYRRRPAGGNDSSRVRHIKVIPESQIMRSSSVASSIRSNASSRASSMDRDRDRDRESEYESGRDDVSLRSGKRQKRRSGSQRSLAQQIHRTRSPLALSLENTYGSNSVANVGLGIGGASRIPKKPLRDVFQKKGKRKDGGDDDWVSEDEDGFACGLGQGRGIAKSFSNANANGTVWMNVNAKTNPARSAAAFPTSKMVAQPTAQGGTSRRRERGRRSSLEEERGRPQEGKGKAKGETVAQGLMGIESLSGRSRRNLPDRSTAPGIIEEEEEDEE

SEQ ID NO: 57150 - protein, 337 aa, uncultured bacterium
TSANNLLSAMLDNHIQQGNSLGIDVRQIVWRRSLDMNDRALRNLVVGLGAKADGVPREDHFVITVASEIMAILCLAENMSDLKKRLSRIIVAYTAEGEPVTAGDLKAVGAMAALLKDAIRPNLIQTIGHTPVFVHGGPFANIAHGCNSVRATKTALGLSEYTVTEAGFGADLGAEKFMDIKCRAAGLQPDAVVLVATVRAIKYNGGVPKDQLVNEDLEALKRGICNLEKHIESLQLYGVPVVVTLNRFTSDTDAELKFVEDFCREKGASFALSEVWAKGGEGGEDLARAVVEAVESGTQDFHLLYEDDLSPGDKMRKIATSIYGAKDVVFTTQARKW

SEQ ID NO: 57151 - protein, 538 aa, Zea mays
  misc_feature (179)..(179): Xaa can be any naturally occurring amino acid
  misc_feature (187)..(187): Xaa can be any naturally occurring amino acid
  unsure (1)..(538): unsure at all Xaa locations
MADTADAPLLTSHGQAKQLAKAPSIDDTIETYIGATGSMQLLKAVLLAFAWAFDAQQVFISVFTDAEPQWHCTGASASCEPATPPASPCALPSGAWAWDRPAHTTVVSEWALKCAGPALVSLPASSFFAGCLAGGFLLTTLADSLLGRRKMLLTSLVSMSVAGVLTAFAPNVWAYAALXRFVCGFGXRPWWGTCTLVLSTELVGKRWRETVSVAGFIFFTVGFLSLPALGYTLREASWRNMYLWTSVPSLCYSVLLYFLAQESPRWLLVRGRKQDAMETLRQIASLNGNSITSSFSMLHACNMQEDDGAAGGAGGVFSTMRAMWERPWALRRLAAIMTASFGVGMVYYGMPLNVGSLGTNLYLSVTYNALAELPSAILSLIFIGRVNRRSSVVALTVAAGAFSLACVVIPEGSAARMAAELLSFFSTITAFNLILIYSIELFPTSVRNSAVGLVRQALVLGGVVAPVLVALGRERSFWSFGVFGLCIGCLGLFAACLPETRGRSMSDTMEEEEHKEAAAAACTGATDIATKDDTDLLV

SEQ ID NO: 57152 - protein, 185 aa, Rubrobacter xylanophilus DSM 9941
MNITERTIQVIRNRIRSVPDYPSPGVVFRDITPLMEDGPSLHAAVDALAEATRSLDYDRVISAEARGFVFGTALAYRSRKGLVLARKPGKLPREVISVSYELEYGTDSLEVHADAIPPGTRVLVADDLLATGGTARAMCELVEKSGGSVAGCAFLIELGFLEGRKKLLAGYDVISLINYHDPAAE

SEQ ID NO: 57153 - protein, 351 aa, uncultured bacterium
ITVAHNLLAALIDNHIHQGNKLRIDTRQILWKRCMDVNDRSLRNIVVGLGAKGDGFVREDHFVITVASEIMAIFCLASDMKDLKKRLSEIIVAYNLDGEPVTAGELNAVGAMAALLKDAIKPNMIQTLEHTPAIVHGGPFANIAHGCNSIIATKTAMRLAGYTVTEAGFGADLGAEKFLDIKCRKAGLKPDAVVIVATIRALKYNGGVAKADLTNENIEALKNGSCNLIKHVENIKSYGLPVCVTINKFVSDTDAEVECLKEILGKLDVPFSVSEVWAKGGEGALDLAKDVMKLADSENNFHYLYPDDMGIKEKIETLATKIYGAGNVEFAPAALKQIAKIEELGFKECPV

SEQ ID NO: 57154 - protein, 551 aa, Spinacia oleracea
MQASTFMVKGNLGFEVQNRRVAGLAGLKGLSSIRSNNLSFVNVNDNNYKSNPCKLSCGSLSMGAGFARLGLDHVMKSSPKYRSVKAQAASGGDLEDATPVKYQGKSSASVLPYVGVACLGAILFGYHLGVVNGALDYLSADLAIAGNTVLQGWVVSILLAGATVGSFTGGSLADKFGRTKTFQLDAIPLAIGAYLCATAQNVQIMMIGRLLCGIGIGISSALVPLYISEISPTEIRGALGSVNQLFICIGILAALVAGLPLAGNPLWWRTMFGIATVPSVLLALGMGFCPESPRWLFQQGKIVEAEKAVAALYGKERVPEVINDLRASVQGSSEPEAGWFDLFSSRYRKVVSVGAALFLFQQMAGINAVVYYSTSVFRSAGIASDVAASALVGASNVIGTAVASSLMDKQGRKSLLMTSFSGMAASMLLLSLSFTWKALAPYSGTLAVVGTVLYVLSFSLGAGPVPALLLPEIFASRIRAKAVALSLGMHWASNFVIGLYFLSVVTKFGISKVYLGFASVCVLAVLYIAGNVVETKGRSLEEIELALSPAV

SEQ ID NO: 57155 - protein, 391 aa, Streptococcus mutans UA159
MDLSKRFNKNLNKIEVSMIRQFDQSISDIPDVLKLTLGEPDFATPKHIKEAAKRAIDADESHYTGMAGLLALRQAASAFVKEKYHLTYNPDNEILVTIGATEALSASLTAILEPGDKVLLPAPAYPGYEPVVNLVGAEVVEIDTRSNDFVLTPEMLEEAILKEGEALKAVILNYPTNPTGVTYSRQQIKNLAEVLKKYPIFVISDEVYAELTYTGESHVSIAEYLPDQTILISGLSKSHAMTGWRLGLIFAPAVLTAQLIKSHQYLVTAATTSVQFAAIEALTNGKDDALPMKEEYIKRRDYIIEKMEAMKFKIIKPDGAFYIFAKIPVAQGQDSFKFLQDFAKEKAVAFIPGVAFGKYGEGYLRISYAASMETIKEAMKRLKEFMEQYAD

SEQ ID NO: 57156 - protein, 118 aa, Panax ginseng
LCSGGELFDRIIQRGHYSERKAAELTKIIVGVVESCHSLGVMHRDLKPENFLLVSKDDDFSLKAIDFGLSVFFKPGQVFTDVVGSPYYVAPEVLLKHYGPEADVWTAGVILYILLSGV

SEQ ID NO: 57157 - protein, 263 aa, Helicobacter pylori 26695
MKLKSFGVFGNPIKHSKSPLIHNACFLTFQKELRFLGHYHPILLPLESHIKSEFLHLGLSGANVTLPFKERAFQVCDKIKGIALECGAVNTLVLENDELVGYNTDALGFYLSLKQKNYQNALILGAGGSAKALACELKKQGLQVSVLNRSSRGLDFFQRLGCDCFMEPPKSAFDLIINATSASLHNELPLNKEVLKGYFKEGKLAYDLAYGFLTPFLSLAKELKTPFQDGKDMLIYQAALSFEKFSASQIPYSKAFEVMRSVF

SEQ ID NO: 57158 - protein, 470 aa, Solanum tuberosum
CRSHRVRAAGEDIEDAAPLKVQGQSSGSVLPYVGVACLGAILFGYHLGVVNGALEYLAKDLGIAENTVIQGWIVSTVLAGAFVGSFTGGVLADKFGRTKTFILDAIPLSVGAFLCTTAQSVQAMIIGRLLTGIGIGISSAIVPLYISEISPTEIRGTLGTVNQLFICIGILVALVVGLPLSGNPSWWRTMFGLALIPSVLLAIGMAFSPESPRWLYQQGRISEAETSIKRLYGKEKVAEVMGDLEASARGSSEPDAGWLDLFSSRYRKVVSIGAAMFLLQQLAGINAVVYYSTAVFRSAGITSDVAASALVGAANVFGTTVASSLMDKQGRKSLLLISYTGMAASMMLLSLSFTWKVLTPYSGTLAVLGTVLYVLSFSLGAGPVPALLLPEIFASRIRAKAVALSLGVHWIMNFFIGLYFLSIVTKFGISTVYMGFALSCLVAVVYITGNVVETKGRSLEEIERELSPAI

SEQ ID NO: 57159 - protein, 94 aa, Synechococcus sp. WH 7805
MVSAADSAHGEQIFSANCAACHMGGGNVVNGQRTLQQDDLKAYLANYNEGHEEAIAYQVTNGKNGMPAFGGKLGPDDIADVAAYVESQSINGWA

SEQ ID NO: 57160 - protein, 246 aa, Helianthus praecox
ANYGGDKQYGRETRQTGDYDNPIHSTGGQYEQDVRQTDEYGNPVRRTDEYGNPVHSTTGGTMGDYGSTGLGRGTAGIGTGGYGTTGHQGLGTGVGHTTGGIGTDYISGGRSTGQTGYQGLGTESEFGGTTGTFQNQPSATPIGGTGLGGGTGAGFGGTGTGTGTGILHRSGSSSSSSSEDDGQGGRRKKKGVMQKIKEKLPGGHSQEGQHQSQTTTTTTAGGAGYGETHEKKGMMEKIKEKLPGHH

SEQ ID NO: 57161 - protein, 395 aa, Bordetella pertussis Tohama I
MRKFSRIERLPPYVFNITGELKMAARRRGEDIIDMSMGNPDGATPQHIVDKLVEASTRPDTHGYSVSKGIPRLRKAICDWYMRRYAVEFDPDSEAIVTIGSKEGLAHLMLATLDRGDTVLVPNPSYPIHIYGAVIAGANIRSVRMTPGIDFFEELERAVRESIPKPKMMILGFPSNPTAQCVDLSFFERVVALAKEHDILVVHDLAYADVCFDGYVAPSIMQVPGARDVAVEFFTMSKSYNMAGWRIGYMVGNRELVGALARIKSYHDYGTFTPIQVASIAALDGPQDCVNEIVAQYQRRRDVLARGLHEAGWNVEIPKASMYIWAQIPEPYRAMGSLEFAKRVLSDAKVAVSPGIGFGEYGDEYVRFALIENEQRTRQAVRGIKDMFRKDGLLK

SEQ ID NO: 57162 - protein, 663 aa, Oryza sativa (japonica cultivar-group)
MRRRSTFAVLLFAAAALPLAAGQPWQLCGRRGGGGGGTYTANSTYDTNLQSLIAALQQNASTSPTLFAAGALGAAPDAVYGLILCRGDVSSSDCYDCGTRAGQDVAPACNRTRDAILVYNQCYTRFSAAGDFLASANNSGQAPLMNSDNVTTADVAGYDRAVTELLSATLMYAVVNTTRLFATGQRVGADPGFPNIYSAAQCTPDLSPALCRSCLEDLVARWWKTFPRTTVGARIVGTRCSLRSEVSQDKFYTGAPMLKLWADGLSPAAAAASPDAAPGTTGVKNNSANKILEIVLPIVAVAIVAAVSILLWNIRKKRRRGKAEHFTGPDAAEDFESVKSTLLSLASLQVATDNFNESMKLGEGGFGAVYKGLLFRQDVAVKRLAKGSNQGLEEVKNELVLVAKLHHKNLVQLVGFCLEEGERMLVYEYMPNKSLDTFLFDEEKRRQLDWTTRFRIIEGIARGLQYLHQDSQKKIVHRDMKASNILLDADMNPKIGDFGLARLFGQDQTREITNRIVGTFGYMSPEYVTHGQYSTKSDVFSFGILVIEIVTGRRRNNGPYFFEPNEDIISIVWRHWAEGNIKEIIDHSLGRNYPEGEVLKCVNIGLLCVQQNPIDRPTMADVMVLLNSDATSTLPAPVVHIPVASFSDGSSGYSQTVTQLSPR

SEQ ID NO: 57163 - protein, 633 aa, Oryza sativa (japonica cultivar-group)
MRRRSSVLHAVLLLLLVAAVALPLAAAQPWPVCGTSGGNYTAGSTYESNLLRLASTLRANASASPTLFASGVRGAGPDAVYGLLLCRGDMNPSDCFDCGTRVGDDVAQACNRTKDAILVYNQCYAQFSDTGDFLAATNNSGAYSLLISGTNISSADVAGYDRAVTELLNATVRYAVENSTRLFATGQRVGADPGFRNIYSMAQCSPDLSPAQCRSCLDGLVGQWWTGFLFPRNGEGARVAGPRCYLRSELGSGFYTGAPMVLLRADGLSPASAPAPDVVPATTLVKKNSASKILLIVLPIVAVAIVAAISVCMWTVRKKSRATKAEHLSELDASEDLESVKSTLLTLGSLQVATDNFDESKKLGEGGFGAVYKGHLFGQEVAVKRMAKGSNQGLEELKNELVLVTKLHHKNLVRLVGFCLEDGERLLVYEYMPNKSLDTFLFDVEQRRQLDWATRFRIIEGVARGLQYLHQDSQKKIVHRDMKASNVLLDADLNPKIGDFGLARLFGQDQTRDVTNRIVGTFGYMAPEYVIRGQYSTKSDVFSFGILILEIVTGQRNSGPYFAEQNEDLVSLVWRHWTEGNIVEMVDYSLDRNYPEAEVLKCVNIGLLCVQQNPVDRPTMADVMILLLIYSHD

SEQ ID NO: 57164 - protein, 609 aa, Oryza sativa (japonica cultivar-group)
MLRRSLVAHAVLLFAAVALPLAAAQPWPVCGTSGGNYTAGSTYESNLLRLASTLRANASASPTLFASGVRGVGPDAVYGLLLCRGDMNPSDCFDCGTNVWRDAGPTCNRTKDAILVYNQCYAQFSDRGDFLAATNNSGEVSLLISGTNITSTDVAGYDRAVTELLNATVRYAVENSTKLFATGQRVGNDTGFSNIYSMAQCSPDLSPAQCRSCLDGLVGQWWKTFPLNGKGARVAGPRCYLRSELGPFYTGNPMVRLPVKADELTQFSQNYANLPADTNEDFESVKSTLLSLASLQVATDNFHESNKIGEGGFGAVYKGILHGQEVAVKRMAKGSNQGLEELKNELVLVAKLHHRNLVRLVGFCLDEGERLLIYEYMSNKSLDTFLFDAEQKRKLDWAVRFKIIEGIARGLQYLHQDSQKKIVHRDMKASNILLDADMNPKIGDFGLARLFGQDQTREVTSRIAGTFGYMPPEYVLRGQYSTKSDVFSFGILVIEIVTGRRRNSGPYLSEQNDEDILSIVRRHWEEGAIAEMIDHSLGRNYSETEVLKCVNIGLLCVQQNPVDRPTMADVMILLNSDTTCTMPALAPRPAYLIDGTSGYSQTVTQWSGR

SEQ ID NO: 57165 - protein, 73 aa, Triticum aestivum
MDASAELQRFIEQEKEKMMVSEMIGKVTSECWDKCITGAPGSKLSSGETSCLSNCAQRFIDMSEMIAKRFGAH

SEQ ID NO: 57166 - protein, 403 aa, Neisseria meningitidis MC58
MAFLKLTEQNVQGKTVLIRADMNVPFKDGKISDDTRIRASLASIKYCVDNGASVIVMTHLGRPTEGEFHPEDDVAPVAAHLGSLLGKDVKVLNDWRENKPALNAGDVVMLQNVRINKGEKKNDLELGKAYASLCDVFVNDAFGTAHRAQASTEAVAQAAPVACAGVLMAGELDALGKALKQPARPMVAIVAGSKVSTKLTILESLADKVDQLIVGGGIANTFLLAEGKAIGKSLAEHDLVEESKKIMAKMAAKGGSVPLPTDVVVAKAFAADAEAVVKDIAADAEAVVKDIADVAEDEMILDIGPKSAAALADLLKAAGTVVWNGPVGVFEFDQFAGGTKALAEAIAQSKAFSIAGGGDTLAAIAKFGVTEQIGYISTGGGAFLEFLEGKELPAVAALEKRGA

SEQ ID NO: 57167 - protein, 326 aa, uncultured bacterium
GAANNLLAAMLDNHIQQGNSLGIDVKQITWKRAVDMNDRQLRRIVDGLGGRAQGVPREDGFEITVASEIMAVLCLASDLKDLKARLARIIVGYTYDGKPVTAHDLKAEGAMTALLKDAIKPNLVQTLEGTPAFVHGGPFANIAHGCNSVIATHTALKLADYVITEAGFAADLGAEKFLDIKCRVSDLHPSAVVIVATVRALKYHGGIPKSELNAENLEALEKGLPNLLQHVSNIKNVFGLPCVVAINAFPTDTEAELKLVEKKCRELGVNVALSEVWAKGGEGGIALAEEVVRLCEQPNSFTFSYPLEMSIEEKLETICKKIYHAD

SEQ ID NO: 57168 - protein, 181 aa, Brassica napus
MASVMLSSATMTSSLAHATMVAPFIGLKSSAAFPVTCKANTEITSITSNGGRVNCMKVWPPVGKKKFETLSYLPDLTDVEIAKEVDYLIRNKWTPCIEFELEHGFVYREHGNIPGYYDGRYWTMWKLPLFGCTDSTQVLKEVKKCKQEYPNAFIRIIGFDNNRQAQCISFIAYKPPSFTDA

SEQ ID NO: 57169 - protein, 833 aa, Rubrobacter xylanophilus DSM 9941
MKAVIMAGGQGTRLRPLTSEQPKPMIRIANVPCMEHIVNLLKRHGFTDIAVTLQFMPDEIRDYFGDGSDWGVNIRYSVEDSPAGTAGSVKMAERQLGLEGERLLIISGDALTDVDLGELLAYHEQKGGEATMVLKSVENPLDFGIVITGEDGRISRFLEKPAWGQVFSDTVNTGIYLLEPSVLREIPDPEEGEYDFSKDLFPRLLEQGRPLYGMVTDAYWEDIGTLEQYASANRDVLEGRVRGVRPPGTRLRENIYVGRRVQVDDEELEGPVVIGDNVRIDEGARISPYSVIGNNVVVASGAHIERSIVADGTYVGEGAELRDTLVGRSCYIQERARILERSALGDDVIVGEGATIAPDVKVYPHKTVESGASVTQSLIYETMGLRTIFRGGRVSGKFNVDVTPEFVIRLASSFGTTLSPGSIVTLGRDSSAAAQVVKRAMTAALLATGVNVRDLRAAHAGVVRHDVLAGKSSAGCHTRAGEDSDEVEVLFFSSDATPMTEGEQRAIEKVFVREEYRRAHEGDIGQLIFPGRAVEQYVERLERAVDRSRVSGGSVVVDFCGGVAGLVASRVFSRLGISAVVMEGFANANVVGGAPRMDLEEGLERVGRIVPTVEAAFGCVVNPTGEQVHFVDDAGEYVPPDVMLACLIRGLEPREVVLPINLSSRYAELVESYGGTVHYARTGMGNVAIRAAERAADLGGLEDGQYIFPAFLPAPDCFMTLARALELFRDRPLSKVRREFGERFGNVVRERLECPWSAKGRVMRGLAERFGGDPDAILTEGVKLMVDGGWVLMLPDPDNPLFYVYAEADDGRRPEALMQDYVRLVRELIESGD

SEQ ID NO: 57170 - protein, 353 aa, uncultured bacterium
IGAADNLLAAMLDNHIQQGNALGIDVKKITWKRCVDMNDRQLRFVVDGLGGKANGVPREDGFDITVASEIMAVFCLASSMKDLKERLSRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLAEENLEALEKGIPNLLRHVRNIREVYQLPCVVAINRFPTDTDAEIEFIIRKCRELGVNTVLSTVWAEGGKGGEDLAREVVRLCEEEKGNFTFSYDLEMSIEEKLEAVTKKIYGGAGVALPPGAKKQAERLTALGFDKMPV

SEQ ID NO: 57171 - protein, 352 aa, uncultured bacterium
IGAANNLLAAMLDNHIQQGNSLGIDGKNITWKRCVDMNDRQLRHIVNGLGGRMQGVPREDGFEITVASEIMAILCLATSIPDLKARLGRIIVGYNFSGEPVTAHDLKAEGAMTALLVDALKPNLVQTLEGTPAFIHGGPFANIAHGCNSVMATKAALKLGDYAVTGAGFGADLGAEKFLDIKCRMADLHPNAVVVVATVRALKHHGGVAKADLGVENLEALEKGLPNLLRHVENITTVFKLPCVVAINRFPMDTEAELALIEAKCKELGVNVALSEVWGKGGEGGVALAEEIVRLCELPNDYAPSYDLDQPVEEKIRAIAKTVYHAKHLLMLPAAKKKAAQIEEMGFGGLPI

SEQ ID NO: 57172 - protein, 165 aa, Triticum aestivum
  misc_feature (63)..(63): Xaa can be any naturally occurring amino acid
  misc_feature (93)..(93): Xaa can be any naturally occurring amino acid
  misc_feature (114)..(115): Xaa can be any naturally occurring amino acid
  misc_feature (123)..(123): Xaa can be any naturally occurring amino acid
  misc_feature (137)..(137): Xaa can be any naturally occurring amino acid
  misc_feature (143)..(143): Xaa can be any naturally occurring amino acid
  unsure (1)..(165): unsure at all Xaa locations
LWLLLTGKVPTKEQVDALSKELLARSTVPAHVYKAIDALPVTAHPMTQFTTGVMALQVESEFXKAYDNGIAKIKVWGATYEDCLNMIAPVPTXGSYVYRRISKGGKSIRNWTFXXIMRNFSHXLGLDDPKMLELMRXLVTSHXHEGGSQSNGTGGKGLQILLLRV

SEQ ID NO: 57173 - protein, 278 aa, Glycine max
MDSIQNKVYYCCVSKGNNVLYVYGGGDQEVEKVAALCLERAPPFHRWYFETIGKRTFGFFMEDGYVYFTIVDKGLGNPVVLQFLEHVRDEFKKLARKGSRGILPNMNSIYIQEKLVPVIRGLITSLESVSHGSSNWRDETSLSFQVDLSPSPSNLNGQIEGASSTKAPLLGKSNKPDKKKVKDHVIAMRDVELEEHQKSTDRGARVDSCNLDGVSQGGAGASVSLQKDMGSMRMRSAPQNIRKKWWRQVRIVLAIDAAVCILLFIIWLVICHGISCIR

SEQ ID NO: 57174 - protein, 354 aa, uncultured bacterium
IGAANNLLAAMLDNHIYQGNALNIDPRRITWKRCVDMNDRQLRHVTDGLGGRVNGVPREDGYDITVASEVMAVLCLSESISDLKERLSRMIVGYTYDEQPVTAGDLKAQGAMTALLKDALKPNLVQTLEGTPAFVHGGPFANVAHGCNSVIATKVSRKLSDYTVTEAGFGADLGAEKFLDIKCRYANMKPDAVVIVATVRALKMHGGVDKKNLCPENLDALEKGLPNLLRHVENIREVYHLPAVVAINRFPTDTDAELNLVIEHCRALGVNAVLSDVWAKGGAGGEALAKEVIRLCNEESNADFSFAYDLDLPIEEKIRAIAKRIYRAKHVSFSLNAEKEIAKFAAMGYGHLPV

SEQ ID NO: 57175 - protein, 246 aa, Helianthus praecox
ANYGGDKQYGRETRQTGDYENPIHSTGGQYEQDVRQTDEYGNPVRRTDEYGNPVHSTTGGTMGDYGSTGLGRGTGGIGTGGYGTTGHQGLGTGIGHTTGGTGTDYTSGGRSTGQTGYQGLGTESEFGGTTGTFQNQPSATPIGGTGLGGGTGAGFGGTGTGTGTGILHRSGSSSSSSSEDDGQGGRRKKKGVMQKIKEKLPGGHSQEGQYQSQTTTTTTAGGAGYGETHEKKGMMEKIKEKLPGHH

SEQ ID NO: 57176 - protein, 360 aa, uncultured bacterium
FTGDFHAIGAANNLLAAMLDNHIQQGNALGIDVKKITWKRCVDMNDRQLRFVVDGLGGKANGTPREDGFDITVASEIMAVFCLASSMKDLKERLGRIIVAYTYDDKPVTAGDLKATGAMAALLRDALKPNLVQTLEGTPAFVHGGPFANIAHGCNSVMATRTAMRMGDYTVTEAGFGADLGAEKFLDIKCRMAGLTPDAVVIVGTVRALKMHGGLDKKQLVNEDLAALEKGIPNLLRHVNNIKNVYQLPCVVAINRFPTDTDAEIDFIIRKCRELGVNTVLSTVWAEGGKGGEDLAREVVRLCEKEKGNFTYSYELDASIEEKLEAVTKKIYGGAGVSLTPNAKKQAERLTELGFDKMPV

SEQ ID NO: 57177 - protein, 308 aa, Vibrio angustum S14
MRQLTTLLDQWLNSFNKVMDETIASGIPFTVPTVREGLANITRELVTEIPNIALIENLTIKDKVPIRIYHPQPETALPVLVYFHGGGHMSGSVEVYDPICRKLAQHSQFIVVSVEYPLAPEHPYPAAIDDSYLVLQSLFQTLIRAELNFIPQLSIAGDSAGGAICATLARMAQFDDDVEIAKQVLIYPSLDYTLSFPSVSQNGMGYLLQQSRIEWYFSNYFQHNEDRRKASPVWGPYSMALPESLVITAEFCPLKDEGIAYVEALKKQGVETEHIHFEQMIHAFLNMENIVKKECELSYKTIGVFLNK

SEQ ID NO: 57178 - protein, 409 aa, Helicobacter pylori 26695
MAQNFTKLNPQFENIIFEHDDNQMILNFGPQHPSSHGQLRLILELEGEKIIKATPEIGYLHRGCEKLGENMTYNEYMPTTDRLDYTSSTSNNYAYAYAVETLLNLEIPRRAQVIRTILLELNRMISHIFFISVHALDVGAMSVFLYAFKTREYGLDLMEDYCGARLTHNAIRIGGVPLDLPPNWLEGLKKFLGEMRECKKLIQGLLDKNRIWRMRLENVGVVTQKMAQSWGMSGIMLRGTGIAYDIRKEEPYELYKELDFDVPVGNYGDSYDRYCLYMLEIDESVRIIEQLIPMYAKTDTPIMAQNPHYISAPKEDIMTQNYALMQHFVLVAQGMRPPVGEVYAPTESPKGELGFFIHSEGEPYPHRLKIRAPSFYHIGALSDILVGQYLADAVTVIGSTNAVFGEVDR

SEQ ID NO: 57179 - protein, 292 aa, Pseudomonas syringae pv. syringae B728a
MIAGSMVALVTPMDAQGRLDWDSLSKLVDFHLQEGTHAIVAVGTTGESATLDVNEHIEVIRRVVTQVAGRIPVIAGTGANSTREAVELTTNAKNAGADACLLVTPYYNKPTQEGLFQHFSHIANAVDIPQILYNVPGRTACDMLPETVARLSTVKNIVGIKEATGNLQRAKDILASVSSDFLVYSGDDATAVELMLLGGKGNISVTANVAPRAMSDLCAAAMRGDAQTARAIHEKLMPLNNTLFIESNPIPVKWALHEMGLMPDGIRLPLTWLSEACHEPLRQAMRQSGVLV

SEQ ID NO: 57180 - protein, 1043 aa, Vibrio sp. Ex25
MFTATNVLTPEFIGQPLDKLWSLISPLYMVDESQWLEQLLPLATPTEDEKSAITTQTTQLIEAIRADKKSIQMIDALLLEYSLDTQEGILLMCLAEALMRIPDAATADSLIKDKLSVADWKSHLKNSDSVFVNASTWGLMLTGKVVGLGEQGTQSPGQAVNRLVNKFSEPVIRKAMYQAMKIMGHQFVRGRTIEEAQKNGRPMRDKGFTYSFDMLGEAALTTADANKYFKDYLMAIEAVGRETYGNDTSPAPSISIKLSALHPRYEVANEERVMTELYDSLMQLLKRAIEVDVAITIDAEEADRLELSLKLFEKVYRSDLVKGWGKFGLVIQAYSKRALPVLVWLNALAKEQGDLIPLRLVKGAYWDSEIKWSQQAGYANYPVYTRKEATDVAYLACARFLLSEGVRGNIYPQFASHNAHTVTAIAVMAEHKEYEFQRLHGMGDSLYNHVMEMYGQPVRIYAPVGSHADLLPYLVRRLLENGANSSFVHRLVDARCPIYELTHHPVDVLTGFDTLHNDKIPLPADIFPERKNSYGVNIDIDSEAKPFEAQVESFMDNQWVAGPMINGERFAESMIKENAAEIITAPYDRRIEVGKVAFATLDHVSAAIDAAQTAFSDWKGVPVEQKAACLEKLADLMEENLAELVAICHKEAGKTIHDSIDEVREAVDFCRYYAKQAQNLQPFELEGFDGVKRISSREGLGVFVCISPWNFPLAIFLGQVTAALIAGNTVVAKPAEQTSLIAARAIELMLDAGFPAGVIQLLTGRGAEIGHALTSHDAIAGVAFTGSTATAQRINVTLAERSAKPVPFIAETGGQNAMIVDSTALPEQVVRDVIRSAFASAGQRCSALRVLFVQEDVADRMINLIQGAMNELHVGLPYLHKTDVGPVIDSNAKQKLLAHLEQMSKTQTKVAQLQLDESCQHGDFVSPSAFEISGIDVLKEEQFGPILHIVRFKASELPNVVAQINKTGFGLTMGIHSRNETTYRWIEKHARVGNCYINRDQVGAVVGVQPFGGQGLSGTGPKAGGPHYLFRFTQHLLAQAENA

SEQ ID NO: 57181 - protein, 360 aa, Cytophaga hutchinsonii ATCC 33406
MYGKQGEKYIDLISGIGVSNIGHCHPKVVQAIQEQSQKYMHLMVYGEFVQAPQVRLATKLIETLPPSLDSVYLVNSGSEATEGALKLAKRYTNRREIISCKNAYHGSSHGALSVMGNEFFKQSYRPLLPGIKHIRYNHTEDLDVITEQTAAVIIETIQGEAGVRIADKPYMQALRKRCDYTGTLLILDEIQCGFGRTGTFWAFETYGIVPDILLAAKGMGGGMPIGAFISSKKIMQTLSSDPVLGHITTFGGHPVSCAASIACMEVIQEEKLMDTVLKKESLIRKQLNHPGIKEIRSAGLMMAVEFESYSVLKRIIDQAIEKGVLTDWFLFCDNSMRIAPPLIISDDQIEQACSIISSCK

SEQ ID NO: 57182 - protein, 132 aa, Zea mays
GTGTAGGMGQLGEHGGAGMGGGQFQPAREEHKTGGILHRSGSSSSSSSEDDGMGGRRKKGIKEKIKEKLPGGHKDDQHATATTGGAYGQQGHTGSAYGQQGHTGGSYATGTEGTGEKKGIMDKIKEKLPGQH

SEQ ID NO: 57183 - protein, 337 aa, Zea mays
MGKIKIGINGFGRIGRLVARVALQSEDVELVAVNDPFITTDYMTYMFKYDTVHGQWKHSDITLKDSKTLLFGEKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 57184 - protein, 267 aa, Oryza sativa (indica cultivar-group)
MLPAAPVVTVAGVEVRPVWANNLNYELGLMQHVAADAICAAVNVHYPGVVHGAGRDQASLTAEQRYADLKRNVDELKPLQVGLAVHNARGHRVTWEFNLRDFDLAAGDAHTARSLSYLAGRGLALGALRRHGLPAAALARGLARSGLVARPGLRWVAYSGTYHVAYLLKVITGGAPLPPTVVGFLAAARHLLGPDMYDVARVAADFHGGPVGLDMIASRLGIPPPLTSPMLAGAAAVRAIEAFVELMHRFGGDVAAYKGLLQGLQIT

SEQ ID NO: 57185 - protein, 374 aa, Carboxydothermus hydrogenoformans Z-2901
MSGRSCKGPFKILVLPGDGIGPEIIKEAVKVLKALGEKKGITFNFQYGLIGGAAIDERGVPLPEETVELGKQCDAILLGAVGGPKWDNLPPEIRPELGGLLKIRKVFDLYANLRPVMFFPELKNASPLKPDIIEGVDILMVRELTGGLYFGEKKRFTTEQGEQAVIDTLIYTEKEVERVVRLGFELAQKRRGKLTLVDKANVLESSRFWREITGEIKKEYPDVELSYMYVDNCAMQLIRNPRQFDVIVTENMFGDILTDEGSVLAGSIGLLPSASLNGKFGLYEPIHGSAPDIAGQNKANPLATILSAGMMLRYSLDCPEEALLIEKAVKAVLQKGYRTGDILEPGTTLVTCEEMGDLVAEEILGGVYDEGLPL

SEQ ID NO: 57186 - protein, 696 aa, Oryza sativa (japonica cultivar-group)
MGVHPFAKAANGFVMQADAPDAKLADVQAVADAIHGNTKLANIQAVADVIHGNAKLADVQAVPDAIHGNTKVFDIQAVADAKPDVQAVPGAIHGNTKVADNSVVADAIQGNTKLTDVHPFMEGDCSIKLADAQVRNKAVDGFDATNMSPLVARCLAHHLAKVSVQRVWQGNYPEMFKPVLDAFGQPHRRIYIAFDFEFAADAFTNMHCWPGCTKTNYEYLRRYVNGGDVVQMGLAFVFEDEVDEEPTFTAMALEINFDFTVELRKYNGEAISFLSEQGHDLTEHRDRGVVPHFVYTGLLSHLPFGNSSVTWIAYHGDYDFGFFLRLLQGGCRGSSHLPLELPTFLHQLRLNFPRLYDIRVLGQLVQHGFRGSLTAIADLLGVNRFGRGHHAGVDALLTLSCFFQIVSCLSASGDHQLHRLDSRQGLLAGIAQVNKAIKDARHIGDRTSNIDVIKVQAGNLDEEAQRIQELVPSNFNIIGVEVMHPQLGNRSYAIGAQQNYESMKTYLKDADSFEIVIAFVNSEGMLAYDCVWKFCISSTPRSGCLHPRQFTRLMASCGATSNPNVSWVTFHGAHGIASLISSFSAPQDLPSDWPSYVEQRRAYFPGMYDVALIVHRYPDIGILPTTGCKGGLFDVARALDLNFIKDDNPVTRVLLTLRCYMRLADRGDFPDKQSAVQGQLMENCCWNCPAKRMEHA

SEQ ID NO: 57187 - protein, 444 aa, Thermotoga neapolitana
MKKFPEGFLWGVATASYQIEGSPLADGAGMSIWHTFSHTPGNVKNGDTGDVACDHYNRWKEDIEIIEKIGAKAYRFSISWPRILPEGTGKVNQKGLDFYNRIIDTLLEKNITPFITIYHWDLPFSLQLKGGWANRDIADWFAEYSRVLFENFGDRVKHWITLNEPWVVAIVGHLYGVHAPGMKDIYVAFHTVHNLLRAHAKSVKVFRETVKDGKIGIVFNNGYFEPASEREEDIRAARFMHQFNNYPLFLNPIYRGEYPDLVLEFAREYLPRNYEDDMEEIKQEIDFVGLNYYSGHMVKYDPNSPARVSFVERNLPKTAMGWEIVPEGIYWILKGVKEEYNPQEVYITENGAAFDDVVSEGGKVHDQNRIDYLRAHIEQVWRAIQDGVPLKGYFVWSLLDNFEWAEGYSKRFGIVYVDYNTQKRIIKDSGYWYSNGIKNNGLTD

SEQ ID NO: 57188 - protein, 220 aa, Helicobacter pylori 26695
MAKQEYKQLPKRAEVHSATEQFKDTVKTSLGLDLFKGLGLTIKEFFSPSVTIHYPMEQLPLSPRYRAVHNLQRLLDSGSERCIGCGLCEKICTSNCIRIITHKGEDNRKKIDSYTINLGRCIYCGLCAEVCPELAIVMGNRFENASTQRSQYGSKSEFLTSEQDAKNCSHAEFLGFGAVSPNYNERMQATPLDYVQEPSKEESQEETPTNPESNKGDENV

SEQ ID NO: 57189 - protein, 418 aa, Hevea brasiliensis
MMSMTCYSLDFGRTVFDLAACGCSSNASIDRCSVRNYARSVYRTCNRDYAARRSPYCRRDSAWCRVSSTKAPETLLNGVSQDPAVNLKESRGPISLINVFEAVAGDLQTLNQNLRSIVGAENPVLMSAADQIFGAGGKRMRPALVFLVSRATAEIVGLKELTTKHRRLAEIIEMIHTASLIHDDVLDESNMRRGKQTVHQLYGTRVAVLAGDFMFAQSSWYLANLENIEVIKLISQVIKDFASGEIKQASSLFDCDVELEEYLIKSYYKTASLIAASTKGAAIFSGVDSSVAEQMYEYGKNLGLSFQVVDDVLDFTQSAEQLGKPAGSDLAKGNLTAPVIFALEKEPKLREIIESEFCETGSLDEAVELVKQCGGIERAQELAKEKADLAIQNLNCLPRGVFQSHLKEMVLYNLERID

SEQ ID NO: 57190 - protein, 480 aa, Catharanthus roseus
MEEMKKVELVLIPTPEIGHLVSAIELAKLLTDQDEQIFIKILTMKLIFDSTVTNYIKSLSGASTSRVSFIELSDNESSSKIVAPNPFLHRLMVLESYKNHVRNILAEICNSSTSKLGGIIVDMFCTNMIDVANEFRVPTYLFYTTTAAMLGLVLHLQSLRDDFAQNLADYKDSISELSIPSYKNPVPVNILPSIVFDKGESSNVFLNHAKRYREMKGIIINTFLDLESYALENLTEDETLPPVYAVGPILNVKGSHNQDNEVEVILEWLDLQPNSSVVFLCFGSRGYFDKEQVKEIAYALEHSGYRFLWSLRQPPSPGKVATEFGNLEELLPEGFFQRSAEIGKVIGWAPQVQVLSHPAVGGFVSHCGWNSTLESIWFGVPMATWPLYAEQQGNAFQLVKDLEMAVEIKIDYRKNFFASTEDIVKADEIEAGIRRLMDPENEVRNKVKEMKERSRVAIVEGGSSYTSMQWFIEDMKKTIS

SEQ ID NO: 57191 - protein, 902 aa, Rhizobium leguminosarum bv. viciae 3841
MTKWVYRFGDGQAEGRARDHEVLGGKGANLAEMCALGLPVPPGLTIVSDACNTYYKNGRHIEDQVKAEVRAGIAAIEAITGRRFGSVSQPLLLSVRSGARVSMPGMMDTVLNLGLNDETVQALGHDAGDARFAWDSYRRFIQMYADVVMGLGNDAFEEILEDEKAKLGHEFDTELSASEWQHIVSLYKKLIEEELEQEFPQDPEVQLWGAVGAVFASWMSARAVTYRHLHNIPEGWGTAINIQAMVFGNLGNASATGVAFTRNPSTGERALYGEFLVNAQGEDVVAGIRTPQSITEEGRISSGSEKPSMEKLMPEAFRELCRICTELEIHYRDMQDIEFTIERGKLWMLQTRSAKRSTRAAMKIAVDMVDEGVITEDEAVLRIEPSSLDQLLHPTIDPRVTRQVIGSGLPASPGAATGAIVFTAEEAVEAESEGRKVILLRVETSPEDIHGMHAAEGILTTRGGMTSHAAVVARGMGIPCVVGAGTMRIDVRNERLLGVGVTLKKGDIITIDGSAGQVLKGEVPMIQPALSGDFGRIMGWADRARRMTVRTNADTPADALAARSFGAEGIGLCRTEHMFFEGERIHVMREMILAVDEKGRRVALDKLLPMQRLDFTGLFTVMHGLPVTIRLLDPPLHEFLPKTDDEVAEVAFAMGMEASVLRQRVDALHEFNPMLGHRGCRLAISYPEIVEMQARAIFEAAVAAAKETGAAVVPEIMVPLVGLRTELDYVKARIDEVAGAVMNEAGMKIDYLVGTMIELPRAALRAHVIAEAAEFFSFGTNDLTQTTFGISRDDASAFIPTYQRKGIIEHDPFISLDFDGVGELISIAAERGRRTRNDMKLGICGEHGGDPASIRFCETIGLDYVSCSPFRVPIARLAAAQAVIAGSLEDVRRGPKDLRASV

SEQ ID NO: 57192 - protein, 404 aa, Leptospira interrogans serovar Lai str. 56601
MDLSAKRLNVIEPSPTLVITAKANELKKKGEDIVSFGAGEPDFETPSHIRDAAKNAIDRGMTRYTAVSGTVELKEAIVHKFKRDNGLDYDKSQVIVGTGGKQVIYNYFLATLNAGDEVIIPAPYWVSYADIVRLAEGVPVIVNTTPEANFQITSEQLKKVITPKTKCLILNSPSNPTGAGYSKKDIEALGEVVLSTGIQVMSDDIYEKIVYDGFVFSNLAMLSPELKKQTFVINGVSKTYSMTGWRIGYGAGDLNIVKNMETIQSQSTSNPSSISQAAAQAAIAGDQSCVEEMRKAFQVRRDLIVSLLNAIPGVKCNNPQGAFYVFPYLTDVYKTTGFIKLKQGFSETSLSKIFCSTLLEKYKVAAVPGIAFGEDQALRLSYAMGENDIRRGVERIAEMIRDLN

SEQ ID NO: 57193 - protein, 330 aa, Arabidopsis thaliana
MENKTEEEVSIIKVSSLTCIDLDNSDLHQSAVLLKQACLDSGFFYVINHGISEELKDEAFEHSKKFFALPLEEKMKVLRNEKYRGYAPFHDSLLDPENQVRGDYKEGFTIGFEGSKDGPHWDKPFHSPNIWPNPDVLPGWRETMEKYYQEALRVCKSIAKIMALALDLDVDYFNTPEMLGNPIADMVLFHYEGKSDPSKGIYACGAHSDFGMMSLLATDGVMGLQICKDKDVKPQKWEYTPSIKGAYIVNLGDLLERWSNGYFKSTLHRVLGNGQDRYSIPFFLKPSHDCIIECLPTCQSENNLPKYPAIKCSTYISQRYKAVHAHLKQT

SEQ ID NO: 57194 - protein, 350 aa, Oryza sativa (japonica cultivar-group)
MGAVLGTGRVGTLTRVALTIVVFLLLLPSHALAAAVAKDTSATLVETLPLPTTLVGPESVAFDKFGDGPYSGVSDGRILRWDGADKGWTTYSHAPGYNVAKCMAPKLHPAELTESKCGRPLGLRFHNTSGNLYIADAYKGLMRVGPRGGEATVLATEADGVPFKFTNGVDVNQVTGEVYFTDSSTRFQRSQHEMVTATGDSTGRLMKYDPTTGYLDVLQSGMTYPNGLAISADRSHLVVALTGPCKLVRHWIEGPKAGTSEPFAELPGYPDNVRPDGKGGYWVALHREKTETPYGSDTHLLAVRIGRKGKILQELRGPKNVRPTEVIERGGGKLYLGSVELGHVAVVKAT

SEQ ID NO: 57195 - protein, 138 aa, Brassica napus
  misc_feature (18)..(18): Xaa can be any naturally occurring amino acid
  misc_feature (39)..(40): Xaa can be any naturally occurring amino acid
  misc_feature (46)..(47): Xaa can be any naturally occurring amino acid
  misc_feature (61)..(62): Xaa can be any naturally occurring amino acid
  misc_feature (69)..(69): Xaa can be any naturally occurring amino acid
  misc_feature (76)..(76): Xaa can be any naturally occurring amino acid
  misc_feature (83)..(85): Xaa can be any naturally occurring amino acid
  misc_feature (87)..(87): Xaa can be any naturally occurring amino acid
  misc_feature (89)..(90): Xaa can be any naturally occurring amino acid
  misc_feature (93)..(93): Xaa can be any naturally occurring amino acid
  misc_feature (99)..(102): Xaa can be any naturally occurring amino acid
  misc_feature (104)..(104): Xaa can be any naturally occurring amino acid
  misc_feature (106)..(107): Xaa can be any naturally occurring amino acid
  misc_feature (110)..(110): Xaa can be any naturally occurring amino acid
  misc_feature (116)..(117): Xaa can be any naturally occurring amino acid
  misc_feature (119)..(121): Xaa can be any naturally occurring amino acid
  misc_feature (124)..(124): Xaa can be any naturally occurring amino acid
  unsure (1)..(138): unsure at all Xaa locations
MASSMLSSAAVATSPAQXTMGAPFTGLKSSAAFPVTRKXXTDITSXXSNGGKVNCLKGGPXXEKKIENXFFFLTYXGELAQKXXXLXPXXKGXPWGEFXXXXRXFXXREXGNTPGXXKXXXWKXGKFGPGGPPPFFFP

SEQ ID NO: 57196 - protein, 449 aa, Bacillus thuringiensis serovar konkukian str. 97-27
MSDPNKDLEDLKREAARRAKEEARKRLVAKHGVEISKLEEENREKEKALPKNDDMTIEEAKRRAAAAAKAKAASLAKQKREGIEEVTEEEKAKAKAKAAAAAKAKAASLAKQKREGIEEVTEEEKVKAKAAAKAKAASLAKQKREGTEEVTEEEKAKAKAAAAAKAKAKAAALAKQKREGTEEVTEEEKAKAKVKAAAKAKAAALAKQKREGTEEVTEEEKAKAKAKAVAAAKAKAAALAKQKASQGNGDSGDEKAKAIAAAKAKAAAAARAKTKGAEGKKEEEPKQEEPSVNEPYLNQYVEVIKGKIGEDILVDFYINKLSKDVPTLVVEPAKYYEVMELLRFHEGLAFDYMSELHATDFVTHMEVYVHLFSYGKKQSVAVKVKLDREAPQVESVTALWKGADWPEREAYDLLGIVFKGHPNLSRILMPDDWVGHPLRKDYEPYDVEV

SEQ ID NO: 57197 - protein, 414 aa, Ustilago maydis 521
MSQRYDLVVFGATGYTGQLVCKYLVTHDARPSWAIAGRSASRLSSLKTSLSLAESVGVIEADTCSYSSLTSMTSQAKVVINIVGPYRPFKATEVVRACIETSTHYVDLSGETGFNKDCIDQFHLEAQAKRVVVVNSAGFDSLPFDLSTYLAVQKLKQLTHANSPVKLAECAYNLPDSLSAGTLASAISMVNEKQQMYSIRGDWLSPVAKPDALVFNTVRWFAQRNRWGAQNTFSIHNTRIVNRTWGLLEHHNSPQAYGEAFIYREGVITPFKLYGIVFSYINALSIWLLMNVALVRSLVKKTMPPNSGPTEKSLVNSTMRVDTVATADDGTQAICSIHAKGHAGYLLTARMIVETALTITDDRSKKSNPLDPIQGGVLTPALVGAETLAQRLVQFAHFQITTDTFLPSEPKKSK

SEQ ID NO: 57198 - protein, 141 aa, Oryza sativa (indica cultivar-group)
MSTPAAGEKPALRKPVFTKVDQLKPVTSGHTLTVKVVSATPVPGRARPGVAAPSRPPRIAECLVGDETGAIVFTARNEQVDLLKPGATVIMRNAKIDMFKGSMRLAVDKWGRIEATEPASFTVKEDNNLSLVEYELVNVTE

SEQ ID NO: 57199 - protein, 116 aa, Erwinia carotovora subsp. atroseptica SCRI1043
MAEETLFSKIIRREIPADIVYQDELVTAFRDIAPRTPTHILIVPNVLIPTVNDTAPEHEAALGRMVTVAGKIAQQEGIAEDGYRLIINCNRHGGQEVYHIHMHLVGGRALGPLLAD

SEQ ID NO: 57200 - protein, 298 aa, Kineococcus radiotolerans SRS30216
MSQDQTQPQDPQEQFSQPDSEGEQIPHPGRTRDMGDQPDHGEDSYRGSNRLDGKKAIITGGDSGIGRAVAIAFAREGADVLIAYLPEEEEDAQTTIRHVEQAGRKGVAVPVDLREEDACQQVVDRAVAEFGRIDVLVNNAAYQMAQPGGIEDITTEQFDRVLKTNLYAMFWLCKKAVPHMQPGATIINTSSIQAYQPSPPLLDYATTKAGIVNFTKGLGQMLAEKGIRVNSVAPGPIWTPLIPATMPEEKVETFGEDAPLGRAGQPAELAPAYVFFASQESSYITAEVLGVTGGSPLA

SEQ ID NO: 57201 - protein, 654 aa, Wolbachia endosymbiont strain TRS of Brugia malayi
MASAIRFLSIDAVQKASSGHPGMPLGMADVATVLFAQYLNHNPDDPKWVNRDRFVLSNGHGSMLLYSILYLTGYISIDELKNFRQLTSKTPGHPEFGLTPGVEATTGPLGQGFAVAVGMALAESILKNQFGINHYTYVMLGDGCLMEGISHEAASLAGHLKLNKLIALFDDNDISIDGATHLSCSDDAEKRFSAYGWNVNKIDGHDFNSISLAIEQARKSDKPTLICCKTIIGKFSNRAGASSAHSGAFTEEDVKQMREKLNWNYVPFHVPKDVKNAWMETVERAKQNYNSVSFQRQALEPSENKELQRRLDKRLPDNIDDDLANLKKQIHETMPNEATRSSFGKVMELLTESMPELIGGSADLTGSNCTKYKHMKVIDNNNYSGSYVHYGVREHAMAACMNGMALHGGILPYGGTFLVFSDYCRPAIRLSALMKQQVIYVMTHDSIGVGEDGPTHQPIEHLASLRTVPNLYVFRPTDAIETLECISIALKKKESPALFALSRQNLGYMRKFHFNVDQSTNLSKSGAYVVCEYSEKLEVTIFATGSEVEIAIETRKKLQEKGIGTRVVSMPCWRLFDEQSDEYKDAILNNDSIKVAIEAGSEIGWHKYIGSNGIFIGMKSFGESAPYKTLYEHFNINTDYVVKCVCEKLFISKP

SEQ ID NO: 57202 - protein, 519 aa, Brassica rapa subsp. pekinensis
MATMAAIGSLKVPSSSSNHTRRLSSSSQRKTLSFSSSSLTGEKLNPTQEIIISNLPRWQREKNAIDSPKAVSDSQNSQTCLDPDASRSVLGIILGGGAGTRLYPLTKKRANRAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEKRSTAFGLMKIDDEGRIIEFAEKPKGEQLKAMKVDTTILGLDDERAKEIPFIASMGIYVVSKNVMLDLLRDQFPGANDFGSEVIPGATDLGLRVQAYLYDGYWEDIGTIEAFYNANLGITKKPVPDFSFYGRSAPIYTQPRYLPPSKMLDADVTDSVIGEGCVIKNCKIHHSVIGLRSCISEGAIIEDTLLMGADYYETDADRTLLAAKGRVPIGIGENSHIKRAIIDKNARIGDNVKIINTDNVQEAARETDGYFIKSGIVTVIKDALIPSGTVI

SEQ ID NO: 57203 - protein, 338 aa, Vibrio parahaemolyticus RIMD 2210633
MSGMRTLGEFIVEKQADFPHASGDLSSLLASIRLAAKIVNREINAAGLGDITGAVGTENVQGEAQQKLDVYANDKFKAALEARDQVCGVASEEEDEAVAFNKELNQNAKYVVLMDPLDGSSNIDVNVSVGTIFSIYRRVSPIGTPATEEDFLQPGHKQVAAGYVIYGSSTMLVYTTGNGVNGFTYDPSIGSFCLSHENMMIPEDGKIYSINEGNYIRFPQGVKKYIKYCQENVPEDGRPYTSRYIGSLVADFHRNLLKGGIYLYPSTQSHPQGKLRLLYECNPMAFLIEQAGGIASDGVNRIMDIKPTELHQRVPFFVGSKNMVRKVEEFLELHRDEE

SEQ ID NO: 57204 - protein, 332 aa, Wolbachia endosymbiont strain TRS of Brugia malayi
MVTLSVREALCTAIREEMQNNHDVFIMGEEVAEYDGAYKVTKGLLKEFGKNRVVDTPITEHGFAGLAVGAAFAGLRPIVEFMTFNFSMQAIDQIVNSAAKINYMSGGQLGCPIVFRGPNGAAARVAAQHSQCFASWYSHVPGLKVIAPYFASDCRGLLKAAIRDPDPVIFLENEIAYGHEHEVPDSELSDKDYLLEIGKAAVIREGKDVTITAFSLKLKDALNAADLLSGGGIEAEVIDLRTLRPLDTETIINSIRKTNRLVSIEEGWPFAGIGAELSAVVMEQGFDYLDAPVVRVTGKDIPLPYAANLEKKALPQVEDIVETVHQVCFRKK

SEQ ID NO: 57205 - protein, 383 aa, Carboxydothermus hydrogenoformans Z-2901
MKFSTGIFDELSMLIKKVSKERDVINLSIGSPDLPPHPKIIEVLAKEVQDFQNYGYTLNPGLEELREGLIAWYQKKYGVNLKIDETLVLLGSQEGLAHLPLSFLNPGDLVLVPNPGYPIYEAAAKLAGAKIYYYPLLEENNYRLDIEKIPYDILRTAKIIFLNYPNNPLTAMANYEFFEKLVFYAKKYGFILVNDLAYGELTFDETRSISLLEIPEAIDVAVEFYSVSKSFNLAGIRVGFAAGNQKVISALTILKSNIDYGVFKPLQKAALEAFKLREVIIPDLVKTYEKRRNVLIKTLSEYGWQVKPPLATMFVWAQLPDGIKDSRKFSLDLLTNAGVAVTPGIGFGDLGEGYVRIALVADEDKLAEAGKRIGEYLQYRRVV

SEQ ID NO: 57206 - protein, 434 aa, Erwinia carotovora subsp. atroseptica SCRI1043
MTSPTKKIVIVGGGAGGLELATSLGHTLGRKKKADITLVDRNHSHLWKPLLHEVATGSLDDDMDALSYLAHARNHAFQFQLGMLTNIDREQQQIQLAEVCDEQGGVLVAARRIPYDILVVALGSASNDFGTPGVKDHCIFLDNPKQARRFHNEMLNLFLKFTANQDEKERVNIAIVGGGATGVELSAELHNAVKQLHSYGFDGLDNQTLNVTLVEAGERILPALPPRISAAAHQELNNIGVRVLTKTMVTSAESGGLNTKDGEFIEADLMVWAAGIKAPDAMKDIAGLETNRINQLVVEPTLQTTRDPNIFAIGDCASCPQEGGGFVPPRAQAAHQMASRCHSNIIALLNGQALKSYVYKDHGSLVSLSKFSTVGSLMGNLMRGSVMVEGRIARFVYISLYRMHQVALHGYVKTGLMMLVGGINRVIRPRLKLH

SEQ ID NO: 57207 - protein, 581 aa, Zea mays
MCGILAVLGCGDESQGKRVHVLELSRRLKHRGPDWSGLHQVADNYLCHQRLAIIDPASGDQPLYNEDKSIAVAVNGEVYNHEELRARLSGHRFRTGSDCEVIAHLYEEYGESFIDMLDGVFSFVLLDARDNSFIAARDAIGVTPLYIGWGIDGSVWISSEMKGLNDDCEHFEIFPPGNLYSSKEKSFKRWYNPPWFSEVIPSVPYDPLRLRSAFEKAVIKRLMTDVPFGVLLSGGLDSSLVAAVAARHFAGTKAAKRWGTRLHSFCVGLEGSPDLKAAKEVADHLGTVHHEFNFTVQDGIDAIEDVIYHIETYDVTTIRASTLMFQMSRKIKALGVKMVISGEGADEIFGGYLYFHKAPNKEEFHQETCRKIKALHQYDCLRANKATSAWGLEVRVPFLDKEFINEAMSIDPEWKMIRPDLGRIEKWILRKAFDDEERPFLPKHILYRQKEQFSDGVGYSWIDGLKDHAASNVSDKMMSNAKFIYPHNTPTTKEAYYYRMIFERYFPQSSAILTVPGGPSVACSTAKAIEWDAQWSGNLDPSGRAALGVHLSAYEQDTVAVGGSNKPGVMNTVVPGVAIET

SEQ ID NO: 57208 - protein, 248 aa, Oryza sativa (indica cultivar-group)
MSGNIAFGRFDDSFSAASLKAYVAEFISTLVFVFAGVGSAIAYTKLTGGAPLDPAGLVAVAVCHGFGLFVAVAIGANISGGHVNPAVTFGLALGGQITILTGVFYWVAQLLGAIVGAVLVQFCTGVATPTHGLSGVGAFEGVVMEIIVTFGLVYTVYATAADPKKGSLGTIAPIAIGFIVGANILVAGPFSGGSMNPARSFGPAVASGDYTNIWIYWVGPLVGGGLAGLVYRYVYMCGDHAPVASSEF

SEQ ID NO: 57209 - protein, 592 aa, Zea mays
MDEAAGLLLQEEGGGGDQEALLLPLPQDVGLYTGDGSVDVKGRPALKGTTGNWKACFFILGNECCERLAYYGIAKNLVTYLKVKLHLGNLEAARHVTTWQGTCYLTPLVGGILADSRWGKYWTIAVFSSVYFIGLAILTLSASVPALQPPSCLRTVCPEASLLQYGIFFGGLYMIALGTGGIKPCVSSFGADQFDDTDQAERAKKGSFFNWFYFCINIGSFISGTMIVWIQDNTGWGIGFAIPTIFMALAISFFFSASNKYRFQKPGGSPLTRVCQVVIAAFRKWHIEVPHDTSLLYEVDGQTSAIEGSRKLEHTNELEFLDRAAVISSADLKSESFTDPWKLCTVTQVEELKILIRMFPIWATTIIFSAVYAQNSSMFIEQGMVLDKRIGSFNIPPASLSTFDVISVIMWVPLYDRILVPLARKFTGREKGFSELQRMGIGLVLSILAMVSAALVELKRLEIARSEGLIHEKAAVPMSILWQIPQYFLVGAAEVFTCIGQVEFFYDQAPDAMRSLCSALALITVSLGNYISSIILTLVSYITTQGGDPGWIPDNLNEGHLDQFFWLIAGISFVNLIVYMGCAVRYRYKKAS

SEQ ID NO: 57210 - protein, 183 aa, Marchantia polymorpha
MFSIINGLKNYNQQAIQAARYIGQGFLVTLDHMNRLPTTIQYPYEKLIPSERFRGRIHFEFDKCIACEVCVRVCPINLPVVDWELKKTIKKKQLKNYSIDFGVCIFCGNCVEYCPTNCLSMTEEYELSTYNRHELNYDQIALGRLPISIIEDSTIENIFNLTSLPKGKIEGHIYSRNITNIVN

SEQ ID NO: 57211 - protein, 258 aa, Prochlorococcus marinus subsp. marinus str. CCMP1375
MTLPQILVFDFDGVIVDGLLEYWDSSRKAFLKIQGALDTDDQLPLEMPHEFRQLRPWVKNGWEMVLLTAELIRKDSPLSMHGAFHFANEYHKNCHTALKTWGWEPKQLQNALDNIRKETIKTDKKKWLASHKLFPNIAERIHQLENESVDFGVLTTKSAEFTSELLNHFNLHPNFLYGHESGQKTTVLLQISKDHSVRGFIEDRRATLETVLNTPGISSIPCYLADWGYLKPDDRKDLPSDIHLLKPEKLMSPLANWP

SEQ ID NO: 57212 - protein, 392 aa, Marchantia polymorpha
MMILTKNKPMIVSMGPHHPSMHGVLRLIVTLDGEDVLDCEPVLGYLHRGMEKIAENRTIVQYLPYVTRWDYLATMFTEAITVNAPEKLTNIQVPKRASYIRIIMLELSRIASHLLWLGPFMADIGAQTPFFYIFREREMIYDLFESATGMRMMHNYFRIGGVAVDLPYGWIDKCLDFCDYFLPKINEYERLITNNPIFLKRVEGIGTVTREEAINWGLSGPMLRASGVQWDLRKVDHYECYDELDWKIQWQKEGDSLARYLVRIGEMKESVKIIQQALKAIPGGPFENLEARRLNQGKNSEWNLFEYQFISKKPSPTFKLPKQEHYVRVEAPKGELGIFLIGDDSVFPWRLKIRSPGFINLQILPQLVKGMKLADIMTILGSIDIIMGEVDR

SEQ ID NO: 57213 - protein, 151 aa, Rhizobium leguminosarum bv. viciae 3841
MMRAQADYSYRNDADVPAFADDRPLIIFDGECVFCTGWVKFALKHDKQQRYRFLAAQTPLGEALYRHYGLHARDYETNILIENGRAFFKSDGSIRMVAGLGFPYSLVKIFRLLPRRAADALYEFIARNRLKIAGRQSCMVPTPQQRSRFIT

SEQ ID NO: 57214 - protein, 237 aa, Bacillus cereus E33L
MKKYALVTGGSGGIGSAISKQLIQDGYTVYVHYNNSEEKVNELQKESGEVIPVQANLASTDGAEQLWKQIEHPLDVIVYAAGKSIFGLVTDVTNDELNDMVELQVKSIYKLLSMALPSMIQRRSGNIVLVSSIWGQIGASCEVLYSMVKGAQNSYVKALAKEVSLSGIRANAVAPGAIETEMLNVFSEEDKNEIAEEIPLGRLGLPEEVAKTVSFLVSPGASYITGQIIGVNGGWHC

SEQ ID NO: 57215 - protein, 444 aa, Glycine max
MATIVSINARQIFDSRGNPTVEVDLTCSDGTFARAAVPSGASTGIYEALELRDGGSDYLGKGVSKAVDNVNTVIGPALIGKDPTEQTAIDNLMVQQLDGTVNEWGWCKQKLGANAILAVFLAVCKAGASVLKIPLYKHIANIAGNKKLVLPVPAFNVINGGSHAGNKLAMQEFMVLPVGASSFKEAMKMGVEVYHNLKSVIKKKYGQDAINVGDEGGFAPNIQENKEGLELLKTAIAKAGYTGKVVIGMDVAASEFYKEDKTYDLNFKEDNNDGSQRISGDALKDLYKSFVSEYPIVSIEDPFDQDDWEHYAKLTAEVGANVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 57216 - protein, 570 aa, Brassica rapa subsp. pekinensis
MVASPDCRISLSAPSCLRGSSGYTKHIKLGSFCNGELMGKKLNLAQLRSSSTNSSQKRIQMSLNSVAGESKVQEIESEKRDPKTVASIILGGGAGTRLFPLTKRRAKPAVPIGGAYRLIDVPMSNCINSGINKVYILTQYNSASLNRHLTRAYNSNGVFGDGFVEALAATQTPGETGKRWFQGTADAVRQFHWLFEDARSKEIEDVLILSGDHLYRMDYMDFVQDQSTKRRDISISCIPIDDRECKRVQQIHSKIMVSYKSLSVLHGRRASDFGLMKIDDKGRVISFSEKPKGDDLKAMAVDTTVLGLSKEEAEKKPYIASMGVYVFKKEILLNLLRWRFPTANDFGSEIIPFSAKEFYVNAYLFNDYWEDIGTIRSFFDANLALTEHPPAFSFYDAAKPIYTSRRNLPPSKIDGSKLIDSIISHGSFLTNCLIEHSIVGIRSRVGSNVQLKDTVMLGADFYETEAEVAALLAEEKVPIGIGENTKISSKTKRSLSNGLPSKQKVLDSFFPSHFPYRECIIDKNARVGKNVVIANSEGVQEADRSSDGFYIRSGITVILKNSVIADGVVI

SEQ ID NO: 57217 - protein, 249 aa, Arabidopsis thaliana
MAGRSGGGRGGGGGGASADLHSAARSARAMIDLIYFTCSLQSFVVHFFVLNIMISWGNRLHLAAWAGHNEVVSYLCKNKADVGAAAGDDMGAIHFASQKGHLEVVRTLLSAGGSVKSITRKGLTPLHYAAQGSHFEIVKYLVKKGASVRATTKAGKSPADVAGNAETQNFLEECEEQARKAKVNNEKKTEIVKPESCSNEGDVKDLKRKDSEDGNEGEEEEASSKPKKPKVALSHLQDIDDTEADQEEE

SEQ ID NO: 57218 - protein, 335 aa, Prochlorococcus marinus subsp. marinus str. CCMP1375
MTSLLDQLSSMTVVVADTGDLEAIRTFKPQDATTNPSLILAAAQIPAYQNLIDKSLQASRQRVGSFASAKEVVDEALDEVCVTFGKEILKIIPGRVSTEVDARLSFNTQATINKARKIIDLYKKVDISKERVLIKVASTWEGIKAAEVLESEGIHCNLTLLFGFSQAVACAEAGVTLISPFVGRILDWYKAETGKDSYAGEEDPGVVSVTKIFNYYKSNNYKTEVMGASFRNIDEILELAGCDLLTIAPKFLEQLENSDSKLTRKLDSLKPLPSETKIHLEEYDFRNMLKLDRMATEKLEEGIINFSKAIEQLEQLLSKRLSYIESGSNAELSIA

SEQ ID NO: 57219 - protein, 171 aa, Zea mays
  misc_feature (157)..(157): Xaa can be any naturally occurring amino acid
  unsure (1)..(171): unsure at all Xaa locations
MDEVMTVADAGGVNRALYGSPPSHNLLPHNLPIFSAFLALALAQFLKVFTNWYKEKRWDSKRMLSSGGMPSSHSATVTALALSIALEEGAGAPAFAIALVLACVVMYDASGVRLHAGRQAELLNQIVCEFPPEHPLSTVKPLRELLGHTPIQVAAGXFLGCVVAYLMRSTS

SEQ ID NO: 57220 - protein, 460 aa, Triticum aestivum
  misc_feature (46)..(46): Xaa can be any naturally occurring amino acid
  misc_feature (64)..(64): Xaa can be any naturally occurring amino acid
  misc_feature (75)..(75): Xaa can be any naturally occurring amino acid
  misc_feature (219)..(219): Xaa can be any naturally occurring amino acid
  misc_feature (231)..(231): Xaa can be any naturally occurring amino acid
  misc_feature (243)..(243): Xaa can be any naturally occurring amino acid
  unsure (1)..(460): unsure at all Xaa locations
MGSSAVQRDSVSAPGNMECADDPGSSSGSRSKWGKMMSNDTWRWCXLGLIYIVAIAGIWIAASXYIVQSVVDGGXVSPFLITYICNSLFIVYIPIVEFARYFEDSIDNLWSKLKGKDGADLQQLADLESVNLLQRSGQEGNAASPLSEDNLTSNANFPIHTELGVADCSKGLDAKGRWTRARTARVSMLVCPFWFLAQLTFNLSLRYTTVTSNTILSSXTSTLFTFLVCIXVFLGETFTWFEXLFSVLLCIAGTIIVSLADSGSTLNAVATNPLLGDFLSIVSAGLYAVYITLIRKKLPDEKEGQGQVSMAQFLGFLGLFNMLFFLPVALVLNFAKLEPFHTLTWEQVGLIVGKGLLDNVLSDYLWAKAILLTTTTVATAGLTIQVPIAALVDTLTGHAPQLLNYIGAAAVLVGFAGINIPSDVLQPSHHQQDQQEAPIVSIVDDSHHSSSDRNSTDAVS

SEQ ID NO: 57221 - protein, 449 aa, Wolbachia endosymbiont strain TRS of Brugia malayi
MNSKYKDVMMNDDLDSTTKQEALKYHIRGGNPGKISILPTKSLSTQYDLSLAYSPGVAAPCLEIAKNPDVVYDYTAKSNCVAVISNGTAVLGLGNIGPLASKPVMEGKAMLFKRFADIDAVDIEVDTENIEDFINAVRYLGPSWGGINLEDIRSPDCFIIEKRLNELMDIPVFHDDQHGTAVVVAAGIENALDIAGKKLEDVKIIMNGAGAAGIACLEILKSMGAKNIVLCDKQGVIYKGRNEDMNEWKEKYATDTKERSLLDAIKDTDVFIGLSAKDALNEEMLKNMGQNPIIFALANPDPEVRPELAKSVRPDAIIATGRSDYNNQVNNVMGFPYIFRGALDVHAMTINNEMKIAAADAIAKLAREPAPDEISAVYGGRKMSYGREYIIPTPFDPRLVSIVSPAVAKAAVCSGVAKKEIQDWSKYANQLKSRLANALNTLNLLSSQY

SEQ ID NO: 57222 - protein, 365 aa, Triticum aestivum
RGRVDTRDLATQTLKFTHQLGKFSDLKTGLIVGGGSMESQFEVLADNPDIIIATPGRFEHILSSARGLSLRSVEYVVFDEADSLFSLGFAEQLHKILHKLSDTRQTLLFSATMPKALAEFAKAGLRDPQVIRLDLDKKISPDLKLAFFTLRQEEKLAALLYLVRERISSEEQTMIFVSTKYHVEFLNILFREEGLEASLSYGAMDQEARTIHISRFRARKTMLLIVTDVAARGLDIPLLDNVVNWDFPAKPKLFIHRVGRVARQGRTGTAFTFVTSEDMPFLLDLHLFLSKPLRPAPTEEELLKDMDGMNLKINQSLADGETIYGRFPQTILDLCSDGEKEVISGCTDLIALEKPCANAFPVVSE

SEQ ID NO: 57223 - protein, 106 aa, Wolbachia endosymbiont strain TRS of Brugia malayi
MSNFEQIKKDITENDVVLYMKGTSDFPQCGFSGLVVSILKKLNVKFKYINVLENDEIRQSIKKFSNWPTIPQLYIKGEFIGGCDITREIYEKGELQSLLKEKKIVE

SEQ ID NO: 57224 - protein, 1421 aa, Cryptococcus neoformans var. neoformans JEC21
MTYHNDDPEATAVQSPASSSSPSLLTGEETNSANVLNKDRTEDAPMSHGKIFDQPGSIPLPNAGYHSLGVVWEDVTVYGAGGGKKYVESFEVSIFKLWDVYSFAKKLFRITTGPTRPLIRNFSGVAEEGEVLLVLGRPGAGCSTLMRALANVHEPFVKIEGDVSYSTIPAHEAKEYYDGEIIFNSEEDEHQPLLTVEETIKAALLLKEPHKKEDKEKRSEYLESLFGRILDTFGMPHTRNTKVGNQFVRGVSGGERKRVSLAEVLTTNAAVTCWDNPIRGLDSAVALHFYKVLRELSKSLGMVNIISTYQTAQDAWDCVDRVVVIYEGRQIFSGRASRAQAYFENMGWYKKPRQTTPDFLTAVTSPNERKVRDGFKGQIPETPEEFEQYFLESQEYKDLQQDIQRYKERHAQSSNADEFQTAVKNSKHPGAGKSTSYRVNFAQQVAILCKRQLQLTRSDMTSLVYRIGSNVLQAVLVGAVCYKPPNNSAGSFATAGALFFCILYYTIFALGEVPATVNSRPLLKKHRALGFYHPAAHTLAQIVCDIPVYVFQTLLFSAIFYFMVGLTAGAKYFFTFWFVIFTMYEAISVMYRMIGSWTPNMSVAIRYGCLALSVVLTSSGFVLPPPRQLRWISWLRRATPCSWAFEALLANEFRARILTCSSTDLIPSGPGYDDIRYQVCSINGAQPGSLNVAGMDYVNFVYGFQVSHIWRNVGILWAYFVVYVIMIVIGSSLLIRESPDSSQKVYKRGGKAAIMDPKEKAEEGKTAMEKVQGPKGSGGEVPVYTFEDVYYTVQVAGKDKPLLNGISGYVKGGSLTALMGASGAGKTTLLDAISLRKTTGKMEGKMTIDGKPLDTSFSRQTGFAMQADIHEPMSTVRECLQFSALLRQSNDRTREERLEFAENIIKLLELEDIADALIGAPGEDGLGVEERKRVTIGVELAADPEFLLFLDEPTSGLDSQASYEIVRFLKRIAASGLAVLCTIHQPSGDLFEMFDSVVLLAPGGHTVYVGETGENAETVVKYFGDRGAYCPPEANPAEFILGTVAPVGGTDTDWPTLWKQSDEATEVRRRINEYTLRNNSGNMDSEKPVIEVQPKSGSDAYASSFMTMTRELVIRNFRAQWRDGSFWTTQTVILIYFGLYVGFFYYKLDHTPNNMTPATLSLLVAVQALPGIAMDIGMNYLAKMDMFLARERLGIYSWQALVTSLLIVSLPVLFVGWNLLFFCFYWTVGLIGTRVDGVLAWLCFMTCSVLNAGFGVLLGAVSPNRLSLPYILSLVWNLLNVLSWALVFYSGLPSPFHYFFSWLSPLRYLYSALMTAALGNLKLECIEEDLITFYPPSGQTCYEYAANYLATTSGYLVDDNSTTSCQYCASSTGYDYVQQMGYSHGTKWRDWAITIIWCFSNIFFCFLFTWAVKIRPLYKKN

SEQ ID NO: 57225 - protein, 107 aa, Glycine max
  misc_feature (92)..(92): Xaa can be any naturally occurring amino acid
  unsure (1)..(107): unsure at all Xaa locations
MASSMISSPAVITVDRACAGMVAPFTGLKSMAGFPTRKTSNDITSIAINRGKVHCMHVLPPIGNKMFETLSYLPYLDDAQLAKEVEYLLMKXWIPCLEFELEHRFAY

SEQ ID NO: 57226 - protein, 501 aa, Pisum sativum
MAMANLARRKGYSLLSSETLRYSFSLRSRAFASGSDENDVVIIGGGPGGYVAAIKAAQLGFKTTCIEKRGALGGTCLNVGCIPSKALLHSSHMYHEAKHSFANHGVKVSNVEIDLAAMMGQKDKAVSNLTRGIEGLFKKNKVTYVKGYGKFVSPSEISVDTIEGENTVVKGKHIIIATGSDVKSLPGVTIDEKKIVSSTGALALSEIPKKLVVIGAGYIGLEMGSVWGRIGSEVTVVEFASEIVPTMDAEIRKQFQRSLEKQGMKFKLKTKVVGVDTSGDGVKLTVEPSAGGEQTIIEADVVLVSAGRTPFTSGLNLDKIGVETDKLGRILVNERFSTNVSGVYAIGDVIPGPMLAHKAEEDGVACVEYLAGKVGHVDYDKVPGVVYTNPEVASVGKTEEQVKETGVEYRVGKFPFMANSRAKAIDNAEGLVKIIAEKETDKILGVHIMAPNAGELIHEAAIALQYDASSEDIARVCHAHPTMSEAIKEAAMATYDKPIHI

SEQ ID NO: 57227 - protein, 524 aa, Erysiphe necator
MYIADILSDLLTQQTTRYGWIFMVTSIAFSIILLAVGLNVLSQLLFRRPYEPPVVFHWFPIIGSTISYGIDPYKFYFDCRAKYGDIFTFILLGKKVTVYLGLQGNNFILNGKLKDVNAEEIYTNLTTPVFGRDVVYDCPNSKLMEQKKFMKTALTIEAFHSYVTIIQNEVEAYINNCVSFQGESGTVNISKVMAEITIYTASHALQGEEVRENFDSSFAALYHDLDMGFTPINFTFYWAPLPWNRARDHAQRTVARTYMNIIQARREEKRSGENKHDIMWELMRSTYKDGTPVPDREIAHMMIALLMAGQHSSSSTSSWIMLWLAARPDIMEELYEEQLRIFGSEKPFPPLQYEDLSKLQLHQNVLKEVLRLHAPIHSIMRKVKNPMIVPGTKYVIPTSHVLISSPGCTSQDATFFPDPLKWDPHRWDIGSGKVLGNDAVDEKYDYGYGLTSTGASSPYLPFGAGRHRCIGEQFATLQLVTIMATMVRFFRFRNIDGKQGVVKTDYSSLFSMPLAPALIGWEKR

SEQ ID NO: 57228 - protein, 394 aa, Legionella pneumophila str. Paris
MHLKRTLSLTLLAFYGLGTILGAGIYALVGEVAKEAAQFTPLSFLIASIIALFTAISYAELSSRLPHSAGSALYVRRAFHQKWLSGLIGWIVVLTGIISAATLSHGFVKYFQLFFPLPPSLIITILTVILAGVAIWGIRESATLILFMTLMEVGGLLMIIYYGRYSLASIDIKSFSFPHSFDGVLIGAFIAFYAFIGFEDMVNTAEETINPEKTLPKAIFLALISATILYIAVAWVIVLTIPSNTLVKTDMPLIEIIKLQGQSPLLFSIIALISITNGILVQIIMASRLIYGMANQQNAPQIFSSVYSKTQTPVHSTLLVFLMILLFAYALPITTLAKLTSSIILCIFIIIHASLIKIKLTEKKPTNAISFPIVFPMISILLTLAFLIIQFFLK

SEQ ID NO: 57229 - protein, 128 aa, Zea mays
  misc_feature (100)..(100): Xaa can be any naturally occurring amino acid
  unsure (1)..(128): unsure at all Xaa locations
DILFDIDSTLCNSDPIYFCAFRELLQYGGFNGGVPITEECYCSHICGSHNDYLTTSVFPTMNYPKAMRFMNDTETMIPSLTTCQLKPVNGLLELCVWIAXRDMKRASLTIATRANDELMLALMVLTDF

SEQ ID NO: 57230 - protein, 77 aa, Triticum aestivum
  misc_feature (12)..(12): Xaa can be any naturally occurring amino acid
  unsure (1)..(77): unsure at all Xaa locations
IVEPDVDKTNQXYYGETKLHYLTTDRAFKGIVPLKKEGPVHDVQWSSSGSEFVVVYGYILTYSGEPCMSHASLFCCP

SEQ ID NO: 57231 - protein, 213 aa, Ustilago maydis 521
MAAESNYDYLFKVVLIGDSGTGKSNLLSRFTRNEFSLESKSTIGVEFATRSISVDGKTVKAQIWDTAGQERYRAITSAYYRGAVGALLVYDIAKHPTYVNVSRWLKELRDHADSNIVIMLVGNKSDLRHLRAVPTEEAKAFAAENNLSFIETSALDASNVEQAFQNILTEIYRIVSNKALQSSDDVIKPSGGETITVQPSADDGGQTKKNGCC

SEQ ID NO: 57232 - protein, 306 aa, Vibrio vulnificus YJ016
MCAITHLIALLNRETMNDDNSQNSEGPSRKSFFGRLGQLFQGEPKDRQELVDVIRDSEVNDLIDHDTRDMLEGVMEIAEMRVRDIMIPRSQMVTIERKDNLDSLIALITDAQHSRYPVISEDKDHVEGILLAKDLLKYLGSDSAPFDIEEVIRPAVVVPESKRVDRLLKEFRQERYHMAIVVDEFGGVSGLVTIEDILEEIVGDIEDEFDEEEDADIRKLSKHTYAVKALTTIEEFNETFGSRFSDEEVDTVGGLVMTAFGHLPTRGEIVEIDGFNFKVTAADNRRVIQLQVTVPDSVSVAETTPE

SEQ ID NO: 57233 - protein, 72 aa, Oryza sativa
  misc_feature (47)..(47): Xaa can be any naturally occurring amino acid
  unsure (1)..(72): unsure at all Xaa locations
LPSNEELTLQTRLIDNLKNHVNVTNSLLQLGQKRLPILNKPTKGGCXSMSLLQSFFPIVTLAFIFWLLINKM

SEQ ID NO: 57234 - protein, 429 aa, Xanthomonas campestris pv. campestris str. ATCC 33913
MNHSRSHALFSQAQNLMPGGVNSPVRAFKSVGGEPFFVARADGAYLFDVDGNRYIDYVGSWGPMIAGHNHPAVREAVERAIRDGLSFGAPCEAEVTMAETITRLVPSCEMVRMVNSGTEATLSAIRLARGATGRNRIVKFEGCYHGHGDSFLVKAGSGMLTLGVPTSPGVPAGLSELTATLSFNDFEGATALFDEIGAEVAAVIIEPVVGNANCIPPQAGYLQHLRTLCTRHGALLIFDEVMTGFRVALGGAQAHYGVTPDLTTFGKIIGGGMPVGAYGGGRDLMEQISPAGPIYQAGTLSGNPVAMAAGLAMLQLVQEPGFHARLSETTSLLCEGLEDAARAAGVAVTTNQVGGMFGLFFTDQIVENYAQATACDVTTFNRFFHAMLQQGVYLAPSAYEAGFVSSAHDEAVIEATLAAAREAFADVMR

SEQ ID NO: 57235 - protein, 358 aa, Leptospira interrogans serovar Lai str. 56601
MKNVAVLSGDGIGPEVMEIAISVLKKALGAKVSEFQFKEGFVGGIAIDKTGHPLPPETLKLCEESSAILFGSVGGPKWETLPPEKQPERGALLPLRKHFDLFANLRPAIIYPELKNASPVRSDIIGNGLDILILRELTGGIYFGQPKGREGSGQEEFAYDTMKYSRREIERIAKVAFQAARKRNNKVTSIDKANVLTTSVFWKEVVIELHKKEFSDVQLNHLYVDNAAMQLIVNPKQFDVVLCENMFGDILSDEASIITGSIGMLPSASLSESGFGLYEPSGGSAPDIAGKGVANPIAQVLSAALMLRYSFSMEEEANKIETAVRKTIASGKRTRDIAEVGSTIVGTKEIGQLIESFL

SEQ ID NO: 57236 - protein, 587 aa, Leptospira interrogans serovar Lai str. 56601
MNHLESFILPWTQEPFPNTVRKEANLALEKFSRGESGPEVEAFSIPLEFGTGGMRGKLGNGIGRMNEFTVGRAALGFISYLSKKNKKASIVIAYDSRRRSKEFAEVTAGIAAYLGVKVILFKEVTPTPILSYAIRYYKASGGVVITASHNPPEYNGFKAYLSDGGQLVPPDDQKIISKIDSIQDWKQIPILSTKDPIYKKMVKFAGKDCFTSYKKDLSKAGILSISLKPKDRTALKIVYSPLHGTGGKSMQELLNSFGYKNVFLVPEQKDPNGEFPTVKYPNPEEAEAMELSKKFAIQKNAHAFIATDPDADRLGIGVKNENGEYVLFNGNQIGSIMAAYLCEAYSTGKKKKKAVLVKTIVTTDLQENIAKKNKVKYKNVLTGFKFIAQVMAKIDKSKTDFFLFGGEESFGYLPVSFVRDKDSLSSALLLLEILTEKKDLFNYMDEIYLKYGLFQESLKSLTLEGSAGKEKIRKSLESLRTLDLLGKKIHHRKITGILDYKTQIAKGNASKSAFSGCPLSDVIQVILEGNAKLTIRPSGTEPKIKIYSSFQSLKAPKSKEEIKILTKDLLSEIKTSEEIFLQLAGLS

SEQ ID NO: 57237 - protein, 227 aa, Zea mays
LLGRQTDLNLWLSYQTDDHSLRDEFAKYGQVIEARIIIDRESGRSRGFGFVTYTSSEEASAAITALDGKTLDGRSIRVNHANEKTGGFRGGGGYGGGGYGGGGGYGGGGGGYGGGGGYGGGGGGGGYGGGDYGGNRNRGGGGDYGVAGGGGGTFTAGGSDSFANSNFGSDSSFGGNGAGGFDATGGSTGDDGFSGTPDDNFGGNKNEETMDDIFKDDEPDSYADKRS

SEQ ID NO: 57238 - protein, 283 aa, Zea mays
  misc_feature (112)..(112): Xaa can be any naturally occurring amino acid
  misc_feature (160)..(160): Xaa can be any naturally occurring amino acid
  unsure (1)..(283): unsure at all Xaa locations
MRLRGRSGRARAGDHRKELRRAAAAAATPPPAATRPLRRAAARLRRLDSTVEKRLLIPFREIQAECTIPKDDAPLASVGGLPVQDDAARTTMHGGPRNHPAAATDGVNPLAXLMTLRSGLAAVPYGGSQGGLGCSPGGLSWSELERLTRVFTPQCHPRIXIHTDIPAPDMGTNSQTMAWILDEYSKFHGHSPAVVTGKPIDLGGSLGRDAATGRGVMYATEALLAEYGKSISGSTFVIQGFGNVGSWAAQLIHEKGGKVIALGDVSGTIRNKAGIDVPALMKH

SEQ ID NO: 57239 - protein, 468 aa, Escherichia coli
MKKVNHWINGKNVAGNDYFLTTNPATGEVLADVASGGEAEINQAVATAKEAFPKWANLPMKERARLMRRLGDLIDQNVPEIAAMETADTGLPIHQTKNVLIPRASHNFEFFAEVCQQMNGKTYPVDDKMLNYTLVQPVGVCALVSPWNVPFMTATWKVAPCLALGITAVLKMSELSPLTADRLGELALEAGIPAGVLNVVQGYGATAGDALVRHHDVRAVSFTGGTATGRNIMKNAGLKKYSMELGGKSPVLIFEDADIERALDAALFTIFSINGERCTAGSRIFIQQSIYPEFVKFAERANRVRVGDPTDPNTQVGALISQQHWEKVSGYIRLGIEEGATLLAGGPDKPSDLPAHLKGGNFLRPTVLADVDNRMRVAQEEIFGPVACLLPFKDEAEALRLANDVEYGLASYIWTQDVSKVLRLARGIEAGMVFVNTQFVRDLRHAFGGVKPRTGREGGGYSSKCSRK

SEQ ID NO: 57240 - protein, 399 aa, Wolbachia endosymbiont strain TRS of Brugia malayi
MMNIPNIENCDLHGKAVLLRVDFNIPIKNGKVHDATRVLRSLPTIRHLVNAGAKVIIISHFGRPRAKDNNLSLKNVVKTLSQLLNKEVKFVDDCIGKKVQKVVNAIAIRDVILLENLRFYKEEEQNDANFAKQLASLADVYVNDAFSCSHRAHASISRITEFLPSYAGFCLQDELRYLEKAVSFEAKPITAIVGGAKISTKIKMLIRLAEKVDYLVLGGAIANNFLLFNKVNIGKSFFQNGVDSLLHDVVKIADKNNCKIVIPEDVLIAVNSDYSTCILRKTESVLDNDVILDIGPQTLSTISSIVASSKALLWNGPIGVFEHSAFANGTIEVMKVVSDSTHKGKLTSVIGGGDSLSAINAAGLTDKDFTYVSTGGGAFLSWLSGDKMPGIAALQSMLN

SEQ ID NO: 57241 - protein, 136 aa, Brassica napus
  misc_feature (7)..(7): Xaa can be any naturally occurring amino acid
  misc_feature (15)..(15): Xaa can be any naturally occurring amino acid
  misc_feature (25)..(25): Xaa can be any naturally occurring amino acid
  misc_feature (128)..(128): Xaa can be any naturally occurring amino acid
  unsure (1)..(136): unsure at all Xaa locations
AFELAPXNMLFAPKXGNGYGEDEDXHLALMMELLGKIPRKIATGGARSKDYFDRHGDLKRIRRLKYWPLDRLLTDKYKLPEAEAREFAEFLCPILAFEPEKRPTAQQCLQHPWLNLRAQNNEDQVEGXMSNLQIKG

SEQ ID NO: 57242 - protein, 175 aa, Erwinia carotovora subsp. atroseptica SCRI1043
MAGQSIIIMGVSGCGKSSVGAAIANALGAKFIDGDDLHPRANIQKMASGQPLDDNDRAPWLERLNDAAYSLRHKNEVGLIVCSSLKRRYRDRLRQDNPEMLFLYMKGSFDVILERLKARAGHFMPTDLLKSQFEALEEPAANETDVVSIDIDGDFDEVVARGLAALRNAGVVSRR

SEQ ID NO: 57243 - protein, 257 aa, Legionella pneumophila str. Paris
MNFLNNKIVMITGASSGIGQACARLFAAQGARLILAARRVERLHELSSELKHHNNQEHYILPLDVCKKDLVRQQIESLPSQWNSIDVLINNAGLALDTLPLHQGILEHWDTMIDTNIKGLLYISRLILPGMLERNSGHVINIGSIAGHECYPNGNVYSATKHAVHAISKSMRLDMLGSAVRVTEIAPGAVETEFSEVRWKDKQRAIDFYKDFQPLMAEDVADAALYCATRPLHVDIEQMIIMPTVQASANHLSRRGR

SEQ ID NO: 57244 - protein, 189 aa, Triticum aestivum
  misc_feature (161)..(161): Xaa can be any naturally occurring amino acid
  misc_feature (165)..(165): Xaa can be any naturally occurring amino acid
  unsure (1)..(189): unsure at all Xaa locations
MIRAASPRPPSAVQLRSSAASSSSACPFRARGSGSRVAATGGRRRNAISCCASDDREGARGAAAPAPAPTAPSDGSIQLYSQIEKVITEAAKQSNQGWSSTGDWTEIEGAWVLRPKSSEPSFVVHFIGGIFVGAAPQVTYRYFLERLADKGALVIATPYGXVGFXHFFIADQVSFLVLTGALEKLGKNL

SEQ ID NO: 57245 - protein, 570 aa, Ustilago maydis 521
MGLAGMKEGRPETDMVPTFLGLRGIRLNWAIGFAASAGFLLFGYDQGVLGSLYTLPSWLAQFPEINTGPDSSPTSNASVLQGLVTGVYELGCFVGAISMLYFGNLLGRRVNIWIGSIIMAVGAIGCTASYSLAQLFVFRVILGIGNGMHTATIPVWQSECSPPHKRGMLIMVEGAMITGGIAMAYWIDFGCFFLEPSSASWRVPLALQLVLILPTFVTAFLPESPRWLMLRGREEEARCVVAALDNVPVDDPMVGKKLREIAASLEAAKTTRIRDIFTNGPERNLHRTILGFVSQMFQQISGINLITYYIGKTLQENLGFSDINSRILAAANGTEYFIASWAAVFFIEKMGRRPLMLGGAAGQCVCMIVLAILDVPRIKNSGNGPPVASVVFYFLFNTSFAWGWLGMTWLYPAEITPLAIRAQANGISTSANWLFNFMVVMVTPVMFNNIGYQTYVVFAVLNFVILVVTFFIFPETAGRSLEEMSAIFAVSSKINPYDVVRKEKITPRRYDKQGHLINDDVDIVEDYDKGDLEKNLGDGKRGGDTNVVTEDATATPTSDGNSSREHSPRS

SEQ ID NO: 57246 - protein, 407 aa, Oryza sativa
MSSTLMASCCFIISYKRPRPIIATFVPFLLLLFFFAVVVAASSSSNGTAAALHPGEELLRLERVRAQLARVRRASVKTIQSPDGDVIDCVPSHLQPAFEHPRLRGQKPEEPPSARPTETTRRRRRRRRSHAAGGRFGMKPRGVGVVGGAARRDSTSSGHEHAVGYMSGGQFYGAKASLNVWPAKVASPAEFSLSQIWLISGSFGNDLNTIEAGWQVSPQLYGDNNPRFFTYWTNDAYQETGCYNLHCSGFVQTNSRIAMGAAISPISSFAGRQFDITLLIWKDPKQGHWWLQLGSGALVGYWLSFLFSHLGARADMAQFGGEVVNTRPSGSHTPTQMGSGRFPGEGYGRAAYFRNVQVVDWDNNLIPAAALRLLADHPACYDIAGGQGAAWGRYFYYGGPGRNARCP

SEQ ID NO: 57247 - protein, 279 aa, Oryza sativa (japonica cultivar-group)
MEQSAGQRSSVATNATVDLEVLDCTVCCHPLKPPVLQCGVGHVICSSCHGKLPDKNRCHVCAMDTAYNRCFAVEQILRSILVPCRNAGYGCDAKTAYHDSDSHEDGCPHAPCFCPEPGCGFAGATSSLPAHFTGGHGWPPATEFRRARAFDLQVQEGKRVLRDVDGGHLFLVDVAPAGPAGLAGAVLLLDPHAGAKAKPKFECHVAFHCRATGWRSSSEFPVRSTALDGGSLPADCYAFVVPRVAHPPATASIIVSVYDVSKKRPRNGDIRQHLKSRVN

SEQ ID NO: 57248 - protein, 408 aa, Xanthomonas campestris pv. campestris str. ATCC 33913
MSTAADSPLSLAHYYLPVYRPRQVVLERGQGSRVWDDQGREYLDLSSGIAVSGLGHNDPDLMAALTEQAGKLWHTSNVFFSAPPLKLAEELVTASRFAQKVFLCNSGTEANEAAIKLVRKWASSQGRPADKRVIVTFRGSFHGRTLASVTATAQPKYQEGYEPLPGGFRYVDFNDVPALESAMASGDVAAVMLEPIQGEGGVMPAAPGFLARVRALCDQHDALLVLDEIQCGMGRTGSLFAHWQEQVTPDIVTLAKALGGGFPIGAMLAGPKVAETMQFGAHGTTFGGNPLAAAVARVALRKLASPQIAENVARQSAALRAGLEALNAEFGVFAQIRGRGLMLGAVLAPAHAGQAGAILDLAAAHGLLLLQAGPDVLRFVPALNLTDAELADGLARLRLAIAAYVAQH

SEQ ID NO: 57249 - protein, 427 aa, Sulfolobus tokodaii
MDKRRCTFLSENLWKKALELFAGGVNSPVRAAVKPYPFYVEKSEGAFLYTIDGQRLIDYVLGYGPLILGHAHPYVKKKIIEQIEKGWLYGTPSKKEIELAEKIRSHIPSAEKIRFVNSGTEATMLAIRLARGYTKREKILKFDGNYHGAHDYALINAGSAVSEFNVIISSGIPTSIINTVIVCKYNDLDCVEKHLRTEEIAGVIVEPVMGNMGVILPEQDFLNGLRELTKTYNSVLIFDEVITGFRLGLSGAQGYFKVIPDLTTLGKIIGGGLPIGAVTGKKEIMSNLTPEGKVFNAGTFNANPLTMAAGIATIEVLETTNAYDIANKASKEIAEELDNSLSKKNFKYTINRIQSMFQFFIGISKVTNADDARLANKDLYVKIHEKLLKLGVFIPPSQFETIFTSSSHSDEIVNLTIEAIHKVVSEI

SEQ ID NO: 57250 - protein, 923 aa, Avena sativa
MASKGAGGGGGGHEEPQRPKQQLPRDSRGSLEVFNPSSSSAAVEPPSAFRPAARSASPFIEEATGGIEDVGKATQRAAEWGLVLQTNEQTGRPQGVSARSSGGGGSARSSSDDKAVAGAIPRVSEELRAALSAFQQTFVVSDASRPGHPIMYASAGFFNMTGYTSKEVVGRNCRFLQGSGTDPAEIAKIRQALANGSNYCGRVLNYKKDGTAFWNLLTIAPIKDEEGRVLKFIGMQVEVSKYTEGNKDTVVRPNGLPESLIKYDARQKDQARSSVSELLLAIKNPRSLSESTNSTFKRKSQESVGALTGDRPGKRSSESGSRRNSKSGARTSLQKISEVPERGSKSRKSGLYSLMSLLGMGPGNIEKDMLKPRDEDPLLDSDDERPESFDDELRRKEMRRGIDLATTLERIEKNFVITDPRLPDNPIIFASDSFLQLTEYSREEILGRNCRFLQGPETDRATVRKIRDAIDNQTEVTVQLINYTKSGKKFWNLFHLQPMRDQKGDVQYFIGVQLDGTEHVRDAAEREGVMLIKKTAENIDEAAKELPDANLRPEDLWANHSKVVLPKPHMKDSASWRAIQKVLEGGENIDLKHFRPVKPLGSGDTGSVHLVELLNTGEYFAMKAMDKNVMLNRNKVHRANAEREILDMLDHPFLPTLYASFQTKTHICLITDYYPGGELFLLLDRQPLKVLREDAVRFYAAEVVIALEYLHCQGIIYRDLKPENILLHRDGHISLTDFDLSCLTSCRPQVFLPEEANKKSRRKSRSSPIFFAEPMRASNSFVGTEEYIAPEIITGAGHTSAVDWWALGILLYEMLYGYTPFRGKTRQRTFANILHKDIRFPASISVSLPARQLIYRLLHRDPSNRLGSYEGSNEIKEHPFFRGINWALVRGTAPPKLDAPLFPDDTDKGMGDAAAADTHTDMF

SEQ ID NO: 57251 - protein, 372 aa, Oryza sativa (japonica cultivar-group)
MASSSSSSSSSPPPPPPRRSVFDAAYIRAEFAAAGISPHFIPLIWKYVLQNPRCGDLDAVPSLPAAAYALLRQKFQPTTSTLTTAAESKDRTTTKLLIRLKLQFDLNLVTLLSDNKHNGESVEAVIMRYDTRLGKYDGKPRPGGVRSTLCVSSQVGCKMGCRFCATGTMGFKSNLSSGEIVEQLVHASRYSQIRNVVFMGMGEPLNNYTALVEAIQVLIGSPFQLSPKRITVSTVGIIHSINKFNNDLPNINLAVSLHAPDQDIRCHIMPAARAFPLVKLMNALQSYQNESKQTIFIEYIMLDGVNDQEQHAHQLGKLLEMFKAVVNLIPFNPIGSSNNFKTSSEHNVKKFQKILRGIYNIRTTIRQQMGQT

SEQ ID NO: 57252 - protein, 927 aa, Avena sativa
MASKGAGAGGGGGGGDGYDEPQRPKQQLPRDSRGSLEVFNPSSSAVEPPSAFRPAARSASPFIEEVAGGIEDVGKATQRAAEWGLVLQTNEQTGRPQGVSARSSGGGGSARSSSDDKAVAGAIPRVSEELRAALSAFQQTFVVSDASRPGHPIMYASAGFFNMTGYTSKEVVGRNCRFLQGSGTDPAEIAKIRQALADGSNYCGRVLNYKKDGTAFWNLLTIAPIKDEEGRVLKFIGMQVEVSKYTEGNKDTAVRPNGLPESLIKYDARQKDQARSSVSELLLAIKNPRSLSESTNSTFKRKSQESVGPLTGDRPGKRSSESGSRRNSKSGARTSLQKISEVPERGNKSRKSGLYSLMSLLGMGPGNIEKDMLKPRDEDPLLDSDDERPESFDDELRRKEMRRGIDLATTLERIEKNFVITDPRLPDNPIIFASDSFLQLTEYSREEILGRNCRFLQGPETDRATVRKIRDAIDNQTEVTVQLINYTKSGKKFWNLFHLQPMRDQKGDVQYFIGVQLDGTEHVRDAAEREGVMLIKKTAENIDEAAKELPDANLRPEDLWANHSKVVLPKPHMKDSASWRAIQKVLEGGENIDLKHFRPVKPLGSGDTGSVHLVELLNTGEYFAMKAMDKNVMLNRNKVHRANAEREILDMLDHPFLPTLYASFQTKTHICLITDYYPGGELFLLLDRQPLKVLREDAVRFYAAEVVIALEYLHCQGIIYRDLKPENILLHRDGHISLTDFDLSCLTSCRPQVFLPEEANKKSRRKSRSSPVFFAEPMRASNSFVGTEEYIAPEIITGAGHTSAVDWWALGILLYEMLYGYTPFRGKTRQRTFANILHKDIRFPASISVSLPARQLIYRLLHRDPSNRLGSYEGSNEIKEHPFFRGINWALVRGTAPPKLDAPLFPDGTDKGLGDATAAADNHTDMF

SEQ ID NO: 57253 - protein, 400 aa, Thermosynechococcus elongatus BP-1
MSKKSVAQLSAADLEGKRVLVRVDFNVPVDEKGVITDETRIRAALPTIQDLISKGAKVILVSHFGRPKGVDEKLRLTPVAQRLSELLHKPVAKLDDCIGDAVIAHTQAMANGDVCLLENVRFHPGEEKNDPEFAKQLAACAEVYVNDAFGTAHRAHASTAGVTQYLSPCVAGFLMEKELEYLQNAIEHPRRPLAAIVGGSKVSSKIGVIEALLEKVDKLLIGGGMIFTFYKARGLNVGKSLVEEDKLELAKHLETKAQEKGVELLLPTDVVVADNFANDANSQVVSIEAIPDDWMGLDIGPASVKRFQEALQDCKTVIWNGPMGVFEFDQFAKGTEAIARYLAELTSQGVCTIIGGGDSVAAVEKVGVADRMSHISTGGGASLELLEGKQLPGIAALDDA

SEQ ID NO: 57254 - protein, 243 aa, Lithospermum erythrorhizon
  misc_feature (213)..(213): Xaa can be any naturally occurring amino acid
  unsure (1)..(243): unsure at all Xaa locations
PHCAIIVATIRALKMHGGGAAVTAGKPLDRAYVTENVGLVEAGCINLARHIENTKTYGTNVVVAINMFQLILKRTGCSKKCSIGSWAFDAVVCSHHAHGGKGAVDLGIAVQKACENVTQPMKFLYPLDISIKEKIEAIARSYGASGVEYSEKAEKQIETYSNQGFSGLPICIAKTQYSFSDDASKKGGSSGFVLPIREVRASIGAGFIYPLRXTMRAMPGLPTRPCFYEIDIDTQTGRVIGLS

SEQ ID NO: 57255 - protein, 320 aa, Nicotiana glutinosa
MENFPIINLEKLNGSERADTMEMIKDACENWGFFELVNHGIPHEVMDTVEKLTKGHYKKCMEQRFKELVANKGLEAVQAEVTDLDWESTFFLRHLPVSNISEVPDLDDQYREVMRDFAKRLEKLAEELLDLLCENLGLEKGYLKNVFYGSKGPNFGTKVSNYPPCPKPNLNKGLRAHTDAGGIILLFQDDKVSGLQLLKDGQWIDVPPMRHSIVVNLGDQLEVITNGKYKSVMHRVIAQTDGTRMSLASFYNPGSDAVIFPAPALVEKEAEESKAIYPKFVFDDYMKLYALLKFQAKEPRFEAMIKAMETDVKCDPVATA

SEQ ID NO: 57256 - protein, 316 aa, Nicotiana glutinosa
MESFPVVNMELLNSEQRAATMETIKDACENWGFFEVVNHGISHELLDTVEKFTKGHYNECMERRFKEMVASKGLEAVQTEIKDLDWESTFYLKHLPVSTISQVPDLEDEYRKIMKEFAEKLEKLAEQLLDLLCENLGLEQGYLKKAFYGSNGPTFGTKVSNYPPCPKPDLIKGLRAHTDAGGIILLFQDDKVSGLQLLKDDKWIGVPPMRHSIVINLGDQLEVITNGKYKSMEHRVIAQPDGNRMSIASFYNPGSDAGISPAPELLEKENKVIYPKFVFEDYMKLYAGLKFQAKEPRFEAMKAVETAVNSAPIATV

SEQ ID NO: 57257 - protein, 438 aa, Triticum aestivum
  misc_feature (240)..(240): Xaa can be any naturally occurring amino acid
  misc_feature (430)..(430): Xaa can be any naturally occurring amino acid
  unsure (1)..(438): unsure at all Xaa locations
MDDDDAGGGGDASPQHEGGGGAVVIERGAGATAPARDAAAASPTSSRSVTETVNGSHRFVIQGYSLAKGMGVGKHIASETFAVGGYQWAIYFYPDGKNPEDNSAYVSVFIALASEGTDVRALFELTLQDQSGRGKHKVHSHFDRALDAGPYTLKYRGSMWGYKRFFRRTALETSDFLKDDCLKINCTVGVVTSTMEYSRPHSLEVPDSDIGYHFGTLLDSQEGADVIFSVAGEKFHAHKXVWGARSSFFRSEFLDPESDEENSEVDTSNEIKEIVIDDMEPKVFQAVLHFMYRDNLVGDDELSASSSDCPIFDTLAGKLLAAADKYELPRLRVLCESYLCKQISVKSVATTLALADRHHATELKSVCLKFAAENLSAVIRTDGFDYLKDNCPALQSEILRTVAGCEEECSSGGKSQSVWGQISDGGDTSXGRRVRPRV

SEQ ID NO: 57258 - protein, 316 aa, Cryptococcus neoformans var. neoformans JEC21
MSRIVSSDFRNCNFYPYYYPVVKYGYPPKPLPSTAGPLSSIPIGKGEQLIVSSIPSGGPSKKVPVVAQPSTTTSSAPAASRPTNASPVLAAPLVSNASQGEGVESGESVAVPGRDAGYLQLRVVPDDNSCLFSAIGIVFEGGIEAAQRLRMVVANAIKDDPFTYSEVMLGQPIDQYVKRIQKPQTWGGAIELSIFAKHYKTEIASFDVATGRCDRFGQDEYDTRCILVYSGIHYDAISLSPLPVSPASFHTTIFPVTDQIILTTADKLVSQLRARHYYTDTANFDLRCAICKKGLRGEKGAREHAMQTGHVEFGEY

SEQ ID NO: 57259 - protein, 560 aa, Cryptococcus neoformans var. neoformans JEC21
MIPRVTAFLSNILRQPALKRIMEHTEPMKRPRSPSPQQAMVPEAKRPHIEPAPVPAAVQVDAEEAMFNVEEETQGGKGRRGKRGNEGQARKEKKEKRDAKDPRAQRAWEPSEKTNGEKRLPKRRCAVLIGYCGTGYQGMQIQDHTDRTIEGEVFAALVKAGAVSADNAIDARKVDIARAARTDAGVHAAGNVISIKMITEPPLPEGFKDVAEYVNTFLPDQIRMWGWVRTVKSFNARTAADSRIYEYLLPSYCLIPPHKDDSLAKHLDLSSPDWREIVGEGPCSFADARLPMPTSDEGEVDPKVRGEYERKRKWRVDEKTLGRFRDIIAQYKGTHNFYNYTVGKPFNDRAVKRFMIKLEVKEPKVYGEIEWISVQIHGQSFMLHQIRKMISMAMLACRTGSPPSLLPETFGPKKIHIPKAPPLGLLLEAPQFGVYNDRITQKLNGITEDRDPVNFGLYADEIYAFKVKWIYEMLRKEELEKNVFHKWIQMMDNIKNDSLGYLNTKGIIPAEATALVLEQESKRKEGQKTQKEGVETGVEEIESDDEEVDQEALKRGELEG

SEQ ID NO: 57260 - protein, 291 aa, marine gamma proteobacterium HTCC2080
MLTVLSAIPKHIVITGPTAGIGRATALSLALQGAQLTLLCRNLNKGLAVSEVIESAGGLKPHLVQVDMASLQSVRIAAASVLDLGLPIDVLLNNAGLINSYRRETPDGFEETLAVNHFAPFLLTGLLLPAILNAAPGARIVNVASGAHSFVKGMGFDDIQLQQSYKMFEAYGRSKLANILFTRTLSQRLAEKGVTVNCLHPGAVATDIGKQHGELIAKIIPILLKPFFRGPQKGAETSIYLCTDDKVADQTGGYWYNCKLTKVKPWAKDDAQAQRLWNYTQDTLGYQYPQL

SEQ ID NO: 57261 - protein, 457 aa, Oryza sativa (japonica cultivar-group)
MIRVVSPPPPSTVQLRGGGGTPGPSSSSAVCRFWGSRRGSRVAATSSWGWGKSRRRRRAAISCCSAEEGEGPRVATPSAPPAPSEGSIQLYSQIERVITEAAKQSREGWGSTGDWTEIEGAWVLKPKSQEPSFVVHFVGGIFVGAAPQITYRFFLERLADKGALVIATPYASGFDHFFIADEVQFKFDRCLRNMVEPVNDLPTFGVGHSLGSVIHLLIGSRYAVQRSGNILMAFNNKEASLAVPLFSPVIVPMAQSFGPIFSQLTSYPTLRFGAEAAIKQLENLSPPVVKQLLPLVQQLPPLYMDLVKGREEFVPKPEETRRLVKSYYGISRNLLIKFKDDQIDETSILAQVLSSESAISSLLDMSIRSLPGDHGLPLQQVLPDVPPAMADAVNRGGELLTNLATGTPWEAVAKEVGSTLGADSGVLRAQISKDVNTLVDVIVSWIESNSGPRLLRS

SEQ ID NO: 57262 - protein, 457 aa, Rhodococcus sp. RHA1
MADAHSDVLILGGGSGGYACAFRAAQLGLSVTLIEADKIGGTCLHRGCVPTKALLHSAEVADTARTGAAFGVRTTFDGIDIEAVHQYKNGTIDRLHRGLQGLVAHHKISGVSGHGKYAGDRTIEVDGTRYTGTSVVLATGSYARTVPSIELGERIVTSDDALNLGFVPKKAIVLGGGVIGVEFASVWASFGAEVTVVEALPRLVAAEDPWCSKQLERAFRKRGIAARAGVTVAAAKETADGILVELDGGETLEAEILLVAVGRAPRTGDSGFAEHGITLDRRFVVTDERLRTDVDGVYAVGDVVAGLQLAHRGFQQGVFVAEEIAGLDPVPVAEHLVPRVTYSHPEVASVGLTEDAARERYGDVTSVVYDLAGNGKSQILKTSGGIKVIRAGDAGPVVGVHMVGDRVGELIGEAQLTVAWEALPTDVAPFVHAHPTQNEALSEAMLALSGKPLHAHG

SEQ ID NO: 57263 - protein, 334 aa, Rhodococcus sp. RHA1
MPVLTMAQALNTALRDALAADENVVVFGEDVGALGGVFRVTDGLTRDFGDDRCFDTPLAESGIIGFAIGMAMSGFKPVVEMQFDAFAYPAFEQIVSHVAKIRNRTKGALSAPIVIRIPFAGGIGGVEHHCDSSEGYYAHTPGLKVVAPSTVEDAYTLLREAIDDPDPVIFLEPKRLYFSRADVDLAVGAPIGQAAVRRPGRDATIVAYGPSVTVALESAEAAAAEGHDIEVIDLRSIVPFDDETVMASVRKTGRCIVIQEAQGFAGVGAEIAARVQERCFHHLHAPVLRVSGFDIPYPAPKLERLHLPSVDRVLDSVDRLQWNDSADTRWAVTA

SEQ ID NO: 57264 - protein, 344 aa, Burkholderia thailandensis E264
MKALVLEKARDLALRDIDLPLEVGPADVKIRIHTVGVCGSDVHYYTHGGIGPFRVDAPMVLGHEASGTVVEVGRDVTHLRAGDRVCMEPGVPRFDSKATLHGLYNLDPSVRFWATPPVHGCLAPYVVHPAAFTYRLPQNVSFAEGAIVEPLAIGLQAAKKAAMKPGDIAVVVGAGTIGAMTALAALAGGAARVILADVVKEKLALFASNRAVTTVDASTQSLADAVAHATDGWGADVVFEASGNAKAYAGIVDLLCPNGCLVLVGMPLEPVPLDVVALQAKEARIESVFRYANVFPRALALIESGAIDVKPFISRTFPFSDGLRAFEAAASGQPHDVKIQIEMD

SEQ ID NO: 57265 - protein, 307 aa, Oryza sativa (japonica cultivar-group)
MADRLELQGRHGKSRVRVSRVWRRPAAAGGHVIVEWNVAVSVVSDCLPSYTSDDNSAIVATDSIKNTVYVKAKECTEIVSMEEFAVILGRHFTSLYPQVSEATVTIAERPWERVVVDGKPHSHGFKLGVEKHVTEVIVKKSGNLLINSGIQGYSLLKTTQSGFEKFVRDRYTLLPDTRERIVATEVTAWWRYPFEHVSQIPSKSFCFTQRYQDVKKVLADTFFGPPDVGVYSPSVQNTLYLMAKEVLNRFPDIASVQLRMPNLHFIPVNLGNKENPGLVKFADDVYLPTDEPHGTIEATVSRPKSKL

SEQ ID NO: 57266 - protein, 496 aa, Pseudomonas putida
MNSSLSAIDGLRLPHQMLIGGQWVNAQSGKTLNVYNPATGDILTEVPDGDVEDVNAAVESAAATLRSDTWRRMPPSARERILLRLADLLEVHGDELARLETLNNGKLLIYSKMMEVGASAQWLRYMAGWATKLTGSTLDLSLPLPPEVRSRASTQRVPVGVVAAIIPWNFPLLMAVWKIAPALACGNTVVLKPAEETPLTALRLAELAMEAGLPAGALNVVTGRGETAGDALVRHPKVAKVAFTGSTEVGRIIGGACGRSLKAVSLELGGKSPVIVLADCDPQEAAEGAAAAIFFNHGQVCTAGSRLYVHESIYEDVIQRLAVIGESIVVGSGLEQGVHMGPMVSKKHHENVLRHIRNGIEDGADLICGGTEAPCAQGFFVKPTIFANREKKDIRLLSQEVFGPVLVATPFSDIAEVVNEANRSVYGLGASIWTNDLSAALRINDELEAGAVWVNTHNMVDPNLPFGGFKDSGVGREHGAAAIEHYTTTRSLVIAY

SEQ ID NO: 57267 - protein, 1955 aa, Ustilago maydis 521
MSFHLDSFVNSPASADQAPAWQLHSSTDSYLEWDANPKSLIEQQPSSTTTSPPPSMSRLRSTSSTVATLAPGAQTPAEPPSTDSASVLSHNGHTTSPERSVSPSYFTKLYFHPPDRTTSATSPTITFTSAIEPSLVAHAQPSPLLPTDAQSASHLPSPARESHTGRRPSISAVGSSSTTSPLTTPLSPTLSSRSSAAGGGFFASLRPSSPGNLPISTSKPQDGDNLGKPRRPSSVFDHVGNVWERFGRKVHHTRTATSEHHSSSSSHTRRSASQASPPIGLTPESADPFDTARNSPSGSFISQASPSQSTTTDSECRTPATPGGEPPAQLSTPQPLPSAPAYTSVSALDSSVNAPQQEEAEELPYLAPESPRPQPQSFNTIGSPRIPSGQRSATSHRRTSSLLERVLIQVTDDNERFSVVDISGVDSADAIKERMFAKLHLFDADHSSFQLFRTEIGQSEATGPVVSDDALLVLCLQMGDDRGTLKFLVQQIAPPPNSTVRALPPPTSTIVSQRAINNIRRTSGTGSAPGQHLRTESQSSKSSLSDALVYPEMIGADAAHEGSNRNSGSSLTRSKAQTRRALPSAPPVDDLRSPTHSCISSTTQSAVQDRRSIASSGDGSANESWARHGASASDGAPSAIPTQRSSSVNANASAAQSSSSGSAGRHPSNLEDDRQRYDAEPGVNRSLHAPATGSSHWQERSDEGARESLRVQTTAQLPGLTLHNAKSMDDLHRPSQSASQPSTLTTQAEVRKQAGMDRDGRYPTPAIMRPSTAAPAGAGARESASSHRQYSSDALGSSRSPQEPTLGLDPRMLQRNRSAQAAIPSGQQLVNHGPTRMSSTPQIRSPPMQHVYLGQGQIDPRFNTQPPHSAHPMQAHPSNMVARPPYSAAPSFASQPAYQSQSFGQAALRPMGHGFVNEFGARAPAASVNFNTYHGHDPRMNASAMQGSLTPRPYSYYEQPSMHQQQPMYRPYAQPSLVTASPYRTREDPFTTRYFPASSSRQVSEFQMQAGRLEPGMTVQQTLRTQEAIWGHTSAGSPGQAYQSAHAHPPGPSYGPRDPRQPGQSNQYTGMQAYPNASAAPQMQQRPSYQGSAMPNLHHVPPPRPQSYPSAQPQPQPPRNAHDRHPAPPAGHSGPQMMPQSSGSSAGRAPMQPQQNQQLSQPSQPSQREQPGHAQAMPGSESHRRDPPVRTNASERSSGSSFSSQGSFQHGRPHNDDCNSRNSIEESFSAPTSARSSQSEAASAKPVNVEHRSSYADQERDLADDELEHVRPLPKLPHSSATTRTDAFKSSSCDASGATVGGSVRRSEDEDTLRAGEWAQLWRALDPKSDGTVSGTAISGSSGGDGDTVRAEPSTPGASRPQTKDGATLPISLEPPRIPSPSLAPEENGTVSSFGTFDDDETESGTWAQPLDSDVNAPRLPLRLDADSEALSDDHATLLPGQDTLLQASTRGTRGFSAASNSPKRPELRLTIDPAAGPTVMTWTASQASTNSPRASTSHLSSALNSGGITRSNSFARRDDDWAFRPPPEQLYENLDDFFPKHDLDKPLLDTTAGPESGLVSSPRAEASVPSVASVGAQQGLSQRSRHKKSIRLVAEDRKRILERADTRRAAQGAELSSGLVRRRSTKLWGTKVVEMTPGQELATPASATSAESPWSDTASTTGQPVFKWVKGDLIGKGTYGRVYLALNATTGEMIAVKQVELPRTASDREDSRQKGVVAALKSEIETLKDLDHPHIVSYLGFEETRQFLSIFLEYVPGGSVGSCLRKHGKFEESTIKSFLHQILEGLAYLHSKGILHRDLKADNILVDFEGTCKISDFGTVRRSDDIYGNVENMSLQGSIFWMAPEVVSLSKKGYSAKIDIWSLGCVVLEMFAGRRPWSDDEAVQAMFKIGAQRKAPPIPADVKLTKQAAHFLKNCFEIDPAKRPTAQRLLDHVFTVPVPGWQFSHSALCRSLHR

SEQ ID NO: 57268 - protein, 236 aa, Triticum aestivum
  misc_feature (149)..(149): Xaa can be any naturally occurring amino acid
  misc_feature (198)..(198): Xaa can be any naturally occurring amino acid
  misc_feature (209)..(209): Xaa can be any naturally occurring amino acid
  unsure (1)..(236): unsure at all Xaa locations
VTLQNKFVQKSRLVPVRNSRDIVDPRVRAHKWVSHRNHRGNICGVDFIWLLNPDKCRKPLKTSWNEAVFGIIKFSFQYLLLQVASLPENAFALLKADSSDDRITYSSFCQALCQLGMVHPDRVNSEEMEDLWSEVDHDGNGAVDYKEFXRCIWSPKCYNQEEEDDTEIDAAEGSIITFEPNDETFGFTVKEAVLFPPXEIEKGMWPEKXSLSDHAPLIVVFSPVRKPCFPSNPKHP

SEQ ID NO: 57269 - protein, 363 aa, Prunus avium
MTFTLRKKEILIDILARLPAKSLIRFLCTCKSWSDLIGSSSFVSTHLHRNVTKHDHVYLLCLHHPNFERLVDPDNPYFKKEFQWSLFSNETFKQCYKLNHPLGSTEHYVIYGSSNGLVCISDEILNFDSPIHIWNPSVRKFRTPPMSTSINIKFNYIALQFGFHPRVNDYKAVRMMRTNKDALAVEVYSLRTDSWKMIEAIPPWLKCTWQHHKGTFFNGISYHIIEKCPIFSIMSFDSGSEEFEEFIAPDVICSSWGLFIDLYKEQICLLSSFYSCEEKGMRKIDFWVLQEKRWKQLCPFIYPSHYYGTLGISKDNELLMEKRDFSRGIGDLHLCNYESKQVLETGIDLATIKYGEIEFLFAI

SEQ ID NO: 57270 - protein, 418 aa, Xanthomonas campestris pv. campestris str. ATCC 33913
MTNGNLLYAQSGGVTAVINATAAGVIGEARARKIKVLAARNGILGALREELIDTSKESAAAIAALAQTPGGAFGSCRYKLKSLEQDRAKYERLLEVLRAHDVRWFLYNGGNDSADTALKVSQLAKAFGYPLHCIGVPKTIDNDLAVTDTCPGFGSAAKYTAVSVREAALDVAAMADTSTKVFIYEAMGRHAGWLAAAAGLAGQGPDDAPQIILLPERAFDQPAFLAKVRQVVERVGWCVVVASEGIQDAQGKFVADAGGATDSFGHAQLGGVASFLAAQVKQELGYKVHWTLPDYLQRSARHLASKTDWEQAQAVGKAAVQYALKGMNAVIPVIERVSDAPYRWKIVPAPLHKVANHEKKMPPSFLRKDGFGLTERARRYFAPLIKGEAPLAYGSDGLPKYVTLKNVAVAKKLPAWEG

SEQ ID NO: 57271 - protein, 147 aa, Fritillaria agrestis
TMLSSVATAARAAPAQASMVAPFVGLKSTSSFPVTQKPATGLSTLPSNGGRVQCMKVWPIVGLKKFETLSYLPTLSVETLLKQIEYLIRNGWVPCLEFSLEGFVSRDNNKSPGYYDGRYWTMWKLPMFGCTDAAQVVKEAAECKKEY

SEQ ID NO: 57272 - protein, 401 aa, Glycine max
MEGAGMEENNIINDDDNNNKSEAHLTSAAAFVEGGIQDACDDACSICLEAFCDSDPSTVTSCKHEFHLQCILEWCQRSSQCPMCWQPISLKDPTSQELLEAVERERNFRFNPSRNATIFHHPTLGDFELQHLPVGASDADLEERIIQHLAAAAAMGRARHVARREGQRNRSSAQGRQHFLVFSTHPNSPPMAPASSSPSQRGDDEPTPTIDVANLSPTPATGEESSQPTLVSPVQAEQVSASGSGTTALATDHQGSSYNNRRSPNQSSPSSQDRAGPSELQSFSESLKSKLNAVSTRYKESISKSTRGWKERWFSRNNTMSDLGSEVRREVNAGIATVSRMMERLETRDNNRSNSNSAPSNIEDGSVQGSNDQTLTAGNEGGSLVRDNNTKASCAAGSSSN

SEQ ID NO: 57273 - protein, 510 aa, Alkaliphilus metalliredigenes QYMF
MKQELVLILDFGGQYNQLIARRVREHNIYCEVVPYKITAEEIKLKNPKGLILTGGPSSVYGESTPRCEEEIFQLDIPILGICYGGQLMAHTLGGKVNRAKNREYGKTALQVDGNSKLFKEVAQDSICWMSHTDFIETAPAGFKITGTTADCPVAAMENQEKALYAVQFHPEVEHTEKGKEILKNFLYEVCHCQGDWTMENYIEKEIEAIRNLVGDRKVLCALSGGVDSSVAAVLVHQAIGDNLTCVFVDHGLLRKDEGDWVEDIFRNQFEMNFIRVNAEERFLGKLKGVTDPELKRKAIGELFIRVFEEEAQKIGDFDFLVQGTLYPDIIESGTETAAVIKSHHNVGGLPEDMKFQLIEPFKFLFKDEVRIAGLELGVPEEIVWRQPFPGPGLAVRVLGEITEEKLHIVREADAIVRDEIIKAGLHRQIWQYFAVLPNIMSVGVMGDERTYAHTIGIRAITSSDAMTADWARIPFEVLENMSRRIVNEVEGANRIVYDITSKPPSTVEWE

SEQ ID NO: 57274 - protein, 316 aa, Pythium aphanidermatum
MLALSPSTRLLKRSALRMTSVTPLGKALSQTITNNHVLSFSTSPDAKDVTEEKPLIAHFSQSSTRHPLDKAQEPVWENPVPHAVYDLQKIEDIPQTHHDPKKIHERAAYVAVKLVRKGFDIASGYRGPGGAMTEKDWLHRCLFLETVAGVPGMVGGMARHLRSLRSMRRDYGWIHTLLEEAENERMHLLIFMNMKQPGPLFRLLVLGAQGVFFNMFFVSYLVSPRTCHRFVGYLEEEAVKTYTGLLKDIEDGHLKEWEKMTAPAIARSYYKLPDEASVYDMIKCIRADEANHRDVNHTFAGLDQVKGVSPFVNGHH

SEQ ID NO: 57275 - protein, 216 aa, Sanguinaria canadensis
IENTTNRQVTFCKRRNGLLKKAYELSVLCDAEVALIVFSNRGRLYEYANNSVKSTIERYKKTCQDPSNSGCAVEANTQFYQQEASKLRQQIGFLQNSNRNLTGEALSSMTVKELKQLETRLEKGISRIRSKKNELLFSEIEYMQKREIDLQNDNMYLRAKIAENERAQQHMNLMPGNEYDVMTSSAYDSRNFLQVNLLESTNHHYSRQEQTALQLG

SEQ ID NO: 57276 - protein, 147 aa, Fritillaria agrestis
TMLSSVATAARAAPAQASMVAPFVGLKSASAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEY

SEQ ID NO: 57277 - protein, 246 aa, Cytophaga hutchinsonii ATCC 33406
MIIFAFLVIHWYVSLFFQSVFHHRYSAHGIFTMSKTWEKIFYVGCFIAQGSSYISANAYGKLHRLHHAHTDTPEDPHSPQNSSNALMMMWETRNNYIDVYTGKTPVDERFTKNLPDWPVFEKYAHTFYTRFAWIFLYVLFYVEFATAWWMFLFLPVTILMGSIQGVAVNWWAHKFGYVNCKVNNTSKNILPIDVIFWGESFHNNHHANPQNPNNSIKWFEFDSGYQMMRFLNMMRIIKLKPYYSVL

SEQ ID NO: 57278 - protein, 147 aa, Fritillaria agrestis
TMLSSVATAARAAPAQASMVAPFVGLKSTSSFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEY

SEQ ID NO: 57279 - protein, 208 aa, Triticum aestivum
  misc_feature (11)..(11): Xaa can be any naturally occurring amino acid
  misc_feature (48)..(48): Xaa can be any naturally occurring amino acid
  misc_feature (172)..(172): Xaa can be any naturally occurring amino acid
  misc_feature (182)..(183): Xaa can be any naturally occurring amino acid
  misc_feature (187)..(187): Xaa can be any naturally occurring amino acid
  misc_feature (189)..(189): Xaa can be any naturally occurring amino acid
  misc_feature (203)..(203): Xaa can be any naturally occurring amino acid
  unsure (1)..(208): unsure at all Xaa locations
RGRGRGGTSSXDCHLISSYHTTPFNQTGTGHFSPIVGYHAEKDMALIXNVARLGYPPHWVPLTLLWDAMNTTDEATGLLRAFMLVSRRSSAPSLLYTVSCGHGSWKSMAKYCVEDVPNLLNDDSLHNVTTLLSPLVESLPANAGHLITCVIEVTTKDERESTLTKQDKERLXFKEKILHQYXXSLPXHXIHKLQYPSGVCGKXSSSKK

SEQ ID NO: 57280 - protein, 331 aa, Nocardioides sp. JS614
MTVRVGINGFGRIGRNFFRAVVASGADIEIVAVNDLTDNKTLATLLKYDSILGRLEGDVTSTETEITAAGHTFRVFEERDPSALPWGELGADIVIESTGLFTDATKAKAHIDGGAKKVIISAPAKNEDVTIVMGVNEGDYDPAAHTIISNASCTTNCLAPMAKVLNDEFGIVKGLMTTVHAYTGDQNLLDGPHRDLRRARAAATNIVPTSTGAAKAIGLVLPELKGKLDGYALRVPVPTGSATDLTFEAGRETTVEEVNAVVKAAADGKILRYNEDPIVSSDITTDPASCIFDAPLTKVIGNQVKVVGWYDNEWGYSNRLVDLVDYVAASL

SEQ ID NO: 57281 - protein, 399 aa, Nocardioides sp. JS614
MAAYDGLGEVAGRRVLVRSDLNVPLDGTTITDDGRIRASVPTIKALADAGARVIVTAHLGRPKGAPEERYSLRPVVARLGELLGQDVAFATDTVGESARATVEALQDGQVAVLENVRFNAGETSKDEAERGAFADRLAALADAFVSDGFGVVHRKQASVYDVAQRLPHAMGALVAKETEVLRRLTVDPERPYVVVLGGSKVSDKLGVIDNLLGKADRLLIGGGMVFTFLKAQGHEVGKSLLEEDQLDTCRSYLERAERTGVQILLPTDVVVDTEFPSGDRAPEPRVVPASEIPADALGLDIGPESAAAFAAALADARTVFWNGPMGVFETDAFAGGTRTVAEALTRIDGLSVVGGGDSAAAVRKLGFDQAAFGHISTGGGASLEYLEGKELPGIKVLED

SEQ ID NO: 57282 - protein, 264 aa, Nocardioides sp. JS614
MATSRTPLMAGNWKMNLNHQEAVVLVQKLAWTLADKKHDYARAEVVVVPPFTDLRSVQTLVDGDRLLVKYGAQDVSTHDGGAFTGEISAGMLAKLGCSYVVVGHSERREYHTEDDQEVNAKAHQALGAGMVPIVCVGEGLDVRQAGGQVAHCLAQVDGSLAGFTAEQIAGLVIAYEPIWAIGTGEVATPDDAQEVCAAIRERIREVHGDEAADGVRVLYGGSVKAANVAGIMAKDDVDGCLVGGASLQADEFGGICRFYDMPVI

SEQ ID NO: 57283 - protein, 319 aa, Salmonella enterica subsp. enterica serovar Paratyphi A str.
MKAMNKVWVIGDASVDLVPEKQNSYLKCPGGASANVGVCVARLGGECGFIGCLGDDDAGRFLRQVFQDNGVDVSSLRLDADLTSAVLIVNLTADGERSFTYLVHPGADTYVSPQDLPPFRQYEWFYFSSIGLTDSPAREACLEGARRMREAGGYVLFDVNLRSKMWRNTDEIPELIARSAALASICKVSADELCQLSGASHWQDARYYLRDLGCDTTIISLGADGALLITAEGEFHFPAPRVDVVDTTGAGDAFVGGLLFTLSRANCWNHALLAEAISNANACGAMAVTAKGAMTALPFPEQLNTFLSSHSLAQAMTVK

SEQ ID NO: 57284 - protein, 191 aa, Zea mays
MAGLQRSATTFRRSGSSGLVWDERFLTEADAEAKAGAAEDAEQPELRHSRSVGMLRRAGGGGDSRSKKGKESRQKQAESARRSNQQVFRTKDVAPDMDPPSPRVSGCAFCAVFRGGSGGTGRRAQARRRLVQLFRLGSAAGPSGSACGFGFETGREAGWSDDELVRDAAELGGQTGRLVVADGMSGDNSEC

SEQ ID NO: 57285 - protein, 316 aa, Psychrobacter arcticus 273-4
MKALNNDVQRPKVGMPKLIRVGVTAALAVGSIALATQQAQALSALAIVNGITSNGGIEVSKDILYGDEPLQDLDIYYPKPLAQAMKTNTTIKQDYPMVVFVHGGSWESGSKEEYAFVGKSLAQAGYVTAVINYRKAPEYVYPDYVEDTAQAIAWSYNNAKRFHANPERFAVVGHSAGAFNAVAAVVNEDFLKPYGIKPKDISAVIGIAGPYSYDFRNFDSVTAFAADATPDEVMPDRQIKGPQPPYLLLTAEKDKVVYATNTIKMTQALKAAGVTVQTSEIAGASHATSIGAMAPPLRWVNDVRAQVLNYLDKTLK

SEQ ID NO: 57286 - protein, 418 aa, marine gamma proteobacterium HTCC2080
MNSFERHKDRLFCEEVALDEMASKYGTPLYVYSRACIEQAYLAYQTALADHDHLICYAVKANSNLAILSVLAKLGAGFDIVSLGELERVIAAGGDPTKVVFSGVCKTHAAIKRALEVGIHCFNVESESELEALSEVAQASGMVAPISLRVNPDVDAQTHPYIATGLKDNKFGVELDSALRLYRKAVALPGIKPIGIDCHIGSQILDIAPFSEAMDHLIDVLENLKSEGIMLEHIDLGGGLGIPYGNENAPKIADYVAALTQGLSDHSLTLILEPGRSIVAEAGVLLTEVMYLKPTPHKNFALVDAAMNDLLRPALYGAWQDIVPLNNRNGDAKCWDIVGPVCETGDFLGKDRNLSLTEGDVLAVMTAGAYGFVMASNYNTRPRSAEVMVDGSHSHLIRAREPLETLWADECLLPEANL

SEQ ID NO: 57287 - protein, 519 aa, Ustilago maydis 521
MPLPCGQAKAFWRLVLASFPRVPPLSHDPGEILVHDENSPVLCFLFPIVPVSALAWFLAAPSAPVFDHAWDASLVSDASFFNAPMPKSSSDPADSVVACCSLRATWFEGVVAQKSRVIWSMVKAKWSGLRRVDCDTEAHQRSARLSYLGCITDTVRIGGERTSGNHTLQTSYLESTCESRTTQPAPRPDRSIANTLSAMSTSIPATSSRTAPTPKSTVASASNPKKYPFYLGGTAASIAAFFTHPLDLTKTRMQTASSRQGMFSLMLKTFREQGPRGLYVGLTASLLRQMTYSVTRFGVYDKLKERTLKQNEGRALGPVQMALCASAAGAAGGLAGNPADILLVRMTSDVNKKPADRYGYPNAISGLVRMTRDEGLRSLFRGLGPNTVRAVLMNASQLATYDVFKNVLLGTGFFSEGTPLHFSASFMAGTVATTVCSPADVIKSRVMNAAGSGDGVLKTLRKDLAKEGLGFLFRGWTPAWMRLSPNTIIVFVVLEKLRLLVDYTREAKQSAVEPVQTTA

SEQ ID NO: 57288 - protein, 147 aa, Fritillaria agrestis
TMLSSVATAARTAPAQASMVAPFVGLKSTSAFPVTQKPATGLSTLPSNGGRVQCMKVWPIVGLKKFETLSYLPTLSVESLLKQIEYLIRNGWVPCLEFSLEGFVSRDNNKSPGYYDGRYWTMLKLPMFGCTDAAQVVKEAAECKKEY

SEQ ID NO: 57289 - protein, 433 aa, Vibrio vulnificus YJ016
MSKIVKVLGREIIDSRGNPTVEAEVHLEGGFVGMAAAPSGASTGSREALELRDGDKARFLGKGVLKAIEAVNGAIADALVGKDAKDQAAIDAIMIELDGTENKSKFGANAILAVSLANAKAAAASKGMPLYEHIAELNGTAGQFSMPLPMMNIINGGEHADNNVDIQEFMIQPVGAKTLKEAVRMGAEVFHNLAKVLKSKGYNTAVGDEGGFAPNLKSNAEALEVIAEAVAAAGYVLGKDVTLAMDCAASEFFDKEAGIYNMKGEGKTFTSEEFNHYLAGLVEQFPIVSIEDGLDESDWAGFAHQTQLLGDKIQLVGDDLFVTNTKILAEGIEKGIANSILIKFNQIGSLTETLAAIKMAKDAGYTAVISHRSGETEDATIADLAVGTAAGQIKTGSMSRSDRVAKYNQLIRIEEALGERAPFNGLKEVKGQA

SEQ ID NO: 57290 - protein, 238 aa, Oryza sativa
  misc_feature (22)..(22): Xaa can be any naturally occurring amino acid
  unsure (1)..(238): unsure at all Xaa locations
GAWQTLVRTNREHHEAVDGNGXFPMALYVVSGDEDGERGGAPVVCIDVAAQLCCDFNKGQSTWSPILLLVPLVLGLDKLNPRYIPLLKETFTFPQSLGILGGKPGTSTYVAGVQDDRVLYLDPHEVQLAVDIAADNLEADTSSYHCSTVRDLALDLIDPSLAIGFYCRDKDDFDDFCSRASELVDKANGAPLFTVMQSVQPSKQMYNEESSSGDGMDIINVEGLDGSGETGEEECQIL

SEQ ID NO: 57291 - protein, 147 aa, Fritillaria agrestis
TMLSSVATAARTAPAQASMVAPFVGLKSTSAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEY

SEQ ID NO: 57292 - protein, 467 aa, Oryza sativa (japonica cultivar-group)
VFAGKPFIHYIRDLRREYGPIVKLQMGVRTLVVISSAELVHEALVEKGREFATRPAESPIRSIFSSGKFTVNSAVYGPEWRSLRRNMVSGMLSAARLREFRPARLRAMERFVARVRAEAAASRDGASVWVLRNVRFAMFCVLLDMTFGLLDLDEELVVRVDAVMKRVVLAVAARIDDYLPFLRPFLWRQHRQAVALRREQIDTVLPLINRRRAIVRGMRAGSPPDPAVAAPYSYLDSLLDLRVEGRDAVPTDEELVTLCAEMINGGTDTTATAIEWAMARVMDNPSIQARLHGEIMQRVGDARPVDDRDTEGMPYLKAFVKELLRKHPPTYFALSHAAVEPGSKLAGYDVPVDANLDIFLPTISEDPKLWERPTEFDPDRFLAGGETADITGSAGVRMIPFSAGRRICPGVGMGTAHIALMVARMVQAFEWRAHPSQPPLDFEDKVEFTVVMKRPLLAMVTPRKLSF

SEQ ID NO: 57293 - protein, 147 aa, Fritillaria agrestis
TMLSSVATAARAAPAQASMVAPFVGLKSTFAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEY

SEQ ID NO: 57294 - protein, 714 aa, Nocardioides sp. JS614
MADDLERNPVTDTAALDWTDLDQKAVDTARVLAMDAVQKVGNGHPGTAMSLAPAAYLLFQKVMRHDPSDPRWIARDRFVLSAGHSSLTLYIQLFLGGFGLELDDLKALRTWGSKTPGHPEYRHTAGVETTTGPLGQGVGNAVGMAMAARRLRGLLDPGAKTGPSVFDHRVYAICSDGDIEEGVSGEASSIAGTQQLGNLTLIYDANKISIEDDTNIALSEDVAARYEAYGWHVQVVDWTNGGTEYREDVHALYDALRAAEAVTDRPSFIELKTIIAWPAPNAQGTGKSHGSALGADEVAATKEVLGFDPAQTFEVPEGVLEHTRRLGERGAAAGKAWDEDFAAWRAKNPDAFDVLMRLRGHELPEGWADDLPVFDADPKGVATRKASGQVINAIAKRVPELWGGSADLAESNNTTIEDVPSFLPVDRSSKMWAGDPYAGRVLHFGIREHAMGSIMNGIALHSGTRVFGGTFLTFSDYMRPAVRLASLMGLPVTYVWTHDSIGLGEDGPTHQPIEHLAALRAIPGLDVIRPADANEVAACWKAVMEHTDRPSALALTRQNVPVFPREQDGFAGTADVHRGGYILIDAPEIDGQGGQPDVVLIGTGSEVQLAVEARALLAEDGIRARVVSMPCREWFAAQHESYREAVIPPIVKARVSVEAGIAQGWHEVVGDHGRIVSIETYGASADYARIYQEYGITARAVADAARDSIRVSSS

SEQ ID NO: 57295 - protein, 742 aa, Oryza sativa
MEEGEKQSSGGRWRCRWLVDVGRWRPSPAEFQAAAAVLPPHDRPAIHRFVREEDRKRALVSRLLKYSLVHHALGMPFHQIRINRTLEGKPYLQNKNVNLPGFNFNTSHQGEYVGIASEPLCLVGLDIVCISKPQRETALEFINNFTSYLTDHEWNCIVTADSHDGMLTEFYRYWCLKEAFVKATGAGVGFGLQRTRASPDAMGQCCTGGGKAVAGDEAEPGTSKAAPPSRGTSSKNGSAKQQPCSPAAKAAATEAAAAASSSKKPAGPIGEVLERPMEEVRTTYSIGKELGRGQFGVTHLCTHKATGEKLACKTIAKRKLANKEDVDDVRREVQIMHHLSGQPNIVDLRGAYEDKHNVHLVMELCAGGELFDRIIARGHYTERAAAALLRAIVGIVHTCHSMGVIHRDLKPENFLLLSKGDDAPLKATDFGLSVFFKEGEVFRDIVGSAYYIAPEVLKRKYGPEADIWSIGVMLYIFLAGVPPFWAESENAIFTAILRGQIDLASEPWPKISSGAKDLVRKMLNINPKERLTAFQVLNHPWIKEDGDAPDVPLDNVVLNRLKQFRAMNQFKKAALRIIAGCLSEEEIKGLKEMFKNIDKDNSGTITLEELKNGLAKQGTKFSDNEIEQLMEAADADGNGIIDYEEFVTATVHMNKMDREEHLYTAFQYFDKDNSGYITKEELEQALKEQGLYDANEIKDVITDADSNNDGRIDYSEFVAMMRKGSGCAEATNPKKKRRDLVL

SEQ ID NO: 57296 - protein, 477 aa, Wolbachia endosymbiont strain TRS of Brugia malayi
MIQSILRLLYITAVLTRYNISPYLLSPSRKSINRIRGYKLRCAFEKLGPVFIKFGQSISSRTDILNEDITNNLLLICDKLPSFSHKIAVKTIESEFNCKLSDIFSSFSEKPIAAASISQAHKATTTEGKEVAVKILRPNIEKTFSKDIKMLFWLAGIVEKFSKQSRRLKPIELVETFAEICRLELDLRFEAAHSSELRENTKNDRGFYVPEVDWSRTSKRVLTLEWIGATPVYEVEKLNNHKQIAINLIESFCNQVYRDCFFHADMHPGNLMIDSNNSIVALDCGIMGRIDRETCYYVIEILKGFLNRDYDRVAKVHFRAGYVSPQHKSFVTACRAIGEPIIGQPIQKISFASLLAQLLKITGDFDMKVQTQLLLLQKTMILLEGTCRKIYPEINVWKVVEAWTENQHKNKISYKERIKSSYPVKTIQEIFNLIEKLNLIANQKLENIQIKDRSNGKIYFLLWSMVIALIVKLLIFL

SEQ ID NO: 57297 - protein, 974 aa, Azoarcus sp. EB1
MTRDEMISVEPEAAELQDQDRRDFLKRSGAAVLSLSLSSLATGVVPGFLKDAQAGTKAPGYASWEDIYRKEWKWDKVNWGSHLNICWPQGSCKFYVYVRNGIVWREEQAAQTPACNVDYVDYNPLGCQKGSAFNNNLYGDERVKYPLKRVGKRGEGKWKRVSWDEAAGDIADSIIDSFEAQGSDGFILDAPHVHAGSIAWGAGFRMTYLMDGVSPDINVDIGDTYMGAFHTFGKMHMGYSADNLLDAELIFMTCSNWSYTYPSSYHFLSEARYKGAEVVVIAPDFNPTTPAADLHVPVRVGSDAAFWLGLSQVMIDEKLFDRQFVCEQTDLPLLVRMDTGKFLSAEDVDGGEAKQFYFFDEKAGSVRKASRATLKLDFMPALEGTFSARLKNGKTIQVRTVFEGLREHLKDYTPEKASAKCGVPVSLIRELGRKVAKKRTCSYIGFSSAKSYHGDLMERSLFLAMALSGNWGKPGTGAFAWAYSDDNMVYLGVMSKPTAQGGMDELHQMAEGFNKRTLEADPTSTDEMGNIEFMKVLTSAVGLVPPAMWLYYHVGYDQLWNNKAWTDPALKKSFGAYLDEAKEKGWWTNDHIRPAPDKTPQVYMLLSQNPMRRKRSGAKMFPDVLFPKLKMIFALETRMSSSAMYADIVLPCAWYYEKHEMTTPCSGNPFFTFVDRSVAPPGECREEWDAIALILKKVGERAAARGLTEFNDHNGRKRRYDELYKKFTMDGHLLTNEDCLKEMVDINRAVGVFAKDYTYEKFKKEGQTRFLSMGTGASRYAHANEVDVTKPIYPMRWHFDDKKVFPTHTRRAQFYLDHDWYLEAGESLPTHKDTPMVGGDHPFKITGGHPRVSIHSTHLTNSHLSRLHRGQPVVHMNSKDAAELGIKDGDMAKLFNDFADCEIMVRTAPNVQPKQCIVYFWDAHQYKGWKPYDILLIGMPKPLHLAGGYEQFRYYFMNGSPAPVTDRGVRVSIK

SEQ ID NO: 57298 - protein, 139 aa, Wolbachia endosymbiont strain TRS of Brugia malayi
MAIERTLSILKPDTVKNNIIGNINSYIEKSGLRIIAQKMMLLTKKQAELFYAIHKDRPFFGGLVEFMTSGPVIVQVLVGENAISKYRQIMGATDPKQADKGTIRGDFADDVNENRVHGSDSLENAHKEIAFFFAECELV

SEQ ID NO: 57299 - protein, 136 aa, Oryza sativa (japonica cultivar-group)
MARTKQTAKKSTASNVPRKLLVMKVARKSAPTMAGLKKPHRFKPGTVALREIRTYQKSTELLIRKLPFQRLVQEIAQDVRSYVRFQSSAVVALQEAAETYLVGLFKDTNLCVIHAKRVTIMPKDIQLARRIRGEKA

SEQ ID NO: 57300 - protein, 568 aa, Brucella abortus
MARDATKLEATVAKLKKHWAESAPRDMRAAFSTDPGRFGRYSLCLDDLLFDWSKCRVNDETMALLKELAVAADVEGRRAAMFAGEHINNTEDRAVLHVALRDTSSKEVLVDGHNVLPDVKHVLDRMAAFADGIRSGALKGATGRKITDIVNIGIGGSDLGPVMATLALAPYHDEPRAHFVSNIDGAHIADTLSPLDPASTLIIVASKTFTTIETMTNAQTARKWVADTLGEAAVGAHFAAVSTALDKVAAFGIPEDRVFGFWDWVGGRYSVWSAIGLPVMIAVGPDNFRKFLAGAHAMDVHFRDAPLEKNLPVMLGLIGYWHRAICGYGSRAIIPYDQRLSRLPAYLQQLDMESNGKSVTLDGKPVSGPTGPVVWGEPGTNGQHAFFQLLHQGTDTIPLEFIVAAKGQRADTGINQHEMLMANCLAQSEALMKGRTLDEARAQLQAKNPACVASGAHSPAPASFPANRPSLTLIHDMLDPYALGRLIALYEHRVFVEAQIFGINPFDQWGVELGKELATELLPVVSAKEGASVRDASTQGLVAHLHARRKACRIICKVRNTRKAGPEA

SEQ ID NO: 57301 - protein, 532 aa, Zea mays
  misc_feature (116)..(116): Xaa can be any naturally occurring amino acid
  misc_feature (137)..(137): Xaa can be any naturally occurring amino acid
  misc_feature (166)..(166): Xaa can be any naturally occurring amino acid
  misc_feature (177)..(177): Xaa can be any naturally occurring amino acid
  unsure (1)..(532): unsure at all Xaa locations
MEMVGGSADAIPGLLSYGWAGLWSTLASLLFLWSMVQDHLPFQLEEQLSALARRALAAVTPYVTITIDEHDADSFGRSEAYLAAEAYLGATFAGRASRLRAELPGGSDRVSLAVDXDHVEVTDAFRGARMRWRKTRXSGRGNVIAWNPREEERRAYCLTFHRRHRXSVEAAYLPHVXLAEGRAATVRNRQRRLYTNNASGDWGGGDDGPRAWTHVKLEHPSTFATLAMDPDRKREVVDDLDMFRDGRDYYASVGKAWKRGYLLFGPPGTGKSTMIAAMANYLGYDIYDLELTAVKSNTELRKLFIETKSKSIIVIEDIDCSIDLTGKRKKKKKDKNDTRKKKKKAPWEEEDKDEGSKVTLSGLLNFIDGLWSACGGERIIVFTTNHKDKLDPALIRRGRMDMHIEMSYCCFQGFKVLAKNYLGVQEHDGGHQELFGDIRRLLEEVDMTPADVAENLMPRSKTKDADACLRRLVKALEEAKEAALLAAKAKQLDGIKDDEGTDDEDDSDDDGSVTSRGHPSDGDEKSAKKEEM

SEQ ID NO: 57302 - protein, 255 aa, Salmonella enterica subsp. enterica serovar Paratyphi A str.
MRHPLVMGNWKLNGSRHMVNELVANLRKELAGVAGCDVAIAPPEMYIDLAKRAAAGSHIMLGAQNVDLNLSGAFTGETSAEMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKADAKIAEQVIIQYGGSVNASNAAELFAQPDIDGALVGGASLKADAFAVIVKAAEAAKQA

SEQ ID NO: 57303 - protein, 304 aa, Camellia sinensis
MEKYEKLEKVGEGTYGKVYKAKDKETGQLVALKKTRLEMDEEGVPPTALREVSLLQMLSHSLYVVRLLCVEHVDNKHGKPLLYLVFEYLDTDLKKFIDSHRKGPDPRALPLSLIQSFLYQLCTGVAHCHSHGVLHRDLKPQNLLVDKEKGILKIADLGLGRAFTVPLKSYTHEIVTLWYRAPEVLLGSTHYSTAVDMWSVGCIFAEMARRQALFPGDSEFQQLLHIFRLLGTPTDKQWPGVSSLRDWHVYPQWEAQNLARAVPSLGPDGVDLLSKMLKYDPAERISAKAALDHPFFDGLDKSQF

SEQ ID NO: 57304 - protein, 440 aa, Camellia sinensis
MGSRAVVVPDQQPRGRGGKQKNGQAEGRNRRVLRDIGNLVPVPTVEEKPQNQISRPVTRSLCVQPAAAAEKKNKKPLAEVVNGGGEVKAAAAAHKKHYDPPKPETVIVISSDEELESEEKKKPVAVIARKSRVGSSRTMTSILTARSKALCGPTTKPKVPIADIDAADVDNELAVVEYVEDIYKFYKLTEGESRVHDYMDSQPEINSKMRSILIDWLTEVHRKFELMPETLYLTINIVDRYLSMNAVPRRELQLVGISSMLIACKYEEIWAPEVSDFIVISDNAYVREQILIMEKAILGKLEWYLTVPTPYVFLVRFIKASVPSNDHREEMENMVFFLAELGLMHYPTIILYCPSMIAASAVYAARCTLNSNPLWTETLKHHTGYSEDQLGDCAKMLARFHSDGGGVEKSKLKAVYKKFSSSDRSSVALFPPARSLLLVL

SEQ ID NO: 57305 - protein, 577 aa, Cryptococcus neoformans var. neoformans JEC21
MTPRPDQIYVSHIPSPQLPRSSVFEFLFPKSKQYNYFPAPAPNPSGAKKAFIDGLTGNTVTREQVEEQALALAGGLKKLGVKTGEVACLFGMNSLEWINALFGCQALGVVTSPANYAYTPLELLHQVKDSTSQTIFVQPNLFPVLKEALKLDPSCNIPESKIFLLCPKDKKPADLKHLKCTEDLWDMGKGIDGRAQWEENVENKTAYLCYSSGTTGKAKGVETSHHNMTSQIQAVRCSFEPMTEKDVVLGILPCSHIYGLTMNLHHALSTNGTVVILPKFEEKTVLEVIQRYKVTFSLIVPPMMIALLHSSLVSSYDISCLRGFQSGAAPLSADLIKAFESRFPHIQVTQGYGLTETTPVSHVMTLDESRHHPGAIGRVIPTYQARLVDAENGKDVEIGERGELWLKGPSVMKGYWRNEEATRNVFEDGWFKTGDIAIVDDRKYFTIVDRVKELIKYKGFQVPPAELEALLLGHPNVADVGVIGIYDKSQATELPRAYIVPKGGLASLSWSDREKLSKEIHDWAAKKVANHKKLRGGVILIEAIPKSPSGKILRKDLRLLAIKEQEEGVKATRGSKL

SEQ ID NO: 57306 - protein, 294 aa, Camellia sinensis
MEQYEKVEKIGEGTYGVVYKARDRVTNETIALKKIRLEQEDEGVPSTAIREISLLKEMKHGNVVRLQDVVHSEKRLYLVFEYLDLDLKKHMDSCPEFSKDPRLIKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRILGTPNEDTWPGVTSLADFKSAFPKWPSKDLATVVPNLDSAGIDLLSKMLCLDPSRRITARSALEHEYFKDIGFVP

SEQ ID NO: 57307 - protein, 423 aa, Cryptococcus neoformans var. neoformans JEC21
MSVDTPTSEKLDQAASVFDKDPTTAERLYKEILQDDSQPGNEDLLRDKEVALIKLGTLYRDSSMLDKLSQLITDSRTFMSHIAKAKTTKLVRTLLDLFPQDSKDMQMKVIQENIDWARTEKRVFLRQSLEIKLINVLLDAEKYQEALTITQTLLKELKKFDDKIILTEVYLLESRAAHHMHNHALAKTALTSARTTANSVYCPPTLQAQLDLQSGVIMAEDKDYKTAYSYFFEAFEGFCQSAERDNRALSALKYMLLCKIMIGSPNDVFSLLSLKSAAPYIGKDVDAMKAIATALEERSLDLFKTALQNYSDQLQKDEIIRSHLSYLYDTLLEQNLIRVIEPYSAVELSWIASEVGQSLQVIEDKLSQMILDQKFCGILNERMGTLEVHDDYSNEGICSMALGTLKHISDVVNGLNDKAAQMV

SEQ ID NO: 57308 - protein, 125 aa, Hordeum vulgare
EQANDVRATYHYYRPAQNNWDLGAPAVSAYCATWDASKPLSWRSKYGWTAFCGPAGPRGQAACGKCLRVTNPATGAQITARIVDQCANGGLDLDWDTVFTKIDTNGIGYQQGHLNVNYQFVDCRD

SEQ ID NO: 57309 - protein, 224 aa, Nymphaea sp. EMK-2003
MGRGKIEIKRIENTTNRQVTFCKRRSGLLKKAYELSVLCDAEVALIVFSSRGRLYEYANNSVRGTIERYKKAYAESSSSGAVAETNAQYYQHEAHKLRQQISKIQQDNRQMLGEGVSEMSLRDLKSLENKLERSISKIRGKKNDLLNGEIQYMQNWNEDLQKENTFLRAKVCENERAQQQHISILAAGPAEYELPPAVPFQHINLMESSHHQYSHQERTALQLG

SEQ ID NO: 57310 - protein, 308 aa, Vigna radiata
PVVDMKNLNNEERGATMEKIKDACENWGFFEVVNHGISIELMDSVDRLTKEHYKRCMEERFKEMVASKGLECAESEINDLDWESTFFLRHLPVSNISEIPDLADDYRKVMKDFAVELEKLAELVLELVCENLGLEKGYLKKAFYGSKGPNFGTKVSNYPPCPKPELIKGLRAHTDAGGIILLFQDHKVSGLQLFKDGHWIDVPPMRHSIVVNLGDQLEVITNGKYKSVMHRVITQTDGNRMSIASFYNPGNDAVIAPAEALVKEDESSKVYPKFVFDDYMKLYAGLKFQAKEPRFEAMKAIDGPIATV

SEQ ID NO: 57311 - protein, 675 aa, Xanthomonas campestris pv. campestris str. ATCC 33913
MLEHYGLMLALGCAVLAIVYGMLSARWVVAQPSGNARMQEIAAAIQEGARAYLNRQYLTISIAGVVLFVLVGLFLSWYTAIGFAIGAVLSGLAGYIGMNVSVRANVRTAQAARHGISKAMDVAFRGGAITGMLVVGLGLLGVAGYFAILQAMGLPLEQNLHALVGLAFGSSLISIFARLGGGIFTKGADVGADLVGKVEAGIPEDDPRNPAVIADNVGDNVGDCAGMAADLFETYAVTVIATMLLGSLTLAETGPHAVLYPLVLGGVSIVASIIGAAFVKVKPGGSIMGALYKGVIVSGVLAAIAYLPITQALMRENAHGAMSLYACALIGLVLTGLIVWITEYYTGTQYGPVQHVAAASTTGHGTNIIAGLGISMKSTALPVIAVCAAIWGAFHFGGLYGIAIAATAMLSMAGMIVALDAYGPITDNAGGIAEMAELPPEVRNVTDPLDAVGNTTKAVTKGYAIGSAALAALVLFADYTHNLQAANPNEVFAFDLSDHTVIIGLLIGGLIPYLFGAMAMEAVGRAAGAVVEEVRRQFRDIPGIMTGTAKPQYDRAVDMLTRSAIREMIVPSLLPVVVPVIVGLLLGPRALGGLLIGTIVTGLFVAISMTTGGGAWDNAKKYIEDGHFGGKGSEAHKAAITGDTVGDPYKDTAGPAINPLIKIINIVALLLVPLL

SEQ ID NO: 57312 - protein, 138 aa, Solanum lycopersicum
MASKRTTSLALFVLVNLLFFTLVSACGTCPGPKPKPKPKPKPKPTPSPSSKGKCPIDTLKLGVCANVLGNLLGVVLGNPPKKPCCSLIEGLVDLEAALCLCTAIKANILGINLNVPLSLSLLLNVCGKKAPSGFQCPK

SEQ ID NO: 57313 - protein, 313 aa, Arthrobacter sp. Q36
DPGADFAGRVVVVPIGIEDSLPWPALRRLETADLATLLPRPARRAHKYSRGVLGVVAGSPAYPGAAVLACRGALAAGVGMVRYVGPPEVADLIRHSCPEVVCSIGTVAETHVQAWLVGSGMDGKDEEEMQRVRDAVDSGLPAVADAGALPVLPDVLAPQVVLTPHAGELATLLQRLGADLDREAVEASTLPAVRRAACLTEATVLLKGASTLVASPYQDFYSQSEGTPWLATAGSGDVLSGIIGALLAQVGSDVGRFRAVGIDPDERWAAIAAMGASLHGLAGAAAAAGGPLTAGRISDVLPEIWGKVSTLSN

SEQ ID NO: 57314 - protein, 823 aa, Arthrobacter sp. Q36
MEIWPGSAYPLGATFDGTGTNFALFSEHAEKVELCLFDDEGTETRVTLREVDGYVWHCYLPQIQPGQKYGYRVHGPYDPANGQRFNANKLLLDPYAKAVAGQIDWDPALFSYNMGDPSSKNDADSAPHMMMGVVINPFFDWDNDQNLRIPYHKSVIYEAHVKGLTELHPEIPEEQRGTYAGVAHPAVISHLQKLGVTAIELMPVHQFVNDGTLQEKGLSNYWGYNTIGFFAPQNTYSSTGDTGQQVQDFKAMVRSLHRAGIEVILDVVYNHTAEGNHLGPTLSFKGIDNEAYYRLVEDDKQYYMDYTGTGNTLNVRQPHSLQLLMDSLRYWVTEMHVDGFRFDLAAALAREFYDVDRLSTFFELIQQDPVVSQVKLIAEPWDVGPGGYQVGNFPPQWTEWNGKYRDTVRDFWRGEPATLGEFASRITGSADLYEHSGRRPVASINFVTAHDGFTLRDLVSYNEKHNEANGEDNKDGESHNRSWNCGVEGPTDDPKVLSLRARQQRNFIATMLLSQGVPMILHGDEMGRTQQGNNNGYCQDSELTWVNWDSVDQPLIEFTAAVNSLRAKHPTFRRSRFFDGRPVRRGEGERLPDIVWLDPDGNLMSPEDWDSGFGRSVGMFLNGDGIQGHDDRGRRITDVNFLLYFNAHDGDVEFTLPPDEYAPAWDVIIDTAGEGADSKPADAGTILSVAAKSLVVLRAHSAPEEEPDHSVAASLAALTQTATAETAALTAPAVPEPAKTKKPAADPVAEPADPPVADPADPVADPVADPAPEPAAEPAKSAAEPGAEPAKDPEEQPAEKPARKPAAKRGGHLRAVKPAGEDA

SEQ ID NO: 57315 - protein, 197 aa, Glycine max
  misc_feature (12)..(12): Xaa can be any naturally occurring amino acid
  unsure (1)..(197): unsure at all Xaa locations
PRIRPLRPGASXIGLTLSDSNGNLPHLGTANRFIWEFNFRDFDVERDAHAPDSIDLLRRQGIDFRRNAAEGVDSYLFAELVMSSGLVCNDSVSWVTFHSAYDFGYLVKILTRRSLPSGLEEFLNMLRAFFGNNVYDIKHMMRFCDTLYGGLDRLARTLKVDRAVGKCHQAGSDSLLTWHAFQKMRDIYFVTDGPQKH

SEQ ID NO: 57316 - protein, 625 aa, Xanthomonas campestris pv. campestris str. ATCC 33913
MNAAPTVLLQQTQTLSAAVTQPIPGSRKIFVQGSRADLQVPMREIVLTRTPTLFGGQDNPPLSVYDTSGPYTDPQAAIDLAAGLAPLRADWIAERGDTLPLEALSSSFGRGREHDARLDAVRFPSRRLPRVARSGANVTQMHYARRGIITPEMEFVAIRENQRLEAVTDAVLRKQHPGEAFGAAIQQRITPEFVREEIARGRAILPNNINHPESEPMIIGRNFLTKINANIGNSAVSSGIAEEVEKLVWSIRWGGDTVMDLSTGKHIHETRDWIIRNSPVPIGTVPIYQALEKVDGRAEELTWEIFRDTLIEQAEQGVDYFTIHAGVLLRYVPLTARRVTGIVSRGGSILAKWCLAHHKENFLYTHFEDICEIMKAYDVAFSLGDGLRPGCIADANDAAQFGELETLGELTKLAWKHDVQTMIEGPGHVPMQLIKENMDKQLRECGEAPFYTLGPLTTDIAPGYDHITSAIGAAMIGWFGTAMLCYVTPKEHLGLPNRQDVRDGIMAYKIAAHAADLAKGHPGVQVRDNALSKARFEFRWDDQFHLGLDPEKAKEFHDETLPKDAHKLAHFCSMCGPHFCSMKITQDVRDYAAEHGISEDHALEAGMQEKSGEFVAQGAQVYRAS

SEQ ID NO: 57317 - protein, 132 aa, Brassica napus
  misc_feature (2)..(2): Xaa can be any naturally occurring amino acid
  misc_feature (6)..(6): Xaa can be any naturally occurring amino acid
  misc_feature (9)..(9): Xaa can be any naturally occurring amino acid
  misc_feature (14)..(14): Xaa can be any naturally occurring amino acid
  misc_feature (17)..(17): Xaa can be any naturally occurring amino acid
  misc_feature (20)..(20): Xaa can be any naturally occurring amino acid
  misc_feature (26)..(26): Xaa can be any naturally occurring amino acid
  misc_feature (29)..(29): Xaa can be any naturally occurring amino acid
  misc_feature (67)..(67): Xaa can be any naturally occurring amino acid
  misc_feature (82)..(82): Xaa can be any naturally occurring amino acid
  misc_feature (112)..(112): Xaa can be any naturally occurring amino acid
  misc_feature (115)..(115): Xaa can be any naturally occurring amino acid
  unsure (1)..(132): unsure at all Xaa locations
GXMELXQNXLLPVXRQXVTXEPELKXVQXSEDDEFIVLACDGIWDCMSSQEVVDFVHKQLKTEDKIXSVCEKLLNRCVAPTXGGEGCDNMTVIVVQFKKPALAVATSSAEQXATXAEGMRPNEVDGPDYPPK

SEQ ID NO: 57318 - protein, 594 aa, Neurospora crassa
MAIFAMGWQKPDNVAGSSAPAIMVGLFVATGGLLLGYDTGTINGILAMKSFKDHFSTGYIDGNGQPGIYPKESALIVAMLSAGTAIGALLAAPLGDHYGRRRSLIGAIGIFVIGAILQVCAYNIDLLVAGRTVAGVGIGIVSVLVPLYQSEMAPKWIRGTLVCTYQLSITMGLLAAAVVNILTYKLKTAAAYRVPIGLQLTWACVLALGLTVLPETPRYLIKRGDKNAAALSLSRLRRLDITHPALVEELAEIEANHQYEMALGPDSYKDILFGEPHLGRRTFTGCCLQMLQQLTGVNFIMYYGTTFFNNAGVGNPLKISLIMQVINTASTIPGLFVVESWGRRRLLMVGAIGMAICQLLIAAFATASGSNNLSAHNKVLITFVAIYIFFFAASWGPVVWVVTSEIYPLKVRAKSMSITTASNWFLNFGIAYGTPYMQTNSAASDESSIDLGSKVFFVWGAFCIVAVGFVWCMVYETSKISLEQIDEMYERVDHAWHSRRFEPSWSFQEMRDLGFSDGGIPPTQQLQQQPQQPQQQQQQHHQQQQHQLQVDLQQSQSRTSNSSTSQTDTGGSNNTGASQDDKLVASLGNIDLSY

SEQ ID NO: 57319 - protein, 490 aa, Pseudomonas aeruginosa UCBPP-PA14
MARFEEQKLYIGGRYVEASSGATFETINPANGEVLAKVQRASREDVERAVQSAVEGQKVWAAMTAMQRSRILRRAVDILRERNDELAALETLDTGKPLAETRSVDIVTGADVLEYYAGLVPAIEGEQIPLRETSFVYTRREPLGVVAGIGAWNYPVQIALWKSAPALAAGNAMIFKPSEVTPLTTLKLAEIYTEAGVPDGVFNVLTGSGREVGQWLTEHPLIEKISFTGGTSTGKKVMASASSSSLKEVTMELGGKSPLIIFPDADLDRAADIAVMANFFSSGQVCTNGTRVFIHRSQQARFEAKVLERVQRIRLGDPQDENTNFGPLVSFPHMESVLGYIESGKAQKARLLCGGERVTDGAFGNGAYVAPTVFTDCSDDMTIVREEIFGPVMSILVYDDEDEAIRRANDTEYGLAAGVVTQDLARAHRAIHRLEAGICWINTWGESPAEMPVGGYKQSGVGRENGLTTLAHYTRIKSVQVELGDYASVF

SEQ ID NO: 57320 - protein, 452 aa, Burkholderia vietnamiensis G4
MTDTISASQHEDTNLRTDAAWLDAHWMPFTANRQFKSDPRMIVSAKDAYYTDAEGRKIFDGLSGLWCTGLGHGRTEITEAVSRQIAQLDYAPAFQFGHPKSFELANKIKELTPAGLDYVFFTGSGSEAADTSLKMARAYWRAKGKGTKTRLIGREKGYHGVNFGGISVGGIGANRKLFGQGIDADFLPHTQLAENKFSRGMPDNGADLADRLLDLITLHDASNIAAVIVEPFSGSAGVVIPPKGYLKRLRDICTAHDILLIFDEVITGFGRSGAMTGADAFGVTPDIMNFAKQVTNGTQPLGGVIATKEIYDTFMAAGGPDYMLEFPHGYTYSAHPVACAAGVAALDLLVKEDAVARVRDLAPHFEAAVHGLKGQRHIADIRNYGLAAGLTIAALPGEPARRPYEIAMRCWAKGFYVRYGGDTIQLAPPFIAEKREIDNLVNALSDALNEVD

SEQ ID NO: 57321 - protein, 812 aa, Burkholderia thailandensis E264
MRPWCPSPNLQTSFVHCARARPERRSCRQRFRPGRNGRRRRAPGAEGAASVARGARFARRGSGPECVAARCGLVRRPPPAIELANGFLAKTPGGVEMASGIRRLGKTASRWIDFGLWTAAALLLLTAGVGALGTARLFDSEADVHRASEVISGLERLLSLARDMETGQRGYILTGKPDYLQPYEAALPEIRKEFDALAPLVQDDPVQQRRLAALRTLLKRKQDELAATIALRKSEGFDAAQAIVSSDAGKIFMDRARTMVNDMEATVQQQLRALRDRARATRDVAIAVGLASGLLTLVVCVSFGYVMRRLLLVESAASDDLFAQRELLHVTLASIGDGVIATDVDGRITFFNRVAEEMTALAADAVVGQPIEQVLTFRHALTQRVIDNPARVAVERKRIAALPVHTRFVGRGGGELPVDGNAAPTFDANGKLVGAVLVVRDVSERERAEERFRLAVEAAPNAMIMVNREGKIVLVNSQAEKFFDYVRGDMIGQGIDMLVPERFRAGHATHRGAFFGKPDARPMGAGRDLFGLRRDGSEFPVEIGLNPITTSEGAFVLCSITDITARKRAEHELRRRSEELARSNQDLEQFAYVASHDLQEPLRAVAGPLQLLQRRYQGQLDARADEFIGHAVDGATRMQSLIDDLLSYSRVGRLEDARQPVDCERVLDEALRNLSAAIRESGAQITHDRLPIVHGIAAQLVLLFQNLIGNAIKFRSKERIARIHLEADTRDDAWVFRVRDNGIGIDPQYFERIFLIFQRLHTRREYPGTGLGLALCKRIVEHHGGRIAVESEPGRGTTFSFALSRPGAEETR

SEQ ID NO: 57322 - protein, 282 aa, Xylella fastidiosa 9a5c
MPVSRFAVFGHPIAHSLSPRIHTEFGRQMGVALNYLAFDVAPDAFRVSLERFVAEGGCGANVTLPLKEAAFEVCTTLSARARRAGAVNTLSRVDGVWHGENTDGTGLVRNLTERHGLDLRGRRALLLGAGGAARGVAPALLDAGITEMVIVNRSPERADMLCDALGEPGRVSARYWGDLGDLGNFELIVNATSIGNTSDMRTFSLPRSLLDSMTAAVDLNYGSAAVPFLAWAHAVETRYVIDGLGMLVEQAAESFSLWHGRRPDTDPVYTVLHSEYGAPGRS

SEQ ID NO: 57323 - protein, 216 aa, Helleborus orientalis
IENTTNRQVTFCKHRNGLLKKAYELSVLCDAEVALIVFSSRGRLYEYSNNSVKKTIERYKKASTDSSNSGSASEANAQYYQQEAAKLRNQIAALQNSNRNLLGEQLSNLSIRELKQIEKKIETGINKIRSKKNELLFAEIEYMQKREVDLQNDNMFLRAKISENERTQQHMSLMPGTNNYEVISSGPFDSRNFLQVNLLESNNNYSRSDQTALQLG

SEQ ID NO: 57324 - protein, 356 aa, Arabidopsis thaliana
  misc_feature (294)..(294): Xaa can be any naturally occurring amino acid
  unsure (1)..(356): unsure at all Xaa locations
MQSRIVGLAPAFSLFPNLNTPHKTFTFHQILVLIITFTAYASFHASRKPPSIVKSVLGPPSLNSSSIDNGWAPFNGTQGTKRLGELDLAFLSSYALGMYFAGHLGDRIDLRYFLVFGMMGSGILTLVFGLGYWMNVHTLGFYMSVQIVCGLFQSIGWPCVVSVVGNWCGKEKRGLIMGLWNSHTSVGNILGSVIASSVLDFGWGWSFVLPGVLVLVSGVVVFMFLVVSPNDLGFEELGKEIEIEMSLGENVEESLRKHEAEGAVLLENVDDSSFAIGFLEAWRLPGVAPYAFCXGLLVNGPYALITTAVAADLGTQDSIKGNGRALATVTAIIDGTGSVGAALGPLLAGYISSRGW

SEQ ID NO: 57325 - protein, 214 aa, Aquilegia alpina
IENTTNRQVTFCKRRNGLLKKAYELSVLCEAEVALIVFSNRGRLYEYANNSVRKTIDRYKKTCGEGSSTLTVSEANLLFYQQESSKMKQQIEILQNSNRHLMGEALSCLSIKELKQLESRLEKGISRIRSKKNEMLLAEIEFMQKREIELHNDNIYLREQITANERAQQHMNSLPGNVYEAITSAPYNSRDFLQVNLRESKPNQYCDSTALQLC

SEQ ID NO: 57326 - protein, 492 aa, Mycobacterium bovis AF2122/97
MATIHPPAYLLDQAKRRFTPSFNNFPGMSLVEHMLLNTKFPEKKLAEPPPGSGLKPVVGDAGLPILGHMIEMLRGGPDYLMFLYKTKGPVVFGDSAVLPGVAALGPDAAQVIYSNRNKDYSQQGWVPVIGPFFHRGLMLLDFEEHMFHRRIMQEAFVRSRLAGYLEQMDRVVSRVVADDWVVNDARFLVYPAMKALTLDIASMVFMGHEPGTDHELVTKVNKAFTITTRAGNAVIRTSVPPFTWWRGLRARELLENYFTARVKERREASGNDLLTVLCQTEDDDGNRFSDADIVNHMIFLMMAAHDTSTSTATTMAYQLAAHPEWQQRCRDESDRHGDGPLDIESLEQLESLDLVMNESIRLVTPVQWAMRQTVRDTELLGYYLPKGTNVIAYPGMNHRLPEIWTDPLTFDPERFTEPRNEHKRHRYAFTPFGGGVHKCIGMVFGQLEIKTILHRLLRRYRLELSRPDYQPRWDYSAMPIPMDGMPIVLRPR

SEQ ID NO: 57327 - protein, 876 aa, Zea mays
TTKKRVFHFGKGKSEGNKTMKELLGGKGANLAEMASIGLSVPPGFTVSTEACQQYQDAGCALPAGLWAEIVDGLQWVEEYMGATLGDPQRPLLLSVRSGAAVSMPGMMDTVLNLGLNDEVAAGLAAKSGERFAYDSFRRFLDMFGNVVMDIPRSLFEEKLEHMKESKGLKNDTDLTASDLKELVGQYKEVYLSAKGEPFPSDPKKQLELAVLAVFNSWESPRAKKYRSINQITGLRGTAVNVQCMVFGNMGNTSGTGVLFTRNPNTGEKKLYGEFLVNAQGEDVVAGIRTPEDLDAMKNLMPQAYDELVENCNILESHYKEMQDIEFTVQENRLWMLQCRTGKRTGKSAVKIAVDMVNEGLVEPRSAIKMVEPGHLDQLLHPQFENPSAYKDQVIATGLPASPGAAVGQVVFTAEDAEAWHSQGKAAILVRAETSPEDVGGMHAAVGILTERGGMTSHAAVVARGWGKCCVSGCSGIRVNDAEKLVTIGGHVLREGEWLSLNGSTGEVILGKQPLSPPALSGDLGTFMAWVDDVRKLKVLANADTPDDALTARNNGAQGIGLCRTEHMFFASDERIKAVRQMIMAPTLELRQQALDRLLPYQRSDFEGIFRAMDGLPVTIRLLDPPLHEFLPEGNIEDIVSELCAETGANQEDALARIEKLSEVNPMLGFRGCRLGISYPELTEMQARAIFEAAIAMTNQGVQVFPEIMVPLVGTPQELGHQVTLIRQVAEKVFANVGKTIGYKVGTMIEIPRAALVADEIAEQAEFFSFGTNDLTQMTFGYSRDDVGKFIPVYLAQGILQHDPFEVLDQRGVGELVKFATERGRKARPNLKVGICGEHGGEPSSVAFFAKAGLDYVSCSPFRVPIARLAAAQVLV

SEQ ID NO: 57328 - protein, 398 aa, Yarrowia lipolytica CLIB122
MLTRLRPVLRGGVKASLPSLTKTVSPLRGYSSLVASHDSPNLVNLSEAPFLLNSANAALSHPELAGTAAAEGQAKQLNLYQSVNDALKTALETDETAVLFGEDVAFGGVFRCSMDLQERFGADRVFNTPLTEQGLVGFGIGYAAYGSTAIAEVQFADYVFPAFDQIVNEAAKYRARSSSNFDAGGLTIRMPCGVVGHGAMYHSQSGEAFFSHSPGIKVVMPRSPFQAKGLLLASIRSKDPIIFMEPKILYRASAEYVPTEDYELPIGKADVMQEGSDVTIVGYGTQLYHIHAAAKMAEQKLGASVEIIDLRTISPWDRDTVFESVKKTGRCVVTHEAPRTGGIGAEVAAEVQEKCFLHLESPVQRVTGWDTHMSLAFEDLQVPNVTRIFHSIKKAIEY

SEQ ID NO: 57329 - protein, 152 aa, Astragalus membranaceus
WSVGCVLAELLLGQPLFPGESGVDQLVEIIKVLGTPTREEIKCMNPNYTEFKFPQIKAHPWHKIFHKRMPPEAVDLVSRLLQYSPNLRCQALDALTHPFFDELRDPNARLPTGRFLPPLFNFKPHELKGVPAETSVKLVPEHARKQCPFLGL

SEQ ID NO: 57330 - protein, 387 aa, Gibberella zeae PH-1
MPRLPFPAFKSLVIQPLRITPTAINRSYYSTMMRAARYYGREDIRVEQVPQPSVKAGQVKVAPAFVGICGTDLHEYLGGPNFCPTTPHPITKESIPVTLGHEFSGIITEVGPDVEGFEVGQPCAIQPTLFCGHCAACHNHAENVCHSGGFIGLSGSGGGLSESVCVNATHVHPLPQDLPLEIGALVEPLSVSWHAMTAAPDINPDSRVVILGGGPIGLAMILCLKAKGVDEIIVSEVATSRQKFARELGATWVVNPIEENLNEIVLALTEGKGADVVFDCAGVPMSIKSACEVVRPKGTVVNLAIWEKEIPFNPNWITMKESSYKSVLGYTHKDFQAVIANLASGAIKPSQMITRKIKLENIVEDGIKALIHDKNNQVKVLVDMSDR

SEQ ID NO: 57331 - protein, 357 aa, Xanthomonas campestris pv. campestris str. ATCC 33913
MSKQILILPGDGIGPEIMAEAVKVLTRIDTQHTLGVTLVYDELGGAAYDKYGSPLADETLERARAADAVLLGAVGGPQWDTIDPALRPERGLLKIRSQLGLFANLRPALLYPQLADASTLKPEVVSGLDLLILRELTGGIYFGQPRGTRTLDNGERQAYDTLPYSESEIRRIAKAGFEMARLRGKKLCSVDKANVLASSQLWRAVVEEVAKDYPDIALSHMYVDNAAMQLVRAPKQFDVIVTDNMFGDILSDQASMLTGSIGMLPSASLDANSKGMYEPCHGSAPDIAGQGIANPLATILSVAMMLRYTFAQAAAADAIEAAVGKVLDQGLRTADIWSEGTTKVGTAAMGDAVVAAL

SEQ ID NO: 57332 - protein, 265 aa, Pyrococcus horikoshii
  misc_feature (1)..(1): Xaa can be any naturally occurring amino acid
  misc_feature (39)..(39): Xaa can be any naturally occurring amino acid
  misc_feature (174)..(174): Xaa can be any naturally occurring amino acid
  misc_feature (176)..(176): Xaa can be any naturally occurring amino acid
  misc_feature (182)..(182): Xaa can be any naturally occurring amino acid
  misc_feature (191)..(191): Xaa can be any naturally occurring amino acid
  unsure (1)..(265): unsure at all Xaa locations
XVLYFIGLGLYDERDITVKGLEIAKKCDYVFAEFYTSLXAGTTLGRIQKLIGKEIRVLSREDVELNFENIVLPLAKENDVAFLTPGDPLVATTHAELRIRAKRAGVESYVIHAPSIYSAVGITGLHIYKFGKSATVAYPEGNWFPTSYYDVIKENAERGLHTLLFLDIKAEKRXYXTANEAXELLLKVEDXKKGGVFTDDTLVVVLARAGSLNPTIRAGYVKDLIREDFGDPPHILIVPGKLHIVEAEYLVEIAGAPREILRVNV

SEQ ID NO: 57333 - protein, 88 aa, Oryza sativa (japonica cultivar-group)
MILEQFDESAAEKADAAMVVAPPSNFGMVDTGVYRSGFPDPASFGFLRGLGLRSVVYLCPEPYMETNAEFLKAEGIRLFQFGIEGNKM

SEQ ID NO: 57334 - protein, 303 aa, Glycine max
  misc_feature (111)..(111): Xaa can be any naturally occurring amino acid
  misc_feature (125)..(125): Xaa can be any naturally occurring amino acid
  misc_feature (214)..(214): Xaa can be any naturally occurring amino acid
  misc_feature (256)..(256): Xaa can be any naturally occurring amino acid
  unsure (1)..(303): unsure at all Xaa locations
APPPPPRITDGDGTFPNLNRCREMAYASSTSLGVRLTEGEGNLPKLVLTSPAGSEAEIYLFGGFITSWKVPSGKDLLFVRPDAVFNGNKPISGGVPHCFPQFGPGPIQQVXVGVDWTVVDSENTXGNPVVTLELKDGPYSCTVWDFSFHALFKVTLNAKSLATELTVKNTDNKAFSFSTTLHTYFQASVSNASVKGLKGCKTLNKDPDPKNPVXGKEEREVVTFPGFVDCAYLDAFSELQLDNGLGDLISIKNTLXSDAVLWKSYLQMEACYKDFVCVENPKIGSVQLEPEQTWTAVQHLSIA

SEQ ID NO: 57335 - protein, 426 aa, Mycobacterium leprae
MTRASDEVGAASACVGDPAQMTDDRSVRTPKALPDGVTAATVGVRGGLLRSRFEETAETMYLTSGYVYESAVVAEKSFTGELDHFVYSRYGNPTVTMFEERLRLIEGAPAAFVTASGMAAVFTSLGALLASGDRLVAARSLFGSCFVVCNEILPRWGVETVFVDGEDLVQWEQALSVPTQAVFFETPSNPMQSLVDIAAVTELAHAAGAKVVLDNAFATPLLQHGLPLGVDVVIYSGTKHIDGQGRVLGGAILGDRDYIDGPVQKLMRHTGPAMSAFNAWILLKGLETLAIRVDHCNSSAHRIAEFLEKHPAVSWVRYPFLVSHPQYDLAKRQMSGGGTVVTFALNSPEDAAKQRAFEVLDRLRLIDISNNFGDVKSLITHPATTTHRAMGPEGRAAIGLGDGVVRISIGLEDAADLIADIDQALS

SEQ ID NO: 57336 - protein, 469 aa, Salmonella typhimurium
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRREEDDRVRMTPHPVEFELYYSV

SEQ ID NO: 57337 - protein, 500 aa, Oryza sativa
MEPWAIRVAYFIVFSFLVTARFGSCAPHSEEGRALPGYRESEQDQSIGSLSNRGEGKLIGRVFNLLLKENMFASETPSESKEHSSISESVPHDSAGFEPCRKCLAKTVHNATPRRLLQARELASNQTQTHPKSQSSPVQSSASHLVPRWAIYALPVAGVLFIAAVATAIYVFFSRRKKDNTVMPWATGLSGQLKKAFVTGVPSLERTELEAACEGFINVIGTLPECTLYKGTLSSGVEIAVLSTSVNSSQQWSAQSEEQFRNKISVLSRVNHKNFMNLIGYCACEEPFTRMMVFEYAPCGSLFEHLHIREAEHLDWKTRLRIIMGVAYCLEHMSQLDPPPLLPTNLSSSSIYLTEDNAAKIADIEFWKDDINKQDDQESVVYKFGILVLEVISGRRPFSEDDRLLVLWASSYLDGKRPLSAMADRTLVRSSSAAPEKDVAALCDVVRQCVRRPEGGKRAISMGEVARLVRGIAGLSPEQAAPREKPLWWAELEIASSETA

SEQ ID NO: 57338 - protein, 417 aa, Oryza sativa (japonica cultivar-group)
MSGCGDSSPFHHASLDTDVAWLLLPPFWPPESTVIRQIGIEWEDKDAYKVWLESFGMYPLPLVRRVKIFWSSLKSWLSENFPEAHKTLNKGVSEAQIQSAEDDLGFKLPLPTKLLYRFCNGQLPLSEHHHENMRMAHLGIIGGYVFYDHLINVHLSPLEQIVEETKEFYREFYDQGVFNMTNLIIVATSWYRPKTFFLNCSDDQLYVGTINLQDGEMLPCVPKSLIRPTNTDMPQDGLLLWLEEHLRRLQNGMIKIRMLKTSRYISLFPEASPSCTSAMTNGVKVRASAVFAPEHPESRRPGAKCLYAYSIRLSVPEACMLGGVYYSSCQLYSRHWIIRWRDRVVSDVNGEGVIGKYPLLTTGQEEFVYESCTPLPDSPGSVEGSFTFVPGKLSRPEGKPFEVTVAAFPLEIPEYIF

SEQ ID NO: 57339 - protein, 371 aa, Sulfolobus solfataricus P2
MIILYLILMKGAILYKYNEPLIIEDNIQIDEPKVGETKIRIEATGLCHSDVNVFEGKTPVPPPVIAGHEIAGVIEEVGNNVTDFKPGDRVISAFIHPCGKCKNCITGKENLCEVFAKNRLNGTLLDGTTRLHFKDGTPIRAFLGGGFAEYAMVPYTALTKVPEDLDLRKVAVLGCAGLTAYGAVNSAKIEPGETVAVIGVGGVGLSVIQMLKIAGAGRIIAVGTRKWKLEKALELGASDVVNSKETDVVRAVKNITGGGPDVVIEVAGTTETVKMSLDMVRIGGKVVLVGLPPTTAEIPIRIASIVRGGIKIIGDYGGRPRVDMPRLIELVKLGKYDPTALVTGKFRLEEINEAVKLLEQGEAIRSLIIPN

SEQ ID NO: 57340 - protein, 380 aa, Triticum aestivum
  misc_feature (42)..(42): Xaa can be any naturally occurring amino acid
  misc_feature (141)..(141): Xaa can be any naturally occurring amino acid
  misc_feature (204)..(204): Xaa can be any naturally occurring amino acid
  unsure (1)..(380): unsure at all Xaa locations
MADGEDIQPLVCDNGTGMVKAGFAGDDAPRAVFPSIVGRPRXHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQXAVLSLYASGRTTGIVLDSGDGVSHTVPIYEGYALPHAILRLDLAGRDLTDSLMKILTERGYSXFTTSAEREIVRDIKEKLAYVALDYEQELETAKNSSSVEKSYELPDGQVITIGAERFRCPEVLFQPSMIGMESSGIHETTYNSIMKCDVDIRKDLYGNIVLSGGTTMFPGIADRMSKEITALAPSSMKIKVVAPPERKYSVWIGGSILASLSTFQQMWISKDEYDESGPAIVHRKCF

SEQ ID NO: 57341 - protein, 253 aa, Brassica napus
PEPLTAEEERELEAAHVRIQDICRKCQESNVPLLIDAEDTILQPAIDYMAYSSAIMFNGDKDRPIVYNTIQAYLRDAGERLHLVVQEAEKEGVPMGFKLVRGAYMSSEARLADSLGHKSPVHDTLQNTHACYNDCMTFLMEKASNGSGFGVVLATHNADSGRLASRKASELNINKKNGTIEFAQLYGMSDALSFGLKRAGFNVSKYMPFGPVETAIPDLVRRAYENRGMMASGALDRQLLRMELKRRLMAVIA

SEQ ID NO: 57342 - protein, 210 aa, Sulfolobus solfataricus P2
MRKAVIFDLDGTLANTDEVHKLAWEIALRKLGYDVKVDIRYLLGRKTIDIAKILIGESHAEKLASVKTEIYNELVKTLAKPKPCVMELINRLRDVEIPIAVVTSSMRNSAVQVLKVINVEPDVLITGDDVKLGKPNPMPVIEAIKRLNVDPNESVGVGDTIYDVMAYYSAGIREIIVVRSSVPLNVEEARKYDAKILDSLCEISDWFELF

SEQ ID NO: 57343 - protein, 435 aa, Triticum aestivum
MASEKHFKYVILGGGVAAGYAAREFGKQGVQPGELAIISKESVAPYERPALSKGYLFPQNAARLPGFHTCVGGGGEKLLPEWYTEKGIELILSTEIVKADLASKTLTSAAGATFTYETLLIATGSSTIKLIDFGVQGAESNNILYLREIDDADKLVAAMQAKKDGKAVVVGGGYIGLELSAALKINNFDVTMVYPEPWCMPRLFTAGIAHFYEGYYASKGINIVKGTVASGFDADANGDVSVVKLKDGRVLDADIVIVGVGGRPLTGLFKGQVEEEKGGLKTDTFFETSVAGVYAIGDVATFPMKLYDEPRRVEHVDHARKSAEQAVKAIKAKESGESVAEYDYLPYFYSRSFDVAWQFYGDNVGETVLFGDNDPAAPKPKFGTYWVKDGKVIGVFLEGGSADENQAIAKVARAQPPVADVEALGKEGLDFATKI

SEQ ID NO: 57344 - protein, 216 aa, Ranunculus ficaria
IENTTNRQVTFCKRRNGLLKKAYELSVLCEAEVALIVFSNRGRLYEYSNNSVKKTIERYKKHSTDSSNTGSVSEANAQFYQQEANKLRNQIATLQNSNKNLLGESLSNLSVRELKAIEKKIEGGIAKIRSKKNELLFAEIEYMQKREIDLQNDNMFLRAKIAENERTQQQHMSLMPVNDYEVISSAPYDSRNFLPVNLLDSNHNYSRNDQTTLQLG

SEQ ID NO: 57345 - protein, 518 aa, Cucumis melo
MEIWFIFLISLSICSLLTSIFTHFQTSTKLPPGPPSIPILTNFLWLRRSSLQIESLLRSFVAKYGPVLTLRIGSRPTVFIADRSIAHKILVQNGALFADRPPALSVGKVITSNQHNISSASYGPLWRLLRRNLTSQILHPSRVRSYSEARKWVLDILLNRLQSQSESGNPVSVIENFQYAMFCLLVLMCFGDKLDESQIREVENVERAMILSFQRFNILNFWPKFTKILFRKRWEAFFQLRKNQEKVLTRLIEARRKANGNRENKAQNEEEEIVVSYVDTLLELELPDEKRKLNDDELVTLCSEFLTAGTDTTSTALQWIMANLVKHPEIQNKLFVEMKGVMGNGSREEVKEEVLGKLPYLKAVVLEGLRRHPPAHFVLPHAVKEDAELGNYVIPKNVTVNFMVAEIGRDPKVWEDPTAFNPERFVKGGKEKEEQVAEFDITGSKEIKMMPFGAGRRICPGFGLAILHLEYFVANLVWRFEWKVVDGDEVDMSEKVELTVAMKKPLKAKIHPRIHTES

SEQ ID NO: 57346 - protein, 342 aa, Bacillus thuringiensis serovar konkukian str. 97-27
MTKIFILASTLSLSFFSGLNIGNAATENFSPITNAIVQNNDYFAEGNSKDNNKPPGNGGSQDDSGSDGNGSDGSGSGDNGSGGNGSGGNGSGDNGSGDDGSGGNGSGDNGSGGNGSGGNGSGGNGSGGSGSGDNGSGGNGSGGNGSGGNGSGGNGSGGNGSGGSGSGDNGSGGNGSGGNGSGGNGSGGNGSGGNGSGSSGSGDNGSGGNGSGGSGSGDNGSGGSGSGDNGSGGSGSGDNGSGGSGSGDNGSGGSGSGDNGSGGSGSGDNGSGGSGSQGGNRVKGDSSSQGGNGSQGGNVKDNAKKQGDKLPNTATHYPASILMGLSTFLIGMLLFIRRKNAK

SEQ ID NO: 57347 - protein, 249 aa, Solanum tuberosum
MACEEILKAVFPFLEGTELATCMIVCKQWRDIAQDDYFWKFLCSKKWPSICKRSSPPTVTYYNLFQNFHKRPYRRTVLPPKLSFSDLEFYIDIWTEEKIIFSDVVPGPVLQKGIWIPPPGICDVLKFHLEGPEYKMTLPVEQIYNSFVQTVSVSVLVGRKDTNKVACIIKKSLFDYIDRTAYRALAYDYLDFSSPMCLFVSGVRAWISLLFMDHGNEGALDVFGIENGFCDAANSEDEVLWLLDMLEWK

SEQ ID NO: 57348 - protein, 542 aa, Prochlorococcus marinus str. MIT 9313
MVISSPAKQFLQGKKLNKIEQNKAFKDGLDVGDELENFAQLGWEQVDKTDLELRLKWYGMFWRPKTPGKFMLRLRIPNGVLNSHQIKVVASIVGRYGEDGSCDITTRQNLQLRGVLLSDLPEILKRLEEAGLNTIQSGFDNPRNVTGNPLAGIDPLEIVDTRPYTTELQNFLTNQGKGNHEFSNLPRKWNTAVAGARDNFLLHNDIIFHPVEHDGVMGFGVWLGGILSSQMNDYALPLNAWVKPNEICRLTGTILTLWRDNGERNNRPKGRFRMYLDSVGIEAFRTMVVEKFGPLTPDPGSVFEDKPRSFYGIHPQKQTGLHYAGMHVPVGRLNAEDLQDLASASLNYGSGEIRLTEDQNIILVGLSTTNLDKFQADPLLQRFPLEPGSIAAGTVSCTGNTYCSFALTNTKDQAMAMAHELDAELILPEEIKVHWTGCPNSCGQAYMGAIGLTGTKARAPNGGQGMVEAYDLSLEGRQGPDAQIGTLHRKGIPGSELKDVLRELLIERFGAQPRSQPKQNSDPFSNFMNWFSNLGENSSPSP

SEQ ID NO: 57349 - protein, 318 aa, Caulobacter vibrioides
  misc_feature (248)..(248): Xaa can be any naturally occurring amino acid
  unsure (1)..(318): unsure at all Xaa locations
MSAFNAVQVGRRVLAVEADALRVLADSLGEAFANAVETIFNAKGRVVCTGMGKSGHVARKIAATLASTGTQAMFVHPAEASHGDLGMIGPDDVVLALSKSGAGRELADTLAYAKRFSIPLIAMTAVADSPLGQAGDILLLLPDAPEGTAEVNAPTTSTTLQIALGDAIAVALLERRGFTASDFRVFHPGGKLGAMLRTVGDLMHGADELPLVAADAAMPDALLVMSEKRFGAVGVVDNAGHLAGLITXGDLRRHMDGLLTHTAGEVMTHAPLTIGPGALAAEALKVMNERRITVLFVVERERPVGILHVHDLLRAGVI

SEQ ID NO: 57350 - protein, 358 aa, Brassica oleracea var. capitata
MVAVERVESLAKSGINSIPKEYIRPKEELESINDVFQEEKKEDGPQVPTIDLQDIESEDETIREKCIEELKKAAMDWGVMHLINHGVPVELMERVKKSGEEFFGLPVEEKEKYANDQAKGKIQGYGSKLANNASGQLEWEDYFFHLVYPEDKRDLSLWPKTPTDYIEATSEYAKCLRLLATKVFKALSIALGLEPDRLENEVGGIEELLLQMKINYYPKCPQPELALGVEAHTDVSALTFILHNMVPGLQLFYEGKWVIAKCVPDSIVMHIGDTLEILSNGKFKSILHRGLVNKEKVRISWAVFCEPPKEKIVLKPLPEMVSVESPAKFPPRTFAQHIEHKLFRNEQEELVTEKKDEV

SEQ ID NO: 57351 - protein, 525 aa, Cicer arietinum
MAVSATGQIMLSSTVQLREPTIMGSTRNLRFVKFCNGEIMGRKIELKAGGAISNCCTKNVIRQNISMSLTADVAAESKLRNVDLEKRDPSTVVAIILGGGAGTRLFPLTKRRAKPAVPIGGAYRLIDVPMSNCINSGINKVYILTQFNSASLNRHIARAYNSGTGVTFGDGYVEVLAATQTPGEQGKKWFQGTADAVRQFHWLFEDARSKDIEDVLILSGDHLYRMDYMDFVQNHRESGADITLSCLPMDDSRASDFGLMKIDNKGRVLSFSEKPKGEDLKAMQVDTTVLGLSKDEALEKPYIASMGVYVFKKEILLNLLRWRFPTANDFGSEIIPASAREFYMKAYLFNDYWEDIGTIRSFFEANLALTEHPSKFSFYDAAKPMYTSRRNLPPSKIDNSKIVDSIVSHGSFLNNSFIEHSVVGIRSRINSNVHLKDTVMLGADFYETEAEVAALLAEGRVPIGIGENTKIKDCIIDKNARIGKNVIIANSEGIQEADRSAEGFYIRSGVTVVLKNSTIEDGLVI

SEQ ID NO: 57352 - protein, 521 aa, Cicer arietinum
MDLAIGSNYASLRSSVFLGETLKGNLSTKFLTSPKFSQIHINNLRSFNPRNGASYSVLTSGINDFEESMTFHEGPYFDTPKADPKSVASIILGGGAGTRLFPLTSKRAKPAVPIGGCYRLIDIPMSNCINSGIRKIFILTQFNSFSLNRHLSRSYNFGNVSTFGEGFVEVLAATQTSGEAGKKWFQGTADAVRQFIWVFEDAKTKNVEHILILSGDHLYRMNYMDFVQKHIDTNADITVSCIPMDDSRASDYGLLKIDGKGRIIQFAEKPKGSELKAMRVDTTLLGLSPEEAKKQPYIASMGVYVFRTETLLKLLRSNCSTCNDFGSEIIPSAVNDDHNVQAYLFNDYWEDIGTIKSFFDANLALTDQPPKFQFYDPNTPFYTFPRFLPPTKVEKCKIVDAIISHGCFLRECSVQHSIVGIRSRLESGVELQDTMMMGADYYQTESEIASLLAEGKVPVGVGENTKIRNCIIDKNARIGRNVIITNADGVEEADRTKEGFYIRSGITAILKNATIKDGTVI

SEQ ID NO: 57353 - protein, 516 aa, Cicer arietinum
MASMAAIGVLKVPPSSSSSSSSSSSKAIIARNLSFTSSQVCGDKIGTFSRRGRGSYVGNPIIVSPKAVSDSKNAQTCLDPDASRSVLGIILGGGAGTRLYPLTKKRAKPAVPLGANYRLIDIPVSNCLNSNVSKIYVLTQFNSASLNRHLSRAYASNMGGYKNEGFVEGLAAQQSPENPNWFQGTADAVRQYLWLFEEHNVLEYLVLAGDHLYRMDYERFIQAHRESDADITVAALPMDELRATAFGLMKIDEEGRIIEFAEKPKGEQLKAMKVDTTILGLDEERAKEMPYIASMGIYVVSKHVMLDLLREKFPGANDFGSEVIPGATNIGMRVQAYLYDGYWEDIGTIEAFYNANLGITKKPVPDFSFYDRSSPIYTQPRYLPPSKMLDADITDSVIGEGCVIKNCKIHHSVVGLRSCISEGAIIEDTLLMGADYYETDADRRFLAAKGSVPIGIGKNSHIRRAIIDKNARIGDNVKIINSDNVQEAARETEGYFIKSGIVTVIKDALIPSGTVI

SEQ ID NO: 57354 - protein, 241 aa, Haemophilus influenzae R2866
MLKIQKLSIAALMVSAVISGQVFAEDNTFDEKAASYAVGTLMGSQMKDLVDSHKEVIKYDNARILDGLKDALEGKVDVRKDEKIQKTLESIEAKLVAASKAKAEAIAKQAKEEGDKFRAEFAKGKDVKTTQSGLIYKIESAGKGDTIKSTDTVKVHYTGKLPNGKVFDSSVERGQPVEFQLDQVIKGWTEGLQLVKKGGKIQLVIAPELGYGEQGAGASIPPNSTLIFDVEVLDVNPKSEK

SEQ ID NO: 57355 - protein, 247 aa, Yarrowia lipolytica CLIB122
MSRTFFVGGNFKMNGSLESIKAIVERLNASELDPKTEVVISPPFPYLLLAKESLKKPTVSVAGQNSFDKGDGAFTGEVSVAQLKDVGAKWVILGHSERRTINKESSEWIADKTKYALDNGLDVILCIGETIDEKKAGKTLDVVRSQLDPVIAKIKDWSNVVIAYEPVWAIGTGLAATAEDAQQIHHEIRAYLKDKIGAQADKVRIIYGGSVNGKNSGTFKDKSDVDGFLVGGASLKPEFVDIINSRL

SEQ ID NO: 57356 - protein, 167 aa, Erwinia amylovora
RHFADTPEEKNLPILLALIGIWYNNFFGAETEAILPYDQYMHRFAAYFQQGNMESNGKYIDRAGNAVSYQTGPIIWGEPGTNGQHAFYQLIHQGTKLVPCDFIAPAVSHNKLSDHHSKLLSNFFAQTEALAFGKSREAVEQEFADAGKDAKSVEHIVPYKVFEGNRP

SEQ ID NO: 57357 - protein, 167 aa, Pectobacterium carotovorum
QHFATTPAEKNLPVLLALIGIWYNNFFVAETEGILPYDQYMHRFAAYFQQGNMESNGKYVGRNGNPVDYQTGPIIWGEPGANGQHAFYQLIHQGTKLVPCDFIAPAMTHNALSDHHSKLLSNFFAQTEALAFGKSREVVEAEFAAAGKSAKEVEHVAPFKVFEGNRP

SEQ ID NO: 57358 - protein, 514 aa, Verbena x hybrida
MTFSELINILFWDLTAAILLYVALILVCSLYSKPSTVSRNLPPGPKGFPVVGALPLLGTMPHIALAKMAKTYGPVMYLKVGTWGMAVASTPDAARAFLKTLDTTFSDRPPNAGATLLAYNAQDMVFAHYGPRWRLLRKLSNLHMLGAKALEDWADVRSSEVGHMLQAMLTSSLRHEAVALPEMLIYSMANMIGQVILSRRVFETKGKEVNEFKDMVVELMTSAGYFNIGDFIPALAWMDLQGIEKGMKSLHKKFDDLIGRMLDKHLESAHKRNAKPDFLDVILANRHNSEGESLTTTNIKALLLNLFTAGTDTSSSTIEWALAEMIKNPTILKTAHNEMDRVIGRDRRLLESDLPKLPYLQAICKEAYRKHPSTPLNLPRISSQPCIVNGYYIPENTRLSVNIWAIGRDPDVWENPLDFNPDRFLSGKNAKIDPRGNNFELIPFGAGRRICAGARMAMVLVEYILGTLVHSFDWELPVGVDEMDMEEAFGLALQKAVPLAAMVSPRLPPHCYAP

SEQ ID NO: 57359 - protein, 137 aa, Brassica napus
  misc_feature (130)..(130): Xaa can be any naturally occurring amino acid
  misc_feature (134)..(134): Xaa can be any naturally occurring amino acid
  unsure (1)..(137): unsure at all Xaa locations
MQITPFSVFFSSVYDDESALMITISSAVVALLVVLLQWRLHRKKQRWKLPPGSMGWPYIGETLRLYTENPNSFFATRQNKYGEIFKTHILGCPCVMISSPEAARMVLVSKAHMFKPTYPASKERMIGPDXLFFXQGP

SEQ ID NO: 57360 - protein, 172 aa, Triticum aestivum
  misc_feature (84)..(84): Xaa can be any naturally occurring amino acid
  misc_feature (159)..(159): Xaa can be any naturally occurring amino acid
  misc_feature (164)..(164): Xaa can be any naturally occurring amino acid
  misc_feature (171)..(171): Xaa can be any naturally occurring amino acid
  unsure (1)..(172): unsure at all Xaa locations
LAWSRPRFCPQIERIQVSQQEIVSLYERFCQLDRSAKGFVAEDEFLSIPEYSTNPLSQRLLRMVDGLNFKEFVSFLSTFSARAXSLQQKIEFIFKVYDIDGKGKVSFKDLVEVLRDLTGSSMSRATKESQVLTKGCWEESWGTHGIPTLSLKDFVTIIXHPGLXMEVEVPXD

SEQ ID NO: 57361 - protein, 507 aa, Nocardia farcinica IFM 10152
MTVTDTLSEASASTLTPVLPQVRDWLARPKQLFIGGRWVDAASGRSFETVDPATGQVLTTVAHGGAEDVDRAVRAARTAFEGEWSLWTPAQRQRLLFRIGEAIFEHAEELAQLESLDNGKSAAVAQAVDITWVAELFQYYAGWATKIEGRTIPVSMPWAPGTQWHAYTLREPVGVCGAITPWNFPLLMVAFKLPVALACGNTIVVKPAEQTPLTTLRLAEIMVEAGLPDGVLNVVTGYGDAGAALAGHLDVDKIAFTGSTEVGKLIVDAAKGNLKRVTLELGGKSPQVVFADADLDLAVPGVASGFLFNHGQTCTSGTRILVERGIFDEFTQRVADIAAASKLGPGLDPTTEVGPLVSQEQLERVTGYIDQGLRDGARALCGGRRHGDSGFYVEPTVLVDVQSSFSVYREEIFGPVVVATPFDAEDGVAAAANDTPYGLAASVWTRDISKAHRTARQIKAGTVWVNAHNAFDAALPFGGYKQSGWGRELGASAIDAYTEQKTINAQL

SEQ ID NO: 57362 - protein, 231 aa, Arabidopsis thaliana
MASSSSLASSTKLVFFACLLLFTFSSHNLVAGESDKVKLNLYYESLCPSCQNFIVHHLGKIFNTDLHTITDLKLIPFGNAHVSDDLTVTCQHGEEECKLNALEACAIRTWPNQRLHYKFIRCVETNTNAWESCVKKYGGEKAINDCYNGDLSKELILGYANQTLSLKPEHKYVPWMTLNGEPLYENIGDFVDLVCKAYKGKAALPKLCYSSVLSQRTMMLEFSYVDEAINH

SEQ ID NO: 57363 - protein, 759 aa, Streptococcus pneumoniae TIGR4
MYNYPMRIHYHRKNGEYDTCSFVKSQDQRIDLLTYKEDYFGALFSFEHPSSHVIESLNFVVHTGQTSKEYSIRFNHYPLLTEVWILEGDDRIYYSENPAIASPFYKNQNPFAFDKAINSASFDHHWGYQGELGCRVEDNQAHFSLWSPTATEVQVVVYESAANDAPVWKTFEMKRGNSYSYNHKDNTIGVWSLDVEEDLVGKTYQYQVQFPHHQTLTRDPYTIATSPDGKRSAILSHVEKQVENFEVKHGSEATWRLENPCKAVICEMHIRDLTKSPTSGVDEHLRGTFLGAAQAGTVNQYGQSTAFDYIKKLGYNYVQLQPIADRHKEYDEDGNVTYNWGYDPQNYNAPETSFSTNPDDPAQVIRDLKVMVQAYHDAGIGVIMDVVYNHTFSVVDAPFQTTVPDYYYRMNPDGTFQNGTGVGNETASEHEMFRKYMIDSLLYWVQEYNIDGFRFDLMGIHDVKTMQMIRQSLDEIDSNIILYGEGWDMGTGLAPYDKAKKDNAYQMPNIGFFNDNQRDAVKGGEVYGAIKSGFVSGAATEPILAKAILGSRELGSYTHPNQVLNYVEAHDNYNLHDLLATLHPDQSSEQIMRKVETATAMNLLMQGMAFMEIGQEFGRTKLVATGENGELTHDDRERAMNSYNAPDSVNQVNWNLINERQDSIEFIRQVIRLKTKTGAFSYSSYDEIYHHVFVHSAIEHSGYLIYEVHGKEHLLVVVNAKSEPYQFENAGNLAMLVTNSRSKEDNVLNDISLAVLSVL

SEQ ID NO: 57364 - protein, 474 aa, Streptococcus pneumoniae TIGR4
MTRYQNLVNGKWKSSEQEITIYSPINQEELGTVPAMTQTEADEAMQAARAALPAWRALSAVERAAYLHKTAAILERDKEEIGTILAKEVAKGIKAAIGEVVRTADLIRYAAEEGLRITGQAMEGGGFEATSKNKLAVVRREPVGIVLAIAPFNYPVNLSASKIAPALIAGNVVMFKPPTQGSISGLLLAKAFEEAGIPAGVFNTITGRGSEIGDYIIEHKEVNFINFTGSTPIGERIGRLAGMRPIMLELGGKDAALVLEDADLEHAAKQIVAGAFSYSGQRCTAIKRVIVLESVADKLATLLQEEVSKLTVGDPFDNADITPVIDNASADFIWGLIEDAQEKEAQALTPIKREGNLLWPVLFDQVTKDMKVAWEEPFGPVLPIIRVASVEEAIAFANESEFGLQSSVFTNDFKKAFEIAEKLEVGTVHINNKTQRGPDNFPFLGVKGSGAGVQGIKYSIEAMTNVKSIVFDVK

SEQ ID NO: 57365 - protein, 380 aa, Streptococcus pneumoniae TIGR4
MKNEMLALILAGGQGTRLGKLTQSIAKPAVQFGGRYRIIDFALSNCANSGIHNVGVVTQYQPLALNNHIGNGSSWGLDGINSGVSILQPYSASEGNRWFEGTSHAIYQNIDYIDSVNPEYVLILSGDHIYKMDYDDMLQSHKDNNASLTVAVLDVPLKEASRFGIMNTDANNRIVEFEEKPAQPKSTKASMGIYIFDWQRLRNMLVAAEKSKVGMSDFGKNVIPNYLESGESVYAYEFSGYWKDVGTIESLWEANMEYISPENALDSRNRQWKIYSRNLISPPNFLGANAHVEDSLVVDGCFVDGTVKHSILSTGAQVREGAEVLDSVIMSGAIIGQGAKIKRAIIGEGAIISDGVEIDGTDEVQVVGYNEVVGVATDED

SEQ ID NO: 57366 - protein, 344 aa, Oryza sativa (japonica cultivar-group)
MVRKLILALAVFLPALVYQQLQPPPPKICGSPGGPPVTGTRTQLKDGRHLAYLESGVPKDQAKYKIIFVHGFDSCRYDALPISPELAQELGIYQLSFDRPGYAESDPNPASTEKSIALDVEELADNLQLGPKFYLMGFSMGGEIMWSCLKHISHRLAGVAILGPVGNYWWSGLPSNVSWHAWNQQLPQDKWAVWVSHHLPWLTYWWNSQKLFPASSVIAYNPALLSEEDKLIMPKFAFRTYMPQIRQQGEYSCLHRDMTVGFGKWSWSPLELEDPFAGGKGKVHLWHGAEDLIVPVSLSRYLSEKLPWVVYHELPKSGHMFPLADGMADTIVKSLLLGDQPPQA

SEQ ID NO: 57367 - protein, 235 aa, Triticum aestivum
  misc_feature (14)..(14): Xaa can be any naturally occurring amino acid
  unsure (1)..(235): unsure at all Xaa locations
EGLTLFGSSDTSLXALKSGSVLSSDLEGVVKPNVTFLQECGLGACDIAKLYVLMPSTLSGTTEHIRTAVACVEGLGVPRGSRMFKHALRAVAFLSEEEITTKIEHLKKTFRWSDAEVGIAVSKAPGVLSKSKESLERRFEFLISEVGLEPAYIAYRPAMLMYSLEGRMRPRYYAVKFLKENGLIDHDRDFFNTVMVSEKVFVEKFICPHKDAAPHLADDYGAACRGEVPARFSFT

SEQ ID NO: 57368 - protein, 362 aa, Oryza sativa (japonica cultivar-group)
MAASGVKRPPRPAPASSGVRKLILALAVFLPALLYSQLQPPPPKICGSPGGPPITGTRTRLKDGRYLAYLESGVPKEQAKYKIIFVHGFDSCRYDALPISPELAQELGIYQLSFDRPGYAESDPNLASTEKSIALDIEELADNLQLGPKFYLMGFSMGGEIMWSCLKHISHRLAGVAILAPVGNYWWSGLPSNMSWHVWNQQLPQDKWAVWVSHHLPWLTYWWNSQKLFPASSVIAYNPALFSEGDKLLLSKFAFRTYMPQIRQQGEYGCLHRDMTVGFGKWSWSPLELEDPFAGGEGKVHLWHGAEDLIVPVSLSRYLSEKLPWVVYHELPKSGHMFPLADGMADTIVKSLLLGDQPPQAS

SEQ ID NO: 57369 - protein, 247 aa, Erythrobacter sp. NAP1
MQSALAPGAPPSLATLLEGQDIALFLDFDGTLVELAEGPDAIAPVPDLADRLANLAHRLGGRCAIVSGRGIDDIERHTGPLSLAMAGSHGSDIRGADGAALGSGPAEIPASIEQRLREFAASEGLDYEHKPHGGALHYRRNPHKGPSAHQFAEALAAEHGWAAQGGKCVVELVAGDANKGAAVCALMQTEAFSGARPFFIGDDLTDEAGFRACDGMGGAGILVGEREETRAKYRLNTVSMVHSWLEL

SEQ ID NO: 57370 - protein, 142 aa, Arabidopsis thaliana
  misc_feature (124)..(124): Xaa can be any naturally occurring amino acid
  unsure (1)..(142): unsure at all Xaa locations
NPGPTHPSEKPRASFILFSFLMVAFPVRAGLVVPLNGLKSSVAFQATRRVNTAITSITGNGGGVNCLQGWPPMGKKKLGTFFNLPALTDSELVKEVAYLIRTRGIPGVEFKWDHGFGSRGHGNXPGYYDGRSWTLWKFPLFG

SEQ ID NO: 57371 - protein, 230 aa, Triticum aestivum
  misc_feature (187)..(187): Xaa can be any naturally occurring amino acid
  misc_feature (197)..(197): Xaa can be any naturally occurring amino acid
  misc_feature (215)..(215): Xaa can be any naturally occurring amino acid
  unsure (1)..(230): unsure at all Xaa locations
MAAATTTASRPLLLSRQQAAASSLQCRLPRRPGSSLFAGQGQASTPNVRCMAVVDTPSAPAVAPARKRSSYDMITLTTWLLKQEQEGVIDNEMTIVLSSISTACKQIASLVQRAPISNLTGVQGATNVQGEDQKKLDVISNEVFSNCLRWSGRTGVIASEEEDVPVAVEESYSGNYIVVFDPLDGSXNIDAAVSTGXIFGIYSPSDECHIGDDAXLDEVTQMCIVNVCQP

SEQ ID NO: 57372 - protein, 167 aa, Pantoea agglomerans
QHFASAPAEQNLPVLLALIGIWYNNFFGAETEAILPYDQYMHRFAAYFQQGNMESNGKYVDRAGHPVDYQTGPIIWGEPGTSGQHAFYQLIHQGTKLVPCDFIAPAITHNALADHHPKLLSNFFAQTEALAFGKSRDVVEKEFTDAGKSAESVAHIVPFKVFEGNRP

SEQ ID NO: 57373 - protein, 1100 aa, Thermosynechococcus elongatus BP-1
MPRRTDISRILIIGSGPIVIGQACEFDYSGTQACKALREEGYEVILINSNPATIMTDPEIADRTYIEPLTPEMVEKVIAAERPDALLPTMGGQTALNLAVALAKSGVLDRYGVELIGAKLPAIEMAEDRKLFKEAMQRIGVAVCPSGLANTLEEARAIAQEIGVYPLIIRPAFTLGGTGGGIAYNQEEFEAIATAGLEASPVSQILIEQSLIGWKEYELEVMRDMADNVVIICSIENIDPMGIHTGDSITVAPAQTLTDKEYQRLRDAAIKIIREIGVETGGSNIQFAVNPETGEVIVIEMNPRVSRSSALASKATGFPIAKIAAKLAVGYTLPEIPNDITQKTPASFEPTIDYVVTKIPRFAFEKFPGSPPVLTTQMKSVGEAMAIGRTFQESLQKALRSLETGRAGWGCDRPEKLPSLEQLRGKLRTPNPERIFAIRHAFLLGMTVEEIYELTAIDPWFLRQMQGLLETEKFLKRSKLEQLTADDLWRIKQQGFSDAQIAYATKTTDDQVRAYRQSLGVVPVYKTVDTCAAEFEAYTPYYYSTYERPLEQINPDSGDVELLPPESEVLPPRKPRVMILGSGPNRIGQGIEFDYCCCHAAYALRADDYETIMVNSNPETVSTDYDTSDRLYFEPLTKEDVLNIIEVERPVGIIIQFGGQTPLKLALPLQRYLQQQGDRLGTQIWGTSPDSIDIAEDRERFEKILRELNIPQPPNGTARSYAEALSIAERIGYPVVVRPSYVLGGRAMEIVYSNGELERYMNAAVQVEPGRPILIDKYLENAIEVDVDAIADATGTVVIGGIMEHIEQAGIHSGDSACSLPTQSLSPAVLQTIRTWSIALAQALKVVGLMNLQLAVQGDQVYILEANPRASRTVPFVSKAIGIPLAKVAARLMSGKTLAELNFLNEKIPNHVAVKEAVLPFEKFAGTDTVLGPEMRSTGEAMGIDMTFGAAYAKSQLAANQRLPLKGTVFVSMSDRDKAAIVPVVQELQSLGFRMIATEGTRNALLEAGLSNIELILKLHEGRPHVLDAIKNGQIHLILNTPSGQEARTDAQLIRRTALAYKIPIVTTIAGAKATAAAIKTLQTSTLGVRALQDYHRVEC

SEQ ID NO: 57374 - protein, 167 aa, Photobacterium sp. WH69
KHFAEAPLEQKLPVILALIGIWYNNFHGAETEAILPYDQYMHRFAAYFQQGNMESNGKYVDRGGNPVDYQTGPIIWGEPGTNGQHAFYQLIHQGTKLIPCDFIAPAISHNPLGDHHPKLMANFFAQTEALAFGKSREKVEAEFFAAGKSQEEVNELAEFKVFEGNRP

SEQ ID NO: 57375 - protein, 167 aa, Serratia marcescens
KHFAETPAEKNLPVLLALIGIWYNNFFGAETEAILPYDQYMHRFAAYFQQGKMESNGKYVDRNGNPVDYQTGPVIWGEPGTNGQHAFYQLIHQGTKLVPCDFIAPAISHNPLGDHHAKLLSNFFAQTEALAFGKSLEVVEAEFAAQGKTPEQVKHVAPFKVFEGNRP

SEQ ID NO: 57376 - protein, 433 aa, Coccidioides immitis RS
MFYEGDLQSGITLAVQQAKQVVCFVRDEGEESTRWEDEYLADEEEAGFLASFCPINKIPTLVAIKNGVLQEYIVSGTAEDELKKRLKTILNPTQVLQASQASQSEALSQPTHQVPTPSPSSDNVNTPAPEPEPSEEETPAEIARRESVRQGKRRAASPEPVSRPRDPAGNTQKIWRQQQFSRERREREERERVLALIRQDKEERRARAEQQRLSHTQQSDSQDTEQRPRPITQRDRASEYRLQVRVFDGSSIRSKFFPTQTVRNDVRPWIDSQRTDGNTPYNLKQILTPLPNKTISISEENQSLSDLGLGPTANLVMVPIHSYTEAYATSESSLPVRGLYAGYNLVTGAVGTVAGALGSFLGLTHGQPASPPETSSRAEQATGAGENSVRNPRSPRSNNIRTLYDGPSDEADRQFYNGNQLNFEPRIDQDKND

SEQ ID NO: 57377 - protein, 199 aa, Campylobacter lari RM2100
MILNAKFLISASKIDEAPQPIYTEIAFLGRSNVGKSSLINTLCKNKNLAKSSSTPGKTQLINFFEVDCKKDEDKFKLIFIDLPGFGYAKVSKKTKAIWNKNLDEFLKERSSIKLFIHLIDSRHENLDIDLNLDLYLDSFIRADQKKITVFTKADKLNQSQKAKLLNANKNAILVSNLKKSGIDKLEQKIILESLGFNEE

SEQ ID NO: 57378 - protein, 379 aa, Streptococcus pneumoniae TIGR4
MKIDKYSAILGNTVGFHNMSTLTDHRPVASLPFGGKYRLIDFPLSSLANAGVRSVFGIFQQDNISSVFDHIRSGREWGLSTLLSHYYLGIYNTRVESSTVGKEYYQQLLTYLKRSGSNQTVALNCDVLINIDLNQVFHLHSTTKEPITVVYKKLAKKDISEVNAILDVDETDHVLSHKLFDSKSTAETFNMSTDIFVVDTPWLIEHLEEEAKKEHPEKLRYVLRDLAVKEGAFAYEYTGYLANIHSVKSYYQANIDMLESQKFYSLFSPNQKIYTKVKNEEPTYYANTSKVSTSQFASGSIIEGQVANSVLSRNIHVHKDSLVKDSLLFPRVVIGEGAQVEYAILDKGVEVEHGVVIRGTAEHPVVVKKGAKVTEDIHS

SEQ ID NO: 57379 - protein, 447 aa, Shewanella sp. MR-7
MIKKFFQTGADRPIMDETPEKIRSIYKKYQWQVFIGLVFGYAMFYVVRMALSVVKKPMLDSGVVTIEELGLMGSAFFFTYAIGKFSNGFLADYANIGRFMSVSLMLSSITCMAMGMGVAGLFFVILWGMNGWFQSVGSAPSCVSIFQWYSPKQRGSVYSVWGGSRNIGEAISWILTASLVSFFGWKIGFVGAGIAAFAAAACMLILLKDRPRTYGLPDPATAYGEEPESVKGHDPAAIRKAQLFVLRQPVVWIIALACAAMYSSRYAMSSWAVLYLQSEKNYSLIDAGVAMSSYPIAGFFGAILSGLISDKVFNANRHIPTFLYGLANIIGMSLLFWGSESRMMDAFGLGLIGFSIGGLVVFLAGLTACDLMPKNAVGAVKGFIGLFSYLAASVQEIVSSKLILVTEVAGVKHYDFGSAQYFWLGTSVLSIVLAASVWRAKKVTVVD

SEQ ID NO: 57380 - protein, 408 aa, Nocardia farcinica IFM 10152
MVIVGAGHAGVQVADALRAGGHTGPLTLVGDEPCLPYQRPPLSKEHLAAESGAEPLPLRGARYFADHGIDLRTGTAAVAVDRRARLVGLADGREIGYDALVLATGSVNRPLRVPGAELAGVHALRTLADARALRGALATASAVLVVGAGFVGLEFAAVARARGLPVTVLDAGSRPLARAVSEPISAHVAAAHRAAGIDLRLGESVARFVGADGRVRGAVGTGGTEYRADLVLVGIGAVPRVELAERAGLAVADGIVVDGRLRTADPAIYAVGDCAAHPHPHAGTRIRLESVQNATDQARHVAAGLLGAEHDYADLPWFWSHQGAVKVQIAGLRRPGDDTVTLGDPATGRFSVCCLREGDLVAVESVGRPADHMAARRLLAAGPVPAPPDLTDPAFSLKRCAAALAPAR

SEQ ID NO: 57381 - protein, 434 aa, Streptococcus pneumoniae TIGR4
MSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAVARAAADYLEIPLYSYLGGFNTKVLPTPMMNIINGGSHSDAPIAFQEFMILPVGAPTFKEALRYGAEIFHALKKILKSRGLETAVGDEGGFAPRFEGTEDGVETILAAIEAAGYVPGKDVFIGFDCASSEFYDKERKVYDYTKFEGEGAAVRTSAEQIDYLEELVNKYPIITIEDGMDENDWDGWKALTERLGKKVQLVGDDFFVTNTDYLARGIQEGAANSILIKVNQIGTLTETFEAIEMAKEAGYTAVVSHRSGETEDSTIADIAVATNAGQIKTGSLSRTDRIAKYNQLLRIEDQLGEVAEYRGLKSFYNLKK

SEQ ID NO: 57382 - protein, 517 aa, Myxococcus xanthus DK 1622
MDLHAEKILILDFGSQYTQLIARRVRELGVYCEIHRPDLPAEDIRKYAPRGIILSGGPASVEAPDSPRCDPFVFEAGVPVLGICYGLQLTAKLLGGKIDRSAHREFGNAEVEVLARRGPFAEFTPGDRVQVWMSHGDRVEALPPGFEAIGRSGNSPFAATAHATKPWFGVQFHPEVVHTPQGKAMLRAFVFNECKVSGSWTMKGFIDEAVGTIRRQVGEHGRVICALSGGVDSSVAALLLHRAIGPRLQCIFVDNGVLRQNERAQVEALFVDRFHVPLKTVDARQRFLDKLAGVTDPEKKRKIIGREFIAVFEEAARDVQDAEFLAQGTLYPDVIESVSYKGPSVTIKSHHNVGGLPETMKLKLVEPLRELFKDEVRALGRELGLPDEMVSRQPFPGPGLAIRVLGEVTEQRLELVRRADAIVQEEIRSAGLYKEVWQAFAVLLPVQSVGVMGDERTYESTCVLRAVTSVDGMTADWARLPFPVLERISTRITNEVRGINRVAYDISSKPPATIEWE

SEQ ID NO: 57383 - protein, 416 aa, Solibacter usitatus Ellin6076
MDADKMNSARRSQTPTAEIPDGETQKVQVRKFLRNKATAYTAEMIRSRREWLAELTQTRLKHLAHFSEDPADFKGKIECPIGVAHVPLGIAGPLQINGEHARGVFFIPMATTEGALITSYTFGSNIITRSGGVNVRILKDALKSDPTFVFKSSTEALSFVTWIENNFGAIKEIAEKTSGHLRLIKAVPVINGRRVILCFHFQTGDALGMNMVYKATDVVCKMIRDSVEPEEFWLHSNFTTIKKTTAENFVNGYGKSAMADVTVPRKLVARFNTTPEQMERFFLRTLLGSAQGGLFGISAHMANAMTAIAIACGQDAALVANTHYANATCETTKNGDLYFSAHFPSLFAATVGGGTSFGTARECLETLGCYGNGKSKRFAEIIAGTALAGEISLMISIVNGSYIYAHETFGRNRPRQ

SEQ ID NO: 57384 - protein, 481 aa, Nocardia farcinica IFM 10152
MRNQLFIDGEWRPGRAGTFATVDPATGKVITDVAQASTADVDDAVAAAAAARAYTAPSWAAMLPATRARLLNRLADLVEAHADELALLETTDQGQPLGVAAGISVPNAVEHLRYYAGWATKITGITAPLSIPDVDYRTRREPLGVCALITPWNFPLTILTWKLAPALAAGNTVVVKPAEQTPLSTLRLAELAAEAGFPPGVINVVPGGPDTGRALVAHPGIAKISFTGSTEVGREIGAAAGRALTRVSLELGGKTPSIVTADADIDAAVRGNIAGGTLNSGQVCAAYSRIYVDRRREAEFVDKLVAAARAIKVGPGRAADTQMGPLVSAEHLDRVHTLVRTGVAEGAELVTGGARAEGDLADGYFYEPTVFTGVRQDMRIAREEIFGPVLSVLSYDDPEEIAGQANDSDFGLAAVVWSRDLATANRLAAAVRAGTVYLNLPPMLDAAAAWGGMKASGIGREMGWEAIAAYTEVKSIWTALT

SEQ ID NO: 57385 - protein, 458 aa, Rhodococcus sp. RHA1
MSDQPDVLILGGGSGGYACAFRAAQLGKTVTLIEEDKVGGTCLHRGCIPTKALVHAAEVADTVTHASALGLGATLDGIDLGGVHAYKNATVERLYKGLQGLVRSHKIEVVHGTGRYGGGRTVHVGDRTITGASLVLATGSQVRGLPGLEIGGRILTSDEALTFPELPKRVVVLGGGVIGVEFASIWASLGADVTIVEALPRLVAAEDEWSSKQLTRALRKRGITIMTATRFAKAVQDESTVSVTVESGDTIEADLLLVAVGRGPRTPDIGLTENGVVLDSRGFVTVDDSLRTSQPDVYAVGDIVAGPQLAHRGFQQGIFVAETIAGLTPTPIEDSGIPRVTYSKPEVASVGLTEDQARERHGDVATVVYDLAGNGKSQILGTSGGVKLVRAGATEGPVVGIHMVGERVGELIGEAQLIVNWGAYPDDVATLVHAHPTQAEALGEAHLALAGTPLHSHS

SEQ ID NO: 57386 - protein, 333 aa, Rhodococcus sp. RHA1
MSTAISAAAPTTLPLGKALNAGLRRALENDPKVVLMGEDIGKLGGVFRITDGLQKDFGPNRVIDTPLAESGIIGTAVGLAMRGYRPVCEIQFDGFIYPGFDQIVSQVAKLHYRTSGNVKMPITIRVPYGGGIGAIEHHSESPEGYLAATAGLRVVTCSTAADAHTMIQQAVASDDPVLFFEPKRRYWEKGLIDPAAETSPLHKARVVVPGTDATVVAYGPLVTTALQAAKVAADEGRSIEVIDLRSISPLDVDTVAESVQRTGRLVITHEAPVFLGIGAEIAARISERCFYHLEAPVARVGGFTVPYPPAKLEEHFLPDVDRILDAVDRTFTA

SEQ ID NO: 57387 - protein, 131 aa, Triticum aestivum
LESSRRDVERDRDVTSVGAEAVTGQVTEVNKDTFWPIVEAAGDKVVVLDMYTEWCGPCKVMAPKFQEMSEKNLDVVFLKLDRDQDNKPLAKELGIKVVPTFKILKGGKVVKEVTGAKIEELAHAIDTLKSG

SEQ ID NO: 57388 - protein, 303 aa, Prochlorococcus marinus str. MIT 9313
MISGTTSLIGLLGQPVHHSLSPVMQNAALAAMNLDWCYMAMPCETNDLANVLCALRSINCLGLNITIPHKQDVAKTCRELSPLAKRLKAVNTLIPHADGGWTGTNTDVAGFIAPLQESKCEWHGRRAVVLGCGGSARAVVAGLQDLKLAQIMVVGRRSDALKRFLDDLQPNPASSESDCQVLLQGILQHDPALIEQLTKADLVVNTTPIGMSQNRAETSTPRAPMPLGKKIWQNLSPKTTLYDLIYTPKPTAWLTLGTEHGCHCIDGLEMLVQQGAASLRLWSGNNKVPVEEMRKAALSWLTV

SEQ ID NO: 57389 - protein, 174 aa, Pisum sativum
MARMAQEPLIVGRVIGEVLDSFTTSMKMTVSYNKKQVFNGHEFFPSTINTKPKVEIDGADMRSFYTLVMTDPDVPGPSDPYLREHLHWIVTDIPGTTDATFGKEIVSYEIPKPNIGIHRFVFVLFKQRARDSVRATPSSRDHFNTRSFASQNDLGLPVAAVYFNAQRETAARRR

SEQ ID NO: 57390 - protein, 170 aa, Thermosynechococcus elongatus BP-1
MDLKSLIRDVPDFPKPGILFRDLTTLLQNQAGLRYVIDQLVEKHANAGIDYVAGIESRGFIFGAPLAYRLGAGFIPLRKPGKLCAPVYAVEYELEYGRDRLEMHQDAIEPGRRVLIVDDLIATGGTAAAAAGLIQKAQAELYGFAFIVELTDLAGRQKLPDVPITTLVTY

SEQ ID NO: 57391 - protein, 794 aa, Aspergillus nidulans FGSC A4
MEKDTPVRITSANDSVPSDDAPSAGLDTVEQLKHLKEHHHWDPNLPDEVVDEVNDALHATDKDRRQSIVASLLENSPYPEVRAAVPNIDEGGHSNTFRAWAIGMFLATVGSALNMLFSMRQPYIVIPSYVAQVVAYPIGVAWAKVMPHKTIRMFGMSVNLNPGPYSKKEHAIAVIMANATFGGGAAYATDVLLAQRAFYKQRFDWAFEIFMCISTQMLGFGMAGFFHRFLVTPAAMIWPSTLINSALFTALHDRSRPDPSKVSGWTIGRYRMFLYCLIGSFLWYWFPGYIAPFLSVFAWVTWIKPNNVVINQLFGGWTGLSLIPMTFDWTQISGFNFSPLIAPWHGIANTLLGMFIFFWVVTPALHYTGTHWAKYLPISDSNSYDNTGQVYNVTRILTPQMTLDKAKYEAYSPLFLSTTFSLAYGLSFATIIAVLIHAILFHGKDIWVRFRQIGHEDEDVHARLMARFKPVPLWWYGAITLIMIGMALGVTLGYPTNLSWWAFFIALIMGAVWFVPCGIIQASTNIQIGLNVITEFVIGYMQPGRPMAMMLFKTYGYISMYQGLYFCQDMKLGHYMKIPPRVTFAAQMISCLWSSIVQICVMNWALGAISSVCTLDQPNRYTCPNGRVFFNASIIWGTIGPARMFSPGQLYASLQWFWLAGAALPVAIYIAAKLLRNTKYARYVRLLNAPIIFGGSSFIPPATPLNYLSWGIIGFIFNKWIRDRWRGWWMQYNYVLSAGLDVGLALCTILIFLTLNLTNTEFPSWWGTNIAANTMDAAGTAVQVTEVKFGPESW

SEQ ID NO: 57392 - protein, 938 aa, Gibberella zeae PH-1
MSTHQHSAFASAQYISPDPIFEVTKRFNADQDPQKVNLGQGTYRDESAKPWVLPSVREAEKLIANSGHEYLPIEGLQSFRDAAKDRIATCQSISGTGSLLLAGLVLKKANSGIENIIITDPTWSNHDLLFHEIGFNVIKAPYYKDRSFDFKGYLDTIKAADKRSAVVLHACAHNPTGCDPTRDQWKQIAEVIKENGIFPIIDSAYLGFNSGNYDEDAWAVKYIIEELGLEAAICLSFAKNMGLYGERVGLTAIVTKSEETKKAVFSLLQQSQRQTVSNPPVHGARIAAAVLSNPDTLKQWHQDLVTMSSRIKSMRSKLFDELVRLETPGDWSHIVNQTGMFGYTGISKPQIECLEEKYHIYMADTSRISLAGLNEHNVDVTQRAERHATPVVALTSRCTIPRRRHPTTANSLDNPASDLKIGVEQKNGAIPDARRNQAPYNVRVTSSDTTPLPQTPRVINGGNRSIGWGTDGVMVAFGQHHSQVPGSPELDSHTQGRWAKTSGNAAAALEATRTNTPVVNGAETPLSELPPLILYRSLFINAVSSRPWLLIPSLHLLQKLSHAGNPYLFNVSRNPLLRTILKHTFYKQFCAGETGAEAQATMKELQDMGFKGTILTFAKETVFDSKTGKEQGHGIETSTTNECQWCDNIEAWRDGTLKTVELLREGDQLATKLTGAGPGVCEALHNDAQLPKQFVDACYEISQKVKDRGAYILIDAESQHYQWGIFRLGMELQQKFNTDGNVVLYNTYQAYLKSTQESLEKHLQIASDKGFTLGVKVVRGAYMSSDPRSLIHDTKQDTDDNYNQIAQGVLRQDFRGFGGSNAKPFPSAQLLLASHNKESLVKAHEMHQERTKANLPTVPVKFAQLHGMSDEVSFGLLKLKDDNGVAPEVYKCTTWGTLGECMAYLTRRAIENRDAASRTLDEYTALKNEAWRRLAFWR

SEQ ID NO: 57393 - protein, 445 aa, Triticum aestivum
MSMTDTSTAPRAEFGTRPKPSPSPLQSSDHLAQIAADSIRFLDGMATKRSVGTLGEADLKGKKVFVRADLNVPLDDAQKITDDTRIRASIPTIKYLLEKGAKVILASHLGRPKGVTPKFSLKPLVARLSELLGLEVVMAPDCIGEEVEKLAAALPDGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGLAVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADKMSHISTGGGASLELLEGKPLPGVLALDEA

SEQ ID NO: 57394 - protein, 687 aa, Yarrowia lipolytica CLIB122
MALFRVLTLLSLALLGAAQYSPEELQGYYGLVEPTNRTQNNYNSFSLTVEGDYVSNIQALTVETDKLAGLNSAAAVSGNLRMISGNYTGPALDWSNAALIDCDNTTDVIDALNEVLINNPACMILYSLNSDACHFTRPYRVFSADIGFVFTTVSAKGAQSLLEKVQQSPVLLHSVAWLNTTSLPDDNTPVVDDKGPSRDTKIAMAVLYCICGVLALAVVVLISLGIWRVHRHPERYGLAPPDQTDEEREISDDFNNGGGDVYTPPPTRVEKAKGLARAVLDAIPLMRVMIGSQEDEKDKGTAPGESSSSPAMSTHKRDVSNVSVKSSCDMSRMETLPVYIQEDDNCAICFDNFEDNQIIRQLPCTHRFHADCVDHWLLNSSSQCPMCRMNLRKEENETTENEATTPSTHTQTQTAQPQTTSQQQPSVITVTQRDLNISLATRIIDWWNMLCLPEDARAEARERLNHESELRRKIRQLQRSDGTLMPNDGIVATDDGALRVLLDNRPLQAPPIDVPLSERMLVPGPDLDLNNVEAPVPRYSVLPDMSAASESVYNRDSVSLPQACLLPQLDLSEFSVDVDGMNTHYDTSTGTGSDIDTDIGDVTRVDTRDATTAHVDGDCASYVEDAKTKEANETASDALYDPASDTLELETLRDASAACEDGPAAHGTHQDPDFEFDFENTTHSKPI

SEQ ID NO: 57395 - protein, 435 aa, Zea mays
MPIQKILARTIFDSRGNPTVEVDLTTDKGLFRAAVPSGASTGIYEALELRDGDKANYHGKSVFKAVSNVNDVIAPALLAQNFNLTQQRDIDNFMLNLDGTENKSKLGANAILGVSLAVCKAGAAEAGLPLYAYIAKLAGNDKIILPVPAFNVINGGEHAGNKLPMQEFMILPTGAATFREAMKIGSEVYHHLKAVIKKRFGLDATAVGDEGGFAPNILDAKDALELIKTAVEVSGHASKIEIGMDVAASEMYKRDQKKYDLDFKNPQSDPTKWITSAELGALYQKFATEYPIVSIEDPFDQDDWEAWTALTGAVNFQIVGDDLTVTNPKRIQSAVEKKACNCLLLKVNQIGSVSESIDAHLLAKKNGWGTMVSHRSGETEDTTIADLVVGLSAGQIKTGAPCRSERLAKYNQILRIEEELGDKAIYAGKNFRHPA

SEQ ID NO: 57396 - protein, 1528 aa, Aspergillus nidulans FGSC A4
MAPVTSAGEAVARIAYQASEVVLSVQPSLQSDSWFTKTLKSLKAAGARSVVPEGVPDVVSVRYNEDPFLSAFHPLQSGKVVSAVTSSSTLLTSIPHLYRLANSPVVIHVALEPYPFPDYSAISSIRQCGFTFLHSETLQEAQDIALTAHALARKSGKGVIHFFDPANSANDDAIEQEDAQTLKSILDLSRSAVSHSEGHGVDTLYAETGRVATVSDETVESSTAAQVEETATPTQPSQTPSSRSVANSSVGSSERDSSVDSRATSSAATTVDGSVRPVSATDIFSWASQIWKALSEITGRNYRAIEYTGPSDAKSAIFVFGSTGVFVDVLSKEDVPAELTNIGLITARLYRPWVGAEIANSIPRSIEKIAVLEQVRKTTRWGPSFMDLLSSLTPAAVGGRSPQIVGYRLGYVEPSTAVQALRGIIQNLSSPSPIQSLEIGSSNVPTLQTPLEQPRIENAYLKILNQLFGERLYLANQLSSNNAGISSTIAASPEYGFGSLIARKEHRQRFIREVEAASKSNSFATDVVSKWLADWALNATDATKANRLAPDVIARLSNDGSALSKQLLQTKKLFYSESQWLIGSDAWAYDLGNSGVHHVLASGADVNMLVIDSQPYSERSAADPTRRKKDIGLYAMNFGNAYVASVAVYSSYTQVLQAMAEAEQFKGPSIVVAYLPYNQENDSALTVLQETKKAVDLGYWPLYRWNPANEDKGEPKFALDSERVKRELEEFLRRDNQLTQLMNRQPKFSSVLSESYGTEVRAIQKRKAKDSYEKLLEGLFGAPLTILFASDGGNAATLAKRLGNRGRARGLKTLVMAMEDYPFEDLPTEENVVFITSTAGQGEFPQNGRALWEYVKNTGDLDLSTINYSVFGLGDSHYWPRKEDKIYYNKPAKDLDARIAFLGGRKLTDIGLGDDQDPDAFQTGYSEWEPRIWQALGVDKVEGLPEEPAPLTNEDIKIQSNYLRGTIAEGLLDESTGAISASDQQLTKFHGTYMQDDRDVRDERKAQGLEPAYSFMIRCRLPGGVATPSQWLQMDAISSAYGNETMKLTTRQTFQFHGVVKRNLRGAMRAINKALMTTIAACGDVNRNVMCSSLPELSYYHREVHAVSKKISDHLLPATTAYHEIWLQDENDKKVQVAGDAVVDQEPLYGPTYLPRKFKITIAIPPHNDTDVYAHDIGLIAIKGADGHLEGFNILAGGGMGTTHNNKKTYPQTGRMFGYVPADQAHIVCEKIMLVQRDYGDRKNRKHARLKYTIDDMGVEAYKEKVEALLPDGLRFAEPRPFKFASNVDTFGWQKDENGLNHFTFFIENGRIEDTADFRMRTGLRELASLDKGEFRLTGNQHLILSNIKDEDLPAIKELMAKYKLDNTSFSGLRLSSSACVAFPTCGLAMAESERYLPVLITKLESTLEEVGLARDSIVMRMTGCPNGCARPWLAEVAFVGKAYGAYNMYLGGGYHGQRLNKLYRSSIKEDEILDIMKPLLKRYALERNTDGEEPERFGDWLIRAGVIKETTDGRNFHEGVAEEEDEE

SEQ ID NO: 57397 - protein, 882 aa, Agrobacterium tumefaciens str. C58
MPAETKTTCPYCGVGCGVIATVNDSGVVSVKGDPDHPANFGRLCSKGSALAETIDLDGRLLHPEIAGRRAAWDEALDLVASRFSDAIAEHGPDSVAFYVSGQLLTEDYYLANKLMKGFIGSANIDTNSRLCMSSSVAGHRRAFGADTVPGTYEDMELADLVILTGSNLAWCHPVLYQRLAAAKAARPGMKVVVIDPRRTMSADIADMHLAIRPDGDVALFTGLLAHLFASSAIDRGYVENHTAGFEAATQAASEHSLPEIAEATGLTIAELIPFYELFERTEKTVTCYSQGVNQSESGTDKVNAIINCHLATGRIGRPGMGPFSLTGQPNAMGGREVGGLANMLAAHMSIENADDRDRVQRFWASPAIAQKPGLKAVDMFRAVADGRIKALWIMATNPVVSMPDAGAVEVTIKACPFVVVSDVMANTDTARHAHVLLPSLGWGEKDGTVTNSERRISRQRSFLDAPGEAKADWWQMAEVARRMGFDAAFAYQQPSEIFAEHAALSGFENAGRRDFDIGGIERDSYETMAPVQWPKAGAGEAEVTRFFANGRFYHADGKARFIATALPETDRTSADYPLTLNTGRIRDQWHTMTRTGKSARLTAHIAEPFAEIHPRDAQALGIKSADLVELESPHGKVLLRALVSERQARGSVFAPMHWNDQFASRARIDVVVAPVTDPHSGQPASKNVGVRVTRFEASAYGFAICRSRPDAPDCAYWAVAKAEGGYRMELAFAEAPEDWTLWARRVFGIDVRIEPLGYSDRQTGDLRLAFFDGDTLLAALFIAREPVAVARNWAISQLSERHEDLRMRFALVAGRPGAGRADPGATVCSCFNVGVNQITAAIREGCHSVEAIGNALNAGTNCGSCRAEIRGIIDGCLKTAAE

SEQ ID NO: 57398 - protein, 815 aa, Agrobacterium tumefaciens str. C58
MTQKLVIIGNGMAPGRMLENLFETAPGLYDVTIFNAEPRVNYDRIMLSPVLSGEKSYEDIVIHNDEWYAANNVTLHKGAKVTRIDRANKIVTSENGITASYDRLVIATGSLPFIIPVPGHQLPGVLAYRDLDDVTKMLEIAKGKGRAIVIGAGLLGLEAAYGLKRQGMDVTVIHLMPTIMERQLDPAAAYLLEKALNERGIDIITKANTKCILGEEKVEGIELEDGRIIKGDMVVMAVGIRPASGLAKEAGIAVNRGIVVDDGMMTSDASIYALGECAEHRGMCYGLVAPLYESARVLADRLCGGSAEYHGSVTNTKLKVTGINLFSAGDFAEGDDREEIVLRDATAGVYKRLILKENRIIGAVLYGETADGSWFFDLMKKSTDISAMRETLIFGQAYQGGSPLDPMAAVAALPDDAEICGCNGVCKGKITSAITSKGLTSLDDVRAHTKASASCGNCTGLVEQLMTLTLGDTYNPAAVQPMCKCTDLGHDDVRRLIKAKGLKTIPAVMQELEWKTSCGCAKCRPALNYYLVCDFPDEYADDYQSRYINERVHANIQKDGTYSVVPRMWGGVTNADELRAIADVVDKFEIPLVKVTGGQRIDLLGIEKEDLPAVWADLGKAGFISGQAYAKGLRTVKTCVGEQWCRFGTQDSTGLGIRIEKFMWGSWTPAKLKLAVSGCPRNCAEATCKDIGVICVDSGFEIHFAGAAGLDIKGTEVLGLVHTEDEALEHIVALTQMYREQARYLERIYKWAKRIGYDEVRRQIMDDADKRKAYFDRFVFSQKFAQVDPWSERVSGHDKHEFRPMAAIGFSEAAE

SEQ ID NO: 57399 - protein, 336 aa, Arabidopsis thaliana
MTHLNKKQRLENNHNNTVNNHFEDLHDDLIISILRKLATSASSPSDFLTVLSTCKRLNRLGLHPLVLSKAGTQTLAVTAEKWSDSSHKFLKLCVNAGNIDASYSLGMIRFYCLQNPVSGASLMAKAAIKSHAPALYSLSVIQFNGSGGSKTDKNLRAGVALCARSAYLGHVDALRELGHCLQDGYGVPRDVSEGRRLLIQANARELACSLRSYLSLKSGDENETLTDLSVVPVQEIHPVNRFLKEWFSSGRVDLAEGLRMCSHGGCGRPETRAHEFRRCSVCGKVNYCSRGCQALDWRAKHKVECTPLDLWVAAAAEIGDDGEAVAVEIDDNHGER

SEQ ID NO: 57400 - protein, 524 aa, Arabidopsis thaliana
APGERERATSPPPPPPRIYTHKSFCLKMAMLGFYVTFIFFLVCLFTYFFLQKKPQGQPILKNWPFLRMLPGMLHQIPRIYDWTVEVLEATNLTFYFKGPWLSGTDMLFTADPRNIHHILSSNFGNYPKGPEFKKIFDVLGEGILTVDFELWEEMRKSNHALFHNQDFIELSVSSNKSKLKEGLVPFLDNAAQKNIIIELQDVFQRFMFDTSSILMTGYDPMSLSIEMLEVEFGEAADIGEEAIYYRHFKPVILWRLQNWIGIGLERKMRTALATVNRMFAKIISSRRKEEISRAKTEPYSKDALTYYMNVDTSKYKLLKPNKDKFIRDVIFSLVLAGRDTTSSVLTWFFWLLSKHPQVMAKLRHEINTKFDNEDLEKLVYLHAALSESMRLYPPLPFNHKSPAKPDVLPSGHKVDANSKIVICIYALGRMRSVWGEDALDFKPERWISDNGGLRHEPSYKFMAFNSGPRTCLGKNLALLQMKMVALEIIRNYDFKVIEGHKVEPIPSILLRMKHGLKVTVTKKI

SEQ ID NO: 57401 - protein, 488 aa, Nocardia farcinica IFM 10152
MNQTADVLTRGLTARHIRFIALGSAIGTGLFYGSAEAIHRAGPAVLLAYLIGGAAIYIVLRSLGEMAVSNPVSGSFGEYASKHLGPLAGFMTGWTYTFEMVIVCLADVTAFGVYMGFWFPDVPRWIWVLSIILFIGAVNLLHVKVFGEVEFWFSLVKIVAILAMIVGGVAILIFGFGMHDTDAGLTHLWAEGGFFATGIGGFLTCFAIVMFAFGGTEIIGITAGEAERPERTIPRAINTVPVRIMLFYVLTLAVIMAINPWQSIGSEGSPFVQIFQALGIGPAATVLNIVVITAALSAINSDIFGAGRMMYGMAQRGQAPAVMRQVSRNGVPWMTVVIMTVTLLVGVLLNYLIPDKVFLIIASIATFATIFVWLMILLAHYRSRRRMSAEETAALRFPVPFWPYGQLITIAFLVFVVAMIAFDADSRVALVVGAVWLALLWLAYRRWVRPTPAATDAAPVAGPGTDPADPADPALTTPTPRIEMEKNL

SEQ ID NO: 57402 - protein, 222 aa, Brassica rapa subsp. pekinensis
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEEVFFSIGRDIKQRLSDTDSRAEPATIRISQTDQELDCAGHTEVCMLWKLKTNYIN

SEQ ID NO: 57403 - protein, 136 aa, Mortierella alpina
MARTKQTARKSTGGKAPRKQLATKAARKSAPATGGVKKPHRYRPGTVALREIRRYQKSTELLIRKLPFQRLVREIAQDFKTDLRFQSSAIGALQEASEAYLVSLFEDTNLAAIHAKRVTIQPKDIHLARRLRGERT

SEQ ID NO: 57404 - protein, 136 aa, Ajellomyces capsulatus
MARTKQTARKSTGGKAPRKQLASKAARKAAPSTGGVKKPHRYKPGAVALREIRRYQKSTELLIRKLPFQRLVREIAQDFKSDLRFQSSAIGALQESVEAYLVSLFEDTNLCAIHAKRVTIQSKDIQLARRLRGERS

SEQ ID NO: 57405 - protein, 514 aa, Oryza sativa (japonica cultivar-group)
MPLDTNACAQPMRRAGEGAGTERLMERLNIGGMTQEKALRKRCFGDGVTGTARCVFTSDADRDTPHLRTQSSRKNYADASHVSAVILGGGTGVQLFPLTSTRATPAVPVGGCYRLIDIPMSNCFNSGINKIFVMTQFNSASLNRHIHHTYLGGGINFTDGSVQVLAATQMPDEPAGWFQGTADAIRKFMWILEDHYNQNNIEHVVILCGDQLYRMNYMELVQKHVDDNADITISCAPIDGSRASDYGLVKFDDSGRVIQFLEKPEGADLESMKVDTSFLSYAIDDKQKYPYIASMGIYVLKKDVLLDILKSKYAHLQDFGSEILPRAVLEHNVKACVFTEYWEDIGTIKSFFDANLALTEQPPKFEFYDPKTPFFTSPRYLPPARLEKCKIKDAIISDGCSFSECTIEHSVIGISSRVSIGCELKDTMMMGADQYETEEETSKLLFEGKVPIGIGENTKIRNCIIDMNARIGRNVIIANTQGVQESDHPEEGYYIRSGIVVILKNATIKDGTVI

SEQ ID NO: 57406 - protein, 446 aa, Oryza sativa
TSGCAEGREARAADLAKYVKELRKYKRHAHALELMEWMVNTKGMNMSYTNHAIRLDLIYKVRGIEAAEQYFAGLPDPGKNHKTYGALLNCYCSAKMEDKATDIYRKMDELGISSSTLPINNLMSLYVKIGQHRKVTSLFEEMKVKNVKPDNLTCCLLMSSYAALNKIDTVGEVLKEMEEKKVALGWSAYSTLASLYVNANMVEEAESALKKLESLIDVQAGRQPFDFLMSLYASVGNLSEVNRVWNLIKANFQKVTNTSYLGMLQALYKLNDDDRMKQIYEDWESNYENYDARLTNMMTRAHLRNGLTKEAELLWEKVKEKGAEFDSKTCELFLEHYMGKGDMTSALNWVENMTKLPRKKSKLDQEKISCFLKYFEEHKDVEGAERFLNCLRTSGCIDGKAYESLLRTYLAAGKTSRSIRQMIKEDKIEICYGIGKLLKRIADKGR

SEQ ID NO: 57407 - protein, 151 aa, Glycine max
MGAFTEKQEALVNSSFEAFKANLPHHSVVFFNSILEKAPAAKNMFSFLGDAVDPKNPKLAGHAEKLFGLVRDSAVQLQTKGLVVADATLGPIHTQKGVTDLQFAVVKEALLKTIKEAVGDKWSEELSNAWEVAYDEIAAAIKKAMAIGSLV

SEQ ID NO: 57408 - protein, 169 aa, Aspergillus nidulans FGSC A4
MASASTAGSYSNPLKKFKLVFLGEQSGAHTLSLHSQTGARFLMLYYNRTVRLQLWDTAGQERFRSLIPSYIRDSSVAVVVYDISNAKSFQNTRKWIDDVRGERGNDVIIVLVGNKTDLSDKREVTTAQGEEEAKKNGLMFIETSAKVGHNVKQLFRRIAQALPDLNDND

SEQ ID NO: 57409 - protein, 544 aa, Brassica napus
MKLLHGLALVFLLAAASCKADEEITCEENNPFTCSNTDILSSKNFGKDFLFGVASSAYQACRGVNVWDGFSHRYPEKSGSDLKNGDTTCESYTRWQKDVDVMGELNATGYRFSFAWSRIIPKGKVSRGVNQGGLDYYHKLIDALLEKNITPFVTLFHWDLPQTLQDEYEGFLDRQIIQDFKDYADLCFKEFGGKVKHWITINQLYTVPTRGYAVGTDAPGRCSPMVDTKHRCYGGNSSPEPYIVAHNQLLAHATVVDLYRTKYKFQKGKIGPVMITRWFLPFDESDPASIEAAERMNQFFHGWYMEPLTKGRYPDIMRQIVGSRLPNFTEEEAELVAGSYDFLGLNYYVTQYAQPKPNPYPSETHTAMMDAGVKLTYDNSRGEFLGPLFVEDEVNGNSYYYPKGIYYVMDYFKTKYGDPLIYVTENGFSTPSSENREQAIADYKRIDYLCSHLCFLRKVIKEKGVNVRGYFAWALGDNYEFCKGFTVRFGLSYVNWEDLDDRNLKESGKWYQRFINGTVKNSAKQDFLRSSLSSQSQKKKLADA

SEQ ID NO: 57410 - protein, 396 aa, Triticum aestivum
MALSISAPTSSPFLPAPRQVGRWSSSPSSVKPAGFSLRRPVVVARAAAGNAPSSPAGAVVTELDVVSSFSEIVPDTVVFDDFEKFAPTAATVSSSLLLGIAGLPDTKFKSAIDTALVDGECNTMEKPGDRMSCYLTKALGNVGAELAHQVPGRVSTEIDARLAYDTQGIVQRVHELLQIYNEHDIPSERLLFKIPATWQGIEASRLLESEGTQTHLTFVYSFAQAAAAAQAGASVVQIFVGRIRDWAKNHSGDPEIDEALKKGEDAGLALVKKAYVYIHKNGYKTKLMAAAVRNKQDVFSLLGIDYIIAPLKILQSLDESVTDSDEKYGYVQRLTPSLDKMYNFSQEELVKWDQLSLAAAMGPAAEELLASGLEGYANQARRVEELFVKIWPPPNV

SEQ ID NO: 57411 - protein, 263 aa, Oryza sativa
MAVLVARQGRELQRYTSAGGRIVVGCIPYRVRSGGEMEVLVITSQKGHGMMFPKGGWELDESMDEAARREALEEAGVRGDTETSLGCWYYKSRRYDTTYEGFMFPLRVTDELLQWPEMSSRKRTWATVQQAMDGCQHGWMREALERLVSRHATNKLQSALPAGLDHISIEHHIFWPPSPESETTADECPARRSEHADDDDSSFGVAGVVVVRQQRLASPGVVAMHGEKKESGDGRGRCDAKMPTASREKDAKPCECDEVQGRD

SEQ ID NO: 57412 - protein, 318 aa, Pseudomonas aeruginosa UCBPP-PA14
MILLPSIRLPETAMSTDSPINRVEQVQVDDLACWRIHTAHGEALIAQQGAQLLSYQPHEQPPLVWLSDEAGYRRGQSVRGGVPVCWPWFGPLERNPQEVRGQVEDGLKAPAHGLVRAVDWEIDDIAEEDGDLCVSFRLDAPDGLPGWPHPAALRMLFRFGERLTLRLTSENLGSKPLVLSQALHTYFAVSDSREIAIEGLEGARYIETLENWEERTQHGAVRVKGELDRIYLGLERDLLIKDPRWERSIHLHALDSRSAVVWNPWVDKSRRLSQFADDAWQQMLCIETGRVWDDLMVVAPGRSESFGVQIWSEPLKRP

SEQ ID NO: 57413 - protein, 152 aa, Glycine max
MSTYRDEDPRLHDIKTKIRVVPNFPKPGIMFQDITTLLLDPKAFKDTIDLFVERYKGKNISVVAGIEARGFIFGSPIALAIGAKFVPLRKPKKLPGKVISQEYILEYGRDCLEMHVGAVEPGERALVVDDLIATGGTLCAAMDLLGKYLYKF

SEQ ID NO: 57414 - protein, 394 aa, Bacteroides fragilis YCH46
MAEKRDYYEVLEVTKESTVEEIKKAYRKKAIQYHPDKNPGDKEAEEKFKEAAEAYDVLSNPDKRARYDQFGHAGMSGAAGNGGPFGGFSGGMSMDDIFSMFGDIFGGHSGGGFGGGFGGFGGFGGGGSQQRKFRGSDLRVKVKLNLKEISTGVEKKFKLKKYIPCSHCHGTGAEGNSGSETCPTCKGSGSVIRNQQTILGTMQTRTTCPTCNGEGKIIKDKCKVCGGEGIEYGEEVVTVKIPAGVAEGMQLSMGGKGNAGKHNGIPGDLLILVEEEPHPELIRDENDLVYNLLLSFPTAAIGGAVEIPTIDGKVKVKIEAGTQPGKVLRLRGKGLPSVNGYGTGDLLVNVSVYVPETLSKEEKSTLEKLEESKNFKPSTSIKEKIFKKFRSLFD

SEQ ID NO: 57415 - protein, 1053 aa, Schizosaccharomyces pombe
MIYKLAARYPIQVIAIVGILVSMAYFSFLEALTQEDFPVLIRALKRFGILDGFPNTRLPNEMILKLSSVQGEDASVWEQIPAAELGGEGFVDFDITQWYYPANAKVDVAQLVEPYRNDCIFHDASGACHFFFKEVGNWTVSSIALPSNLANPPIDYFLDSSSTVIQRILPAIREHGISWSWLLQLIARTWMNTLKIASQASKTELLIVGTAYACMLISIVSLYLKMRRLGSKFWLFFSVLLSTLFSVQFAMTLVRASGVRISLVSLIESLPFLINVVALDKAAELTRQVITRCSVSDSHSPMHEDIAKACRNAAPPILRHFSFGIVVLAIFSYCNFGIKQFFLFAAVMIYDLLLLFSFFVAILTLKLEMRRYNAKDDVRKVLIEEGLSESTARHVADGNDSSATTSAGSRYFKVRYGTKIILFIFIAFNLFELCSIPFKHYAATSAAAARLIPLVRSQYPDFKSQRLLDDGVFDDVLSAISSMSNIESPSVRLLPAVFYGAELSSTSFLSTIHSFINNWSHYISASFLSKWIVCALSLSIAVNVFLLNAARLNSIKEEPEKKVVEKVVEVVKYIPSSNSSSIDDIQKDEIAQESVVRSLEECITLYNNGQISTLNDEEVVQLTLAKKIPLYALERVLKDVTRAVVIRRTVVSRSSRTKTLESSNCPVYHYDYSRVLNACCENVIGYMPLPLGVAGPLIIDGKPFYIPMATTEGALVASTMRGCKAINAGGGAVTVLTRDQMSRGPCVAFPDLTRAGRAKIWLDSPEGQEVMKKAFNSTSRFARLQHIKTALAGTRLFIRFCTSTGDAMGMNMISKGVEHALVVMSNDAGFDDMQVISVSGNYCTDKKPAAINWIDGRGKSVIAEAIIPGDAVKSVLKTTVEDLVKLNVDKNLIGSAMAGSVGGFNAHAANIVTAVYLATGQDPAQNVESSNCITLMDNVDGNLQLSVSMPSIEVGTIGGGTVLEPQGAMLDLLGVRGAHMTSPGDNSRQLARVVAAAVMAGELSLCSALASGHLVKSHIGLNRSALNTPAMDSSAKKPATDALKSVNSRVPGR

SEQ ID NO: 57416 - protein, 896 aa, Candidatus Kuenenia stuttgartiensis
MTTVIIDGKRVEADPSQTILEAARRVGIRIPTLCHDPRLKPSGACRICVVEVEGKDNLAASCATPVSEGMKVSTRSEAVLRSRRLNLELLWSNHPNDCLTCDKAGECSLQNLMYEYDVKTSRFVKQNPVPALDESNPAIYRDMNKCILCGKCVRICDEVQGQHVWAFSDRGIKTRVSTAFEKSMQDGGCVFCGHCVSVCPVGALMDKPVMKKARSWETRKVRTVCSYCGVGCSLVLHIKNNEILQVTADINSAPNYGSLCVKGRYGFEFYSSKDRLKTPLVRDNINEPFREASWEEAIGLVAKRFSEIKKKYGPDSFGCLSSSRGTNEENFLAQKFTRVVMGTNNMDNCARVCHAPSVTGLRAALGSGAATNSLADIEGAEVLIVSGSNTTEAHPVAALKIKKAVRQNGAKLIVIDPRKIELVKYADIHLQLRAGTNVALINGLLHVIIKEGLQNDDFIERRTENFEMLKQVVSKYTPEETEAITGVPKEDIIKAARMYAGTNKGMIIYGLGMTEHKAGSHGVMSLANLALITGNVGRPNTGINPLRGQNNVQGSCDMGALPDVYACYQRVDDPEANRKHAEAWKVKKLPEKPGLKEPQMYRAIESGDLKAMYIIGYDPAISQADINKVRASISKLEFLVVQELFMTETAKLAHVVLPTSCYFEKDGTFTNAERRVRRLHKAIPLPEGTKSDWDIICSIATAMGYPMSYNHPSEIMDEIAKLTPDMAGINYKRLEGDGLVWPVWDMNHPGTPILHKDTFKRGRGMFNDLMYTPSEELPDEEYPLLLTTGRRLYQYNNGSMSLRNPEICAINSEEFMEIHPADAAKLDIKSGEKVKVSSRRGSLEVKTELTEKSRLGSVFLSFHYPETPTNVLTGPGEDMLALTPEYKVCAVKVEKM

SEQ ID NO: 57417 - protein, 179 aa, Campylobacter lari RM2100
MMKEQDKKYLLDSIRAIKDFPKKGIIFRDITTLLNNKEAFAFLMDYLVEKYQNAKLDYIVGIESRGFIFGAALSARLKLPFVPIRKPGKLPSKCLQESYSLEYGSDTIEIHIDAFNNQKANVLLIDDLIATGGTAIAAVKLIQRLNANCVEACFLLNLKDLDGEKELSKLTSVYSVLEV

SEQ ID NO: 57418 - protein, 313 aa, Leptospira interrogans serovar Copenhageni str. Fiocruz L1-130
MHLTRNESKKLNLVCKIHKEKIEMKTKTNQSVKTFGIVGFPLSHSLSPLIHNSIYKDRNINASYLVFETQNLNVEKIQEFRNSGILGLSVTIPHKETAFTLADKADDTSRIMKASNTLLIGPDSTYAYNTDGEGAYHSILEFSPESLKTGKVVILGSGGSARGIAFSLAVSGKIQNLLVCSRNEITAKEICLLVTKNSNVKAEPISQDVLLTRKEEISLVIHTTPLGMKGQSPGPYLPEDFFNSNMTLFDIVYNPLETPLVKAAQKAGAKIIPGSEMLLYQAMKQFELFTEISPNAEDIIKTRERLSKALENR

SEQ ID NO: 57419 - protein, 513 aa, Erythrobacter sp. NAP1
MTDQSRIADAWERLSALPTETLAGLFDADEDRVARLSQRLEFDLGELGEVGILLDWSKTHLNDAALDAFEELAKASQFGAARDALFDGGIVNPTEGRPATHGAMRGSGRESDVEEAEALLARMGMLVEAIHQGTLGEIKHLIHIGIGGSALGPDLAVDALTRDLKLVDVHVVSNIDGLALEQAFAACDPATTLIAVASKTFTTTETMTNASSALKWLADNGVSDPSGRVVALTANPEKAVQWGVDETRILPFPESVGGRYSLWSSIGFPVALAVGMDDFSAMLAGAQAMDAHFRESEGRANGPLLAAFGDLYYTRVRGCQTRAVFAYDERLALFPDYLQQLEMESNGKSVTADGKPVNGPTAPITWGGVGTDAQHAVFQLLHQGTHLVPVDFIASIAPGDELDPAHHSSLLMNCLAQGAALMAGKTSDDPARNYPGDRPSAMFLVDDLDAATLGALIAFHEHRTFANAVLMGINPFDQFGVELGKAMAKAIDSGEGEFDASTKALMQAAGLGG

SEQ ID NO: 57420 - protein, 116 aa, Arabidopsis thaliana
  misc_feature (64)..(64): Xaa can be any naturally occurring amino acid
  unsure (1)..(116): unsure at all Xaa locations
KRTYSNSDSSESLTSSKNYRLRWLSWDLPERIRIDDYLLIWICSDSSSFANVVLTFNGCDIVRXDAEQDSLVIEFYQYRRILTRRYYLVEKTKDANITRILVGTLRVTGYLHMTHH

SEQ ID NO: 57421 - protein, 631 aa, Salmonella enterica subsp. enterica serovar Paratyphi A str.
MSTTTLTRREQRAKAQHFIDTLEGTAFPNSKRIYVTGSQHDIRVPMREIQLSPTLIGGSKDNPQFEENEAVPVYDTSGPYGDPEVAINVQQGLAKLRQPWIDARNDSEELDDRSSAYTRERLADDGLDDLRFTGLLTPKRAKAGHRVTQLHYARQGIVTPEMEFIAIRENMGRERIRSEVLRHQHPGMNFGARLPENITPEFVRDEVAAGRAIIPANINHPESEPMIIGRNFLVKVNANIGNSAVTSSIEEEVEKLVWSTRWGADTVMDLSTGRYIHETREWILRNSPVPIGTVPIYQALEKVNGIAEDLTWEAFRDTLLEQAEQGVDYFTIHAGVLLRYVPMTAKRLTGIVSRGGSIMAKWCLSHHKENFLFEHFREICEICAAYDVSLSLGDGLRPGSIQDANDEAQFSELHTLGELTKIAWEYDVQVMIEGPGHVPMHMIQRNMTEELESCHEAPFYTLGPLTTDIAPGYDHFTSGIGAAMIGWFGCAMLCYVTPKEHLGLPNKEDVKQGLITYKIAAHAADLAKGHPGAQIRDNAMSKARFEFRWEDQFNLALDPFTARAYHDETLPQESGKVAHFCSMCGPKFCSMKISQEVRDYAAAQTIEVGMADMSESFRAKGGEIYLKREEA

SEQ ID NO: 57422 - protein, 304 aa, Triticum aestivum
  misc_feature (119)..(119): Xaa can be any naturally occurring amino acid
  misc_feature (144)..(144): Xaa can be any naturally occurring amino acid
  misc_feature (161)..(161): Xaa can be any naturally occurring amino acid
  misc_feature (188)..(188): Xaa can be any naturally occurring amino acid
  unsure (1)..(304): unsure at all Xaa locations
MTLGLFRVTLPEQVCTKKQVATGPEFPGYRRPTRPTFYLSSSQFCSSAILATMPGSIAFGRFDDSFSLASFKAYIAEFISTLIFVFAGVGSAIAYTKVSGGAPLDPSGLIAVAICHGFXGLFVAVAIGANISGGHVNPAVTFGXLALGGQITILTGIFYWXVAQLLGAIVGAFLVQFCTGVATPTHGXLSGVGAFEGVVMEIIVTFGLVYTVYATAADPKKGSLGTIAPIAIGFIVGANILVAGPFSGGSMNPARSFGPAVASGDFTNIWIYWAGPLIGGGLAGVVYRYVYMCDDHSSVAGNDY

SEQ ID NO: 57423 - protein, 517 aa, Aspergillus nidulans FGSC A4
MNSREDTELSAAHAPLLAQEPVLRQHDEDQSKHSSGRFIWYLTFSAGISGLLFGYDTGVISSTLVSIDSDLSNRPLTTLDKSLITSCTSLFALIASPLAGILADRLGRKRVILVADVLFTVGSFIQAATGEVWGMIIGRSIVGFAVGSASLVTPLYISELAPSDARGRLVTILSLFITGGQVVAYIIGWLFSYVGGGWRWMVGLGMLPAVFQLIIVVALPKTPRWLVQAGYEDKAQRILSEVHQDDQTAKQTLRDIQQEVAEENSSNKSAGFKQRSHDLFKIAGNRRALTIAVMLQALQQLCGFNSLMYFSATIFSLLSFSSPTLTSLSVALTNFLFTLLAFVYIDRIGRRRILLYSIPVMIISLFVCAVTFSFVELPKDTSEAQARQAATDSSVIPLLILLCLTVYTAAYAFGLGNVPWQQSELFPLNVRSLGSALATATNWGSNFVVGLTFLPMMELLSPSLVFALYGVVCIAGWFGVRTFYPEMSGLNLEDVKALLADSWGVRASLIGVRNRSA

SEQ ID NO: 57424 - protein, 135 aa, Agrobacterium tumefaciens str. C58
MRGRVENQKLVRYETADNQAGGQRRPFAKAVRAGDFVYVSGQVPTVDGEVVTGGIVAQTEQVVANIRDVLALAGCTLADVVKVNVWLDDARDFSSFNAVFQKYFIDHPPARSTVQSPLMVDAKVEMDVIAYKPLA

SEQ ID NO: 57425 - protein, 557 aa, Moorella thermoacetica
MSKVPSDIEIAQAAKMKPVMELARGLGIQEDEVELYGKYKAKISLDVYRRLKDKPDGKLILVTAITPTPAGEGKTTTSVGLTDALARLGKRVMVCLREPSLGPSFGIKGGAAGGGYAQVVPMEDINLHFTGDIHAVTYAHNLLAAMVDNHLQQGNVLNIDPRTITWRRVIDLNERALRNIVIGLGGKANGVPRETGFDISVASEVMACLCLASDLMDLKERFSRKVVGYTYDGKPVTAGDLEAQGSMALLMKDAIKPNLVQTLENTPAFIHGGPFANIAHGCNSIIATKTALKLADYVVTEAGFGADLGAEKFYDVKCRYAGFKPDATVIVATVRALKMHGGVPKSDLATENLEALREGFANLEKHIENIGKFGVPAVVAINAFPTDTEAELNLLYELCAKAGAEVALSWAKGGEGGLELARKVLQTLESRPSNFHVLYNLDLSIKDKIAKIATEIYGADGVNYTAEADKAIQRYESLGYGNLPVVMAKTQYSFSDDMTKLGRPRNFTITVREVRLSAGGRLIVPITGAIMTMPGLPKRPAACNIDIDADGVITGLF

SEQ ID NO: 57426 - protein, 102 aa, Oryza sativa (japonica cultivar-group)
MDQCQECVAAGSGGRRLVGVRRRGGAAASGVVATYNPDTINWDLRAVTNTATAASAVARVVDQCSTGGLDLDVAVFRQIDTDGGGMANGHLVVDYEFVDCQD

SEQ ID NO: 57427 - protein, 409 aa, Sulfolobus solfataricus P2
MKIDEVVEKLVKGEISFHEVDNLLEANAAMVARRLALEKIVGVGLPSIGSTVIDYSEIKNKNAENVIGAIQIPLGIVGPIRVNGDYAKGDFYVPMATTEGALIASVNRGIKAVTLSGGVRAKVLKDEMTRAPVFKFDSIEQIPNFLKFIEENLEKIRNIANSTSHHGKLKSITPFVLGNNVWLRFSFETGDAMGMNMVTIAVEKVCEFIEENFPSADCLAVSGNMCSDKKQTNVNSLFGRGKTVVAEALIKKDVIRNILHSNAQLIHDINLRKNWLGTARAGSLSQFNAHFANIVTAIFIATGQDVAQIVESSSGYTWTEVRGEDLYISVTLPSLEVGTVGGGTRLPTQKEALSIMGVYGSGNPPGSNAKKLAEIIASTVLSGELNLLAALSNKELGKAHAKLGRAMKV

SEQ ID NO: 57428 - protein, 450 aa, Thermoanaerobacter brockii
MIKLAKFPRDFVWGTATSSYQIEGAVNEDGRTPSIWDTFSKTEGKTYKGHTGDVACDHYHRYKEDVEILKEIGVKAYRFSIAWPRIFPEEGKYNPKGMDFYKKLIDELQKRDIVPAATIYHWDLPQWAYDKGGGWLNRESIKWYVEYATKLFEELGDAIPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSIVKYDEDSMLKAENVPGPGKRTEMGWEISPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQKRILKDSALWYKEVILDDGIED

SEQ ID NO: 57429 - protein, 199 aa, Nannochloropsis gaditana
AGGIAEMSQQPEFVRESTDRLDAAGNVTKAITKGYSIGSASLACFLLFGAFMDEFSQFSGKPFRVVDIAVPEVLIGGIIGTMMVFYFVGLTVAAVGKTAGEVVKEVRRQFRDNPEIMTFKARPDYRSCVALVTHAALKEMVWPGLLATGLPIVVGVVFRGVGAITDRSLLGAEVPGRGYLMFGTVTGDTCMAATTRTMS

SEQ ID NO: 57430 - protein, 528 aa, Alkaliphilus metalliredigenes QYMF
MTNSVAEVKQADVIFITGSNTTESHPVIGAQVRQAVKNGTKLIVADPREIDLAQDADVFLKIKPGTSIALSNAMLNVIFEEGLEDKTYIEENTEGIEELKKVVQKYTPEMAGEICGVKPEDIRAAARLYGQGVRGSILYCMGITQHHNGTESVMSLSNLALATGNLGKEGTGINPLRGQNNVQGACDMGALPNVMPGYQQVTNAEVINKFEKAWNTKLSNNVGLTIPEVMHKAAHGDVKMIYIFGENPMVSDPDTHHVEEALKNSFVVVQDLFLTETAELADVVLPAASFAEKDGTFVNTERRVQRVRKAVNSQGEAKADWMIFMELMNHLGYDKQYKNVEEIFEEIRQVTPQYAGISYDRIEDIGIQWPCPTEDHPGTKFLHTGKPARGAGLFMAVEHVESSELGNEEYPLILTTGRILYQYHTRTMTGKTEGINQMAPESYIEMHPNLAVSLGITNGETVKVKSPRGEVRTKAKVTKIVDENVVFMPFHYFEGAANVLTNGTDLDKYCKIPGLKVTGVKVVKIIAR

SEQ ID NO: 57431 - protein, 451 aa, Erythrobacter sp. NAP1
MADQDYDFDLFTIGIGSGGTRASRVAAAHGARVAAAEEHRVGGTCVIRGCVPKKMLVYGAQFAEDLEDATHFGWTIEGKSFDWIKLRDHVMKDVSRIESVYTDTLDKHDVTIFHERAEITGDHEITLASGKVVTAKYILIATGAWPHVPEFEGSEHCITSNEAFHLDEIPKRVLIAGGGYIANEFAGIFNEFGCKVVVANRSDVILRQYDFALRDRLMQISMTKGIEFCFHAEFEYVKKNEDGTFAVKMTNHEEREFDLVMVATGRVPNTSGLGLENVGVELGDKGEIKVDEYSKTNVDYIYAVGDVTDRVQLTPVAIREGQAFADSVFGPGEPYSVDHSCIPSAVFSHPPICSVGLNEREAKDQYGKVAVYTSDFRPMKNVVANRNERSLVKMICDDANGKILGIHMIGPDSPEIMQAAAVAVKAGMTKADFDATTAIHPTVAEELVLLR

SEQ ID NO: 57432 - protein, 214 aa, Synechococcus sp. WH 8102
MSIFVGNLPFRAEQEDVIELFAQFGEVANCALPLERDTGRKRGFAFVEMADEAVEDAAIEGLQGAELMGRPLRINKAEPRGSAPRGGGGGYRGGGGGYGGGGGYGGGGGRDGGGGYGGGGGGYRGGGGGYGGGGGGGRDGGGGYGGGGGGYRGGGDAGDRPSGARGWEDRSYGARDSGGEGGGGHDDGRSRRRRGSSGGGGGGDDYSGYGGAEG

SEQ ID NO: 57433 - protein, 411 aa, Oryza sativa (japonica cultivar-group)
MNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRGVLFATEALLAEHGKGIAGQRFVIQGFGNVGSWAAQLISEAGGKVIAISDVTGAVKNSNGLDIAKLMKHSSENRGIKGFDGGDAIDPRSLLTEECDVLIPAALGGVINKDNANEIKAKYIIEAANHPTDPEADEILSKKGVLILPDILANSGGVTVSYFEWVQNIQGFMWDEEKVNNELKTYMTRGFRDVKEMCRSHHCDLRMGAFTLGVNRVARATVLRGWEA

SEQ ID NO: 57434 - protein, 926 aa, Magnaporthe grisea 70-15
MAPASATSDLDRVDSSPSPAVSDDEKRNHRNDDVSPHDKATSVVGHKEKGQDIDTTAAPVFPPAEWVERLKAEYTGRHDAGTETLPPGCDPDRMAASVLTLDVEESVQVLKNLLESQKEDFTIDQVVMARVRELVQGHEHCEMTHGDWTYDVCKRAGLYHNWSPYAEVRAVTLPYDDVEEACESFRAYLLGYFWICVCTAINSFFAPRQPGISIPGSVIQLILVPMGRAMAYILPDWGFRWRGTRYTLNPGPWTAKEQLFTTIIFNGASGIGNMTGLLVMRLPVFFNQKWATYGFNIMLALSNQVFGLGMAGILRRLSVYPIEAVWPSTLPVLALNRTLMNADNKREKINGWTMTRYRMFLWSSLFFLIYYWIPNRFWEGLRLFNWLTWIDPNNFNLATVTGSYGGMGYNPFSSFDPNVSGSGTMNAPFFAQLQQFVMRALSGIIILIMYYKNAFWSAFLPINSNSAFDNTAKPYNISMVLNSDDTLNMQKYEAYGPPYYAIANLFITGVNFIYYTFSIVYVFTKFWKPIKKAFVGIVVNTIKRRSVYSGFEDGHTRMMRVNYKEVPEWWYGLLFTFGFVISIISLEAWPTDTPWWSMLGVTAIGALLTIPWVVIESIASTGIAVNVIWQVLPGIWFPGRPMPQLIILMLGAAFEIMAGSFSHDLKYAHYAKIPPRAVFRGHVSSVMVNCFIYVAMIEVMMAYANSDNTLCQWNNKQAMVCQYANSVYSSTIFYGIFGTNNMFKLYPILPWCFLIGAVLGVLWIGGERLLPRLRPHIKARLGSERGSKFDRYIWDPAAATLACLNPAIALSGALQWAGNNNLTYATLGIYLAWYFQYYLKRRYTAWWGKYAYLIFAGLAVGVAISGLIVTLVFSFGAGKGVEMKWWGNDVSKAGIDYKLYTNEARLMEVGERGYFGLDPKDYPNGW

SEQ ID NO: 57435 - protein, 881 aa, Oryza sativa
MMHPSLLATIQWLTLSALLSIAMAADNNSTASAPIFLNCGASGVQPDSYNRSWDGDASSKFAPSVKGNVARASYQEPSLPSPVPYMTARFFTSNYTYSFPVSPGRMFVRLHFYPTNYNGNLDSANGYFGVTTNNLILLDNFNASQTALATSSAYFFREFSVNVTSSSLKLTFAPSTRNGSYAFVNGIEIVPTPDIFTTPTPTSANGGDNVQYGIDPVMGLQTMYRLNVGGQPISPQGDSGFYRSWDNDSPYIYGAAYGVTFSKDGNVTIKYPNTEPNYTAPVAVYATARSMGPTAQINLNYNLTWILPVDAGFTYLLRFHFCEIQYPITKVNQRSFFIYINNQTAQNQMDVIVWSGGIGRTTYTNYVVTTVGSGQTDLWVALHPDLSSKPEYFDAILNGLEVFKLQDLGRNNLAGLNPPLPPKPGVNPNGGSSRGKSKSVAPAAIGGAVGGLAVLLIACVGLCIICRRKKKVAKDTGKSDEGRWTPLTDFTKSQSATSGKTTNTGSHSMLPANLCRHFSFAEIQAATNNFDKSFLLGKGGFGNVYLGEIDSGTRVAIKRGNPLSEQGVHEFQNEIEMLSKLRHRHLVSLIGYCEDRNEMILVYDYMAHGTLREHLYNTKNPPLSWKQRLEICIGAARGLYYLHTGAKQTIIHRDVKTTNILLDDKWVAKVSDFGLSKAGPNVDNTHVSTVVKGSFGYLDPEYFRRQQLTEKSDVYSFGVVLFEVLCARNALSPSLPKEQVSLADWALRCQKKGVLGEIIDPLLKGKIAPQCFLKFAETAEKCVADRSVDRPSMGDVLWNLEFALQLQESTEDSSSLTEGTSASTSPLVVARLHSDEPSTDVTTTTTTTTSLSITDRSIASVESDGLTPSNIFSQLMTPDGR

SEQ ID NO: 57436 - protein, 495 aa, Aspergillus nidulans FGSC A4
MKSLHQLARPRALPSFAAPRAQSARSNRLWQRCFSATRAASEGAQLDPSKLTITKTSTPKELLPAKDLVFGKNFTDHMFTVEWTAKDGWLAPQIVPYQKLQLDPSACVFHYAFECFEGMKAYKDSKGQIRLFRPDKNMQRLNKSSARIALPTVDGEALTKLIGELVKLDSRFIPDARGYSLYLRPTMIGTQSTLGVGPPGSALLFVIASPVGPYYPTGFKAISLEATDYAVRAWPGGVGDKKLGANYAPCIVPQLEAASRGFQQNLWLFGEEEYVTEVGTMNLFIALKNKETGKKELVTANLDGTILEGVTRDSVLALARERLVPKGWQVSERKIRMAEVAEAADEGRLLEVFGAGTAAIVSPVRTISYRGRLVNCGLKETEEAGEIASQMKNWIEGIQYGDEEHPWRIIYWQSIRFIFNSNPFLQSSLSDGRALVREKNYPTYLYSAPRVSSGFHQTPAHIIPCIIHLVEAELNQAQNMNPCQAVNKPALRDNQ

SEQ ID NO: 57437 - protein, 261 aa, Triticum aestivum
PSSSCLVSDLGLRSGLDIYLNSSVKLLDICIALSSELARLDQGQLLVKYVLHVLDPKGGVPSLEQLKRAEVLLKEWMDKVDTTRPRLDSCSMALQELAGSLCLMKVKNSAKGKVLMRALYGIESVTVFTCSVFVAALSGSPKPLVELHVPHKFGWSQAFNDLHATISGEVKRRLSRGSVSAVKELEEVEACARKLHALTRTAQLENENDNVACAVSLSKQMVMPVSRGLFFFFFSFFFFFFNSRTIYSSINTAYTITQLIT

SEQ ID NO: 57438 - protein, 428 aa, Arabidopsis thaliana
MMTSRSIVPQQSTDDVVVVDGKNVAKGRNRQVLGDIGNVVRGNYPKNNEPEKINHRPRTRSQNPTLLVEDNLKKPVVKRNAVPKPKKVAGKPKVVDVIEISSDSDEELGLVAAREKKATKKKATTYTSVLTARSKAACGLEKKQKEKIVDIDSADVENDLAAVEYVEDIYSFYKSVESEWRPRDYMASQPDINEKMRLILVEWLIDVHVRFELNPETFYLTVNILDRFLSVKPVPRKELQLVGLSALLMSAKYEEIWPPQVEDLVDIADHAYSHKQILVMEKTILSTLEWYLTVPTHYVFLARFIKASIADEKMENMVHYLAELGVMHYDTMIMFSPSMVAASAIYAARSSLRQVPIWTSTLKHHTGYSETQLMDCAKLLAYQQWKQQEEGSESSTKGALRKKYSKDERFAVALIPPAKALLTGTESA

SEQ ID NO: 57439 - protein, 252 aa, Zea mays
MSRFGRSGPPPPIRDTYSLLVLNITFRTTADDLFPLFDKYGEIVDIYIPRDRRTGDSRGFAFVRYKYEDEAQKAVDRLDGRLVDGREIMVQFAKYGPNAERINKGRIMEPVPRPRGRSRSRSPRRRYRDDYRDDYQDRDYRRRSHSQSRDRYTRDSYRDRDYRHLSLSRSYSPDDYKKRGRDSLSPARISPSHSRSRSYTPDDYKRRGKDSITSPASRSPSRSPPRKTSPSPKRSPVRRNDDRSPRSRSPST

SEQ ID NO: 57440 - protein, 376 aa, Parvularcula bermudensis HTCC2503
MAVTQKARDLQAAGRDVLTLSMGELDFETPAPVKEAAIAAIAAGETRYTAVDGTPALKAAITEKYRRDHDFLLSPEEIVATTGGKFLIYAALRATLEPGDEVIIPSPYWVSYPGIVRMCGAVPVILATQAGQGFLPDPQTLKATMTPKTRWILLNFPNNPSGATLPLEHAAALAEVIEAHPRALVLSDDIYELIRFDASPPGPLFAKMKGMRERTLTVNGVSKSHAMTGWRLGFGAGPAPLMAAIRRVAGQTTSNPCSISQAAAVAALGMEPSFLTDWRTALRTRRDLVVRTLNRIEGISCLSPSGAFYVFPDINGVVKRKGLADDTAFCTALLDEEALALVPGSAFGAPGFVRLSFAAADSVLEEAMGRLKRFCA

SEQ ID NO: 57441 - protein, 418 aa, Arabidopsis thaliana
MSSSGQTQFRYTQTPSKVVHLRNLPWECVEEELIDLCKRFGKIVNTKSNVGANRNQAFVEFADLNQAISMVSYYASSSEPAQIRGKTVYIQYSNRHEIVNNQSPGDVPGNVLLVTFEGVESHEVSIDVIHLVFSAFGFVHKIATFEKAAGFQALVQFTDVETASAARSALDGRSIPRYLLSAHVGSCSLRMSYSAHTDLNIKFQSHRSRDYTNPYLPVNQTAMDGSMQPALGADGKKVESQSNVLLGLIENMQYAVTVDVLHTVFSAYGTVQKIAIFEKNGSTQALIQYSDIPTAAMAKEALEGHCIYDGGYCKLRLSYSRHTDLNVKAFSDKSRDYTLPDLSLLVAQKGPAVSGSAPPAGWQNPQAQSQYSGYGGSHICTHHLIPTGFTLRSTSLLWMRYCLLKISDFAATGEYFHV

SEQ ID NO: 57442 - protein, 377 aa, Synechococcus sp. WH 8102
MADYYDLLGVGRDADADTLKRAYRSKARKYHPDINKEPGAEDRFKEIGRAYEVLSDPQTRARYDQFGEAGLGGAAGASDMGDMGGFADLFETFFQGFGGPGGAAAGRSGRRGPQQGDDLRYDLTIDFEQAVFGQEQEIKIPHLETCDTCGGSGAKAGSGPTTCGTCGGAGQVRRATRTPFGSFTQVAECPNCGGTGQVIADPCNACGGQGVRQVRKKLRINIPAGVDTGTRLRVSGEGNAGQRGGPSGDLYVFLTVKSHPRLRRDGLNILSTVNVSYLQAILGDTIEVETVDGDTVLEIPPGTQPGTVLTLANKGIPKLGNPVARGDQRVQVMVQLPTRLSDPERTLLEELAGHHSARGKQHHHHNSGLFARLFGQK

SEQ ID NO: 57443 - protein, 341 aa, Synechococcus sp. WH 8102
MTLRVAINGFGRIGRNVMRGWISRGADTGLEIVGMNSTSDPKTSAHLLTYDSILGKLDPSVKIETTDDTMLVNGKEIKFFADRNPLNCPWKDWGVDLVIESTGVFNTDEKASMHLEAGASKVILTAPGKGDGVGTFVVGVNDDQYRHEDWNILSNASCTTNCLAPIVKVLDQNFGLDWGLMTTIHSYTGDQRILDNSHRDLRRARAAALNMVPTTTGAAKAVALVYPEVKGKLTGFAMRVPTPNVSAVDLTFGPSRATSVDEVKAVIKAASENGMKGIIKYSDLPLVSTDYAGTNESTIFDADLTYAMGDKAVKILAWYDNEWGYSQRVVDLAEVVARNWK

SEQ ID NO: 57444 - protein, 393 aa, Oryza sativa
  misc_feature (318)..(318): Xaa can be any naturally occurring amino acid
  unsure (1)..(393): unsure at all Xaa locations
METVAAASYTRGAATRSPACCAAMSFSQSYRPKAARPPSTFYGESLRVNTARSLPSGRQSKAASRAALSTRCEIGDSLEEFLTKATPDKNLIRLLICMGEAMRTISFKVRTASCGGTACVNSFGDEQLAVDMLADKLLFEALEYSHVCKYACSEEVPELQDMGGPVDGGFSVAFDPLDGSSIVDTNFTVGTIFGVWPGDKLTGVTGGDQVAAAMGIYGPRTTYIIALKDCPGTHEFLLLDEGKWQHVKDTTTIGEGKMFSPGNLRATFDNPEYDKLINYYVKEKYTLRYTGGMVPDVNQIIVKEKGIFTNVTSPTAKXAKLRLLFEVAPLGFLIEKAGGYSSDGKQSVLDKVINNLDERTQVAYGSKNEIIRFEETLYGSSRLTAGATVGAAA

SEQ ID NO: 57445 - protein, 339 aa, Synechococcus elongatus PCC 7942
MTIRVAINGFGRIGRNFLRCWFGRQNTDLEVVAINNTSDARTAAHLLEYDSVLGRFNADISYDENSITVNGKTMKIVCDRNPLNLPWKEWDIDLVIESTGVFVTAEGASKHIQAGAKKVLITAPGKGEGVGTYVIGVNDSEYRHEDFAVISNASCTTNCLAPVAKVLHDNFGIIKGTMTTTHSYTLDQRILDASHRDLRRARAAAVNIVPTTTGAAKAVALVIPELKGKLNGIALRVPTPNVSVVDLVVQVEKPTITEQVNEVLQKASQTTMKGIIKYSDLPLVSSDFRGTDESSIVDSSLTLVMDGDLVKVIAWYDNEWGYSQRVVDLAELAARKWAA

SEQ ID NO: 57446 - protein, 174 aa, Triticum aestivum
MVYHSSFIDDDGITKACGCPLLPLKTHIKGPAPAADSDKADIVDEAITFFRANVFFKNFHVKSPADKLLIYLTSYINIALKRLETCRTLAVGTKAIINLGLEKVPVPGEPGFPFPGLFTLPQSGEEAELLRNYLKQIREETSGRLLNCAYRANGTPNKWWLAFAKRKFMNVVIL

SEQ ID NO: 57447 - protein, 548 aa, Oryza sativa (japonica cultivar-group)
MDAGAEPLLPPPASAVDHLGRPASRRTSGRWLAALFIIGVEISERFAFGGISGNLITYLTGPLGQSTASAAAAINAWNGAALLLPLLGAAVADSWLGRYRIIICASLLYILGLGMLTLSPVLVPHQQAESGDNADNNASSSMDIHVAFFYLSLYIVAFAQGGHKPCVQAFGADQFDENDPEECASRSSFFNWWYFGIYGGNVITVSILNYIQDNIGWQLGFGIPCIAMSLSLAVFLLGTKSYRFYPLRSNTSLFDQVGKSLLAKIRWWCASWCSKSSGDLHCTQASSSQGDHNDAEKACFPDEATAVLKLFPIGATCLIYAIVFAQWITLFTKQASTLDRWIGKVHIPAAALQSLISVSIVISVPIYDRILVPLTRRYSKNPRGITTLQRIGIGLIISVILMVVSALVETRRLMVARDFGLVDNPEATIPMSFWWVVPQFILTGLADMFTMVGLQEFFYDQVPDGLRSLGLALYLSIFGIGSFISSFLVYAIDKVTSMTGDSWFSDNLNRGHLDYFYWLLAVLSVLGLAAYLHFSRVYVHKKKGISVQ

SEQ ID NO: 57448 - protein, 281 aa, Triticum aestivum
MEAAVGGSWTRVRTLGRGASGAVVSLAADDLLGALFAVKSAPAAAADQLRREGDILSGLSSPHVLPCLGFRAAAGECQLFLEFAPGGSVADVAERCGGRLEEGAVRAYAADVARGLAYLHGRSLVHGDVKARNVVVGADGRAKIADFVCARAVGSSDRPIGGTPAFMAPEVARGEEQGPAADVWALGCTVVEMATGRAPWSDMDDVLTAMHRIGYTDAVPEVPAWLSAEAKHFLALCFARDARDRCTFVLGAPRTTHVMILRFRTKCLFLKERKAKCLVSK

SEQ ID NO: 57449 - protein, 574 aa, Oryza sativa (japonica cultivar-group)
MAMEAEALLPEPEPESPPLLAVDHLGGPASRGSSGRWPAAFFLIGAEVGERFAYSGIMGNLVIYLTGPLRQPTAAAAAAVNVWMGTSMLLPLLGSAVADSWLGRYRTIVCASLLYILVPAYKLLSWLGLEPDFFFLLFLQGLGMITVSSVLAPEESSESSNLAAHVAFFYFSLYVVAFAQGGHKPCAQALGADQFDENDPGELASRSSFFNWWFFASYGGNTVTVPILNYVQESVSWQLGFAIPCIAMAVSLAIFLIGTRSYRFYPPKSKGNPFGEVAEWIRRWIASSCSNHFGTNICCRLPDSSDELLPSSSSEGDVSNSSSEFVPKEAAELVKLFPIWASSLIYAAVMAQCITFFTKQASTLDRRVGSLVLPAASNGALFNATIMVFLPIYDRIFIPVARRYTKNPSGITTLQRIGVGLVLSIITMIVAAMVEMRRLRIARDFGLVDKPEAVVPMSFLWIVPQNILAAISDMFAVIGLQEFFYGEAPESLRSFSMALFLSIIGVGNFISSFIVYAIDRVTSSFGDSWFSNNPNRGHVDYFYLLITVLNALSLACFLYFAKMYEHRKKVISVQ

SEQ ID NO: 57450 - protein, 253 aa, Synechococcus elongatus PCC 7942
MSFSDHFSAVAASYAKARPRYPQRWFRYLARIVPDRQRVWDCATGNGQAAIALAEYFSEVIGSDASAAQVRQARSHPRVQYQVFPAEATPLAPASLDLITVAQAAHWFDLPQFYIEAQRLLRPGGVIALWGYGLGSLNPAIDHVFNHFYRDWLDPYWPPERQWVEQAYEGLSFPFEPLPTPTFSMQCDWTLFDLLAYLRTWSGVQQFQRQRGFDPVWAIAPELQRVWGDPQRYRRITWPLFAKVGRWQPDRVR

SEQ ID NO: 57451 - protein, 485 aa, Agrobacterium tumefaciens str. C58
MTSPLQHLQQSGRLKKFYIDGKWVLPSGSDKVAVINPATELEFAEIALGNDEDVALAVAAARGAFAGWARTGPADRSELLNRVHQLMQQRLELLAQALTMEMGAAINYARSVQVPLAAEHIKVARDNAASYSFLSQRGHTAILREPIGVCGLITPWNWPLYQITAKVGPALAAGCTVVLKPSELSPLSALLFAEIIEDAGFPPGVFNLVNGEGTIVGAGLSAHPDVDMISITGSTRAGILVAQAAAPTVKRVAQELGGKSPNIILADADMTRAVPLGVAAAFRNLGQSCSAPTRMIVPRSHQKHIEELAAAAALEIVVGDPLSEHTTHGPVANHAQFDRIQRMISIGMDEGAKLVVGGTGRPDGLDTGFYVRPTIFSDVDPKMQIAQQEIFGPVLSIISYDTLEEAIEIANDTVYGLGAHVQGTDLQTVRIVAEQIRSGQVHLNYPAWDPNAPFGGYKQSGNGREYGTEGMEEYLEIKSILGFYP

SEQ ID NO: 57452 - protein, 325 aa, Oryza sativa (japonica cultivar-group)
MPGVDSHAPGGLLKFLRKTTPRTEQHVCNGSSSQPINVGDDCNVGDCVRTEKRLPWTKEEDLRLVSAWLNNSNDPIQSNYKKNDQYWNGVAAVYNNTTPKNRARQVKQVKDRFGRIKKRVAWFCASWKEANALWASGESEVNLMDRTVKSYEEDHKKDGPFMFKHCWDVLSKEPKWDAYLERLEGLEPDKRKFNVEEGVGHHFSLDDARDERPIGGKQAKEQQKRKRKDQAIIDLEEEFHKLVDAQNTANEGHKEMLETQRRVSSENVEARKLKYLAEKEHKESTILETYKSLMMQDTTGMPEDVRSERMLALRCFREKLFGKTD

SEQ ID NO: 57453 - protein, 125 aa, Aspergillus nidulans FGSC A4
MTGTDSGRFAPKVPVQLDPPKDDLITPEELAKCDGTDPSRPTYVAIKGIVFDVSRNSAYGPEGQYKVFAGKDASRALACSSLKPEDCKPEWYDLPDKDKKVLEEWFTFFSKRYNIVGKVKDAKNY

SEQ ID NO: 57454 - protein, 609 aa, Coprinopsis cinerea okayama7#130
MPRLTVTPGVAFLTRNLVVPTAFNYGLATLALRVASNKISGIPRVPGWLLLALSVLVIPTRIAAALVYQQWRNQREAEKRGARLAPVLQGKRIGNMDQLSYLLNCWKNGYAADGIREIIEDLGNTFNPRIMFADTIFTVEPEHVKLILSTDFNNYVKGERFQFAIFHRSMTRPFFSRERVTDLDRFDRHTQTALSLLLAKAKTGYAVDFQDVMQRLTLDISTDILFGACVDNLKITPDDLALPYNHPRYSSASSAKDTSFTQAFLNAQFVIAERERNGWAWPLLEIFEDKAAPHMAVVNRFVEPIINEAIRKRKEKEALYGDSEKANGQKADIDADETLLDHLVRSTSGKPLLTVQSRRQKVKYVEFADPRILKDETLNILLAGRDTVSATLTFTIYLLSLHPHVLERVREEVLNRVGPSRAPTYDDVREMKFLRAVINESLRLLPPVPMDVRECVNGAIWPSPDPTQKPIYVPPGAATPYSALLTQTRKDLWGPDALEFDPDRFIDERVKKYLVPNPFIFIPFNAGPRICLGQQFAYNVTSFVLVRLFQTFSSFTLDEEAFPPDCRVPKEWAEVGKNSRKAKERFMPKLVLTMSSKGGMWLKMQPVDH

SEQ ID NO: 57455 - protein, 290 aa, Leptospira interrogans serovar Copenhageni
MKTKTNQSVKTFGIVGFPLSHSLSPLIHNSIYKDRNINASYLVFETQNLNVEKIQEFRNSGILGLSVTIPHKETAFTLADKADDTSRIMKASNTLLIGPDSTYAYNTDGEGAYHSILEFSPESLKTGKVVILGSGGSARGIAFSLAVSGKIQNLLVCSRNEITAKEICLLVTKNSNVKAEPISQDVLLTRKEEISLVIHTTPLGMKGQSPGPYLPEDFFNSNMTLFDIVYNPLETPLVKAAQKAGAKIIPGSEMLLYQAMKQFELFTEISPNAEDIIKTRERLSKALENR

SEQ ID NO: 57456 - protein, 290 aa, Leptospira interrogans
MKTKTNQSVKTFGIVGFPLSHSLSPLIHNSIYKDRNINASYLVFETQNLNVEKIQEFRNSGILGLSVTIPHKETAFTLADKADDTSRIMKASNTLLIGPDSTYAYNTDGEGAYHSILEFSPESLKTGKVVILGSGGSARGIAFSLAVSGKIQNLLVCSRNEITAKEICLLVTKNSNVKAEPISQDVLLTRKEEISLVIHTTPLGMKGQSPGPYLPEDFFNSNMTLFDIVYNPLETPLVKTAQKAGAKIIPGSEMLLYQAMKQFELFTGISPNAEDIIKTRERLSKALENR

SEQ ID NO: 57457 - protein, 187 aa, Acidobacteria bacterium Ellin345
MLRDLLSRWPVVRQIQNRDWKATGETAMSGQTRDLRARNVGAEVTRSICPYCGVGCGQLVFHKDNELINIEGDPDSPISRGRLCPKGAATYQLHTVDSRLLKVRYRRPYGADWEDLDLETAMDMVADRLWESRERSFVEKQDGEWVMQTKAIGHLGGATLDNEENYLIKKLFAGGLGMVCVSNQARI

SEQ ID NO: 57458 - protein, 101 aa, Brassica napus
  misc_feature (20)..(21): Xaa can be any naturally occurring amino acid
  unsure (1)..(101): unsure at all Xaa locations
DEGAKKYRSRTFVPTGQEMXXMRKNQTVYANKIDGVSVSSSLSSSVGSSPKSSSVTSDPAAKSSLLVDGLDSLDTMYDMSLIDIDISSFPSNVPSASESGA

SEQ ID NO: 57459 - protein, 372 aa, Rhodospirillum rubrum ATCC 11170
MIVSRAAIAWEAGKPLSVEEVEVAPPRQGEVLVRIIATGVCHTDAYTLSGSDPEGVFPAILGHEGGGIVEEIGPGVTSVAVGDHVIPLYTPECGTCKFCRSGKTNLCQAIRATQGQGLMPDGTSRFSIKGREIRHYMGTSTFSEYTVLPEIALAKVNKAAPLEKICLLGCGVTTGMGAVLNTAKVEPGATVAIFGLGGIGLSAIIGCVMAGAGRIIGVDINPDKFEIARQLGATDVINSRDYDRPIQEVLIDMTDGGVDYSFECIGNVGVMRSALECCHKGWGQSVIIGVAGAGQEISTRPFQLVTGRVWRGSAFGGVKGRSELPALVERYLAGDFELDTFITHTMGLADINHAFELMHEGKSIRSVIHYDL

SEQ ID NO: 57460 - protein, 870 aa, Acidobacteria bacterium Ellin345
MPGLGTSFGRGGATTAQQDLANADAILIMGSNMAENHPVGFQWVIEARERGGKIIHVDPRFTRTSAMADVWVPFRAGSDILFLGGLINYAITHDKIFRDYVVHYTNAPVILRDDLKDTEENDGVWSGWDEQAKKYNPETWAYAGSPKKDAGGAAPGHQEASGGHGKDRGGEASTTSQYHADYTLEHPRCVYQVMKRHFARYTPEFVEEHCGVPRDQFLKVAETFCNASGPDKTAAICYAVGFTQHSKGVQIIRTAAILQLLLGNIGRPGGGILALRGHASIQGSTDIPTLYDILPGYLPMPFFEKDANDFASYNKKHRSETGVWSNFPKFSTSLLKAWYGEHATNENDYCFDLLPRVTGDHSHFGYWLDMQDGKMEGLFIMGQNPAVGASNGQVERTAMSKLKWLVVRDMSEIESATWWKRGPEIASGKLKTEEIGTEIFLFPAAGTAEKAGCFTNTQRLVQYREQAIEPAGDIRSELWFMYHLGRRLKAKAEGKPGKKYEALNKLTWDYYTHGAQAEPSADQVLQEINGRHIDTGKFVARYQELKDDGSTASGCWIYAGVHPDERTNQANARAATNYLGHGWGFAWPSDIRILYNRASARPDGKPWSERKKLVWWDDEKQEWTGIDQPDFDKKKRPDYKPGPGVKGIDGIPGDKPFMLHPDGMGWIWVPSGLKDGPLPTHYEPLESQFRNPLYPGKHDSNPPADKKIRPDNPYSKFGDDRYPFALTTYRLTEHHTAGGMSRTLSYLAELQPELFCEVSPELAAERGLRHGDFATITTPRATVEARVLVTRRMRPLWVEGRTIHQIGLPYHWGYEGLVKGDVTNDLLAISEEPNVRIMETKALICDIEPGRRPRGEAAPEYVREKAEQPA

SEQ ID NO: 57461 - protein, 1005 aa, Desulfovibrio vulgaris subsp. vulgaris str. Hildenborough
  misc_feature (192)..(192): Xaa can be any naturally occurring amino acid
  unsure (1)..(1005): unsure at all Xaa locations
MTVTRRHFLKLSAGAAVAGAFTGLGLSLAPTVARAELQKLQWAKQTTSICCYCAVGCGLIVHTAKDGQGRAVNVEGDPDHPINEGSLCPKGASIFQLGENDQRGTQPLYRAPFSDTWKPVTWDFALTEIAKRIKKTRDASFTEKNAAGDLVNRTEAIASFGSAAMDNEECWAYGNILRSLGLVYIEHQARIXHSPTVPALAESFGRGAMTNHWNDLANSDCILIMGSNAAENHPIAFKWVLRAKDKGATLIHVDPRFTRTSARCDVYAPIRSGADIPFLGGLIKYILDNKLYFTDYVREYTNASLIVGEKFSFKDGLFSGYDAANKKYDKSMWAFELDANGVPKRDPALKHPRCVINLLKKHYERYNLDKVAAITGTSKEQLQQVYKAYAATGKPDKAGTIMYAMGWTQHSVGVQNIRAMAMIQLLLGNIGVAGGGVNALRGESNVQGSTDQGLLAHIWPGYNPVPNSKAATLELYNAATPQSKDPMSVNWWQNRPKYVASYLKALYPDEEPAAAYDYLPRIDAGRKLTDYFWLNIFEKMDKGEFKGLFAWGMNPACGGANANKNRKAMGKLEWLVNVNLFENETSSFWKGPGMNPAEIGTEVFFLPCCVSIEKEGSVANSGRWMQWRYRGPKPYAETKPDGDIMLDMFKKVRELYAKEGGAYPAPIAKLNIADWEEHNEFSPTKVAKLMNGYFLKDTEVGGKQFKKGQQVPSFAFLTADGSTCSGNWLHAGSFTDAGNLMARRDKTQTPEQARIGLFPNWSFCWPVNRRILYNRASVDKTGKPWNPAKAVIEWKDGKWVGDVVDGGGDPGTKHPFIMQTHGFGALYGPGREEGPFPEHYEPLECPVSKNPFSKQLHNPVAFQIEGEKKAVCDPRYPFIGTTYRVTEHWQTGLMTRRCAWLVEAEPQIFCEISKELAKLRGIGNGDTVKVSSLRGALEAVAIVTERIRPFKIEGVDVHMVGLPWHYGWMVPKNGGDTANLLTPSAGDPNTGIPETKAFMVDVRKV

SEQ ID NO: 57462 - protein, 361 aa, Synechococcus elongatus PCC 7942
MARSGLEPQTVTDATPLLGRSLPELQDWVVAQGQPSYRAKQLYQWLYERSIHNLAEISVFPKAWRQSLQAVPVGRSQIVDRSVSPSGTIKYLLRLHDGEIIEAVGIPSGDRLTVCVSSQLGCAMACDFCATGKGGFRRHLAPHEIIDQVLTVQEDWQQRVSNIVFMGMGEPLLNLDAVLAAIRCLNQDIGIGQRGITVSTVGIPGHIRRLAETKRVGDRPLQFTLAVSLHAPNQAIRDRLIPSSRHYPITDLLQECRDYVQITGRRVTFEYILLAGLNDQPEQAEQLAQLLRGFQSHVNLIPYNPIDEVEYQRPSKARVDAFADALRQQRVAVTVRWSKGLGADAACGQLRANRSTATLPA

SEQ ID NO: 57463 - protein, 505 aa, Agrobacterium tumefaciens str. C58
MHEPLTAAEYKAIASDLQFPANAFIDGAFRPAGSGKTFKTINPATGETLADISACDVSDVDYAVGKARAAFDDGRWRLLPPGERKAILLTFAKLLEQHRHELAVMESLDSGKPVSECQTVDIPDTIHTIRWHAELIDKLYDNTAPVGSNALALVVREPVGVVGCVLPWNFPLLMLAWKIGPALASGCSVIVKPAEETTLTTLRVAELAHEAGIPAGVFNVVPGGGKEVGEPIGMHMDVDMVAFTGSTPTGRRFLRYAADSNLKRIVLECGGKNPAVVLDDAEDLDLVAEQVVNGAFWNMGENCSASSRLIVHAKIKDELLQRIGAYMREWRMGDPLDPQNRVGALVSKAHFDKVHSFLEDVKAENLTIVHGGKTEKGIFIEPTVVDAVPPASRLFREEIFGPILSVTTFNTLAEAVALANDTNYGLAASVYTGSLRKAIKLSREIRAGVVTVNCFGEGDATTPFGGYKESGFGGRDKSIFAHDNYCELKTIWIDVSDRSVDETVR

SEQ ID NO: 57464 - protein, 1212 aa, Oryza sativa
MQFMMPLDTNACAQPMRRAGEGAGTERLMERLNIGGMTQEKALRKRCFGDGVTGTARCVFTSDADRDTPHLRTQSSRKNYADASHVSAVILGGGTGVQLFPLTSTRATPAVPVGGCYRLIDIPMSNCFNSGINKIFVMTQFNSASLNRHIHHTYLGGGINFTDGSVQVLAATQMPDEPAGWFQGTADAIRKFMWILEDHYNQNNIEHVVILCGDQLYRMNYMELVQKHVDDNADITISCAPIDGSRASDYGLVKFDDSGRVIQFLEKPEGADLESMKVDTSFLSYAIDDKQKYPYIASMGIYVLKKDVLLDILKSKYAHLQDFGSEILPRAVLEHNVKACVFTEYWEDIGTIKSFFDANLALTEQPPKFEFYDPKTPFFTSPRYLPPARLEKCKIKDAIISDGCSFSECTIEHSVIGISSRVSIGCELKDTMMMGADQYETEEETSKLLFEGKVPIGIGENTKIRNCIIDMNARIGRNVIIANTQVYVLGLFWNGNSIIGILKFAPLSQQTCPVICFACLMCLRFFNSHLLATYETEELMGEVNSCKEMKSVCNWFALARQLIILLSVLVSCPGCQDFLSSLKMSHSSDEDSEISDSEIDEYADKFYARLVAGEFKVKDGQSYSCPFCSGKKKKDFNINNLIQHASGVGAASNRQAKDKATHRALAKHLKNGLTKSSGQQSQTAVVEPQPLPNRDEKFVWPWMGVLVNVPTEWKDGRQIGRSGNHLKEQLSRFCPLKIIPLWNFRGHSGNAIVEFGKDWHGFRNALAFEDYFGKEGYGRRDWKEKQNQGSNLFGWVARAEDHTSPGLIGDHLRKNGDLKTINDLENEGARKTDKLVANLANQIEVKNRHLQELEVTYNERTTSLEKMMGQREQLLQKYNEEIRKMQQLAQRHSQKIIDENQKLRSELESKMSELNTRSKELDEIAAKSDYDRRIIDQEKQKNAIKSSHLKLATLEQERADENVLKLVREHKREKEAAVKKILKLEQQVDAKQKLELDIQQLKGKLEVMKHMPGDEDSALKNKIDELSEELQEKMDELDAMESLNQTLVIKERKSNTEMQDARKELENGLLDLLDGQSHIGIKRMGELDLEAFSKACRKMSSEEDAEITAAILCSKWQAEIKNPDWHPFRFVLVDGQEKEIIEDDAKLQELKEEHGEDIYRLVRDALCEINEYNPSGRFPVGELWNFKDKRKATLKETVQFVLRQWRANRRKR

SEQ ID NO: 57465 - protein, 46 aa, Schizosaccharomyces pombe
VVISVKASCIDSTADAAVVFAREVKKMQEEKIKPQEQLTLEPYERD

SEQ ID NO: 57466 - protein, 211 aa, Glycine max
MEESKKRVRDESSYSPESQTQLVDSPESESQRVDSPESKIRRVDSSESQLDSVLDSEVRLQDDIFNILDDADNVPERDSVQGLDSVIKSFEDEINAPGSDSGSGDPTQEPDSGELQSNLGYLLEASDDELGLPPTVVDGEETGRVGPEMTELARLMGFEDDIPSYDAFGFGSGFAAESDGGAGGFVTVDGLFDYSDPAADVLWRSESLQAM

SEQ ID NO: 57467 - protein, 229 aa, Triticum aestivum
  misc_feature (156)..(156): Xaa can be any naturally occurring amino acid
  misc_feature (171)..(171): Xaa can be any naturally occurring amino acid
  unsure (1)..(229): unsure at all Xaa locations
MSDLRAPEHQVAGHRAAPDKLGPLVDGAGLFYKPLQALDRGEQELAFYTAFSAHPDVPPRIRDAFFPRFHGTRLLPTAASPGEFHPHLILDDLLKGLAAPSVTDIKIGACTWPPRAPEPYVEKCLAKDRGSTSGLLGFRVSGVLVSHASGAVWGPXRSELKGTGLPGVRRXLRRYVSSAGGDGGGEDCPLAAAVYGGNVRGPGAGCGNLRAWFRGCTRCSTSYSGVEPF

SEQ ID NO: 57468 - protein, 369 aa, Burkholderia vietnamiensis G4
MRMYVDVVVIGGGQAGLATAYFLRRAGIDYVVLDDQSAPGGAWRHTWESLHLFSPAEWSSLPGWQMPISHSTYPSRNHVVDYLANYERRYHLPVQRPVHVEAVSRTSEGLLVTTDRGEWLAQAVVSATGTWSAPYIPDYPGREMFRGRQIHSAQYRNPDDLSGLAVLVVGGGNSGAQILAEVSTVCSATWVTLHEPVFLPDDVDGRILFERATAKWKALRDGQATGVPVGGLGDVVMVPPVRDARTRGVLHTVRPFSHFDADGVVWADGSRSHVDAVIWCTGFRPSLGHLDALQIRDADGLVRTDGTRAKDEPRLWLVGYGEWCGAASATLIGVMRSARDTAREIAEYLRSTHEQDASAPRPVSGGGVR

SEQ ID NO: 57469 - protein, 545 aa, Debaryomyces hansenii CBS767
MGYEEKLVAPALKLRLFLDKLPNIYNIYVIATISCISGLMFGIDISSMSAFLSNDAYLKYFGTPEPDMQGFITAAMSLGSFFGSLASAFCSEPFGRRASLLLCGFFWSVGAAIQSSSQNVAQLIIGRFISGFGIGFGSSVAPVYGSELAPRKIRGLIGGLFQLSVTLGILIMFYICYGLGKIQAVGSFRTAWGLQIIPGLILILGCFFIPESPRWLAKQNYWEEAEDIVARVQAKGNREDPEVLIEMAEIRDQILTLDKVKSFTYIDLFKKKYLLRTVTAIFAQIWQQLTGMNTLMYYIVYVFEMAGYHGDANLVASSIQYCINFAMTIPALYLMDKVGRRPVLLTGAALMMAWQFAIGGLLATYAEPTDIFGGNNTVKISIPEDESPAAKAVIACCYLFVVSFASTWGVGIWVYCAEVWGDSASRQRGACVATAGNWIFNFAIAMFTPHAFSTITWKTYMIFATFCACMFLHVFFFFPETKGKRLEEIGQMWDEHVPAWKSASWQPHVPLVSDNEIHGKMDSAHDEHSSRSESTGEKVVADHIA

SEQ ID NO: 57470 - protein, 528 aa, Synechococcus sp. WH 8102
MSQSSSDGQRQPAIVILDFGSQYSELIARRVRETEVFSVVLGYSTSAEELRAMQPKGIVLSGGPSSVYAEHAPLCDPAIWELGIPVLGVCYGMQLMVQQLGGVVEAASGKAEYGKAPLEVDDPTDLLTNVTGGSTMWMSHGDSVKALPEGFVRLAHTANTPEAAVAHLQRRLYGVQFHPEVVHSTCGMALIRNFVYHICGCEPDWTTSAFIDEAVAVVREQVGEKRVLLALSGGVDSSTLAFLLKKAIGDQLTCMFIDQGFMRKGEPEFLMDFFDRKFNIHVEYINARQRFISKLKGITDPEEKRKIIGTEFIRVFEEESKRLGPFDYLAQGTLYPDVIESAGTNVDPKTGERVAVKIKSHHNVGGLPKDLQFKLVEPLRKLFKDEVRKVGRALGLPEEIVRRHPFPGPGLAIRILGEVTDEKLNCLRDADLIVREEIREAGLYHEIWQAFAVLLPVRSVGVMGDKRTYAWPIVLRCVSSEDGMTADWSRLPYDLMETISNRIVNEVKGVNRVVLDITSKPPGTIEWE

SEQ ID NO: 57471 - protein, 493 aa, Aspergillus nidulans FGSC A4
MPPPVGRYGPTGLTGPYSHLAQQQAHLQQQQQAQHHPAHAQSSNTALPPPSLGVHPGFTTANANANMNPFTLAGAGVGNGMSVAGFGAAGDGGGTGLASHAAQMGFARGAQMQQQQLHQAHDGRFTLEGKGGGVKTRIRDVWKHNLAQEMAVLRHLVERYPYISMDTEFPGIVARPIGSFTNKADYHYQTLRCNVDLLKMIQLGITLFSPKGEVPPPDATDANGQPLGNGLVPAPCTWQFNFRFSLEEDMYAQESTAMLAKAGIDFATHEKNGIDPLEFGALLISSGLVLLDDVHWISFHSGYDFGYLMKIMLCQALPENEEEFHKLLNIFFPSLYDIKYLMKHATRNQAVNDSPLTPAAAQIISNLGQKSGLQDIADELGVKRVGIAHQAGSDSLVTGEIFWKMRQLVFNGKIDDSKYSGQIWGLNGQMPTVTYHNNPHQTPNLNGATIYSAAGTPSTPNNAGVQTPQNHTPGALTPGATGGVLGQYQMAKS

SEQ ID NO: 57472 - protein, 409 aa, Candidatus Kuenenia stuttgartiensis
MKPFDHTLYRKVLVMLLAGGKGERLYPLTRDRAKPAVPFGGIYRIIDFTLSNCINSGLRKICVLTQYKSYSLDRHLRVGWNIFNTELDEFIENIPPQKRTNEMWYLGTADAVYQNIYVLESERPEMVLVLAGDHIYKMDYAELINYHITNEADLTVPCIEVPLEDATRFGVVAIDNDSRIIDFDEKPSNPKPLPTNQNVALVSMGIYLFNTEVLVRRIIENAKNDTNRDFGKNIIPTMIQKDRVLSFVFNGNEHNTSNYWRDIGTLDAYWEANIDLVKKNPDFDLFDNRWPIRTYNKQYPPAKYIFENEKNGMIKDALISNGCLINDASIVKSIISPCVTIGAQSSVIGSIIMEGVRIGENVKIKNAIIDKHVTIPDGMKMGYDLQDDGKQFTVTEKGIVVAHKEMHLI

SEQ ID NO: 57473 - protein, 282 aa, Campylobacter lari RM2100
MQELINDIQKAVIEISQELRYLKDFDYTSSQNATGDNQLKLDVKSDEIITRILGQNKNIKSLISEEKQEQLLINENEKYIVAYDPLDGSSLVDVNFAIGSIFAIYENEAKAKNLKAAIYAIYGVRLELVVCFEKPMLYRLNENDEFVFVKELKLNEKGKLNACGGTQKNWSSTHGAFIKALFDEGYRLRYSGAMVSDLHQILLKGGGLFSYPATSDAPNGKLRAYFEVFPFAFIFEKANGLSTNGENDSLLDLEFEKIHASTPCFLGSKYEIEKLKQAYKGL

SEQ ID NO: 57474 - protein, 215 aa, Zea mays
  misc_feature (74)..(74): Xaa can be any naturally occurring amino acid
  unsure (1)..(215): unsure at all Xaa locations
TADLVLKMACEGCGNTSDLYGTGCKHTTLCSDCGKSMARSRARCLVCSAPITRLIREYNKNAENKWSLHKEGLXQGRQIAENMREKYNKKPWILEDETGQYQYQGQMEGSQSATATYYLLMRHGKEFNAYPAGSWFNFSKIAQYKQLTLEEAEEKMNKRKTSATGYERWMMKAAANGPAAFGSDMKKLEATNGGEKESARPKKGKNNEEGNNSDK

SEQ ID NO: 57475 - protein, 629 aa, Campylobacter lari RM2100
MRYITTPIYYVNDVAHIGHAYTTIIADTLARFYRLQGEKTFFLTGTDEHGQKIEQAASAKNFTPKEYADEISTKFKKLWDEFEISYDYFIRTTDENHKLSVQKAFKKMFDKGDIYKGTYEGFYCVSCESYFTQTQLINECHCPDCGKKTQLLKEESYFFKLSKYQDQILKWYKEKEPILPKNKANELINFVESGLKDLSITRTSFEWGIKLPKELNDDKHVVYVWLDALMNYVSALGWGNDEANMDFWPAHIHFVGKDILRFHAVYWPAFLMSLDLPLPKFIAAHGWWTKDGEKMSKSKGNVVAPKEVADTFGLEAFRYFLLREVPFGNDGDFSQKALIARINAELSNELGNLLNRIIGMSAKYSQNIIDCKDVNLYFNQELNECKEYLDNAINALENIQPNRYLEELFKALSLANLSISKYEPWNLIKNDQMQKANALVALCANILAKVAILLSAAMPNTALKIAKALNFEISNENYQKLILNNQLCDLKSSPCEALFPKIELTQEPKKEEKIPEDKPNLAQIKIDDFKKIEIKVALVKDCQNIEGSEKLLKFQLELENGETRQVLSGIAKFYKASELIGKQVCVITNLKKAKIFGYESEGMILSAEKNGKLVLISPQSFIENGALIG

SEQ ID NO: 57476 - protein, 561 aa, Aspergillus nidulans FGSC A4
MVFTSPSPAVLPPIPDNIPISEFMLTDANGRYPLSKARHPFTCGLTGKTYSALEVKDRVEYMSRGLAKLLNWEPNGGSEWDKTLVIFSLNTIDSIPLGWATHELGGIVSPANAAYSADELKHQLLDSKAKAMFTCVPLLPTALKAASAAGLPKDRIYLIDVLPGSGKIPTEFKTLSQIVEEGKSLPKLEKLKWGAGEGARRTAYLCYSSGTSGLPMTALEKSWRDTRKNADGSYYSDVLLGLLPQSHIYGLVVICHAGTFRGDQVIVLPKFELRSCLAAVQRFKISVLFVVPPIIITMLRSPEICAEYDLNSAVALVTGAAPLGQETALDFQKRYPKVAIRQAYGLTETSTVVTATHFDDIVPGSSGWLIPGVEARIVTPEGEDITKYDTPGELWVRAPSVVLGYLNNEKATKETFGDGWMHTGDEAVIRKSPKGNEHVFIVDRIKELIKVKGHQVAPAELEAHLLTHPAVADCAVIAIPDDAAGEVPKAIVSKSPEAGPDDEATVKSIVKYVQDHKARHKWLKGGVRFIDTVPKSPSGKILRRLLRDQEAAMRRQAGSKL

SEQ ID NO: 57477 - protein, 338 aa, Sulfolobus solfataricus P2
MRLYELSFAQIEDFFYKLAEVKDIIKDHGLLEFLPEFKKLDSTVHTGTTRVKHAFPIFQKGGVVMDITNVQQAQIAEEAGAVAVMVLDKLPYDVRKSGGVARMADPKIIEEVMSSITIPVMAKVRIGHYYEAKLLEALGVDMIDESEVLTPADEEHHINKWEFSVPFVNGARNLGEALRRTSEGASMIRTKGEAGTGNVSEAVKHMKIINSEIRSLISMSEEDRVKKAREYQVPYQIVELTAKIKRLPIVNFAAGGIATPADAALMMWLGADGLFVGSGIFKSQDPDERAKAVVLAAACWEYPEIVLEAQKMISEQKSMMGIDIKSLKPEELLQVRGL

SEQ ID NO: 57478 - protein, 181 aa, Catharanthus roseus
MGLSFTKLFSRLFAKKEMRILMVGLDAAGKTTILYQLKLGEIVTTIPTIGFNVETVEYQYISFTVWDVGGQDKIRPLWRHYFQNTQGLIFVVDSNDRDRVVEARDELHRMLNEDELRDAVLLVFANKQDLPNAMNAAEITDKHGLHSLRQRHWYIQSTCATSGEGLYEGLDWLSNNIANKA

SEQ ID NO: 57479 - protein, 514 aa, Oryza sativa
MGGILVPYVCGACGPGRTGGKRGFAIRGSEATKSRHDAPQSPASTVARGVGGVPGASWGWFFQAAAGSPELDPAEERISGKGAAKLLDGRLVVALRARIHADPAPEFDQFDCLPDPVVLLILNKLEDVRSLGRCAAVSKRFSGLVPLVSDVYVKIDRVVATDGDADDALNLSSAKPKNIFSHFFKLMLFTIVKPFHSMRNLNGTGRPLFPLAQHSPVHVLRNFSDVWNLRVELPSGDVGTEEGVLLKWRAEYGSTLRNCVILGGTLVDRKPIGAEHESSVEDNGSMPESFYTNGGLKLRVVWTISSLIAASTRHYLLRSIIKDHPTLRSLVLADADGQGTLYMGMEQLREFRENKLSASACSNRTQVPACNMKLKYAPYLELPGGMTLQGATLVVIKPSNDGGSGGHSSRKETEAFVSSAFDEPFRFAVKALMKRRTYLLEMNASGSSTTALYVGLGQAPPRRRPRALPRHLQGVGFFRTAKETRHCQPLPRCLDIGIGLSLFVVLQVTTTRKG

SEQ ID NO: 57480 - protein, 489 aa, Acidobacteria bacterium Ellin345
MQGESRVMSSSKGNGNGTPTVPQARAEWVKKRKEEAARTGDDNVSQMHFARKGLVTEEMLFVAERERVSPEIIRAEVAAGRMIIPANINHPELEPMAIGIESRCKINANIGNSAVTSDVETELKKLHTSVHHGADTVMDLSTGGDIHDIREAIIRHSPVPIGTVPIYEAVSRVKRIEDLTADLMLEVIEEQAQQGVDYMTIHAGVLIQYLPLVAKRITGIVSRGGAILAQWMAHHHKQNFLYERFDDITKILKKYDVSYSLGDGLRPGCIADASDEAQFAELKTLGELTTKAWEYDVQTMIEGPGHVPLDKIKEQVEKEVEWCHGAPFYTLGPLVIDIAPGYDHITSAIGAAIIGWHGASMLCYVTPKEHLGLPNEKDVKDGIIAYKIAAHAADVARHRPGAQDRDNALSHARYTFDWESQFNLSLDPETARSMHDETLPDAYYKEAAFCSMCGPKFCSMNYSSKVDEYNKKVHGIDKAEFISQLTVLK

SEQ ID NO: 57481 - protein, 545 aa, Debaryomyces hansenii CBS767
MGYEDKLLGPALKFRNFLDKFPNIHNVYIVVGISCISGMMFGIDISSMSLFIGDDKYLDYFNSPDSTLQGFITASMSLGSFFGALFSAFISEPFGRRMSLMFCAFFWCVGAAIQSSSQNVVQLIIGRFISGFGVGFGSSVAPVYGTELAPRKIRGLIGGLFQLSVTLGILVMFYVCYALHYINGVASFRLSWGLQIVPGLLLFIGCFFIPESPRWLAKQGCWEEAEYIVAMIQAKGNREDPDVMIEITEIKDQILTEENIKAFTYADLFKRKYLLRTVTATFAQIWQQLTGMNTLMYYIVYVFDMAGYQGDANLIASSIQYVLFFVMTAPSLYLMDKLGRRPILLSGAAFMMIWQFAVGGLLSTYAEPTNDVGGNDTVRLRIPADNSTAAKGVIACCYLFVVSFAYSWGVCIWMYCAEVWGDSASRQRGACFTTSANWIFNFAIAMFTPSAFKNITWKTYMIFATFCGCMFLHVFFFFPETKGKRLEEIGQMWDEGIPAWRTAAWEPSIPFLSDNDLREKLEVKHVEDSNSSNSDAEKPSAVHIA

SEQ ID NO: 57482 - protein, 379 aa, Aspergillus nidulans FGSC A4
MASTVGKTITCKAAIAWAAGEPLSIEDVEVAPPKAHEVRIQVLHTGVCHTDAYTLSGKDPEGAFPVILGHEGAGIVESVGEGVTSVKPGDHVIALYTPECRECKFCKSGKTNLCGKIRATQGKGVMPDGTSRFKARGKDLLHFMGTSTFSQYTVVADISVVAVTDKIPTDRSCLLGCGITTGYGAAVVTAKVEEGSNIAVFGAGCVGLSVMQGAVKNKAGKIIAVDVNDAKEEWSRKFGATDFVNPTKLNGQTIQEKLIEMTDGGCDYTFDCTGNVGVMRAALEACHKGWGESIVIGVAAAGQEISTRPFQLVTGRVWRGCAFGGIKGRTQLPGLVDDYLDGKLKVDEFITHREPLANINTAFEQMKAGDCIRCVVDLS

SEQ ID NO: 57483 - protein, 477 aa, Symbiobacterium thermophilum IAM 14863
MYIGGEWREAVSGRRFEVTNPATGEVIATVPDAGREDARAAIEAAHAAFGEWSSLPAHVRARYMRRLYDLIVQNVDRLARVLTEENGKPLAEAKGEVFNGAEYLNWYAEETRRIYGETIPSSSRRTRIWVLRQPVGVVGAITPWNFPSSMVTRKIAPALAAGCTVVLKPAEQTPLSALLIAELIHEAGLPAGVVNVVTTLDPAAVGQEFLENRLVRKISFTGSTEVGKHLMQGAAAQMKRVSMELGGNAPFIVFEDADLDAAVQGVVISKFRNAGQTCICANRIYVQESIAPAFTERLVEAVRGLRVGHGLEEGINVGPLIDEAAYVKVEGHVSDARGKGARVLTGGHRLTGPGFDRGFFYAPTLLDQVSDEMRIVHEETFGPVAPILTFRTEEEVIRRANDTNYGLAAYIFTRNLGRTVRVSEALEYGMVAVNDSLLAVPQAPFGGVKESGLGREGGHHGLDDYLEYKYLSVVLDG

SEQ ID NO: 57484 - protein, 353 aa, Streptomyces avermitilis MA-4680
MPHIAAVATEPPPGTLSGQHAGSEFAPLLRTVKGQGLLERRHGWYAREIALNALALASVVTGVLLMGTSWWVLLLAPVLAVLSTRTAFIGHDAGHSQITGDKSVSRLIGLIHGNLLLGMSYAWWNDKHNRHHANPNHIDKDPDVAADVLVFTSEQARERVGFRRWLTRNQAWLFFPLTLLEGIALKVSGFQDLRRQPPRERTVEALLLVSHVIGYACLLLVSMSPGKALAFAAVHQALFGLHLGLSFAPNHKGMEMPDPDATRLGHLRRQVLTSRNVRGGPLTDWFLGGLNYQIEHHLFPSMPRPHLRLAQPLVRAHCRETGISYVEAGLVDSYRQALRHMREVGEPLRSQYP

SEQ ID NO: 57485 - protein, 114 aa, Escherichia coli
SNIIKQLEQEQMKQDVPSFRPGDTVEVKVWVVEGSKKRLQAFEGVVIAIRNRGLHSAFTVRKISNGEGVERVFQTHSPVVDSISVKRRGAVRKAKLYYLRERTGKAARIKERLN

SEQ ID NO: 57486 - protein, 929 aa, Desulfotalea psychrophila LSv54
  misc_feature (198)..(198): Xaa can be any naturally occurring amino acid
  unsure (1)..(929): unsure at all Xaa locations
MARSRVNKAVASTATTSKRVTLNPKVARRSFLKISAATAALTGAAMTTNLTKKASASGKKSPYEGSKTVRTICTYCAVGCGIEAEVHNGVWVRQNVAVDHPVSRGGHCCKGAGAIDMVTSPKRMKSPMKRINGKWTPISWDRAMGEITDKLKSIREKDGPDALHFNGSAKVSNEMAYQIRKFAAFWGSNNIDHQARIXHSATVAGVANTWGYGAMTNSLNDIRHAKSMIFIGSNAAEAHPVSMQHILHAKEKNNAPIIVVDPRRTKLAAKADEFVRIRPGSDAAFMMGLIHVIVKNGWEDKEFIRTRVSGYEEMIEVTKKYTPEEVEDVTGIPAAQTIKVAKMLATHRPTSLTWCMGGTQHSIGSSITRSFCLLQLVLGNMGKSGGGTNIFRGHDNVQGATDMCILSHSLPAYYGLSDGAWKHWCRVWGVDYEWMVSRFPAKEWMNKKGFTLARWYEGVLNEEKIHQPSPIKALIQWGCGANSNSQYGRVKRAYNKLDLLVIVDPFPTMAAALCETDNVYILPSASQYETQGSVSSTSRQIQWRYKVVDPIYNSRDDYDILRDFVTRLGFADKFYKNIKQEPEDITRELGSGSLTIGYNGQTPERIKAHMENWHTFDIDTLQAKGGPCDGEYYGLPWPCWTQEHPGTPILYDMSKSVAEGGLPFRNRFGVEKTYDSGRTENQLAAEGTYTPGSEVKGGYPEFKDVVPGTNWKTDLSQKTIKDAISRGMAPFGNARARCIVWTFPDQVPVHREPLHSPRPDLIERYPTYQDQTNHFRVDTRFESEQNPNLIKEFPYILTTGRQVEHMGAGAETRSNQYLAELQPEMYAEINPRLANNLGIRKDAMIWIESPEGGKIKVKAFVTERVDEKTIFLPYHFGGSWEGESLVDKYPEGHAPWVVGDSANVVVNYGYDIVTQIQATKDGLCKISLA

SEQ ID NO: 57487 - protein, 725 aa, Arabidopsis thaliana
MRLLKVATCNLNQWAMDFESNMKNIKASIAEAKAAGAVIRLGPELEVTGYGCEDHFLELDTVTHAWECLKELLLGDWTDDILCSIGMPVIKGAERYNCQVLCMNRRIIMIRPKMWLANDGNYRELRWFTAWKQREELEEFQLPIEISEALEQKSVPFGYGYIQFIDTAVAAEVCEELFSPLPPHAELALNGVEVFMNASGSHHQLRKLDIRLNAFMGATHARGGVYMYSNQQGCDGSRLYYDGCACIVVNGNVVAQGSQFSLRDVEVIISQVDLDAVASLRGSISSFQEQASCKVKVSSVAVPCRLTQSFNLKMTLSSPKKIIYHSPQEEIAFGPACWMWDYLRRSGASGFLLPLSGGADSSSVAAIVGCMCQLVVKEIAKGDEQVKADANRIGNYANGQFPTDSKEFAKRIFYTVFMGSENSSEETKRRSKQLADEIGAWHLDVCIDGVVSAVLSLFQTVTGKRPRYKVDGGSNAENLGLQNIQARMRMVLAFMLASLLPWVHSKPGFYLVLGSSNVDEGLRGYLTKYDCSSADINPIGSISKMDLRLFLKWAATNLGYPSLAEIEAAPPTAELEPIRSDYSQLDEVDMGMTYEELSVYGRMRKIFRCGPVSMFKNLCYKWGTKLSPAEVAEKVKYFFKYYSINRHKMTVLTPSYHAESYSPEDNRFDLRQFLYNSKWPYQFKKIDEIVDSLNGDSVAFPEEEANSNKEIGVVAANSGDPSAGL

SEQ ID NO: 57488 - protein, 619 aa, Synechococcus elongatus PCC 7942
MHGVPIARRLMTEDGSLVYDPEAIARYYLNRPFAVWSRFLEILWPLFSFIFGLWFDARTGASRRNQNQRAVQLRDLLTELGPAFIKVGQALSTRPDLVPPAYLEELTRLQDQLPAFPNAIAFEFIEAELGVPPEAIFAELSDNPVSAASLGQVYRGRLHTGEEVAVKVQRPGLAERIALDLYILRGLAAWAMRNVRRVKSNLVAIADEFGLRIFEELDYRQEADNAERFAELYGQLPDIYVPSIYRQYTSRRVLTMEWIQGTKLTELQAIRNQGIDPAYLIERGVQCSLRQLLEYGFFHADPHPGNLLATPDGQLAYLDFGMMSQVEDYQRYGLIEAVVHLVNRDFQGLARDYVKLEFLTPDTDLTPIIPALAGVFKDAMGASVADLNFKSITDQLSQVMYDYPFRVPAYYALIIRSLVTLEGIAINVDPNFKVLSKAYPFIARQILTDPSPDLRASLRELLFNGGQLRWNRLENLLRNASNSSDYDSEHLIQQTVDFLLSESGQDLRDRLVEELVNSLDRLGRGALPLLRNQIRQRLGMDPEPDSTLTDLQPLLRVLSLLQQGQRFEPQRFIPLIPVLGRPEVQQMGQQVVTGLAQKALVRFIREVVVGDRRNNAIAA

SEQ ID NO: 57489 - protein, 69 aa, Eschscholzia californica subsp. californica
  misc_feature (1)..(1): Xaa can be any naturally occurring amino acid
  misc_feature (6)..(6): Xaa can be any naturally occurring amino acid
  unsure (1)..(69): unsure at all Xaa locations
XRKVLXNNIQGITKPAIRRLARRGGVKRISGLIYEETRGVLKIFLENVIRDAVTYTEHARRKTVTAMDV

SEQ ID NO: 57490 - protein, 286 aa, Candidatus Desulfococcus oleovorans Hxd3
MHSVDTATRLCAVIGNPVEHSLSPAIHNAAFAARNLNFVYVAFRVNDVGPALAGMRALENFRGMSITIPHKISAIGHVDEITDLDRAMGAINTVVNEKGRLTGSNTDGPGALKALKNAGVETSGKTVLMLGAGGVARAIAFTLAWQADIAELVLLDIDSALREQLSSDLKNGTSATITAAGFENKALAHAMARADIVIHCTPVGMHPKTDASLVPPDLFRPGMAVFDVVYNPLETKLLTEAAAFGLKTVSGVELFVNQAVLQFEKFTGETGPADVMRRVVMEHLKS

SEQ ID NO: 57491 - protein, 332 aa, Arabidopsis thaliana
MATDFKSLPVIDISRLLLKCDDPDMAEDVGVAEVVQQLDKACRDAGFFYVIGHGISEDVINKVREITREFFKLPYEEKLKIKMTPAAGYRGYQRIGENVTKGIPDIHEAIDCYREIKQGKYGDIGKVMEGPNQWPENPQEFKELMEEYIKLCTDLSRKILRGISLALAGSPYEFEGKMAGDPFWVMRLIGYPGAEFTNGQPENDIGCGAHTDYGLLTLVNQDDDKTALQVRNLGGEWISAIPIPGSFVCNIGDMLKILSNGVYESTLHRVINNSPQYRVCVAFFYETNFDAVVEPLDICKQKYPGGRGGCQVFKRAVYGEHLVSKVQTNFAM

SEQ ID NO: 57492 - protein, 125 aa, Oceanicola granulosus HTCC2516
MRKAIIVEDAIPPVGHFSHAVILNGTVYASGQGPQDPETGAVPDDFEAQVRQTLRNLETVLKGAGSSLADVLKMNVYLTDATRFADFNRVYAEFFPEEPPARTTVSCQLIGILVEIDCIAAVREE

SEQ ID NO: 57493 - protein, 127 aa, Desulfovibrio vulgaris subsp. vulgaris str. Hildenborough
MADRYPILPGGAPAPVAPYSPGMVCGSFLFVSGQLPLDAATGVLIEGDIRERTRQALRNMQAVVRAAGCELSCAVRVNIYLADMNDFAAVNEVYKTFFCKPYPARTAIQAAALPLGSDILIDGIFAL

SEQ ID NO: 57494 - protein, 832 aa, Desulfovibrio vulgaris subsp. vulgaris str. Hildenborough
MNWTWQTLRIPCALTLLWCLLLLGLYRWNADSEADHIHELALLQARSFFAQIVATRAWNAVHGGVLVPESAYGPPNPYLPEDDRVVTTSDGQRLTRVNPAYMTRQISEILNDREGVGFRITSLFPLRPENAPDVWEKAALDKFRYGEKEVFTLEQGMKGSLSHYRFMAPLATDATCMNCHRDERDVTGGQRGGISVALAAAPLLAVQADRLNTLSITYWCIAIVGVFGIGGATLLISSRQAVAEAANRMKSAFLANMSHDMRTPLTGIIGMADLLEAPGCPPERRSAYIAQLKGASANLLEIVNDITDYSCLESGRLRLLPRHFALRNAVDECLGLFRFTCEQKGLTLTADIPPGLPDSLTGDDFRLRQALGNLVSNAVKFTRRGTITVAVREEERSAEDVMLRFTVQDTGVGIPLHEQDAIFESFVQGGAAHELRMGGTGLGLAITRDIAAMCGGTAGVHSTPGTGSSFWFTARLGIATEQEARADRRQPLVQDSHVPYRSPLPPSEEVLPHQTGDSAAMTCSPASLSVASPAHRLRILVADDNPVNRLFLHDALTGAGYDVMCASDGLEALECLADGRGFSLALLDVRMPGLDGLDVLRHMRAGDVPGIRPDTPVLMVTASAAGDERAQLLNAPADGVIIKPLRVATLLEQVHRVLHPGTAAMAAASPPALPPSSHCPGDAPLPSASAASYPPPVAPLSTVASQQQDTTPLPVHDTQAALADLAGNEGLLARLYAAFLDDVPTRRTALMRTLEVRQTSEWDLAPLRREAHALCNSAKALHLGHLAASTSALEMACVAGAPDRRMLEAVITDLAGAETTLTALLQATREDA

SEQ ID NO: 57495 - protein, 465 aa, Pseudomonas straminea
MTSQTSKQNTDPTVVNVQTVLNESPFSGFQWGIFFLCFLIVLLDGFDTAAIGFIAPSLLGEWGIDKSHLGPVLSAALFGLAFGALGAGPLADRVGRKTVLIIAAVVMGGASIASGLVHDLQGLTIWRFITGLGLGAAMPNAITLMNEYCPDSKRSFITNCMFCGFPIGSAFGGFIAAWMIPHFGWRSLLIVGGVVPLILAVLMIVMLPESVRFMVLKNYSADRVRKVMVRIAAGTRNAARFVLNDGGAAAAQAQQGPQGLRLVFSQKYLVGTLALWVTYFMGLVIVYGLVNWMPVLFKEAGVPASQAAVIAALFQLGGVGAIFVGLLMDRWNANLIIAAGYFLTSLGVAFIGQVLGGGVGMLVASVFIAGLLMNAAQSSMQALAAEYYPTECRASGVSWMLGIGRFGGIAGSFLVAELSRRHLELPQVFMVVAIPGVIAALALLVKNRYAGGAPRTSMLGLGGAH

SEQ ID NO: 57496 - protein, 964 aa, Spinacia oleracea
MSSLYNPIALASSFHHHYPNLRFLPFNFNFITKLPVSNSFAIGSSSRSFHSSPLKKDSSCFCCSMAVEVGSASSVSQSELQGSLNSCRAYWPSKYTFAWNVDIGNGSYYLFASKTAALKFTDAGIEGYDVKIKLDKDQGGLPANVTEKFPHIRGYSAFKAPATLDVDSLLKCQLAVAAFSADGACRNATGLQLPGVIDELYSYDGPLGAVFSENTISLYLWAPTAQAVSASIFKDPSGGEPLQTVQLIESNGVWSAVGPRTWEGCYYVYEITVYHHSTLRIEKSFAIDPYARGISADVKRTLLADLSSETLKPEGWENLADEKPHLLSPSDISLYELHIRDFSAYDLTVHPDLRGGYLAFTSQDSAGVNHLEKLSAAGLTHVHLLPSFQFAEVDDDKKKWKFVDTKRFETLPPDSEEQQAQITAIRDEDGYNWGYNPVLWGTPKGSYATDPNGPCRIIEFRKMVQALNRIGLRVVLDVVYNHLNSSGPSDDNSVLDKIVPGYYLRRDNDGAIENSTCVNDTASEHFMVERLILDDLKHWAVNYKVDGFRFDLMGHIMKHTMVKATNMLQGLSKNIDGVEGSSIYLYGEGWDFGEVANNARGVNASQLNLGGTGIGSFNDRIRDAVLGGGPFGPPLQQGYVTGLSLQPNDHDHSGKANADRMLAVAKDHIQVGMAGNLRDYILTNCDGKQVKGSEVYTYGGTPVGYAMQPIETINYVSAHDNETLFDIVSLKTPTYITVDERCRVNHLATSILALSQGIPFFHAGDELLRSKSLDRDSYNSGDWFNRLDFSYNSNNWGVGLPPKDHNESNWPLIKKRLANPSYKPDKNHIIAAVENFTNLLQIRYSSPLFRLRSAKDIEDRVRFHNNVPSWIPGLIAMSIEDGHAGAPGLSQIDPKFQYIVVIINVQPTETKFVNPDLRAKSLQLHPVQSTSGDTVVKESKYEPSTGCFTIPPKSTAVFVEPRHV

SEQ ID NO: 57497 - protein, 458 aa, Oceanicola granulosus HTCC2516
MPARSPASGQPIGTLPRSSREDAQRAVAAARDAQAGWAEVSVWERADACLRIAAELEARRERVADMLVLEQGKPRAEAEGEVGAAVAGFRLAAEEVRQLGGETIPTEDGGKLALTIRQPRGVFAVVTPWNFPINIPVEYLGPAIASGCAVVWTPAPTTAFCAIELAEAIEAAGLPAGVVNLVIGEGPVVGDEIVSHPGTDGIGFTGSTATGQRIAERGAGKQMLLELGGNGPVIVFDDADLDRAAEAAAAAAFLNAGQVCSATERVLVHRDVVDAFADKVARIAKAKVLGDPAARETQMGPLNNAQVAQKTREHVEDALNHGATLLAGGRSRDDLGSELFYEPTVLTGVTADMRINREETFGPVVPILAFDSDDEALALALDNDYGLTSSVFTRDLGRALRFGKSLRSGIVNVNEAPSYWELHLPFGGGAGRKSGTGRIGGRHTLEAMTVIKTIVLQA

SEQ ID NO: 57498 - protein, 358 aa, Oryza sativa (japonica cultivar-group)
MAGCLWPCVTGGGAAADGAGSLFRSKARGPVEVVRHARELLAFLAENHDACGDKRDVKREHKMVDLAKSIGEMKSILYGNGEADPVDEACSQLTKEFFKENTNSLHLLVVCLPYMDLETQKDVTQVTANLLRQKVDYRMVASDYLEENQDLLDVLMSGYDNMDIAIHYSAILRDCIRHQVAARYVLESQHMKKFFDYIQYPDFNIASDAFKTFKELLTRHRSSAAEFFSNNYDWFFPEFNSKLLSSSNYIIRRQATQLLGDILLDKSNTTAMVRYVSSKDNLIILMNLLREQSRAIQVEAFRVFKLFTCNPKKPPEIVGILVTNKSKILRFLADFTIEKEDQQFEADKAQVVTEISAM

SEQ ID NO: 57499 - protein, 174 aa, Medicago truncatula
MPPDFPFLLPCPELLSRKFPILLPSYKASSSFTNVESQFASSRSGSVIPTRIGSYQQHHGFPFLLPSLLHSSISMNPTTTTPSISSPLEPLNKIGDFKALGRCCVVSRHFHSLVPQVANVVVRVDCVISDDDSNSSENSSDKSRGPFWNLLRLVFGGIAKPIQNLGQFLGPQRG

SEQ ID NO: 57500 - protein, 500 aa, Debaryomyces hansenii CBS767
MNINPHLQYLQQQQQSQQPMNASVQSPQISQLQLQQQQQLQQQRQQLLNHHLQQQPQQQLGTPNASQVSTNPLLSAINASNQSGGSVNAGAGTSSNQTVNTALQIQLQQQLQQHQQQIFQQQLQGQHNHPVQQQQVPIIKEVWSHNLEQEFHALRSFVNDNKSSPVYIAIHQEIPGIVARPVGTFKSSSDYHFQTLRSNSDLLNLIQLSLCVTKVNKNNEIRSSIIWQFNFLYDLTKEMYNEEHLTMLSQTSQINFQLHMTQGIPHFAFAELITESGLLLDTSINWISYHAGYDLGFLISLLINDNLPLDEKDFYWWCSKYFPNFYDLKLIGNQLVNNFSNNNSNSNNSKSNGNSINNGPSNSVEMPTGGSNSDSSKNMISNNKPSIEYLAEELHLLPISPVIRQYFASSNSHFPGQQHQQMTSTLHAYLSMECFKELLRQAGYDNSILEKFKGVIWGLGSVYGSSTSEMTQQNGSVSNTTPSTPGTSAKSGVVHFGRPL

SEQ ID NO: 57501 - protein, 991 aa, Acidobacteria bacterium Ellin345
MLRRLSLPVLILLCTLAGYAQGPTQARIHYYRPDAQFAGWGLHVWNNTTDNVTWTTPLQPAGSDSYGIYFDVDLFDATTPLGFIIHKGDTKDPGPDMYMDVTQPGRNAWIISGDSTIYYTQPTKSQLLSANFHRLQAYWIDRNTIAIQAAYFHSGDTVRLHSDLSAGLAITDTGLTGGQSTLLTPDPSGLTPAQLATFPQLNGYAAFHLQNARSFNYAMYLKGQVAVSDVDSAGNLTYATGVQTPGVLDDLYFYSGKLGPSFRGTVPTVSVWAPTAQSVALQLFNAATDATPTQVVPMHESNGVWSVQGKPQWKNKYYLFNVKVYTPFTFSVVENVVTDPWSLGLSLNSTKSQIIDLDDASNKPLGWDLLPSPPLASWNDLSIYELHIRDFSATDSTIPAVQRGTYLAFTDQTSNGMKHLRSLSQSGLRAVHLLPNFDIASVNEDKTTWKTTGDLSVYPPDSDQQQAAVAAIQGQDGFNWGYDPLHYLTPEGSYAVNAASRTKEYRAMVESLHANGLRVIQDVVFNHTSSFGQNPNSVLDEVVPDYYYRLDANGANYFASCCADTATEHRMMEKLMIDAVTTFAKEYKVDGFRFDIMSFHLLSNIQHVRQALDQLTLRNDGVDGRKVYLYGEGWNFGETGNNALGKNAMQSNLYGTGIGSFNDRTRDGVRGGGPFNDVREQGFATGLFTDPNTTFSIGDSDTQKAKLLQESDWIRIGLTGNLRDYSFTDSNGNTVTGGSVDYNGQHAGYTAQPIEDISYASAHDNQTIFDAVQLKSNITDSIADRTRRQNLANSLILLGQGIPFFHAGDDILRSKSGDNNSYDSGDWFNKIDWTLQTDNWGVGLPIASQNSFQWSDLQPLLADPALMPQPANIQRAYDHFCEMLRVRYSSPLFRMSTEPQIQANLRFLNVGPNQIPGVIAVVLGTGRQQIVVVFNGSNASQTISDASLANLRLQLHPVLQHSTDPVVKQSTYNSNGSVTVPALTTAVFTPR

SEQ ID NO: 57502 - protein, 405 aa, Streptomyces avermitilis MA-4680
MKRILVVGASAAGLTAAETLRREGYDGTITLVGDECHAPYDRPPLSKQLLAAEWEPERLALRTPGDLEALDLDLRLGVAATGLDVTDRTVRLADGSSVPYDGLIVATGVRPRRLPGEGAHVLRTVDDALALRDRLGPGTRLVVVGAGFLGAEAAAVARRLGADVTLLEPAPVPLAHAVGAEVGEVLSRAHLEHGVELRTGVTVTEVTDEGVRLADGEVVEADEILVAIGCLPNTEWLKGSGLTLGDGLVCDAYGEAARSVYGAGDVARWHNPLFGVSMRIEHRTNAAEHGMAAARNLLRPEARRPFAPVPYFWSDQYDMKIQAYGYFRAHDETVVVEGDLAERRFVAAYRTGDRLTGALAAGLPPRAIRRWRQAIAAGATWREAVRDNISPATAPWGSVLPEKIT

SEQ ID NO: 57503 - protein, 607 aa, Rhodospirillum rubrum ATCC 11170
MKSDAPSDRPSVDRPPTLPPRALRLSGLGVGPGICVGTVHLHEIGSVPVPEYKIPAARVEDECARLAEAAEQGSRQLGMLRGRARELPGGAGEELGYLLDAYQNMLKGSRLLRGVESRIINEKINAEAAIRNEMDAMADVFSAMQDSYLASRIEDVKDVGWRLIRVLTKAAYRPFTLLPRNAVIVAGELSPADTALLDPKQVAGMALSSGGADSHTAIMARSLGLPAVLAIADLMRHVRSGDIICLDGRTGEVVIDPDRETLADFRKRRADFLRGRRNLGRLRDLPAETRDGARVRLMANVELPAEVESARQSGAEGIGLLRSEFMFMNRTVLPDEEEQYHFLRGMVAGMAGRPVTVRTLDVGGDKLSDALGLRDCANPALGLRAIRLSLSRPELLEIQLAAILRAGVHGPVRILLPMISTVEELDAVREIHAKVVARLRQRGVPLPEPLPPLGVMIEVPGAALSADALAWRCDFFAIGTNDLTQYTLAIDRSDESVAHLYNPLHPAVLRLIQFTVEAAERAGIPVSVCGEMAGDPRLAAVLVGLGVTELSMSAANIPRVKQNIRRLSMIDVARQIQAIMAINDAPRIAALADALLIESDRVSEKLA

SEQ ID NO: 57504 - protein, 356 aa, Zea mays
MDRGERLGRALDAFGGNLWALVDAALDAAARDRPDELRARRDSIVERLYAAAAGCSNCAGRPPSVAALAAAGLEEEDGEEAAPASPWAEADAQAGGAEAQTEVLGAGEPDLESKIVAIRDFLEDPNQPENELVSLLQNLADMDVTYNALQETDIGRQVNGLRKHPSAEVRRLVKQLIRKWKEIVDDWVRLDNSGGDGSASVMTADGDSPHKIQGRSHQSPRVSGFQYSPSPQRFNGSTSEMANNGFESTMDAKRRASPVPAHHNSRQMNNNHHSTTITTSTSSAPAKVTREQKQSLVDLDRLDSARKRLQENYQEAQNAKKQRTIQVMDINDIPKPKSRNAFIRKSGSGGLPARHR

SEQ ID NO: 57505 - protein, 481 aa, Glycine max
MLDSATPHDKITTAASGFVLEDVPHLSAYIPHLQTYPDPLQDNPSYSVVAQYYVNVDDTIAQQIVVHKNSPRGTHFRRAGPAQKVYFDSEEVHACIVTCGGLCPGLNTVIREIVCGLYHMYGVHKVLGIQGGYPGFYSRNTVPLTPKVVNDIHKRGGSILGTSYGGHDTSKIVDSIQDRGINQVYILGGYGTQYEAAMIFEEVRRRGLKVAVVGIPKTIDNDIPVIDKSIGFDTAVEEAQRAINSAHVEAESAENGIGVVKLMGRYSGFIAMYATLASRDVDCCLIPESPFYLEGPGGLLEFIEKRLKEQGHMVIVIAEGAGQELLSGNPSIVNKPDASADKLFPDVGLWLSQKIKDHFEKRQKMAINLKYIDPTYMIRAIPSNASDNVYCTLLAQSAVHGAMAGYTGFTVGPVNGRNCYIPFHLINEGEKRVVITDRMWARLLSSTHQPCFLNPKEITGEREERTENQTTDGQNHSEIAD

SEQ ID NO: 57506 - protein, 428 aa, Cryptococcus neoformans var. neoformans JEC21
MSSCLPVTLTRTRTRTRTLTLTLHPAMPSTKGVILVGGPSKGTRMRPLTLDCPKPLLPVAGKPMIWHPLQALSKVPDLTEVIIIGFYDDSQMAAFVKEAKREFPNIAISYLREYKALGTAGGLYHFRDSILRPPVPQHIFICNIDICCSFPFAEMLELHTSHGGTGTIMGVNVKKETATQYGCIVTDPETNQMVHYVEKPEGWISNIVNGGVYLFDKSLFDVIKVAMDEKTARAAEDPLVKPDEILRLEQDVIVPLAAARKMYVYQTHDFWRQIKTAASAVTATALYLSNYKLTNPSLLAPAAPNIIAPTFIDPSATIDPSAKIGPNVAIGPNVTVGPGVRIKDAIVLEGSTLEKHSCALNSIVGTNSHIGAWSRVDGEQEFEREVKGKISVTILASEVSLAPETMVRSCIVLPNKTLTKNATNQVLL

SEQ ID NO: 57507 - protein, 335 aa, Allium cepa
MEVERVQAIATLTANLGTIPSEFIRSDHERPDLTTYHGPVPELPVIDLANSSQENVVKQISEAAREYGIFQLVNHGIPNEVINELQRVGKEFFLLPQEEKEVYATVPDSGSFEGYGTKLQKDLEGKKAWVDYLFHNVWPKHKINYKFWPRNPPAYRKANEEYTKHLQVVVDKMHSYLSLGLGLESHVLKEAVGGDDLEYLLKINYYPPCPRPDLALGVVAHTDMSSLTILVPNEVPGLQVFKDDHWFDAKYIPNALICHIGDQLEILSNGKYKSVLHRTTVNKEKSRMSWPVFCSPPGDTMIGPLPQLVNDGNPPKFKTKKYKDYAYCKINKLPQ

SEQ ID NO: 57508 - protein, 352 aa, Haemophilus somnus 129PT
MSINFVKEGNIMSKYVRSVCLVEPKKVDIKTVLYPKKGECDVLIKVESIGICGSDIGAFRGTNPLVTYPRILGHEIVGTVIESGVGMPKNINIGDRVILEPYIYCGHCYPCSISRTNCCEALKVLGVHIDGAMQEIVRHPAHMLIKAPDIPIHELALAEPLTISLHAIRRTKVKAGEHVAIIGAGAIGLMAALVAKAYGATPILIDILDKRLDYAKSIGIPNIINPAKENDLEAIKSITNGRMAEVVIEASGANIAVQNTLKYTSFAGRIALTGWPKNETPLPTNLITFKELNIYGARTSKGEFEEALKLLESRKIEPKNIISKVITFDEIPHYIEELSENPDDYLKIIAVF

SEQ ID NO: 57509 - protein, 474 aa, Lactobacillus rhamnosus
MRKQLPKDFVIGGATAAYQVEGATKEDGKGRVLWDDFLEKQGRFSPDPAADFYHRYDEDLALAEAYGHQVIRLSIAWSRIFPDGAGAVEPRGVAFYHRLFAACAKHHLIPFVTLHHFDTPERLHAIGDWLSQEMLEDFVEYARFCFEEFPEIKHWITINEPTSMAVQQYTSGTFPPAETGHFDKTFQAEHNQIVAHARIVNLYKSMGLDGEIGIVHALQTPYPYSDSSEDQHAADLQDALENRLYLDGTLAGDYAPKTLALIKEILAANQQPMFKYTDEEMAAIKKAAHQLDFVGVNNYFSKWLRAYHGKSETIHNGDGSKGSSVARLHGIGEEKKPAGIETTDWDWSIYPRGMYDMLMRIHQDYPLVPAIYVTENGIGLKESLPAEVTPNTVIADPKRIDYLKKYLSAVADAIQAGANVKGYFVWSLQDQFSWTNGYSKRYGLFFVDFPTQKRYVKQSAEWLKQVSQTHVIPE

SEQ ID NO: 57510 - protein, 399 aa, Symbiobacterium thermophilum IAM 14863
MERIIKVCPDLWLPGGGAVPTRILLLSADFGSGHLAAATAIAAACRSLSADCEAVVVQCRSPLLGLVGRAYLWQIRHTPDLYRQLYRLPPGRPLRRLVIRVLSGPVRRALQQYNPDVVVGTHPFPAGAALHLLNRSWPKRVPVVMALTDFAPHGFWIWPGVARYFTASEQAARELVRRGADAAAVRATGIPVRMALAADGTGADRTAGPTAGSSSSGVRRVLVIGGGLGLGPIAAAVDALLSLPRPDLRVTVICGRNEALLDQIRRRHGSDARLTALGFTDQVLDHMREADLLVTKPGGITCAEALALGLPMLLLDPLPGPEEENAAYLAGSGAARVVGVKRLAGAADDLLFRRPERLAAMAAAARQAGHPASALAIAAEVLALADAPRAQVAGITPSS

SEQ ID NO: 57511 - protein, 356 aa, Glycine max
MGKLLCDSTSVAEPFQGSPPAALPWREPKPEPIGTVDLVVPANVGGAPFAGGGWEDVVGLEEQQRRHLQRLHAKGVLWKPPPEEEDSSSPLSSSALRSVVFRLSHGGEVSADGNCLFTASRKAMGGEDVDARELRRRTVARFLEDLGSVSFEEREAIDNAIRHMYSPDLKNGWGIHVVQEVKLLAKKEDRFALDSAIEELVHLGMQREMAAESIYKERCVSVNDGPSWAKYMLISGSPDDEYDIITLQYTEEGLLSVDENREGRAAAFGDDIAIECLATEFKREIYVVQAHGSDAMVDEENCVFFLPHRPRSRITEPPFFLFMKGTGWCGAGADHYEPLIAHPSAFVSQEKVAVVL

SEQ ID NO: 57512 - protein, 488 aa, Streptomyces avermitilis MA-4680
MPDLFIDGEWVRGATGTTREVVNPFDATVVRSVDEGDATDVDRAVTAARRAFHAADWAAAPTQRRADVLFRVAEYLLRDIEEIARDETLNTGKTLAEARIDVKDVSNAFRYFAEMAGKDAGRVVDAGPDVLSRVVHEPVGVCALIAPWNYPLLQASWKVAPALAAGNTFVLKPSEITPLTTIAMMRLIEEAGAPPGVANLVLGAGATVGSAMTVHPEVDLVSFTGGLGTGRRIMESAAREVKNIALELGGKNPNVVFDDADFEAAVDHTLDASFLHSGQVCSAGSRLLVQDSWHDRFVRELADRASRIRLGNGLDPHTESGPLSSAEHRAKVEKYIDLGRSEGARLVTGGRRPDDPDLAHGFFLLPTIFDDCDRSMRIVQEEVFGPVVTVETFRTEDEAVELANDTRYGLAAGVWTGEASRAQRVAARLRHGTVWINDFHPYLPQAEWGGYGQSGVGRELGPTGLREYQEIKHIYQNLSPGPSGWFKG

SEQ ID NO: 57513 - protein, 217 aa, Triticum aestivum
MGGGDLYALDFDGVFCDSCGESSLSAVKAAKVRWPWVFEQVDAAMEEWIVEQMHTLRPVIETGYENLLLVRLLVEIQIPSARKSSVKWFYPGTADALKLSSSELYIVTTKQSRFTGALLKELAGVDFPSERIYGLGTGPKVKVLQQLQEMPQHQGLTLHFIEDRLATLKNVMKEPALDKWNLYLVKWGYNTQKEREEAGDIPRIQLIDLPDFSKQLK

SEQ ID NO: 57514 - protein, 144 aa, Zea mays
  misc_feature (17)..(17): Xaa can be any naturally occurring amino acid
  misc_feature (75)..(75): Xaa can be any naturally occurring amino acid
  misc_feature (98)..(98): Xaa can be any naturally occurring amino acid
  unsure (1)..(144): unsure at all Xaa locations
FQVSICIPPPFSVFDIXERRVEDLEPFDFLGNLHIREGFFGQGDAVVFESEVVKVYLSAPPKVVVIVPEKKRNFXLRKEGLPEVFVWNPLDKKGEGYXGMLCVGAAAIEKPVTFKPGEVWIGKPEIFGVPSSYSKGQLAPEIIC

SEQ ID NO: 57515 - protein, 185 aa, Ashbya gossypii ATCC 10895
MFLERGTVTEMPAYNSTFVGDGHDRLVGNFVLLPLNTRFRGPAYAANSDYDIVDECLDLFRANSFFKNFEIKSPADRVLVYGILFTNSCLGQLRPGMSYNEAVKALTNLALDSFTLPGTVGFPLNNVYSVPVEDGAQMELLKGYLQQLRQELATRLLDRVYGAEKAQPSKFWLAFTRRKFMNKAL

SEQ ID NO: 57516 - protein, 423 aa, Desulfotalea psychrophila LSv54
MSDIISAVDAMEVLDSRGNPTVRVFVTLDNGTTCAASVPSGASTGENEAIELRDGDASRYLGKGVLKAVDNVKNIIAPAVIGKKITHQAAIDNLMIELDGTETKSSLGANAILGVSMAVARAGARSSRLPLYQYLGGPGARRIPVPAMNIINGGEHADNSVDIQEFMAVPVGAPSFGEGLRYIAETFHNLKKILKSRGLATSVGDEGGFAPNLESNEAAMDIIIEAIEASGYTPGKDIAFALDSAASSFSPDLCGSYDLKWSGGGKKDSADMIAMAQKWIEKYPIVSWEDPLAENDWAGFQKLTAAVGDKIDVVGDDLFVTNTKYIARGIEEKSANSVLIKLNQIGTVTESIDAVRMCREAGWRYFISHRSGETEDTFLADFAVAMDGGQLKTGSASRSERIAKYNRLLEIERELGANALYYW

SEQ ID NO: 57517 - protein, 508 aa, Flavobacteria bacterium BBFL7
MDEALKQLGIKDINHGTSTGSDCFGNGEEIASYSPVDGKLIGKVTTTTQEDYDVVMDKAQAAFLSFREMPAPQRGEIVRQFGNKLRDLKEPLGKLVSYEMGKSLQEGYGEVQEMIDICDFAVGLSRQLNGQVIPSERPGHVMREQWHPIGVVGIISAFNFPVAVWAWNTALAWICGDVCVWKASEKAPLCSVACQNIIAGILKDNNLPEGISSIINGDYKVGEMMTTDSRIPLISATGSTRMGRIVGATVAQRFGKSLLELGGNNAIIITPTADLKVVVPGAVFGAVGTCGQRCTSTRRLIIHESVYDKVRDAIVGAYGQLTIGNPLDEKNHIGPLIDKDSVNTYLAAIEKAKAEGGNVLVDGGVLEGEGYESGCYVKPAIIEAENHFEIVQHETFAPVLYLMKYSGEVENAIEKQNGVAQGLSSSIMTNEMKEAEKFLSFAGSDCGIANVNIGTSGAEIGGAFGGEKETGGGRESGSDAWKVYMRRQTNTVNYSDELPLAQGIKFDL

SEQ ID NO: 57518 - protein, 324 aa, Zea mays
GTSSFPVAAVHRIGILDIRIFNTDRHAGNVLVRKLNGGTGRFGCQTELFPIDHGMCLPENLEDPYFEWIHWAQASIPFSEEELEYIRNLDPRKDVQMLRRELPMIREACLHVLALCTIFLKEAAAFGLCLAEIGEMMTREFRGMEEEPSQLEVMCMEARKRVAEWEPFSATAEHGEDTDFQFSVDMLGEYSDVVRSPRFNGSGSKVSSFRSPLSKLVESVDEGSDGHEDQNESDRVLYAGWNTSSVPSKAMGHSGNASKSAMNRSADEQLPSSMCFVRLSDMSADEWDVFLEKFQELLKEALHESARAAAGQRMKQRLGTSCKF

SEQ ID NO: 57519 - protein, 385 aa, Oryza sativa (japonica cultivar-group)
MPLPLKWISSLNFQVRCGSIRSDNLDPASASLYQVNPYLSSPHVAGLNDDYNYNVRGDGVEEETSQWLVGAAAHAEIERRNGDGSWRRSGAGGAWRRGKVDNGCCQWNKERSGQRISMMMETELCSSRVLSLPRYDSGDEELSVLPRHTKVIVTGNNRTKSVLVGLQGVVKKAVGLGGWHWLVLKNGVEVKLQRNALSVLEPPTGNEDDDDIDGNNSFCSSSDMGDKDMDYSIIEYHKPTKPRVRHTRPWSSCTKSSNRGNFHPSSILQTRVNLTRLGTPTLWRYWKHFNLVILGFIQAAKRLKTLLERAEQKGDSIRGAFDHTKVVIQCEAMMNLDVNSSNACFPPNPQLIPSLRSLVGGGGTRMQAYDPPVVYGSHWQGNTAG

SEQ ID NO: 57520 - protein, 530 aa, Coprinopsis cinerea okayama7#130
MWQSGRLPMDSPLWKNEKPWLQRLGSNAVMLVEDMKNAVVQFLPASNRRSNRTLTAAPNNSNIAFIFMCGLWYTSSALSSNTGKAILTQFRYPITLTFVQFGFVAAYCLLFMSPLVRFTRFRPPTKEIVFSTFPMGLFQVGGHIFSSIAISRIPVSTVHTIKALSPLFTVAAYALLFGVSYSTKTYISLLPLTIGVMLACSFDVSASNAVGLLCAFGSALVFVSSNIFFKKIMPTNPSGSSAPSHKLDKLNLLLYSSGMAFLLMIPLWLYHDLPVLLASRNHNHVVHPSHGHEPRHSVSYYFFMNGTVHYAQNLIAFILLSSTSPVTYSIASLIKRVAVICIAIVWFSQRIHPIQAFGICLTFAGLYMYNNAKGDVEKGEKKIRRMEAVNSLTLPSTKEDSRMMMGTDTPPEFEVTETTGLGSGTYNPSTYSRARGLSLSSKDGQGLYHNTSSYPHHRTPQAPPTNSFVKTVDARLQSMKEEPEHFRKNSYPSPPPSVDSHSPPVRNAPLPKNVGYAGMQHYNRVAAVAG

SEQ ID NO: 57521 - protein, 421 aa, Flavobacteria bacterium BBFL7
MTYDQEYKNWRRLSKETIDQQIVNALSQNINYYDSLKMGVPASHLDKQEFAPDSQVLDGSTFLKTLINNPNHIGVHTDTDLSEPYFSGTQRLEAEVIKIIAEDILKANPDSIDGYVSSGGTEGNIQAIWVYRNLFNETFDLNKDYSSIAILCSEDAHYSMDKASNLLNIKLSKVEVHSETRAIDLVDLKNQLDALQSQGVNKLILVCNMMTTMFGSVDSLDDYMNVINQYTDMTVKVHVDGAYGGFFLPFTTPEQPLTFDDKRIDSFTLDAHKMLQAPYGTGIFVIRKGLLKYSLTDSAQYVAGMDCTLVGSRSGANAISIYKILMNYGPYDWAERMLALAARTTRLKNHLLDLNVKLIHFENSNIITIHRDFITPLIAVKYGLVPDNHNHPEWFKIVVMDHVKGDKITQFLNDFKSQKFE

SEQ ID NO: 57522 - protein, 577 aa, Aspergillus oryzae
MVTVFAVPSPGLVRRLLDHFAKHGPMWLTSRMGNRRTAILSHIFPEAMESPLILHCVLMIAAKDLLKYDSNVELQASAVEYYGRAISGLREALSGEQLANEPTSGAIISGASPAYNIEEMTYALKTGNAKFLMTVPAGMDVAVPAAREAGIPTERIFLLEGEKGEYISVQDLVRKGRSYGPTGQTTPFELPRGKSNRDVCGFLSFSSGTTGLPKAVMIAHHNVIAQCMQVDQILRKDVNKSLAVLPLFHITGLVHQMHLPVIRNSTVYMLPSFTMESMLATIVEYQITEILSVPPIIIRLLTDPIVSKYDLSHVKTFSSGAAPISGEILQKLEARFPWTGFKQGYGMTESCSCITAHPPEKQTYEYAQRAGILVANTEVKILNTQNGKELGYGEEGEILARGPQVVMGYLGNEKATRETFDSDGWLHTGDVGYMDQEGFLVITDRIKEMIKVKGIGVSPAELEDLLLGHPEVDDAAVTSVPDDYSGEKPKAYVVVNAAAKSRLATGDAVKSVGRELIEYVKAKKVRHKWIVEVEFMDEIPKSPSGKILRRVLKDRERKRESGEKRLVVRDEKATAKL

SEQ ID NO: 57523 - protein, 367 aa, Oceanicola granulosus HTCC2516
MDGFEIAVFEGDGIGPEVMRPTVELLTALARGHGRYALNFETLPAGAGHYREHGVSLPGDALARARRADAILLSAMGLPEVRYPDGTEISPQIELRMELGLYAGVRPVFQFGQSCPIARFGGDQRPVDFVIVRESTEGLFYSHGKGEVIDDSEARETLRITRATSEKLFDFAFDLARQRKADGRGAGVVHCVDKANVFQAFAFFRRIFRERAEAFPDIRAEAAYVDATAMWLVEKPQVFDVLVTENMFGDILSDLGAAMMGGLGLAPSADIGERNAVFQPCHGSAPDIAGQGRANPIAMVLSAAMMLDWLGRTRGQEAMRADALRIHEAVREVVTSGGPLTPDLGGTASTGEVVAAVRDAALAAVAA

SEQ ID NO: 57524 - protein, 164 aa, Silicibacter pomeroyi DSS-3
MTQIDYTRAAKYFLLQDFWVGMKLGLKYFFSPKATINYPHEKGPLSPRFRGEHALRRYPNGEERCIACKLCEAICPAQAITIDAEPREDGSRRTTRYDIDMTKCIYCGFCQEACPVDAIVEGPNFEFATETREELFYDKEKLLSNGDRWEAEIARNLELDAPYR

SEQ ID NO: 57525 - protein, 104 aa, Zea mays
  misc_feature (56)..(56): Xaa can be any naturally occurring amino acid
  unsure (1)..(104): unsure at all Xaa locations
MSGRGKGGKGLGKGGAKRHRKVLRDNIQGITKPAIRRLARRGGVKRISGLIYEETXRGVLKIFLENVIRDAVTYTEHARRKTVTAMDVVYALKRQGRTLYGFGG

SEQ ID NO: 57526 - protein, 416 aa, Oryza sativa (japonica cultivar-group)
MAAAANNGGEGGDGFDVIVVGAGIMGSCAAYAASTRGGARVLLLERFDLLHHRGSSHGESRTIRATYPQAHYPPMVRLAARLWDDAQRDAGYRVLTPTPHLDMGPRADPALRASIVNGAATEVASDAAAPWPWSGVFRLPEGWTAATSEIGGVMKATKAVAMFQSLAAKNGAVVRDRTEVVGIAKQGDGSIVVKTSSGEEFHGAKCIITVGAWASKLVRSVAGVDLPVQPLHTLICYWRARPGREHELTPESGFPTFASYGDPYIYSTPSMEFPGLIKVAAHGGPPCDPDRRDWLAGAGAGLVEPVARWIDEVMPGHVDTAGGPVIRQPCMYSMTPDEDFIIDFVGGELGKDVVVGAGFSGHGFKMGPAVGRILAEMALDGEARTAAEAGVELRHFRIGRFEDNPEGNLAENKVKN

SEQ ID NO: 57527 - protein, 262 aa, Streptomyces sp.
MSDAADRVALVTGGTSGIGLAVGRRKLALDGTRVFLCARDESAVTGTVKELQASGLEVEGTSCDVRSTDAVDRLVRTARNPLRAIDIVVNNAGRGGGGVTAQITDDLWSDVVDTNLGGAFRVTRAVLTGGGMQEHGWGRIINIASTGGKQGVALGAPYSASKSGLIGFTKAVALELARTGITVNAVCPGYVETPMAQGVRQRYAAFWGITEDDVLEKFRAKIPLGRYSTSDEVAGMVHYLVSDSADSITAQAINVCGGLGSY

SEQ ID NO: 57528 - protein, 342 aa, Streptomyces avermitilis MA-4680
MKALVKEKAEPGLWLMDVPEPEIGPGDVLIKVLRTGICGTDLHIRSWDGWAQQAVRTPLVLGHEFVGEVVETGRDVVDIKAGDRVSGEGHLVCGKCRNCQAGRRHLCRATVGLGVGRDGAFAEYVALPAANVWVHRVPVDLDVAAIFDPFGNAVHTALSFPLVGEDVLITGAGPIGLMAAAVARHAGARNVMITDVSEERLELARKIGVSLALNVADTTIADGQRALGLREGFDIGLEMSGRPEAMRDMIANMTHGGRIAMLGLPSQEFPVDWARIVTSMITIKGIYGREMFETWYAMSVLLEGGLDLAPVITGRYGYRDYEAAFADAASGRGGKVILDWTL

SEQ ID NO: 57529 - protein, 324 aa, Silicibacter sp. TM1040
MNLIDGIKGNRFAVFGRAGMDMFADPIGTKSEDATTFRADLGGSSANICAGLVKLGAEAALVTSVSDDAVGRFCVNRLRDYGVETRYVRAVGGEARTSLAVYESRIDDFQNVIYRNGAADFQVTKADMDAVDYSAFSALITAGTVFAAEPSRSATFRAFEHARTAGLPVIFDIDYRPYSWPSPEVASEVLTRAGEASDLIVGNDEEFGFMAGHIDKGLEKARALAAQGRMVIYKMGEAGAITIAEGQEIRTGIYPVTAVKPNGAGDSFMAGLLASIAQGHALSDAVLRGSACASIVVSQPGCANAMPTTAELEAFLASHPGPTV

SEQ ID NO: 57530 - protein, 300 aa, Schizosaccharomyces pombe 972h-
MNTTSEVIVGTGFQAIRQQLAQMHPELNFVEQLWLAYYKWFDNDVVATGLMSFLLHELIYFGRCIPWMIIDAMPYFRRWKIQPKKVPTLAEQWECTRLVLLSHFTVELPQIWLFDPMCATFGLSTSVPFPPVTKMIWQITLFFFLEDTWHYWAHRLFHYGIFYRFIHKVHHRYSAPFGLSAEYAHPLEIILLGAGTVFVPLMWCYFTHDLHLVTMYIWITLRLFQAVDSHAGYDFPWSLNKFLPIWAGADHHDYHHMAFKDNFSSSFRWWDAVLKTDQNYHQFKARRLAAKYEAESKKAK

SEQ ID NO: 57531 - protein, 277 aa, Schizosaccharomyces pombe 972h-
MSSLEIIVDKILKFLEKQPKPEGRPFILGISGPQGSGKSTLASALDTELTRKNESVVKFSLDDFYLTHAEQVELAKNNPNNPLVQHRGLAGTHDVTFLNNVLNAFVKGSDEEVSIPFYDKSKFGGYGDRGDESQWKKANPKTTTYVIFEGWMVGFEPLDSCMLSVRARSTRWQNIEGSLLWVNRKLADYQPIFQKIDSLVELEAQEINYVYRWRLQQEHALKARIHKGMSDEEVIEFVNHYMPQYVFYLGTLSNKVHLNPHCLEIILDENRYPVVMH

SEQ ID NO: 57532 - protein, 656 aa, Arabidopsis thaliana
MLSRFNIHQPFKRCKFRFFLRSIGNPDTILVESCSSSSCSSPEPSLVRSDYLTKPSDQDQIFPLNKIIARCVRSGDIDGALRVFHGMRAKNTITWNSLLIGISKDPSRMMEAHQLFDEIPEPDTFSYNIMLSCYVRNVNFEKAQSFFDRMPFKDAASWNTMITGYARRGEMEKARELFYSMMEKNEVSWNAMISGYIECGDLEKASHFFKVAPVRGVVAWTAMITGYMKAKKVELAEAMFKDMTVNKNLVTWNAMISGYVENSRPEDGLKLFRAMLEEGIRPNSSGLSSALLGCSELSALQLGRQIHQIVSKSTLCNDVTALTSLISMYCKCGELGDAWKLFEVMKKKDVVAWNAMISGYAQHGNADKALCLFREMIDNKIRPDWITFVAVLLACNHAGLVNIGMAYFESMVRDYKVEPQPDHYTCMVDLLGRAGKLEEALKLIRSMPFRPHAAVFGTLLGACRVHKNVELAEFAAEKLLQPNSQNAAGYVQLANIYASKNRWEDVARVRKRMKESNVVKVPGYSWIEIRNKVHHFRSSDRIHPELDSIHKKLKELEKKMKLAGYKPELEFALHNVEEEQKEKLLLWHSEKLAVAFGCIKLPQGSQIQVFKNLRICGDCHKAIKFISEIEKREIIVRDTTRFHHFKDGSCSCGDYW

SEQ ID NO: 57533 - protein, 245 aa, Mycobacterium avium 104
MGKLDGKVAVITGGSSGLALATAKLFVDEGAHVFITGRRRHALDEAVASIGRNVTAVQGDAANLDDLDRLFDTVKREKGSIDILFASAGTGGQARRLGEITEQDFDTVFGLNTRATLFTVQKALPLFNDGGSILMTGSIASVKGWPDYSVYSASKAALRSFARTWLNELKDRRIRVNVLSPGQVATPIQEKMFDAETKRQFESLIPRGTMGRPEEIATAALFLASDDSSYVNGVELAVDGGTSAI

SEQ ID NO: 57534 - protein, 342 aa, Ashbya gossypii ATCC 10895
MATVNPQRRDSAEAIDTDIITLARFILESQRSSAKNATGEFNLLLNSLSFAFKFISQTIRRAELVNLIGLSGASNATGDQQKKLDVLGDEIFINAMKASGNVKVLVSEEQEDLIVFPETGGTYAVCCDPIDGSSNLDAGVSVGTIVSIFKLTPDSSGTIKDVLRSGREIVAACYAMYGASTHVMLTTGQGVNGFTLDTSIGEFILTYRDLKMPALRNIYSINEGNMRFWTDGIRRFVEALKDSDKPYSARYIGSMVADVHRTLLYGGLFSYPLDMKNPNGKLCLLYEAFPMAFLVEQAGGKAVNDRGERILDLTPEHIHDKSSIWLGSAGEVDKYLAHIGRA

SEQ ID NO: 57535 - protein, 392 aa, Streptomyces avermitilis MA-4680
MTAPLMTLAWTDHVTGRQGYLVVDRLVRGVSSGGLRMRPGCTLDEVAGLARGMTMKEALHYNPEGRYIPLGGAKGGIDCDPRSPEAYGLLVRYLRAMRPYIESCWTTGEDLGLTQDLVDRAAAEAGLVSSIQAVYPLLDDEATARKRLADAFAVEVDGIGLDELVGGCGVAESLLAALDRAAVPYAGTRVAVQGLGTMGGATARFLARAGLTIVAVADVKGTIANPEGLDVEALLAARDAYGTVDRSALRPGDRELPGEAWLSVEAEVLVPAAVSYVVDTTNQRRIGARWIVEAANMPVLPEAEALLTERGITVLPDVVVNSGTNAWWWWTLFGDIDADADEAFARTRRSMRALTDLMLARAEADGTTPRAAAHAIVADRLPVIAERFGWYR

SEQ ID NO: 57536 - protein, 720 aa, Xanthomonas axonopodis pv. citri str. 306
MATRKFTQRSRIREGRPNPLGATWDGLGVNFALYSRNATRVELCLFDERGREQERIALPEYTDEVWHGYLPDARPGQLYGYRVHGPYAPDAGHRFNHNKLLLDPYAKQIVGELKWAPHLFGYTIGHRDKDLSFDRRDSAAFMPKSAVIDPAFTWGQDRPPQTPWNRTVIYEAHVRGLSMLHPAVPPEERGTFSALKTDELIDHISSLGVTAVELLPVHAFVDDQYLLEKGLRNYWGYNTLGFFAPQARYMSTRTVAEFKQMVARLHHAGLEVLLDVVYNHTAEGNELGPTLSFKGIDNASYYRLADDRRFYINDTGTGNTFDLTNVGALRMVMDSLRYWVQEMHVDGFRFDLASILGRERYGFDPSGSFLDAVRQDPVLSQTKLIAEPWDIGPGGYQVGNFPPGWVEWNDKFRDNVRAFWRGDGGQLAELATRLTGSADLFDHSGRRPTASVNFVTAHDGFTLRDLVSYEGKHNLANGEDGRDGSDHNISSNYGVEGETNDPAIKQLRRQQMRNLLATLLLSQGTPMLLAGDEFGHSQNGNNNAYCQDNELTWIDWTAATKAAAADQAAFVRRLIRIRQRYPLLHRARFFDGKFDEALGLKDLTWLAPNGTEMDEAGWHDPEARALMLRLDGRSPTTGLREIAANVTLLMLINAASTAVSFTLPAMHDEHWRVLVDTARHGGRVVAGGSEWKAPAHSLTLLAVERDRIVSSARIVSEGAR

SEQ ID NO: 57537 - protein, 157 aa, Triticum aestivum
  misc_feature (80)..(80): Xaa can be any naturally occurring amino acid
  misc_feature (101)..(101): Xaa can be any naturally occurring amino acid
  misc_feature (106)..(106): Xaa can be any naturally occurring amino acid
  misc_feature (110)..(110): Xaa can be any naturally occurring amino acid
  misc_feature (113)..(113): Xaa can be any naturally occurring amino acid
  misc_feature (132)..(133): Xaa can be any naturally occurring amino acid
  misc_feature (138)..(138): Xaa can be any naturally occurring amino acid
  unsure (1)..(157): unsure at all Xaa locations
MAPTVMASSATSVAPFQGLKSTAGLPVSRRSNGASLGSVSNGGRIRCMQVWPIEGIKKFETLSYLPPLSTEALLKQVGLXLIRPKWVPCLEFNKVGFIFRXEHNAXPGVXYNXRYWTMWKLPMFGCTDATQXXNEVEXVKKGVPDAYVRINRIPKNA

SEQ ID NO: 57538 - protein, 208 aa, Cryptococcus neoformans var. neoformans JEC21
MSNQQVRTHTPRSADMQPEDELAPTRTEGYKLGHSKTVAELAALDQDDESLQRWKQSLGIAAGASAGGEKRVVLKSLFLSSPTLPSEITIDLTQSKDALAKLKKDPVTIKEGVEYSVGITFMIENEIVSGLKYLQVVKRSGITVDKTEAMLGSYGPQPEPFTKVFASEESPSGMLARSGTYVVRSRVIDDDNTIWLDFEWGFKLGKEW

SEQ ID NO: 57539 - protein, 172 aa, Arabidopsis thaliana
MAILIPASFGRLTITSREKVRVRFSASANQRTIRRDSVDWVKETSSFFEEDKRPIMLFDGVCNLCNGGVKFVRDHDRNRSIRFEALQSEAGKKLLLRSGRAPDDISSVVLVENDRSYIKSEAVLKIMKYIDLPFPQLAFFLQFAPLFVRDFLYENVANNRYAMFGRSDSCEL

SEQ ID NO: 57540 - protein, 197 aa, Cryptococcus neoformans var. neoformans JEC21
MSGEIRRKLVIVGDGACGKTCLLIVFSKGMFPEVYVPTVFENYVADVEVDGKKVELALWDTAGQEDYDRLRPLSYPDSHVILICFAIDSPDSLDNVQEKWISEVLHFCQGLPIVLVACKKDLRDDGKTIQDLARMNQRPVSRAEGMAVAQKIGAQGYVECSAKTGEGVREVFQTATRHALQSKKSKSGRGKKGCVVL

SEQ ID NO: 57541 - protein, 428 aa, Flavobacteria bacterium BBFL7
MSEKAILEIDGNKYEFPIITGTENEKAIDIKALRGATGGVTTIDPGYKNTGSCESAITFLNGEEGILRYRGYSIEELADKADFLEVAYLLIFGELPTQAQLDKFHADIKANSHVDEDVKKILDGFPKSAHPMGVLSSLTSALIAFNPSSVNVDSEEDMYKAIVNIMGKFPVLVAWALRKRTGQPLDYGDDNLGYVENILKMMFKKPNAEYNVDERIASALDKLLILHADHEQNCSTSTVRIVGSSHAGLFASLSAGINALWGPLHGGANQAVLEMLEAIKEDGGDTKKYMAKAKDKSDPFRLMGFGHRVYKNFDPRAKIIKVAADEVLNSLGVDDPILDIAKGLEKEALEDSYFVDRKLYPNVDFYSGIIYRAMGIPVEMFTVMFALGRLPGWIAQWKEMRENKEPIGRPRQVYTGENHRPFKEVSER

SEQ ID NO: 57542 - protein, 216 aa, Cryptococcus neoformans var. neoformans JEC21
MSGEIRRKLVIVGDGACGKTCLLIVFSKGMFPEVYVPTVFENYVADVEVDGKKVELALWDTAGQEDYDRLRPLSYPDSHVILICFAIDSPDSLDNVQEKWISEVLHFCQGLPIVLVACKKDLRDDGKTIQDLARMNQRPVSRAEGMAVAQKIGAQGYVECSAKTGEGVREVFQTATRHALQVGLLPLHRRPPLTVRRAKSPSLAEGRRVVWCFRAL

SEQ ID NO: 57543 - protein, 428 aa, Flavobacteria bacterium BBFL7
MSTIIDVHARQIFDSRGNPTVEVDVITSNGVMGRAAVPSGASTGEHEAVELRDGGKSYMGKGVGKAVNNVNTIISLELMGTSVFDQQHIDQLMIELDGTPNKANLGANAILGVSLACAKAAAAELNQPLYKYIGGISACTLPVPMMNIINGGSHSDAPIAFQEFMVMPVEAESFSHALQMGTEIFHHLKKVLHDRGLSTAVGDEGGFAPTLDGTEDALDTIIKAIGNAGYTAGKDVMIALDCAAAEFFVDGKYDYTKFEGESGVIRSSKEQAQYLASLAEKYPIISIEDGMDENDWEGWKILTDLAGDKVQLVGDDLFVTNVERLSRGIKEGIANSILIKVNQIGTLTETIAAVTMAHKAGFTSVMSHRSGETEDNTIADLAVALSTGQIKTGSASRSDRMAKYNQLLRIEEELQESAYYPARDAFQI

SEQ ID NO: 57544 - protein, 276 aa, Yarrowia lipolytica CLIB122
MSSERETKTFLARLCEQADRYDEMVNYMKDVAKSGEELTVDERNLLSVAYKNVIGARRASWRVIFPIEQKEEAKGATHHLELLKTYRAKIEAELEDICSDVLDILTNHLLPKAENAESKVFYYKMKGDYHRYLAEFTSGEKRKEAATAAHESYKSATDVAQTELSSTHPIRLGLALNFSVFYYEILNSPDRACHLAKQAFDDAIAELDTLSEESFRDSTVIMQLLRDNLTLWKNDLEESLQAQQSEETPATDAAAASTEAAAPKEEAKPAAEEPKE

SEQ ID NO: 57545 - protein, 372 aa, Oryza sativa
MKTSLCVLLCILVISEVVGVPRCAAALGINYGQVGNNLPSPAQVVSLLASLRIGKVRIYDANPQVLAAFAGTGIELIVTVPNDLVRPMAASPGEALQWVSSSVRPYFPATRVTGIAVGNEVLTDDDEALKAALVPAMRNLHAALAQLGMDGYVHVSTASSLAVLATSYPPSQGAFTAEVAPLMAQFLRFLAETNAPFWINAYPYFAYKGDPTRVSLDYALSNPYHVGAIDPYTRLQYTSMLYAQVDAVAYATSQLGYNNIPVYVSETGWPSKGDTDEVGATVENARAYNRNLLLRQAAGEGTPLRPRQRLEVYLFALFNENMKPGPTSERNYGLYQPDGRTMVYNVGLMQQSTSAASLSLAASPATKTVSAH

SEQ ID NO: 57546 - protein, 348 aa, Oryza sativa (japonica cultivar-group)
MEEEGFYTNLMNEGNDSLDWDSLSSMPVEDDMSNQLDENGMSSKPVTQQFPTAERTTVARPNQKRSKNFSEQVDKILVSAWLHVSLDPVLGTNQTRAAYWTRIYEHFYKTSKSTPDRSQNSLMHRWKTIQENVNKFCGYLSQIEGRRQSGVSIHDKAIAVFKELEGKPFQFLHCWTLLRSQSKWHDKMKQITSQKPCATNRQKPSTDGSAKAIPTNDETTNHVGEDNEPTETEEPKRPMGKKRAKEQLRRGGGETCTDAFDHLWEKKKEADAEKERDERHQKSYELDKQRLELDKKKVANEMDEIQLKRILEEERIMTMDISSKPLSQQQFYKCVQDEIISRRMNSSG

SEQ ID NO: 57547 - protein, 645 aa, Arabidopsis thaliana
MDPYSHGSSFMNLLTSQQEAHNLETNPYDDDVSPNQAAHTPKVKRERRKWSAGEDLVLVSAWLNTSKDAVIGNEQKGYAFWSRIAAYYGASPKLNGVEKRETGHIKQRWTKINEGVGKFVGSYEAATKQKSSGQNDDDVVALAHEIYNSEHGKFTLEHAWRVLRFEQKWLSAPSTKATVMSKRRKSDKASTSQPQTHEAEEAMSRPIGVKAAKAKAKKAVSKTTTVEDKGNVMLEIQSIWEIKQKDWELRQKDREQEKEDFEKQERLSRTKLLESLFTKKEPLTDIEVPVISNALGGILVGLVTSHAGGRRKVMHLKERLEEEEAVTRTLRAAFDGSIVSLPSLSSLFLPPQAIPIDIITHNFSELFQELAIVEAEILCLDRKIKEQASYSSSSNFLRSKNHYPSMESINTLKGYDKVSDQENQIHHHHHSPLPKPSSFSRKTLIATGSVVSLLLILSVVALTAGAFTHSPPHHPPISSASLKSLCSVTRYPETCFNSLSSSLNESDSKLNPESILELSLRVAAKEISNLSISFRSINDMPEDAAVGDCVKLYTDALSQLNDSITEIERKKKKGGNNWLTEEVVGDVKTWISAAMTDGETCSDGIEEMGTIVGNEIKKKMEMANQMMSISLAIVSQMKKLLLIFH

SEQ ID NO: 57548 - protein, 254 aa, Brassica napus
MARKFFVGGNWKCNGTAEEVKKIVNTLNEAQVPSQDVVEVVVSPPYVFLPLVKSILRPDFHVAAQNCWVKKGGAFTGEVSAEMLVNLDIPWVILGHSERRALLNETNEFVGDKVAYALAQGLKVIACVGETLEQRESGSTMDVVAAQTKAIADRVSNWSDVVIAYEPVWAIGTGKVASPAQAQEVHDELRKWLAKNVSADVAATTRIIYGGSVNGGNCKELGGQADVDGFLVGGASLKPEFIDIIKAAEVKKSA

SEQ ID NO: 57549 - protein, 65 aa, Oryza sativa
TIQFSLVNSFGAENCVFFHQASDLCLACFPGLAFHPLDGILQAIPHVFALYLIPTHFRTHIALLF

SEQ ID NO: 57550 - protein, 558 aa, Ashbya gossypii ATCC 10895
MQATTSASTDVDAYKKDITVRRRSQPCSSSSGSLKVMNTETKAMDTRSVLELKEKEEYGVYEAAGSTDRSISLSGASPVPEGSLVRPVLYCLSVAFCGIIFGWDLGTIGGISTMPSFQNTLGPRFNGDTGLHEFPGRLLGLLIGIFNIGCAIGGLTIARLGDIKGRKIAILTSLLVYAVGMFVQLGSGHFWYRYFIGRLIAGLAVGATMVLVPMFLSELAPVRIRGAMIVLYQVVICLGIALGSIVNYACKELVHDTLSNMTWKVPIFFQIGFTVLLSLALLITPESAEFLAMKGHLEKAKRSFAVMNGLSKDHPFVEERVASFVQVSMKSDDIEHSGDRWEFIRGNPRLGLRLFIGVTVMALQMLSGVNYFFYYGTTLFRFVGIEDAYVTSIIIGCVDLLGTFIGVYIVERLGRKICLLSGATGMFICMTVYACLGSFALKDDSNNKTVGAVMIFFTCVFVMFFAATSGPVSMVVMSEIFPIRTKVMSMAICTSVNWLVNFLIAFVTPDVTDAINYRFGFVFSGCLLFSIVFFIYLVPETKGLTHEQVDAIYEKTHD

SEQ ID NO: 57551 - protein, 199 aa, Spiroplasma citri
MFKFKNANYITSAVNKAGWINDDLFEIAFLGKSNVGKSSFLNMLTNQRQLAKVSQIPGKTRMLNFFSINNNQFRIVDAPGYGFAKVGNQYKMDFAKMMEEYLTQRENLKFVCLLVDLRHPPTQDDYEMYQYLKHFNILTVLIGTKLDKVKKNDIQKHEKMIKAKLNFADSDYFIKTSSRNKIARDECWTLFAKLLNFNE

SEQ ID NO: 57552 - protein, 353 aa, uncultured bacterium
IGAANNLLAAMLDNHIQQGNALGIDVKKITWKRCVDMNDRQLRFVVDGLGGKANGVPREDGFDITVASEIMAVFCLASSMKDLKERLSRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLAEEDLGALEKGIPNLLRHVHNIKEVYQLPCVVAINRFPTDTDAEIDFIIRKCRELGVNTVLSTVWAEGGKGGEDLAREVVRLCEEEKGNFTFSYDLNMTIEEKLEAVTKKIYGGAGVALTPAAKKQAERLTQLGFDKMPV

SEQ ID NO: 57553 - protein, 344 aa, uncultured bacterium
GAANNLLAAMLDNHIQQGNALGIDVKKITWKRCVDMNDRQLRFVVDGLGGKANGVPREDGFDITVASEIMAVFCLASDMADLKKRLSRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLATEDLAALEKGIPNLLRHVNNITTVYQLPCVVAINRFPTDTDAEIDFIVKKCRELGVNTVLSTVWAEGGKGGEELAREVVRLCEEEKGNFTFSYDLNMSIEEKLEAVTKKIYGGAGVSLTPAAKKQAERLTE

SEQ ID NO: 57554 - protein, 351 aa, uncultured bacterium
ITVANNLLAALIDNHIHQGNKLRIDTRLILWKRCMDVNDRSLRNIVVGLGAKGDGFVREDHFVITVASEIMAIFCLASDMKDLKKRLSEIIVAYNLDGEPVTAGELNAVGAMAALLKDAIKPNMIQTLEHTPAIVHGGPFANIAHGCNSIIATKTAMRLADYTVTEAGFGADLGAEKFLDIKCRKAGLKPDAVVIVATIRALKYNGGVAKADLTNENIEALKNGSCNLIKHVENIKSYGLPVCVTINKFVSDTDAEVECLKEILGKLDVPFSVSEVWAKGGEGALDLAKDVMKLADSENNFHYLYPDDMGIKEKIETLATKIYGAGNVEFAPAALKQIAKIEELGFKECPV

SEQ ID NO: 57555 - protein, 532 aa, Oryza sativa
  misc_feature (290)..(290): Xaa can be any naturally occurring amino acid
  misc_feature (297)..(297): Xaa can be any naturally occurring amino acid
  unsure (1)..(532): unsure at all Xaa locations
MAAQRRLLAEAPPHQPHPSRHQQGAPSSVWSAGYLNGWLSQRTAVFGLRLWVLIGIAVGAAIVLVLVLVFVCLSRRRRRRDDLASNLYPADTKILKQHLQQPTPPKDIQEIVRRQQRQQQTPTPTPPQPPPPAAQHGVQLAKAETPPPPQRTQPPVLPAGSTRSTAASGMSATTSGGSERDGATPRSTASGSAGPEVSHLGWGHWFTLRELEEATDGLAEENVIGEGGYGIVYKGTLQNSAMVAVKNLLNNRGQAEKEFKVEVEAIGRVRHKNLVRLLGYCVEGAYRMLXVYEYVDXNGNLDQWLHGDVGEVSPLTWEVRMNIILGTAKGLAYLHEGLEPKVVHRDIKSSNILLDQQWNAKVSDFGLAKLLCSERSYVTTRVMGTFGYVAPEYASTGMLNERSDVYSFGVLIMEIITGRSPVDYTRAPGEVNLVEWLKTMVAERKAEEVVDPKLPEKPSPKALKRALLVALRCVDPDGHKRPKMGHVIHMLEMDDLLCRDDKKPGRDAPQTSDRHSSRDGGNFSKRENQRYR

SEQ ID NO: 57556 - protein, 354 aa, uncultured bacterium
AVTTATNMIAALLDNYLFQHRDDGFALKEVLWKRVLDVNDRSLRNIVTGLGPKTDGIPAETGFDITPASEIMAILCLSKDLDDLRRRIDNILLGIKMDDTPFYVRDMGVGGAITVLLMDAIKPNLVQTTEQTPGFVHGGPFANIAHGCNTLLATQMAMTFADYVVTEAGFGADLGAEKFFDIKCRKSGLQPKLTVIVATTQGLKMHGGVPVEAIKEPNMEGLAKGFDNLDRHIRNLKGFGQSVVVAFNRFDTDAEEEIEFVRQHCNSIGVGFAINNAFHEGGEGAKELAQLVVDTIEQQPSHPLTYTYADNDSIKTKVEKVCRKIYGASSVSYGKTAEAALLRIQKLGLEHYPV

SEQ ID NO: 57557 - protein, 327 aa, Xanthomonas axonopodis pv. citri str. 306
MSSPITLIEAITQALAWELEHDPAVLVLGEDVGVNGGVFRATAGLQQRFGSDRVLDTPLDETTIAGLSVGLAAQGMKPVAEAQFDGFVYPMVDHLICHAARLRNRTRGRLHCPMVLRVPWGGGIRAPEHHSEANEAIFTNVPGLRVVLPSSPQRAYGLLLAAIRDPDPVIYMEPKRIYRQYKEVVANDGEALPLDVCFVLRDGTDVTLVTWGAQVKEALEAADKLAGEGISAEVIDVATLRPLDFDTIAESVAKTGRCVIVQEAPRTAGFGAEIAARLAEQSMYDLVAPVERVTGYDTHIPLFRLEMKFLPSVERIVSAARRAVAAG

SEQ ID NO: 57558 - protein, 514 aa, Triticum aestivum
  misc_feature (224)..(224): Xaa can be any naturally occurring amino acid
  unsure (1)..(514): unsure at all Xaa locations
STHASVDPRVRPRVRFNLHMTGDIHAITAANNLLAAAIDTRIFHEASQSDKALFNRLCPPNKEGKRRFADVMLRRLIKLGISKTDPDELTPEEVRRFARLDIDPASITWRRVMDVNDRFLRKITVGQGPEEKGMVRETGFDISVASEIMAVLALTTSLADMRERLGRMVIGNSKAGEPVTADDLGLGGALTVLMKDAIHPTLMQTLEGTPVLVHAGPFANIAHXNSSIVADKIALKLVGKGGFVVTEAGFGADIGTEKFMDIKCRYSGLTPQCAIIVATIRALKMHGGGPDVVAGKPLDHAYVSENVALVEAGCVNLAKHISNTKGYGVNVVVAINKFATDTDAEMEVVKKAAMAAGAFDAVVCSHHAHGGKGAVDLGVAVQRACESQAEPLKFLYPLDSSIKEKIESIAKFYGASGVEYSEQAEKQIEMYTKQGFSNLPICMAKTQYSFSHVPSMKGAPSDFVLPIRDVRASIGAGFIYPLVGTMSTMPGLPTRPCFYEIDIDTATGKVMGLS

SEQ ID NO: 57559 - protein, 362 aa, Xanthomonas axonopodis pv. citri str. 306
MSVAAQFQIDYLQYMDADGQWVRDDLPADAANPQHLLALFKRMLFVRTFDTKSVALQRTGKLGTYAACIGHEATHVGIGASMRSGDVFAPSYREYGTMFERGVRPRDVLLYWGGDERGSDYPRDADAAIDFPICVPISTQCLHAAGSALSFKLQGKQHVAVACCGDGGSSKTDFYAALNSAGAYKLPLILCVINNGWAISVPRSAQTGAQTLAQKGLAGGLHCLQVDGNDLVAVLEAMRQARVRALAGEGGTVIEFLTYRLSDHTTADDARRYRGEEEVKQGWAREPLLRLRRYLTAQGLWDEAQEDAWKADCSARVDEEVNAYLNTPVQPVEAMFDYLYGDPPAELLAQRAEVMALESRHG

SEQ ID NO: 57560 - protein, 352 aa, uncultured bacterium
IGAANNLLAAMLDNHIQQGNSLGIDPKAITWKRAVDMNDRQLRHIVDGLGGKAQGVPREDGFDITVASEIMAVLCLAADLKDLKARLARIIVGYTYDGKPVTAHDLKAEGAMTALLKDAIKPNLVQTLEGTPAFVHGGPFANIAHGCNSVTATHTALKLADYVVTEAGFAADLGAEKFLDIKCRLSDLHPDAVVIVATVRALKYHGGVPKSELSAENLDALEKGLPNLLQHVGNIKDVFGLPCVVAINAFPTDTEAELKLVEARCRELGVNVALSEVWEKGGKGGIALAEEVVRLCDQPNDFRFAYPLDISIEEKLETICRRIYHADGVLLEAGAKKQARQLTELGFDRLPI

SEQ ID NO: 57561 - protein, 204 aa, Oryza sativa
  misc_feature (170)..(170): Xaa can be any naturally occurring amino acid
  misc_feature (184)..(184): Xaa can be any naturally occurring amino acid
  misc_feature (187)..(187): Xaa can be any naturally occurring amino acid
  unsure (1)..(204): unsure at all Xaa locations
MSSMESSCLPATTESIAKAQEAKDASESISILYRVLQDPSSSAEALRTKELAITNLTNYLTKENRAEELRNLLTQLRPFFSLIPKAKTAKIVRGIIDAVAKIIGTSELQISLCKEMVEWTRAEKRTFLRQRVETRLAALLLENQEYTDALTLLTDLIKEVRRLDDKLLLXDIDLLESKLHFSLXKLXKAKASLTAARTAANGLT

SEQ ID NO: 57562 - protein, 405 aa, Silicibacter pomeroyi DSS-3
MMDGGKGFEDALTGEQKIRNFNINFGPQHPAAHGVLRMVLELDGEIVERCDPHIGLLHRGTEKLMESRTYLQNLPYFDRLDYVAPMNQEHAWCLAIEKLTGVEVPRRASLIRVLYSEIGRILNHLLNVTTQAMDVGALTPPLWGFEEREKLMVFYERACGARLHAAYFRPGGVHQDLPDALLDDIEAWSHTFPNVLDDIDGLLTENRIFKQRNCDIGVVSEEEILQYGFSGVMVRGSGLAWDLRRAQPYECYDEFEFQVPVGKNGDCYDRYLCRMEEMRQSISIIRQAIAKLRDCPGDVLARGKLTPPKRGDMKTSMESLIHHFKLYTEGFHVPAGEVYAAVEAPKGEFGVYLVADGTNKPYRSKIRAPGYLHLQAMDHVARGHQLADVAAIIGTMDIVFGEIDR

SEQ ID NO: 57563 - protein, 144 aa, Arachis hypogaea
MASLATLAAVQPAAVNGLAGSSLNGTKLSFKSSHQTLKSKKFRSGAVVAKYGDKSVYFDLEDIGNTTGQWDLYGSDAPSPYNPLQSKFFETFAAPFTKRGLLLKFLILGGGSTLAYFSATASGDILPIKKGPQLPPKLGPRGKI

SEQ ID NO: 57564 - protein, 200 aa, Silicibacter pomeroyi DSS-3
MSDALRELGTHLELKRADCILSWDVTFGELNVDVAPSNLVDFVDFLRSDSSCRFSTLVDITAVDYPERAKRFDVVYHFLSMYQNQRIRLRVSIREDDMVPSITDVHPSANWFEREVFDMFGILFTGHPDLRRILTDYGFRGYPLRKDFPTTGYTEVRYDEAEKRVVYEPVSLVQEYRQFDFMSPWEGADYILPGDEKKEG

SEQ ID NO: 57565 - protein, 459 aa, Amycolatopsis methanolica
MTLHLDDLRVRLLGECRYDSPFAEVLSTKRTSPHYVAEGDRVLLEDTVAMLAEHSLPSVQAPSFEAAGPRRKIYFDPARVTAGIVTCGGLCPGLNNVIRGLVQELSVHYRVKRIVGFRNGPGLTAAHRDDTVELTPEVVRDIHNLGGTILGSSRGGQDADEMVETLALHGVDVMFVIGGDGGMRAATFLSGAIRARGLDIAVIGVPKTIDNDLPFTDQSFGFQSAFARATDFISAVSVEAAASPNGVGIVKLMGRHSGFIAAYAALAANSADVVLIPEVPFALDGDDGLLAHVERLVRAKGFAVVVVAEGAGQDLFDAHGLPQLNGRGTDASGNVKLGNIGELLRTSIEAHLTAAGLAPTMRYIDPSYAIRSIPANAYDSVYCLRLAHAAVHAAMAGRTEAAVARWRRRFVHVPFSLMTRRRNQVDPDGDLWMSVLETTCQPAEFGAVAARERISSGFC

SEQ ID NO: 57566 - protein, 323 aa, Synechococcus sp. WH 7805
MATVTELLQPVEADLEILLSDLRSLIGAGHPILQAAAEHLFSAGGKRLRPGIVLLVSRGLSPEGELSPRHRRLAEITEMIHTASLVHDDVVDEAGTRRGVETVHSRFNHRVAVLAGDFLFAQASWHLANLDNLDVVKLLSRVIMDLADGEVKQGLFRYDTGQTFETYLEKSYCKTASLIANSARAAGVLSGCTEPQLESLYHYGRQLGLAFQVVDDILDFTGSDQQLGKPAASDLSSGYLTAPALYALEENPSLGVLIEREFSNEGDLDEALRIVRQSDAIARTRQLAERFAQESREALSWLPESPSRSALLELPDFVLSRLY

SEQ ID NO: 57567 - protein, 573 aa, Pseudomonas syringae pv. syringae B728a
MSRRKRRLEKMTKTSRPLYISYAGPSLLEMPLLNKGSAFTPQERVEFNLIGLLPQNVETIEEQVTRVYSQYKQCASDLDKHIYLRSIQDNNETLFFRLLDSHLDEMLPIIYTPTVGQACQEFSKIYRTHRGLFISYPERDRIDDILRSATKDRIKIIVVTDSERILGLGDQGIGGMGIPIGKLSLYTACGGISPAYTLPIVLDVGTNNRELLDDPMYMGWRHERVSGKEYEDFIALFIDAVQRRWPDVLLQFEDFAQSNAMPLLEKYRDELCCFNDDIQGTASVAVGTLLAACKAKNETLGQQKVVFVGAGSAGCGIAEHIIAAMRIEGLSESEARKRIFMVDRFGLLTESMDNLLDFQKRLAQKTADVSGWTAGSEAFPQLLDVVTHAGATVMIGVSGQRGLFTEQVIRELHKHCAKPLVMPLSNPTSKVEATPEEILRWTDGNALVATGSPFAPVEINGRTVHIAQCNNSYIFPGIGLGVVACKASRITDRMLMAASNALAECSPMVTGKGDAVLPPLKEIQQVSRKIALAVAREAQAEGLALETTEEALLEAIERNFWLPGYRAYRRRSV

SEQ ID NO: 57568 - protein, 848 aa, Schizosaccharomyces pombe 972h-
MSGFQTSDEVDISNSLKAFPVDIATDNQKDKHENVGENVSDEDDGNYIASKLLESNRRTKGKKGNGKASNFQSMGLNQTLLRAIFKKGFKAPTPIQRKTIPLLLEGRDVVGMARTGSGKTAAFVIPMIEHLKSTLANSNTRALILSPNRELALQTVKVVKDFSKGTDLRSVAIVGGVSLEEQFSLLSGKPDIVVATPGRFLHLKVEMKLELSSIEYVVFDEADRLFEMGFAAQLTEILHALPTSRQTLLFSATLPRTLVDFAKAGLQDPVLVRLDVESKVSADLQSAFFSVKTAEREAALLCILQDIIKLPLKDNVRPREIGNVNNPKKRKRALELALKGSESGSPDSTLVFVPTKHHVEYVSELLVQAGYSVSKIYGSLDQEARLNEINNFRLGKTNLLVVTDVASRGIDIPLLANVINYDFPPQPKVFVHRVGRTARAGRTGWAYSLVRAEDAGYLLDLQLFLNRPLVTSSKQVKTDSDCDFTKQIVLGSLPQELVAELLEWVQRIVSRDVELQQLSNVAARGEKLYFRTRATCSAESAKRAKELVDSKGWSSNNPLFGDVSVIEAEEKYAELLSKVSSYRPSETVFEIGQRGHLKTEAAEIMRKRRNKVKPKGIKSEVASDKITDSSPGNMSEASESELEEVFKNPKELSKKKTTDFKDKEYYMSHYAPKESIQETGYAINSGENFTTAARHAILDLTNDEGIEQSRKGGQRWDPKKKKFVNIINDEDGSKGSPKIIRGESGVKLPATYRSGRFDEWKASKAFGANDSPIRENKRYKHNKLQTPKPADKFRDNYHKQNKRNREAKERGIGIKVNSELKSAVEIRKARELKEKRLAKNNRPSKKHR

SEQ ID NO: 57569 - protein, 578 aa, Spiroplasma citri
MSKKLHGIGASNGIAIAKVFKLEEPKYEISNNTVSDSAKEIKILEAAMQNANTDIEKLQKIALEKLGAEKAAIFEAHKEILRDPAMIDEAKNIIIKSNNNNAAYAIHTVAQKFITMFASMDDPYFKERAADVKDVTDRLIKYILNVPVLDLATIHEEVIIVAEDLTPSQTAQLNPKFVKGFSCDMGGRTSHAAIMARSLEIPAVLGLKDITKQANHHELVMINGTTGEVILNPMSTEVKTWTAEKEKFLQLQQELLGFKYKPTVSKDGYQKFVLEGNIGAPKDVQGVLDNGGQGIGLFRSEFLYMNNDHFPTEDEQYEAYKGVLEGMQGRPVIIRTLDIGGDKKLSYFKFPEEMNPFLGYRAIRLCLDKTDVFRTQLRALLRASVHGKIGIMFPMIATIDEFNSAKKITLEEKATLIKEGHKVADNIEIGMMMEIPAAAMLADQFAKHADFFSIGTNDLIQYTMAADRMSQFVAYLYQPYNPSVLRLIKTIINGAHKEGKWVGMCGEMAGEEQAIPLLMGMKLDYFSMSATSILNARRIISKLEVSAMEKLVTEALECQTADEVLALVEKSTKNALKA

SEQ ID NO: 57570 - protein, 440 aa, Cochliobolus lunatus
MAITKIHARSVYDSRGNPTVEVDIVTETGLHRAIVPSGASTGSHEACELRDGDKTKWGGKGVTKAVANVNDIIAPALIKEKLDVKDQSAVDAFLNKLDGTENKTKLGANAILGVSMAIAKAAAAEKGVPLYAHISDLAGTKKPYVFRFLSKNVLNGGSHAGGFLLFQEFMIAPAKTFAEALRIRQGAEVYQKLKALTKKTYGQSAGNYGDEGGVAPDIQTAEEALDLIVDAIEAAGHTGQIKIAMDVASSEFFKDDEKKYDLDFKNPDSDKSKWLTYPQLAEMYKSLAEKYPIVSIEDPFAEDDWEAWSHFYKDGDFQIVGDDLTVTNPEFIKTAIELKSCNALLLKVNQIGTISEAINAAKDAFGAGWGVMVSHRSGETEDVTIADIVVGLRSGQIKTNAPARSERLAKYNQILRIEEELGDKRLFAGNKFHTAINLYL

SEQ ID NO: 57571 - protein, 352 aa, uncultured bacterium
IGAANNLLAAMLDNHIYQGNKLNIDPRRITWHRCVDMNDRQLRFVADGLGGRVNGVPREDSYDITVASEIMAVLCLASDITDLKKRLERIIVGYTYDEKPVTAGQLNAHGAMAALLKDALKPNLVQTLEHTPAFIHGGPFANIAHGCNSVIATKIAMKLGDYAITEAGFGADLGAEKFLDIKCRMAGLTPSAVVVVATVRALKHHGGALKENLKNEDLKALEKGLPNLLQHVENMTKVYGLPTVVAINRFPDDTEAELKLVEEKCKELGVNVALSEVWGKGGEGGVELAKEVVRLCEQKGNFKFSYESDLTIEEKIEAVVKKVYHGDGVMFTPAAKKQIKQLEDLGFGDMPV

SEQ ID NO: 57572 - protein, 345 aa, Spiroplasma citri
MTSIFGYPKEELQLDLVAHGFKKYLAEQIFDWIYVKNIYSFDEMTNISKTDRNKLQEYYTIEPLKIVVQQQSKDWTVKFLFQLADGYKIETVLMPQSYGNSVCVTTQVGCNMACTFCASGLLKKTRNLSTAEIVQQVMMVNRYLATTNERVSHIVVMGIGEPFDNFDNTLKFVNIINDPKGYQIGARHITISTCGLVPKIKQFAELKTQVNLAISLHAPNNTIRNQLMPINKAYPVEKLMDAVRYYIELTNRRVTFEYILIENVNDSRETALELAKLIRGLNAYVNLIPYNTVAENGHQRSTKINKFFETLQQQKINCIVRREFGHDIDAACGQLRAKNEGVIRK

SEQ ID NO: 57573 - protein, 353 aa, uncultured bacterium
IGAANNLLAAMLDNHIQQGNALGIDAKKITWKRCVDMNDRQLRFVVDGLGGRANGCPREDGFDITVASEIMAVFCLASSMKDLKERLSRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGPTPDAVVVVGTVRALKMHGGLDKKQLVSEDLAALEKGIPNLLRHVNNIKNVYQLPCVVAINRFPTDTDAEIDFIIRKCRELGVNTVLSTVWAEGGKGGEDLAREVVRLCEEEQGNFTFSYELDASIEEKLEAVTKKIYGGAGVLLTPAAKKQAERLTELGFDKMPV

SEQ ID NO: 57574 - protein, 353 aa, uncultured bacterium
IGAANNLLAAMLDNHIQQGNALGIDIKKITWKRCVDMNDRQLRFVVDGLGGRANGTPREDGFDITVASEIMAVFCLATSMADLKERLSRIIVAYTYDDRPVTAGDLKATGAMAALLRDALKPNLVQTLEGTPAFVHGGPFANIAHGCNSVMATRMAMRMGDYTVTEAGFGADLGAEKFLDIKCRMAGLVPDAVVVVGTVRALKMHGGLDKKQLANEDLAALEKGIPNLLRHVHNITNVYHLPCVVAINRFPTDTDAEIDFIVRKCRELGVNTILSTVWAEGGKGGEDLAREVVRLCEEEKGSFTFSYELDASIEEKLEAVTKKIYGGAGVALTPAARKQAERLTQLGFDKLPV

SEQ ID NO: 57575 - protein, 345 aa, uncultured bacterium
GAANNLIAAMLDNHIKWGNELGIDPRRVVWRRCVDMNDRQLRNVICGLGGVVDGMPRQDGFDITVASEVMAVFCLARNLADLRQRLSRMVVAYTYDRAPVTVGDLKAEGACMALLRDAIKPNLVQTLEHNPAFVHGGPFANIAHGCNSVMATTCAMGMADYVVTEAGFGADLGAEKFLDIKCRSTELSPSAVVIVATVRALKYNGGVARSLLTEENVEAVSAGLPNLMRHVDNIRNVFGLPCVVAVNAFPTDTDAELAVIRRACEEVGVSVALSHVWEKGGEGGRELADEVVRLCEQPKHFRFAYDVNASIEEKIRAIATRIYRADGVDFQGRARTQLRQSEELG

SEQ ID NO: 57576 - protein, 401 aa, Candidatus Desulfococcus oleovorans Hxd3
MVAGLAADTSIVVPDKKLEDAGIKVLQDEVVQVDAAGKTVTLAGGNTVPYDKLYLATGSRSFVPPIEGKDLEGVMTLRGIEDARRIRTFLTEKTPRHIVFVGAGFISMETATLLAEHMPGQFDISVVELIDRPLPLMLDKDMADMVTAYLTEKGLNLLTGEKVEKLAGENGKVTGVALASGKTLDADMVFINVGVRPNIELAQAVGLEMGRFGIKVNPFQETSNPDILAGGDCVEKINFITKAPCPGQLRGPAVMQGRVAAKRLAGLDVPFPGVVDAGGCKMFDMTITATGLSESAAAREGIETVCASVDSRSKHAMIPGAKESRIKLVFEKKTKKLIGGQIVSHDIAPARAIDTVTAFILGGKTVADLTTFTSACNPDISSEPSAEFITVAAEQALQKLR

SEQ ID NO: 57577 - protein, 481 aa, Elaeis guineensis
LTFVDLSRNNLSGEIPAEIAGIRILNYLNVSRNHLEGSIPPSIATMQSLTAVDFSYNNLSGLVPSTGQFSYFNVTSFVGNAELCGPYLGPCGFTNSSGSTHARGPLSASFKLLLGHWSPPLFHCLRHRRHHQKLGSFEEGRARPGHGSLTAFQRLDFTCDDVLDWLKEENIIGKGGAGIVFQGCDAQRRTVAVKKLPAINPGSSHEHGFSAEIQTLGRIRHRHIVRLLGFCSNHETNLLVYEYMPNGSLGEVLHGKKGGHLRWDTRYKIAVEAAKGLCYLHHDCSPLILHRDVKSNNILLDSDFEAHVADFGLAKFLQDSGTSECISAIAGSYGYIAPEYATLKVDEKSDVYSFGVVLLELVTGRKPVGEFGDGVDIVQWVRKVTDTNKEGILKIIDPRLSSVPLHEAMHVFYVAMLCVEEQSVERPTMREVVQILTELPGTPAKQGEDPPPPPPVGGETPPRESKPRQEQQSPPPDLLSI

SEQ ID NO: 57578 - protein, 219 aa, Synechococcus sp. WH 7805
MDFIGGSYLATSPQISYRRLLEWLADEGYAIHAWSYVPGFDHQLQAREGWQQLRQCRRLLEERLNRPITPMRLGHSLGCKLHLLAPDDGRGCSGLAALSFNNFTAERSIPLLGTLAPKLGVVTEFSPGPVETLNMIERFYRQERNLVVRFGDDALDQSDDLIQALQRRPGDQSRFVQTTGDHLTPASAGLRQGLLGGWADDQGRSRRIRRLVDLLLTWA

SEQ ID NO: 57579 - protein, 254 aa, Escherichia coli
MRHPLVMGNWKLNGSRHMVHELVSNLRKELAGVAGCAVAIAPPEMYIDMAKREAEGSHIMLGAQNVDLNLSGAFTGETSAAMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKVDANIAEQVIIQYGGSVNASNAAELFAQHDVDGFLVGGASLKPEFVDIINAAEAAKQA

SEQ ID NO: 57580 - protein, 70 aa, Zea mays
  misc_feature (39)..(39): Xaa can be any naturally occurring amino acid
  unsure (1)..(70): unsure at all Xaa locations
ISWRVSLGPGGDLGLTSRVTNANAAGRPFSYTLAYHTYXAVSDRSNVRVVGLVTMCYLDNLQAEALFTGH

SEQ ID NO: 57581 - protein, 204 aa, Medicago sativa
MDSKKAILMLSLLAMALISSVMSARDLTETSTDAKKEVVEKTNEVNDAKYGGGYNHGGGYNGGGYNHGGGYNHGGGGYHNGGGGYNHGGGGYNGGGGHGGHGGGGYNGGGGHGGHGGGGYNGGGGHGGHGGAESVAVQTEEKTNEVNDAKYGGGSNYNDGRGGYNHGGGGYNHGGGGHGGHGGHGGHGGHGGHGAVQTEDNTQN

SEQ ID NO: 57582 - protein, 352 aa, uncultured bacterium
ITSAHMLLSAMLDNSIQQGNPLNIDPRRVIWKRVVDMNDRALRNIVIGLGGKAHGVPREDGFDITVASEVMAILCLASNLHDLKERLKRIVVAYNYDGKPVTAEDLHAAGAMAALLKDAVKPNLVQTLEHVPAIIHGGPFANIAHGCNSVMATRTALRLADFTITEAGFGADLGAEKFFDIKCRQAGLAPDACVLVATVRALKMHGGVAKADLKEPNVEAVKKGLPNLGKHIENIFKFGVPVVVAINIFAQETREELQAVYDYCAGMGVNVALSDVFAKGGEGGVELAKEVVALAESGMARFKPIYPLEMSLKEKVATVVKEVYGGDRVEFQTKAAQALDQYEKEGYGNLPV

SEQ ID NO: 57583 - protein, 343 aa, uncultured bacterium
GAANNLLAAMLDNHIQQGNDLNIDPRRITWKRAVDMNDRQLRNIVDGLGARTDGTPRQDGFEITVASEVMAVLCLSSSITDLKQRLGKIIVGYSYEGDPITAHDLKAEGAMAALLKDAIKPNLVQTLEGTPAFIHGGPFANIAHGCNSVMATRLALKLGDYVVTEAGFAADLGAEKFVDIKCRMAGLKPSAVVIVATVRALKYHGGVPKTELNSENLEALKKGLPNLLQHVSNVKNVYGLPCVVAINAFPSDTKAELDLVEEKCRELGVNVALSEVWAEGGEGGKALAEEVVRLCDQPNDFTFAYDLDLPIKEKLLTIARKIYHADGIHLPGNVPKQIKQLED

SEQ ID NO: 57584 - protein, 357 aa, uncultured bacterium
VTSAHNTISALLDNYLYQHRKDGFSLREIFWKRVLDVNDRALRNVVTGLRGDGVVSETGFDITPASELMAILCLATSEEDLQRRIENIVLGITADGKLFKVKDLGVAGAITVLLRDALSPNLVQTTEHTPAFVHGGPFANIAHGCSSVVATKMAMSYCDYVVTEAGFGADLGAEKFFDIKCRKTGLQPRLVVIVATTQGLKMHGGVDLEQINEPNKKGLTEGLKNLNRHIRNMQGFGQPVVVTLNRHDTDLEEEIDIVRKNCEDLDVGFAVNEAFLRGGEGATELAQTVIDTIERQQPLPIHFTYKEADCLEDKIEKVCKRIYGASAVEYSKTAKKKLEALRATFTDEDGAIAHYPV

SEQ ID NO: 57585 - protein, 352 aa, uncultured bacterium
IGAANNLIAAMLDNHIKQGNALDVDLNNIIWRRCVDMNDRQLRNVVDGLGTAGDGVCREDGFDITVASEVMAVFCLATDLDDLKERLGRMVVAYSRSGKPVTVADIKAEGACTALLKDAIKPNLVQTLENNPAFVHGGPFANIAHGCNSVQATMTAMKMTDYVVTEAGFGADLGAEKFIDIKCRYAGFNPSCAVIVATVRALKHHGGVAKADLNNENLEALEAGLPNLLQHVSNVKDVFGISPVVAINAFPTDTEAELKLVQDKCAELGVNAVLAEHWAKGGEGAKALAEEVVRVCDQPNDFKFCYDVEMGIEEKIEAIAKRVYHADGVDYTPKAKKQLAQLNELGFDKLPI

SEQ ID NO: 57586 - protein, 352 aa, uncultured bacterium
IGAANNLLAAMLDNHIQQGNSLGIDPKAITWKRAVDMNDRQLRHIVDGLGGKAQGVPREDGFDITVASEIMAVLCLAADLKDLKARLARIIVGYTYDGKPVTAHDLKAEGAMTALLKDAIKPNLVQALEGTPAFVHGGPFANIAHGCNSVTATHTALKLADYVVTEAGFAADLGAEKFLDIKCRLSDLHPDAVVIVATVRALKYHGGVPKSELSAENLDALEKGLPNLLQHVGNIKDVFGLPCVVAINAFPTDTEAELKLVEARCRELGVNVALSEVWEKGGKGGIALAEEVVRLCDQPNDFRFAYPLDISIEEKLETICRRIYHADGVLLEAGAKKQARQLTELGLDRLPI

SEQ ID NO: 57587 - protein, 239 aa, Francisella tularensis
MSDINIKIGLAEMLKGGVIMDVVNAEQAEIAQQAGAVAVMALERVPADIRKDGGIARMSDPKLIKEIMSVVSIPVMAKARIGHFVEAQILESLGVDFIDESEVLTPADELNHIDKDSFKVPFVCGCTNLGEALRRIGEGAALIRTKGEAGTGNIVEAVRQLRQVNKDINYIKNADKSELMAIAKNLQAPYDLVTYVHKNGKLPVPNFSAGGVATPADAALMMQLGAESVFVGSGIFKSA

SEQ ID NO: 57588 - protein, 452 aa, Rhodobacter sphaeroides 2.4.1
MAFDYDLFVIGGGSGGVRAARIAASEGGATVALAEESRMGGTCVIRGCVPKKLMVFASGYPDAVEDARAYGWDASIGGFDWPAFRGKLDRELDRLEAAYRSGLTSAGVEIFDERATVADAHTVALASGRKVTAKHILIATGGRPFVPDFPGCELAMSSDDVFQLESLPTSILVVGGGYIASEFACILHGLGVEVCQFYRGAQILRGFDDEARGHVASAMIDRGIHIKCGTDVIRLEKTERGVRAVTTDGSDQEFGAVLYATGRRPNTRGLGLEALGIELGRHGQIPVDGWSQTSVPSIYAVGDVTDRINLTPVAIREGHAFADTVFKGEPRQADHELVASAVFTQPELGSVGLSEEAAREQEPIEVYAAAFRPMQSLFAGRPDRVLMKLIVSQASRKVLGCHIVAPNAGEMIQLAAIAVKMGATKEDFDRTVAVHPTMAEELVTLRKPIRTA

SEQ ID NO: 57589 - protein, 484 aa, Agrobacterium tumefaciens str. C58
MKNLHRRDLIEDRAFVNGAWVERDQMFAIVDPAGGDHLADVASCTLNDVDFAIDAASKAFAGWRDMLPVDRGDILRNWSARMRENAHDLATIISAEQGKPLAESRGEIAYAANFLDWFASEGERSYGETIPTHLKGSNLSVRMQPIGVTVAITPWNFPSAMIARKAGAALAAGCTMIVKPAPETPLSALALARLAEESGVPPGVLQVLPGEAAPLARRLLENTEVRAFSFTGSTEVGRILLTQSAATVKKASLELGGHAPFIVFADADLTEAVKGCLGAKFATSGQDCLAANRIYVQRSLYPRFVERFAEATSRLTVGHGLETGVDIGPMTRPSVAEKCRQQVAQALSAGARLVCGGQDSPLGGNFVTPTVLADVTDDMLIAREETFGPVAAILPFDDEAEVIRRANATEMGLAAYLYTNDLGRAMRLTDQLEYGMVAVNTPKFTGAPIPFGGWKQSGLGREGSRHGLMEYLEPKYVCFGNLAA

SEQ ID NO: 57590 - protein, 520 aa, Agrobacterium tumefaciens str. C58
MPSTRRNSPERPFHSAAGNNQALAARARVMASWNISNPNMSASAIWLPERISPMTIDIKNIAEMDRNAVLHPFTQLKDFASGKLGEPTIVETGKGIRIQDAHGKQLIDGFAGLYCVNVGYGRTEVAEAISRQAYRLAYYHSYAAHTTDELAILSDRLVRMAPGKMSKVFYGMSGSDANETQAKLVWYYNNLRGKPQKKKIISRERGYHGCSVVAGSMTGMSFYHDHMDLPRVGILHTGVPHHYWGAEAGETELEFSKRRAAELEALILREGPDTIGAFIAEPVLGTGGITPPPEGYWPAIQEVLKKYDVLLIADEVITGFGRTGSMFGSQHYGIEPDLITVAKGLTSAYFPLSGAIVGEKVYTVMEDGADRVGAFSHGYTYSGHPIGAAAANAVLDIVEKEDLPGNAQAVGSYFQEQLKAKFAQLPIVGEVRGVGLMGAIEFVADREKKTRFAPHLTVGARVSKAARNGGLIARAMPHGDILGFAPPLVTTKAEVDEIIAIAEAAVRTVMDDLVQAGEKI

SEQ ID NO: 57591 - protein, 363 aa, Salmonella typhimurium LT2
MSKNYHIAVLPGDGIGPEVMAQALKVMDAVRSRFDMRITTSHYDVGGIAIDNHGHPLPKATVEGCEQADAILFGSVGGPKWENLPPESQPERGALLPLRKHFKLFSNLRPAKLYQGLEAFCPLRADIAANGFDILCVRELTGGIYFGQPKGREGSGQYEKAFDTEVYHRFEIERIARIAFESARKRRRKVTSIDKANVLQSSILWREIVNDVAKTYPDVELAHMYIDNATMQLIKDPSQFDVLLCSNLFGDILSDECAMITGSMGMLPSASLNEQGFGLYEPAGGSAPDIAGKNIANPIAQILSLALLLRYSLDANDAATAIEQAINRALEEGVRTGDLARGAAAVSTDEMGDIIARYVAEGV

SEQ ID NO: 57592 - protein, 192 aa, Yarrowia lipolytica CLIB122
MSDPINANPEVIDVSALPTRNKGQSQLDLPLGAFLDTHPTPLSLIQNESASGSDDDDDDDEPEPIDSQEIYDLIATISDPEHPLTLGQLAVVKLEDIWVHDTGDKNKMAEIVVKITPTITHCSLATLIGLGIRVRLERALPPRFRFTITVKEGTHQSENQVNKQLNDKERVAAACENEQLLGVISGMLATCQ

SEQ ID NO: 57593 - protein, 191 aa, Triticum aestivum
  misc_feature (33)..(33): Xaa can be any naturally occurring amino acid
  unsure (1)..(191): unsure at all Xaa locations
SLSLSLSLSLSLSLSLSLSLSLSLSEDNGSMPXESFYTNGGLKLRVVWTISSLIAASTRHYLLRSIIKEHPTLVSLVLTDADGQGTLTMGAEQLKEFRENQLSASACSNRTQVPACNMKLKYAPYLELPGGIALQGATLVAIKPSTEGSNGGHISRKETDAFISGAFDGPFKFALKALMKRRTYLLEMNGF

SEQ ID NO: 57594 - protein, 415 aa, Methanococcoides burtonii DSM 6242
MSDVSAGSTTEKKFSDMDSNGEEHNTDEIQEVDIQKVISENDLLKVQNETMKAKLLETSMMVNKYLSEMDQLKDQLDHLTTPPLFIASVMEVEDDMALLRQHGNNQEVMTRIPPEMEGTIGPGMRVSINAAFAIIAIISRAADVRAQMMELIDSPGIDYDMIGGLDDVLKEVIESVELPLTEPELFENIGIEPPSGVLMYGSPGTGKTLIAKAVASRAHATFIRMSGSDLVQKFIGEGARLVKDVFQLAREKSPSILFIDEIDAVGGMRTHDGTTGSAEVNRTMLQLLAEMDGFDPSGNVKIIAATNRIDLLDPALLRPGRFDRIIEIPIPDEKAREEILKIHTRKMNLEKDIDLAKIANMTDGLSGADLNVIVKEAGMFVLRRRGDMIKMQDFLEAFEKVVSEEEVNTPAGMFA

SEQ ID NO: 57595 - protein, 1002 aa, Oryza sativa (indica cultivar-group)
MGSGSLLLSLLLVLVVVNVGVAVNQDGLSLLDARRALAAPDGALADWNARDATPCSWTGVSCDAGVGGGAVTGISLAGLNLTGSFPAALCRLPRVASIDLSDNYIGPNLSSDAVAPCKALRRLDLSMNALVGPLPDALAALPELVYLKLDSNNFSGPIPESFGRFKKLESLSLVYNLLGGEVPPFLGGVSTLRELNLSYNPFVAGPVPAELGNLSALRVLWLAGCNLIGAIPASLGRLGNLTDLDLSTNALTGSIPPEITRLTSVVQIELYNNSLTGPIPVGFGKLAELQGVDLAMNRLNGAIPDDFFEAPKLESVHLYANSLTGPVPESVAKAASLVELRLFANRLNGTLPADLGKNSPLVCVDMSDNSISGEIPPAICDRGELEELLMLDNKLSGRIPDGLGRCRRLRRVRLSNNRLDGDVPAAVWGLPHMSLLELNDNQLTGVISPVIGGAANLSKLVLSNNRLTGSIPPEIGSASKLYELSADGNMLSGPLPGSLGGLEELGRLVLRNNSLSGQLLRGINSWKKLSELSLADNGFTGAIPAELGDLPVLNYLDLSGNRLTGEVPMQLENLKLNQFNVSNNQLSGALPPQYATAAYRSSFLGNPGLCGDNAGLCANSQGGPRSRAGFAWMMRSIFIFAAVVLVAGVAWFYWRYRSFNNSKLSADRSKWSLTSFHKLSFSEYEILDCLDEDNVIGSGASGKVYKAVLSNGEVVAVKKLWGLKKGTDVENGGEGSAADNSFEAEVKTLGKIRHKNIVKLWCSCTHNDTKLLVYEYMPNGSLGDVLHSSKAGLLDWSTRYKIALDAAEGLSYLHHDCVPAIVHRDVKSNNILLDAEFGARVADFGVAKVVEATVRGPKSMSVIAGSCGYIAPEYAYTLRVNEKSDIYSFGVVLLELVTGKPPVDPEFGEKDLVKWVCSTIDQKGVEHVLDSKLDMTFKDEINRVLNIALLCSSSLPINRPAMRRVVKMLQEVRAEATRPRLEKDGKLSPYYYEDTSDQGSSV

SEQ ID NO: 57596 - protein, 327 aa, Escherichia coli
MSERHLPDDQSSTIEPYLITSVRQTLAEQGAALQNLSKQLDSGQYQRVLNLIMNCKGHVILSGMGKSGHVGRKMSATLASTGTPSFFIHPAEAFHGDLGMITPYDLLILISASGETDEILKLVPSLKNFGNRIIAITNNGNSTLAKNADAVLELHMANETCPNNLAPTTSTTLTMAIGDALAIAMIRQRKFMPNDFARYHPGGSLGRRLLTRVADVMQHDVPAVQLDASFKTVIQRITSGCQGMVMVEDAEGGLAGIITDGDLRRFMEKEDSLTSATAAQMMTREPLTLPEDTMIIEAEEKMQKHRVSTLLVTNKANKVTGLVRIFD

SEQ ID NO: 57597 - protein, 323 aa, Synechococcus sp. WH 5701
MATVAELLQPVENDLETLLSDLRSLIGAGHPILQAAAEHLFSAGGKRIRPGIVLLLSRALSPDGELSSRHRRLAEITEMIHTASLVHDDVVDEASTRRGVDTVHSRFNNRLAVLAGDFLFAQASWHLANLDDLAVVKLLSRVIMDLADGEVRQGLYRYDTGQSFETYLDKSYCKTASLIANSAKASGVLSGLADDRLEDLYRFGRQLGLAFQVVDDILDFTGSDQQLGKPAASDLATGYLTAPVLYALEERPALAGLIERELCEPDDLAQALALVRGCEAIPRSRALAEGFAREAGEALQWLSPSDSRTALLGLPEFVLSRLY

SEQ ID NO: 57598 - protein, 333 aa, Vibrio parahaemolyticus RIMD 2210633
MQGLTSAGYTMDFKTIQALTADDMAKVNETIQAQLNSDVSLINQLGFYIVSGGGKRLRPLLAILSARALGYQGTGHTMAAAFIEFIHTATLLHDDVVDESDMRRGKATANAAFGNAASVLVGDFIYTRSFQMMTELGSMKILQLMSNAVNVIAEGEVQQLMNCNDPDTTEESYMQVIYSKTARLFESATQIGAILNDAPEHVELALQNYGKYLGTAFQLIDDVMDYTSDGEDMGKNVGDDLAEGKPTLPLLHAMRNTTPENALMIREAIEKANGMERLDEILAVMKEAGSLEYTTQKALEEADKAIAELEVLPESEYKEALITLAHVAVKRTR

SEQ ID NO: 57599 - protein, 459 aa, Vibrio parahaemolyticus RIMD 2210633
MFNFFKTRPDLPLSDGSKEEMQARFKRYQWHVFLGLVFGYAVFYVVRMSLGVVKKPMLDAGIVTIEELGIMGSAFFFTYAFGKFSNGFLSDYANIGRFMSFSLLLSGITAVFMGLNTTAFFFVLLWGLNGWFQSVGSAPSCVSLFQWFSPKQRGSRYSIWGGSRNIGEGITWILTASLVSYFGWRAGFIGAGIAAIAAAICMFFILKDRPQTYGLPDSATAFDEEPEIKKKNDPQATRRAQMFILKQPTVWLIAAACAAMYISRYAMSSWAVLYLQEAKGYSLIDAGFAMSTYPIAGLAGAILSGIISDKVFNSNRHIPTLLYGLANIGGMCLMFFGPDNRIVDAVALGMIGFAIGGLVVFLAGLTACDLMPKNAVGAVKGFIGLFSYIAASGQELASASLIKITEVDGVTKYDFAQAQYFWLAAGVISLLLALTVWNAKKVVDIDPVEEKELEARPSH

SEQ ID NO: 57600 - protein, 216 aa, Nicotiana tabacum
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGSDMEETLVEAIYTAEQSENAFYMHDEAMFEMPSLLANMAEGMLLPLPSVQWNHNHEVDGDDDDVSLWSY

SEQ ID NO: 57601 - protein, 717 aa, Bacillus halodurans C-125
MKQIEEQAVKCLFHSAEIVTLHTVMIHFTVTKEQVCPFVVEKEGTTVPFSIKSWQEWERGAIAFIQFDDPLELGVEYKLRQKNHEQTHLIKVGRVVRTEAFDQQYVYNGELGALYSHERTVFAVWTPVATEVSLLLYENWHTLEAIEYQMKRSPNGVWSVSLDGDLHQYCYLYRAKVNGKWKTTVDPYAKSVTVNGEKGVIFDLKRTDPASWPTVHPIPPEHTIIYELHIRDATVYPGSGHHKKGTYLSLAEQNTCGPWGESTGLSYIRELGVTHLELLPVADYGSVDEANREKEYNWGYDVVHYFAPEGSYASDPYDGVTRVKELKQLIAQCQRMDLRVILDVVFNHVYVMKESPFEKLVPGYYFRYDGEGNLADGTGVGNDIASERLMVRKFIVDCVTYWASEYRVDGFRFDLMGIIDQMTMKEVKRALAPINRQILLLGEGWDLETPLENDQKTTLAQARAVPFLHFFHDTFRDAVKGSTFDLNKGGFCAGNIELKETLIASMLGHEAQFDRPSQAIQYVEAHDNHTLWDKLQFVFPDEEEEVLRACHRLATAIVLTSQGIPFLHGGQEFFRTKHGEGNSYNSPDWINQLDWSRRAIYAADVEYVKGLIALRKAHRAFCFSTFSEVNTHMCPLKTPSEVIGFHYHHIAKWGPWDEMVVLHNGGGDKVDIRLPASGEWEVIVDGKKAGLVPLYTFNGHTVSVQSRSSMVLYRLNE

SEQ ID NO: 57602 - protein, 405 aa, Medicago truncatula
MPATDYQGSSPSSLTNFGRSILSFRREQIHSMEGSTLEIELDSFQQHVTDRFVDLSSVPHDELLSLKWVGKMLDCFLICQEEFKAILHTHKGQVVRPPLDRMVSEYFERSVKALDVCNAIRDGVEQIRVWQKLLEIVLYALDHQRSIGEGQFRRAKKALIDLSISMLDDGKESNASVAHRNRSFGRSNGGRDRDHHQHGNSHSNNNINTYQHRSMGQFRSLSWSVSRTWSAARQLQAIGNNINPPRANDLMATNGLAMSVYTMNSVLLFVMWALVAAIPCQDRGLNVHFSIPRSYTWAIPLLLLHERIMEESKKRDRKNACGLLREIQQIEKCVRVMSDLVDSAHFPLTEEKEGEVRQKVHEVSKVCDALKDGLDPLERQVREVFHRIVRSKTEGLDSLGRPNNE

SEQ ID NO: 57603 - protein, 352 aa, uncultured bacterium
IGAANNLLAAMLDNHIYQGNELDIDTRRIVWRRCVDMNDRELRNIVVGLGGKAHGVPREDGFDITVASEIMAAFCLATSLDDLKARFARIVVAYNRKGEPVTAGQLGAQGAMTALLKDALKPNLVQTLEGTPAFVHGGPFANIAHGCNSVMATNMARHFGDYVVTEAGFGADLGAEKFLDIKCRLTGIRPSAVVIVATIRALKYNGGVPKAETGTENLEALEKGLPNLLKHVENITQVYKLPCVVALNRFVADTDAEIELVTRKCAELGVNVKMSEVWGKGGEGGIELAEEVVKLCEQPNDFSFSYDLDLPIKDKIKAIATRIYGADDVVYAGKVEQEIANLEALGFGNLPI

SEQ ID NO: 57604 - protein, 262 aa, Rhodobacter sphaeroides 2.4.1
MPAELSPIDTAKFAAARRAVDLVQDGMKLGLGTGSTAAWMVRCLAERVREEGLRVQGVPTSTRTAELARALGIQVVTLDEAKWLDLTIDGADEFDADFNLIKGGGAALLQEKIVATASDRMVVIADAAKEVAHLGAFPLPVEVIPFGWQSTKMLIEETLEGMDVLGREVTLRLSGDAPLLTDEKNYILDLHLKRIGEPRPLALALNQIAGVVENGLFIDICDTVVVGHGDGRVSLRDLQSGQAEEGSIDMDRARNIFADLGD

SEQ ID NO: 57605 - protein, 361 aa, Azospirillum brasilense
MTAGKRIGILTSGGDCAGLNAVIRAVVHRAVLTYGWQVLGIKEGTQGLLQRPVQYQVLDLPQVDGNMMRMGGTILGTTNRGDPFAYPMADGTQKDRSDEIIGGYRELGLDALIGIGGDGSFAILKKLADKGGFQMVGIPKTIDNDLGLTEVSVGYDTAVGVAVEALDRLQPTAASHARVMVLEVMGRDAGHIALAAGIAGGADVVLIPEIAYSIEKIAQKIKQVRSTGRNFALVVVSEAVKTVDGTGVQKLFQGGQKRYGGIGDYIGEKIAEATGAETRVTVLGHVQRGSMPSPRDRLVASAFGVHAVDLIAEGKFDRMVAWSDRGVIDVPITEAIAKYACVELDGAMVKTARGLGISLGD

SEQ ID NO: 57606 - protein, 1054 aa, Rubrobacter xylanophilus DSM 9941
MPRRDDIRSILIIGSGPIVIGQAAEFDYSGTQACRALKEEGYRVILVNSNPATIMTDPEMADTTYIEPLRAETVAEVIRRERPDALLPTLGGQTALNLAVELSEAGVLEEYGVQLLGASIPSIQKAEDRQLFREAMERIGLRVPESRTVRSVPEAEELAERIGFPLIIRPSFTLGGTGGSVAEDLDALRASVRDGLDASPVRSVLVERSVAGWKEFELEVMRDLADNVVIVCSIENVDPMGVHTGDSITVAPAQTLSDRQYQSLRTAAIRIIREIGVSTGGSNIQFAVNPEGDDFYVIEMNPRVSRSSALASKATGFPIAKIAARLAVGYTLDEITNDITGATPASFEPALDYVVTKIPRFAFEKFPGTSARLTTRMHSVGEVMAIGRTFTESLLKAMASLEIETRDIQARLDEPSPYRIFAVFEALRAGMDIPEIYRRTSIDPFFIAAAARIVAAEGAVEETLSAEQVRELKRMGFTDEALAACSGYPAEVVRGVRRALGVHPTYKAVDTCAGEFPARTPYYYSTYEQEDEVERGENPSVVVLGSGPNRIGQGIEFDYACVHASYELKACGYDAVMINSNPETVSTDYDTSSRLYFEPLTAEHVLEVVRRERPEGVILQFGGQSPLKLARELERAGARVLGTSPEAIDLAEDRSRFGRLLRELGIPHPRFGTATTAAEAREVARRLGYPVVVRPSYVLGGRRMEIVYGDEDLELYLRSSVSGSPEHPILVDKFMEAYVEVDVDAVSDGEEVYIGGIMEHIEEAGVHSGDSSCVTPPITLTRSLQERIEDYTRRLALSIGVVGLMNVQYVVRGDEVMAIECNPRASRTVPYISKATGVPLARLATRVLLGEKLRDLGPRPASSGSFAVKAPVFPFDRFAEVDPLLGPEMRSTGEAMGIDPTFGGAFAKALAAAGQRLPESGRVYVSVADRDKRAAVLIARGFADLGFEVLASEGTAGVLRNNGLPAAVVPKIGEGGEDVLGLIERGGVDLIVNTPWGRGSRTDGYLIRRKALMHRVPCITTLAGAAAALQGIEARIRGETRRVHSLQDLYAART

SEQ ID NO: 57607 - protein, 352 aa, uncultured bacterium
ITSANNLCAALLDNHIQQGNELNIDTRNIVLKRCEDMNDRVLRNIVVGLGAKADGFVREDHFVITVASEIMAILCLASDLEDLRARLSRMVVAYDMTGKPVTAKDIKAVGAMMALLKDAAKPNLIQTLEHTPALVHGGPFANIAHGCNSVRATKAALKMGDIAITEAGFGADLGAQKFLDIKCPMAGLAPDACVIVATVRALKYNGGVPKDALSDENLDALKNGIANLEKHIENIKKYGVPVVVTLNRFVTDTDAELAFVRSFCEDKGCSFALSEVWAKGGEGGEELARAVLDTLENKKSEYKPLYDHSLPIKEKIDTIAKEIYGAGNVVYADSVVKKMTELEAQGFSKLPI

SEQ ID NO: 57608 - protein, 354 aa, Emericella nidulans
MVQQMPPQGGSRKISFNVSDQYEIQDVIGEGAYGVVCSAIHKPSGQKVAIKKITPFDHSMFCLRTLREMKLLRYFNHENIISILDIQRPRNYESFNEVYLIQELMETDMHRVIRTQDLSDDHCQYFIYQTLRALKAMHSANVLHRDLKPSNLLLNANCDLKVCDFGLARSAASTDDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPFKALFPKSNDLALDLLEKLLAFNPTKRITVEEALRHPYLEPYHDPDDEPTAPPIPEGFFDFDKNKDALSKEQLKILIYEEIMR

SEQ ID NO: 57609 - protein, 451 aa, Lactobacillus sakei
MIILSQATDYVQHVYQVIEHRDPNQTEFLEAINDVFKTITPVLEQHPEYIEANILERLTEPERIIQFRVPWLDDAGHARVNRGFRVQFNSAIGPYKGGLRLHPSVNLSIVKFLGFEQIFKNALTGLPIGGGKGGSDFDPKGKSDNEIMRFCQSFMTELSKYIGLDTDVPAGDIGVGGREIGFLYGQYKRLRGADRGVLTGKGLNYGGSLARTEATGYGLAYYTNEMLKANQLSFPGQRVAISGAGNVAIYAIQKVEELGGKVITCSDSNGYVIDENGIDFKIVKQIKEVERGRIKDYADRVASASYYEGSVWDAQVAYDIALPCATQNEISGDQAKNLIANGAKVVAEGANMPSSPEAIATYQAASLLYGPAKAANAGGVAVSALEMSQNSMRLSWTFEEVDNRLKQIMQDIFAHSVAAADEYHVSGDYLSGANIAGFTKIADAMLAQGLV

SEQ ID NO: 57610 - protein, 352 aa, uncultured bacterium
ITSAHMLLSAMLDNSIQQGNPLNIDPRRIIWKRVVDMNDRALRNIVIGLGGKAHGVPREDGFDITVASEVMAILCLASNLHDLKERLKRIVVAYNYDGKPVTAEDLHAAGAMAALLKDAVKPNLVQTLEHVPAIIHGGPFANIAHGCNSVMATRTALRLADFTITEAGFGADLGAEKFFDIKCRQAGLAPDACVPVATVRALKMHGGVAKADLKEPNVEAVKKGLPNLGKHIENIFKFGVPVVVAINIFAQDTKEELQAVYDFCAGMGVNVALSDVFAKGGEGGVELAKEVVALAESGMARFKPIHPLEMSLREKVATVVKEVYGGDRVEFQTKAAQALDQYEKEGYGNLPV

SEQ ID NO: 57611 - protein, 633 aa, Ehrlichia ruminantium str. Welgevonden
MLINCYVCYKLVLNFIKFRDIMSSEGDYQSICNLAIIAHVDHGKTTLLDAMLKQSGTFRENQDVAERVMDNNDLERERGITILAKCTSITWQGKKINIIDTPGHADFGGEVERVLSMADGVLLLVDASEGPMPQTKFVLSKALKAGLLPIVIINKVDRPDSRIDEVLDEVYELFMNLDATDEQLDFPILYASGRSGWCVKSLSDNRENLVPLFDAVIQHVKPISYDINAPFSMLLTLLESDKFLGRVLTGKIYTGTAKINDSVKVLNLAGEVVEYGKLTKLLSFSGLKRVPVKDARAGDIIAVAGLEKASVSDSIVDSSITHPIASTPVDPPTMAVTISVNDSPFAGTEGVKLTSTVIKARLIAEAETNVAITVKETEQGDAYEVGGRGELQLGVLIETMRREGFELSVSRPRVLLKKDDNGQVLEPIEEVVIDVDEVYSGIIMEKLNLRKGDMQDLRPSGKNRVRMVFLVPSRGLIGYQGEFLTDSHGTGIINRLFYSYAPHKGNIPTRNNGVLISNDKGEAVAYALFNLQDRGMMFIKPQDKVYCGMIVGLHSRENDIDVNVLKGKQLTNIRAAGSDEAVRLVPPKLMTLEEMIAFINDDELVECTPKSIRLRKKYLDPNERKRAFRANKI

SEQ ID NO: 57612 - protein, 233 aa, Arabidopsis thaliana
MVSSSLTKLVFFGCLLLLTFTDNLVAGKSGKVKLNLYYESLCPGCQEFIVDDLGKIFDYDLYTITDLKLFPFGNAELSDNLTVTCQHGEEECKLNALEACALRTWPDQKSQYSFIRCVESDTKGWESCVKNSGREKAINDCYNGDLSRKLILGYATKTKNLKPPHEYVPWVTLNGKPLDDSVQSTDDLVAQICKAYKGKVALPKVCNSSASMSKSPERKWKLQVSYANKATNY

SEQ ID NO: 57613 - protein, 352 aa, uncultured bacterium
IGAANNLLAAMLDNHIQQGNSLGIDGKQITWKRAVDMNDRQLRRIVDGLGGRAQGVPREDGFEITVASEIMAVLCLASDLKDLKARLARIIVGYTYDGKPVTAHDLKAEGAMTALLKDAIKPNLVQTLEGTPAFVHGGPFANIAHGCNSVIATHTALKLADYVITEAGFAADLGAEKFLDIKCRVSDLHPSAVVIVATVRALKYHGGIPKAELNAENLEALEKGLPNLLQHVSNIKNVFGLPCVVAINAFPTDTEAELKLVEKKCRELGVNVALSEVWAKGGEGGIALAEEVVRLCEQPNSFTFSYPLEMSIEEKLETICKKIYHADGVTLDANARKQAEQLTALGFDKLPI

SEQ ID NO: 57614 - protein, 400 aa, Thermoplasma acidophilum DSM 1728
MYEFKLPDIGEGVTEGEIVRWDVKEGDMVEKDQDLVEVMTDKVTVKIPSPVRGKIVKILYREGQVVPVGSTLLQIDTGEEAPVQQPAGRAESTVQVAEVKQVPLPEVSGHVLASPAVRRIARENGIDLSKVGGTGEGGRVTLDDLERYMKSPAPSPAPSAGKAEAVHTAPQIPAQKPAPGREEILEMHGLRRIIFDKMTKAKQIMPHFTVMEEVDVTSMVSILDSAKARNRKVTVTGFLARIVPSILKQYPYLNAIYDETRRVYILKKYYNIGIAVDTPDGLNVFVIKDADRKSMVEISAEISDKASRARENKLQLDEVQDSTFTITNVGTIGGIMSTPIINYPEVAILGVHRILEREGRKYMYLSLSCDHRLIDGAVATRFIVDLKKVIEDPNAIIYEI

SEQ ID NO: 57615 - protein, 319 aa, Thermoplasma acidophilum DSM 1728
MNMVQALNSAMDLKMSEDDSVIILGEDVGRDGGVFRVTDGLQAKYGPQRVIDTPLSELGIVGMAIGMAVNGLKPIPEIQFQDFIYTSMDQIINQMAKIRYRSGGDYTVPLVLRTPVGGGIKGGLYHSQSGEAYFAHTAGLTVVSPSNPYDAKGLLISAIESPDPVIFLEPKRLYRAQKVEVPDEKYTIPLRKANVLKQGNDVTIVTYGSMVPTVMSVASKSKYDVEVIDLRTIAPMDRDTIISSVKKTGRVVIVHEAPRTLGVGAEISAMISERAIEYLYAPIVRVTGPDTPFPYRLEEYYLPNEGRINAALDRVMSFR

SEQ ID NO: 57616 - protein, 252 aa, Triticum aestivum
CKSKRGSNYTNLEDIQLCKSWIHISNDPIIGNQQPGKTYWERIANDFHMNRNFESDRTPNSLEHRFGIILKECMKFQGYYEEVERCHPSGIPYQEHLLEAHARYARKANGKNCQFEQCWLTLRHTQKFESTLEANKKPAKSRELNLSVGIEQENDESSAQGQETSSIPSAKKARPPGRKQSKEKLKKNEGDDDYKDMMQNLLVMKTEEHMMKKERWEKDMMLEQRKLKMEEEWLQWEQEQKIMFCDVTTMDD

SEQ ID NO: 57617 - protein, 377 aa, Streptococcus mutans UA159
MNNQEYYDRLGVSKDASQDEIKKAYRRMSKKYHPDINKEPGAEEKYKEIQEAYDTLGDEQKRAAYDQYGPAGANGGFGDGSGFSGFDSSGFGGFEDIFSSFFGGGASRNPNAPRQGDDLQYRVNLQFEEAVFGTEKEVHYNREASCHTCNGSGAKPGTSPVTCSKCHGSGVINMDTQTPLGMMRRQVTCDVCHGTGQEIKEPCPTCHGTGHEKQSHKVSVKIPAGVETGQQIRLAGQGEAGFNGGPYGDLFVIINVLKSDKFERDGSTIYYSMDINFVQAALGDTVEVPTVHGNVELAIPAGTQTGKTFRLKGKGAPRLRGNGQGDQHVTVNVVTPTKLNDAQKEALQDFAKASGINPVHPKKKGFFNKVKDAFDEM

SEQ ID NO: 57618 - protein, 1407 aa, Aspergillus oryzae
MSLSSSTSDTKSTVAGEERDTEDETKRDSVQHVQATWHMAPELHRMRERDEAGGEKPRKLGIAWQNLTIKGVGGNATFKENVVSQLLPFHKGSNDTQLKTIIQDSYGCVKPGEMLLVLGRPGAGCTTLLSVLANNRQGYEEVTGDVSYGNMSAVEAQQYRGQIIMNSEEEIFFPTLTVEDTIKFAARMKVPYHLPPGITTHEEYVQFYKDFLLRSVGISHTERTKVGDAFIRGVSGGERKRVSILECLTTRASVFCWDNSTRGLDASTALEWIKAIRAMTDVLGLATIVTLYQAGNGIYEHFDKVLVLDEGKQIFYGLRKDAVPFMEDLGFMRDPGSNQGDFLTGVTVPTERRIAPGYEDKFPHTADEILAAYERSEVKRRMLEECQIYPKSKEADENTAVFKEMVSREKHRGTFKKSPVTADFITQIKAAILREYQLKRGDKATLLMKQGATLIQALLGGSLFYSAPDNSSGLFLKGGALFFSILYNALIALSEVTDSFTGRPILAKHRSFALYHPAAICIAQIVADFPMLLFQVTHFGLVLYFMVGLKTSAGAFFTYLITNFITAMSMTAFFRLVGAAFPTFDAATKVSGLSIVALFVYMGYMIIKPLMHPWFVWIFWINPMAYAFEALLGNEFHAQDIPCYGPNLIPSGSEYIDGAGGQSCAGVVGAAPGATSLKGDDYLAAISFSHSHIWRNVGIICAWWALYVGLTILFTSRWKLLGDGSRRLLIPREQQHRSKHLLQSVDEEARATEKSTVSSNTSSESIGDNLLRNKAIFTWKDLTYTVKTPEGDRVLLDNVQGYVKPGMLGALMGTSGAGKTTLLDVLAQRKTSGTIHGSILVDGRPVPISFQRSAGYVEQLDIHEPLATVREALEFSALLRQSRDTPTEEKLRYVDIIVNLLELNDLEHTLIGHPGTGLSVEQRKRLTIAVELVAKPSILIFLDEPTSGLDGQSAYNTVLFLRKLAEAGQAVLVTIHQPSAQLFTQFDKLLLLTTGGKTVYFGDIGPNASTIKKYFGRYGSPCPPEANPAEHMIDVVSGKGEGQDWNQIWLQSPEHEKLSGELDSMTAEALSRNTTVNDEQHEFAASLWTQTKLVTHRMNISLFRNTEYLNNKFAMHISLALLNGFTFWMIGDSLTDLQQNLFTVFNFIFVAPGVISQLQPLFIDRRDIFEAREKKSKMYHWAPFVTGLIVSEFPYLLVCAFLYYVCWYFTVGLPTSPYHAGSVFFVVVMYECLYTAIGQMIAAYTPNAVFASLVNPLVITTLVSFCGVMIPYSQIQPFWRYWMYYIDPFNYLMSSLLVFTTWDKPVHCTPDELAVFDPAPNQTCGEYLETYQRGLGVATNLLNPLDTAGCRVCQYTEGGDYLRTLNLAERSYGWRNAGIVVSFVIGIYGLVFLMMKLRTKATKKAES

SEQ ID NO: 57619 - protein, 297 aa, Aspergillus oryzae
MSTLIEISSEAEFDSHIKSLPSTTLSILYFHAPWAAPCAQMRTVLAALASQYPATQPPTTSFISINAEELPDISETYEVTAVPFVVLTRDGKILESISGSDAVRVREAIERHAGSKASTGAPATIPPPLAAVPRETGPTTATQPPAGAANGDALTPEQSKEALFARLRELVKAAPVMLFMKGTPSAPQCGFSRQLVAILRERSVKYGFFNILADEDVRQGLKEFADWPTFPQLWVGGELVGGLDIVSLYFLFFFFLCLVSLPWLNGLVLIGEQVKDEIENDPDFLREHSVNKAPVAA

SEQ ID NO: 57620 - protein, 161 aa, Yarrowia lipolytica CLIB122
MLSRSLRQLSQPSVRSFATSARLLQKKDVPEVGVNLDNVPAHEIVSGAPAELSRNRVVRIYQQAKPATQSGEYGTFAWRLDWDIVDVANRWENDLIGWQSSGDYMQATQMKFTSKESAIKFANKQGWDFYIQEPHHRKFRVKQYANNFVHSYGKLKHIRTK

SEQ ID NO: 57621 - protein, 447 aa, Flavobacteria bacterium BBFL7
MEKNIESFIDLIKSKNPNEPEFIQAVSEVAEAVIPFIENNPQYASDKLLERMAEPERVTMFRVPWTDDNGEVQVNRGYRIQMNSAIGPYKGGLRFHPSVNLSILKFLAFEQVFKNSLTTLPMGGGKGGADFNPKGKSDREVMRFCQSFMVELQRVIGADTDVPAGDIGVGGREIGYLFGYYKKLRNEFTGILTGKGRSYGGSLIRPEATGYGNVYFAENMLKTRGESITGKTTVISGSGNVAQYAAEKILQLGGKVVTMSDSGGYIHDADGIDADKLAFVMDLKNNRRGRISEYVSQYPSATYHEGERPWSVKCDIALPCATQNELNGDEAKTLVSNGCMCVSEGANMPSTPDAIEHFIDNKILFAPGKASNAGGVATSGLEMSQNSMRYSWTAEEVDNKLHGIMNDIHEACVEYGKDSDGFVDYVKGANIAGFVKVADAMLAQGIV

SEQ ID NO: 57622 - protein, 475 aa, Staphylococcus aureus subsp. aureus Mu50
MRDYTKQYINGEWVESNSNETIEVINPATEEVIGKVAKGNKADVDKAVEAADDVYLEFRHTSVKERQALLDKIVKEYENRKDDIVQAITDELGAPLSLSERVHYQMGLNHFVAARDALDNYEFEERRGDDLVVKEAIGVSGLITPWNFPTNQTSLKLAAAFAAGSPVVLKPSEETPFAAVILAEIFDKVGVPKGVFNLVNGDGAGVGNPLSEHPKVRMMSFTGSGPTGSKIMEKAAKDFKKVSLELGGKSPYIVLDDVDIKEAAKATTGKVVNNTGQVCTAGTRVLVPNKIKDAFLAELKEQFSQVRVGNPREDGTQVGPIISKKQFDQVQNYINKGIEEGAELFYGGPGKPEGLEKGYFARPTIFINVDNQMTIAQEEIFGPVMSVITYNDLDEAIQIANDTKYGLAGYVIGKDKETLHKVARSIEAGTVEINEAGRKPDLPFGGYKQSGLGREWGDYGIEEFLEVKSIAGYFK

SEQ ID NO: 57623 - protein, 404 aa, Vibrio parahaemolyticus RIMD 2210633
MQDALAVILAGGMGSRLSPLTDDRAKPAVPFGGKYRIIDFTLTNCLNSGLRKILVLTQYKSHSLQKHLRDGWSIFNPELGEYITAVPPQMRKGGAWYEGTADAIYHNLWLLSRNDAKYVVVLSGDHIYRMDYAAMLEEHKEKGAKLTVACMDVPVKDASAFGVMGIAENGLVKSFVEKPENPPTLPDDNAKSLASMGIYIFDMDVLKEALTEDAKLETSSHDFGNDIIPKLIDTESVYAYKFCGSKGRVDKDCYWRDVGTIDSFYEANMDLLEPVPPMNLYQSNWAIRTYEPQFPPARTVSSATGNEGIFINSIIATGVINSGGSVQHSIISSNVRIQDSATVVDSIIFDDVEVGEGSQLVNCIVDKHVRIPPNTQIGINKVEDAKRFKISEKGIVVIPESYQF

SEQ ID NO: 57624 - protein, 582 aa, Vibrio parahaemolyticus RIMD 2210633
MQSDIEICRNTPLSSIDVIAEKAGLLPEEFDTHGKYKAKVHPKCLARLNDNQNGKLVLVTAITPTPLGEGKTVTTIGLAQGLAKLKQSVMACIRQPSMGPVFGIKGGAAGGGYSQVAPMEELNLHLTGDIHAVTAAHNLASAALDARLFHEQREGYDAFEARTGLKALKIDVESITWKRVMDHNDRALRMVKIGLNEHGKTINGFERNEGFDISAASELMAIIALAKNLKDLRQRIGKIVVAYDLDGQPITTEDLQVAGAMAVTLKEAIAPTLMQTLEGVPTLIHAGPFANIAHGNSSIIADEIALKLSRYTVTEAGFGSDMGFEKACNIKAAAANKAPDCVVIVATLRGLKANSGHYDLRPGMAIPDSIFSPDQAALVAGFENLKWHIKNVHKYGIPAVVAINQFPQDCEQELTALQDLIHAFDPNVKVAISTAFAQGGEGTRDLAQYVVDACEKTTNFRPLYQKHQSLQEKLMSVCEAGYGATNVEMSELATKQLAHFEKLGFNELAVCIAKTPLSVTTDSSVKGAPVGFTVPIRELRLCAGAGFVYALSGSVMTMPGLPDKPAFMNLDLDEDGNIIGLS

SEQ ID NO: 57625 - protein, 438 aa, Synechococcus sp. WH 5701
MTSAPVSVPALNTSRSQDLFSAAQTLMPGGVSSPVRAFRSVGGDPIVFDRVKGAYAWDVDGNRYIDYIGSWGPAICGHARPEVIAALHEALDKGTSFGAPCALENTLAEMVIEAVPSVEMVRFVNSGTEACMSVLRLMRAFTGRDKLIKFEGCYHGHADMFLVKAGSGVATLGLPDSPGVPRSTTTNTLTAPYNDLEAVKQLFADNPGEIAGVILEPVVGNAGFITPEPGFLEGLRELTTEHGALLTFDEVMTGFRISYGGAQARFGITPDLTTLGKVIGGGLPVGAYGGRAEIMAMVAPAGPMYQAGTLSGNPLAMTAGIKTLELLKQPGTYERLEAITKRLSDGILAAGREAGLPICGGSISAMFGFFLCEGPVRNFEEAKATDSQRFGRLHRAMLERGVYLAPSAFEAGFTSLAHSDADIEATLRAFRDCFAAIA

SEQ ID NO: 57626 - protein, 327 aa, Crocosphaera watsonii WH 8501
MAETLLFNALRQAIDEEMGRDETVFVLGEDVGHYGGSYKVTKDLAKKYGDLRVLDTPIAENSFTGMAVGAAMTGLRPIIEGMNMGFLLLAFNQIANNAGMLRYTSGGNFKIPMVIRGPGGVGRQLGAEHSQRLEAYFHAVPGLKIVACSTPYNSKGLLKAAIRDENPVLFFEHVLLYNLKENLPDGEYIVPLDKAEIVRKGKDVTILTYSRMRHHCLQALKEMEAQGYDPEIIDLISLKPFDLQTIGESIRKTHRVIIVEECMKTGGIAAELIALINDNFFDELDAPVIRLSSQDIPTPYNGMLERLTIVQPPQIAEAVDKLMTLHI

SEQ ID NO: 57627 - protein, 233 aa, Synechococcus sp. WH 5701
MTCAEARAYASAFLPLLGNLPSDREVVLAPPFTAIAALSEALEGSAVKIASQNVHWDDVGAYTGMISAPMLLEHGVSHAIVGHSEPRKYYSETDEQINLRARTAQKSGMIPILCVGESDSQREAGEAERVIRRQVDQGLEGLDPTQLVVAYEPIWAIGTGKTCGAEEANRLCALIRGWVGYEDVVIQYGGSVKAENIDLLMAQPDIDGVLVGGASLDPTGFARIARYQVPVAA

SEQ ID NO: 57628 - protein, 352 aa, uncultured bacterium
IGAANNLLAAMLDNHIQQGNSLGIDVKQITWKRAVDMNDRQLRRIVDGLGGRAQGVPREDGFEITVASEIMAVLCLASDLRDLKARLARIIVGYTYDGKPVTAHDLKAEGAMTALLKDAIKPNLVQTLEGTPAFVHGGPFANIAHGCNSVIATHTALKLADYVITEAGFAADPGAEKFLDIKCRVSDLHPSAVVIVATVRALKYHGGIPKAELNAENLEALEKGLPNLLQHVSNIKNVFGLPCVVAINAFPTDTEAELKLVEKKCRELGVNVALSEVWAKGGEGGIALAEEVVRLCEQPNSFTFSYPLEMSIEEKLETICKKIYHADGVTLDANARKQAEQLTALGFDKLPI

SEQ ID NO: 57629 - protein, 363 aa, Vibrio parahaemolyticus RIMD 2210633
MTDKSYKIAVLPGDGIGPEVMAQAHKVLDAIEQKHGISFEREEHDVGGIAIDNHGCPLPESTVTACEESDAVLFGSVGGPKWEHLPPNDQPERGALLPLRKHFQLFCNLRPAQIHAGLEAFSPLRADISGRGFDIVVVRELTGGIYFGQPKGREGEGANEKAFDTEVYHRYEIERIAKIAFESARLRRKKVCSIDKANVLQSSILWREVVEEIAKDYPDVELSHMYIDNATMQLIKDPAQFDVMLCSNIFGDIISDECAMITGSMGMLPSASLNESKFGLYEPAGGSAPDIAGKNIANPVAQILSAALMLRYSLGEEAAAQDIESAVSKALSAGELTADLASDKPALTTSEMGDKIAEYILNS

SEQ ID NO: 57630 - protein, 356 aa, uncultured bacterium
IGAANNLLAAMIDNHIYQGNELNIDPRKITWRRCVDMNDRQLRFVVDGLGGRVNGTPREDGYDITVASEIMAILCLSNDISDLKNRLAKIIVGYTYGKPAEQKPVTAGELHAEGAMAALLKDALKPNLVQTLEHTPAIVHGGPFANIAHGCNSVTATKMCMNLADYTITEAGFGADLGAEKFLDIKCRMAGLKPNAVVIVCTVRALKYNGGVPKAELGSENLEALKAGLPNLLKHVDNITNVFGLPCVVAVNAFPTDTKAELDLVEAECKKLGVNVKLSEVWAKGGEGGRALAEEVVRLCEQPNNFKYSYELEGSIEDKIRTIATRIYGAKDIVLTSNAVKQAAELEALGFSNLPI

SEQ ID NO: 57631 - protein, 352 aa, uncultured bacterium
ITSANNLMCAMLDNHLLQGNELRIDPKRVVVKRCLDMNDRALRNITVGLGKRLDGVVREDHFCITVATEVMAILCLAENLEDLKARLGRIIVAYNYDNEPVTAADLKCVGAMTVLLKDAIRPNLIQSLENNPVFVHGGPFANIAHGCNSVRATKLALKAADYVITEAGFGADLGAEKFLDIKCRMAGIKPDAVVLVATARALKYNGGIPKDELNNENVEALKKGIVNLGKHIENLKKYNVPVVVTINKFVADTEAEVAAIKEFVESKGCRFAISEVWAKGGEGGQELASQVLDAIEEGSPDFKFLYEDDLSLKEKIETISKEIYGADGVEYSPEANNALKKLEALGFGNVPV

SEQ ID NO: 57632 - protein, 353 aa, uncultured bacterium
IGAANNLLAAMLDNHIQQGNALGIDVKKITWKRCVDMNDRQLRFVVDGLGGKANGVPREDGFDITVASEIMAVFCLASSMKDLKERLSRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLAEENLEALEKGIPNLLRHVRNIREVYQLPCVVAINRFPTDTDAEIEFIIRKCRELGVNTVLSTVWAEGGKGGEDLAREVVRLCEEEKGNFTFSYDLEMSIEEKLEAVTKKIYGGAGVALIPGAKKQAERLTALGFDKMPV

SEQ ID NO: 57633 - protein, 353 aa, uncultured bacterium
IGAANNLLADMLDNHIQQGNALGIDVKKITWKRCVDMNDRQLRFVVDGLGGKANGTPREDGFDITVASEIMAVFCLASSIKDLKERLSRIIVAYTYDDKPVTAGDLKATGAIAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLANEDLAALEKGIPNLLRHVNNIKNVYQLPCVVAINRFPTDTDAEIDFIIRKCRELGVNTVLSTVWAEGGKGGEELAREVVRLCEEEQGNFTFSYELDASIEEKLEAVTKKIYGGAGVMLTPAAKKQAERLTELGFDKIPV

SEQ ID NO: 57634 - protein, 457 aa, Thermoplasma acidophilum DSM 1728
MDMQHDDLNYEYLYGTTYPLMKNAGKAVADAVMKNYPDARTVCVVAGTGNNGGDAIVAGSILSAKYDVRVLIVTEVRSELARRALSEYGGRVIGLDGMEECMKCDVIIDGIFGVGISGDPKDPYRSVIENINRSCSHVVSVDIPSGLGTRYAVKPEITVTFTMEKYGMNQDNSGKIIVADIGIPPDVRKYAGPGDLLYYPKPDPSSHKGMNGTLAIVGGWEFHGSSVIAALAAERIGLDLVRVFVSPRNYQIVSGYDPGIIVRQVEKLDEKKLSEIYGNSAILLGPGMGKGDDAMEAARKIVSDSRVPMVVDADALDAVGAYSGSFAGRKIIITPHKGEFRRISGFEPTEENAISYARKKGLIVVLKGQVDVITNGEEVHYAKGGNARMTMGGTGDLLAGIISAFLARSVDPMRACLMGTYLNKALGEAAYSKHGYWYTVTDMISEIPGVMGKYIKI

SEQ ID NO: 57635 - protein, 377 aa, Arabidopsis thaliana
MEEFDYISEFPDCLLTQILLNLPTKDSVKTSVLSKRWRNLWLNVPGLRLRTFDFPVFPYPYEEGFVRFMDRFMEFKCRSRLQKFMITYFEHNGYRDRLMELIGTLVDRGIQHLYVYMHTCNRVDFIRQNIYKSKTLVSLKLYNVELKNPEFVVSLPCLKILKLENIFHGEDGPLVVEKLISGCPVLEDLELIRPFDDNVGYGSLTAPKYSRNRDIIGDFLTVISSVRHTIICYSTSKMLYSYSKQLGPIPQFHNLYHLQARFSSSSLQLLPTFLESCPACPNLKNLIMEFPFEPKNIDFHKVPQCLISTLEYVQIEELILKEKSGIKLVDYFLENSAVLKKLTLSFTYHSKKKQDPESYKKLLTSTKLSPTCQIIID

SEQ ID NO: 57636 - protein, 605 aa, Agrobacterium tumefaciens str. C58
MEEMNMLDVSPATKIDTVLSKLGNALEAGDIDAAVNLFQADCYWRDLVTFTWNLKTLEGREQIHDMLASQLAAIKPSGFVQDAKEQASEGGGVTEGWFEFETGAARGYGHIRLKDGLIWTLLTTMSELKGHEEPKGIRRPMGAEHGHDRSRRTWKEKREAEAAELGYAEQPYVVIIGGGQGGIALGARLRQLGVPTIIIEKNERPGDSWRKRYKSLCLHDPVWYDHLPYIPFPENWPVFTPKDKVGDWLEMYTRVMELNYWGSTTCKSAQYDETTGEWTVVVDRAGKEVVLRPKQLVLATGMSGKANVPKFPGQDVFKGEQQHSSQHPGPDAYAGKKVVVIGSNNSAHDICAALWEAGADVTMLQRSSTHIVKSDSLMEIGLGDLYSERAVANGMTTRKADLIFASLPYRIMHEFQVPIYDRIREQDAEFYAALEKAGFMLDFGDDESGLFMKYLRRGSGYYIDVGACDLVIDGSIKLKSGVDVSHLTENAVVLKDGTELPADLVVYATGYGSMNGWAADLISRDVADKVGKCWGLGSDTTKDPGPWEGEQRNMWKPTRQDALWFHGGNLHQSRHYSQYLSLQLKARQAGLKTPVYGLQKPHHLS

SEQ ID NO: 57637 - protein, 416 aa, Arabidopsis thaliana
MEECDYINELPDSLLTQILLDLRTKDSVKTSVSSKRWRNLWLNVPGLDLFSLQFTNPHHEEGLIKFMDRFMESNCRSRLQKFMIRYFECNGYRDRFMELIGTVVDCGIQHLYVYMHTCNRVDFIRQNIYKSKTLVSLKLYNVELKNPDFVVSLPCLKILKLMKICYGEDGPLVVEKLISGCPVLEDLELIKPFDILTQDVILFLRIDAPRLKYMTFYESRFDRIMVKNMSSLFSIEIRAKSSFEYGGLLKAEDPRKRAIICDFLTVISSVRHMIISGSILEELHSYSKLGWIPQFRNLYHLQASFFGTSLQLLPTFLESCPNLKNLIMDYGAFKEENIDFHEVPQCLISTLEYVHINKLMMMEQSGIKLVNYFIENSAVLKKLTLRFSFFSSIESESYKKLLTSTKLSPTCQVIFV

SEQ ID NO: 57638 - protein, 477 aa, Phytophthora megasperma
MAPIETVKDANEGLHQRKGAAAASKDTTTFTWQDVAKHNTAKSAWVTIRGVVYDVTEWADRHPGGRELVLLHSGRECTDTFDSYHPFSDRADKILAKYAIGKLVGGSEFPTYKPDTGFYKECCDRVNQYFKDNKLDPRSPYSGLWRMILVAIVGAVAYMGMNQLLPGNIYAHYAWGALFGVCQALPLLHVMHDASHAAITSSPTGWRLIGRLAMDWVAGANMVSWLNQHVVGHHIYTNVAGADPDLPVDFKSDVRRIVYRQVLLPIYKYQHLYLPPLYGVLGLKFRVQDVFETFVTLTNGPLRVNPLSVGDWAEMILSKAFWVFYRIYLPLAVLQVDPARFWGVFFLAEFSTGWYLAFNFQVSHVSTACEYPGGDEEVTSIDDEWAISQVKSSVDYGHGSFITTFLTGALNYQVTHHLFPGVSQYHYPAIAPLILDVCHKYKVKYNVLPDFTAAMAGHFDHLVIMGKMGKRVTIHMG

SEQ ID NO: 57639 - protein, 212 aa, Hyphomonas neptunium ATCC 15444
MIGTLLNNNMNWASARVRADPGFFRRLSAQQAPEYLWIGCSDSRVPANEIVGLDPGELFVHRNIANLAPPRDINFLAVLQYSVEVLRVRHIIVCGHYGCGGVRAALDTERRGLIDHWLQPVSDLAHRHAGHLDKISDFDTRVNVACEHNVRAQVEYLGRNPFVTDAWRRGQKIAVHGWIYSIRDGLLRDLDLTIERPKDVDRLSAKAWFPDG

SEQ ID NO: 57640 - protein, 304 aa, Zea mays
MAATSTFLFSSNLHSLNSQPFSSSLSFFRNVHSTLSFPSSKPSRGVVAMAGSGKFFVGGNWKCNGTKDSIRKLVSDLNSATLESDVDVVVAPPFVYIDQVKNSITDRIEISAQNSWVGKGGAFTGEISVEQLKDLGCKWVILGHSERRHVIGENDEFIGKKAVYALSEGLGVIACIGELLQEREAGKTFDVCFQQLKAFADVVPSWDNIVIAYEPVWAIGTGKVATPEQAQEVHAAVRDWLKKNVSAEVSSKTRIIYGGSVNASNSAELAKQEDIDGFLVGGASLKGPEFATIINSVTSKKVVA

SEQ ID NO: 57641 - protein, 317 aa, Aspergillus oryzae
MGFGAPRGRGGPPGGRGGRGGFGGGRGGGRGGLGSASRGRGGPRGGGRGGRGGPPGRGGRGGRGGARGGAKGGAKGGAKVVIEPHRHAGIFVARGGKEDLLVTKNLTPGEAVYGEKRIAVETPTEDGTTTKTEYRVWNPFRSKLAAGVLGGLDDIYMKPGSKVLYLGSASGTSVSHVADIVGPTGNVYAVEFSHRSGRDLIGMATHRTNVVPIVDDARHPLRYRMLVPMVDVIFADVAQPDQARIVGLNAHMFLKEGGGVIVSVKANCIDSTAKPEVVFTREVQKMREERIKPKEQLTLEPFERDHCIVAGIYKRSA

SEQ ID NO: 57642 - protein, 545 aa, Flavobacteria bacterium BBFL7
MKNINPTETNAWLQLEKHFEGFDDFSLREEFKKDASRAQKLTIIDKDFYVDFSKNLITESTRTHLTALATECGLKEAINSYFTGAVINATEKRSVLHTALRTPQAHADKSLESNVSDAIASKQKMFDYVDGILNGDTLSANGKKFDTIVNIGIGGSDLGPVMIYEALQAYKNNMTLHFVSNVEGDHVEEVLKKINPDTTLFVIVSKSFGTQETLTNATTIRNWFTEKLEASAVSKHFIAVSSNVDKAVNFGIDHKNIFPMFDWVGGRFSLWSTVGMSVALGIGTDNFQALLDGAHEMDNHFRNTDFEKNIPVQLALMTIWYNNFYRAQSEVIIPYTQYLHRLPAYLQQAIMESNGKCVDRDGNSVTYDTGNIVWGEPGTNSQHAFFQLIHQGTKLIPAHFIAFAKAKYNQPDHHNKLMANFIAQTEALMNGKTRSEAKKDLERSGKSKDEIDMLLPFKVFEGDQPTTTILIDELTPQSIGKLIAMYEHKIFTEGIIWNIYSYDQWGVELGKVLADTILDNIENKEYADHDSSTSAILKRFGNLNS

SEQ ID NO: 57643 - protein, 586 aa, Bacillus cereus ATCC 14579
MKQSVSAEQIELKSSLPGSKKVYVDGPREGMKVPMREIEQSETNGVPNPPIRVYDTSGPYTDPEYKVELEKGIPTPRHSWILGRGDVEAYEGREVKPEDDGVKVASKHTPVFPQMDRKPLRAKQGANVTQMHYARNGIITSEMEYVAIREGVEPEFVRKEIAEGRAILPANINHPEAEPMIIGRNFHVKVNANIGNSAVSSSIAEEVEKMTWATRWGADTIMDLSTGKNIHTTREWIIRNAPVPVGTVPIYQALEKVNGIAEDLTWEVYRDTLIEQAEQGVDYFTIHAGVLLRYIPITAKRTTGIVSRGGSIMAQWCLFHHKENFLYTHFEEICEIMKQYDVSFSLGDGLRPGSIADANDEAQFSELETLGELTKIAWKHDVQVMIEGPGHVPMHLIKENMEKELDICQGAPFYTLGPLTTDIAPGYDHITSAIGAAMIGWFGTAMLCYVTPKEHLGLPNKDDVRTGVITYKIAAHAADLAKGHKTAHQRDDALSKARFEFRWRDQFNLSLDPERAMEYHDETLPAEGAKTAHFCSMCGPKFCSMRISHDIREYAKENDLETTEAIEKGMKEKAEEFKEAGSHLYQ

SEQ ID NO: 57644 - protein, 1101 aa, Synechococcus sp. WH 5701
MPRRSDLRRILLLGSGPIVIGQACEFDYSGTQACKALRDEGYEVVLVNSNPASIMTDPEMADRTYIEPLTPDVVRQVIELERPDALLPTMGGQTALNLAVALAEDGTLERFGVELIGANLQAIQKAEDRRLFKEAMERIGVAVCPSGIASSLEEAERVGEEIGTYPRIIRPAFTLGGSGGGIAYNPEEFQAFCKSGLEASPVSQILIEQSLIGWKEFELEVMRDLADNVVIICSIENLDPMGVHTGDSITVAPAQTLTDREYQRLRDQSIAIIREIGVETGGSNIQFAINPANGDVVVIEMNPRVSRSSALASKATGFPIAKIAARLAVGYTLDEILNDITGATPACFEPTIDYVVTKIPRFAFEKFQGSPAVLTTSMKSVGEAMAIGRCFEESFQKALRSLETGHAGWGCDRPDKPLEPSDLERMLRTPSPDRIFAVRAAMVAGRSDEEIHQLSAIDPWFLAKLRRLIEAEERLLRGRTLEQLSAADLLELKQLGFSDRQIAWTSGSDELSVRRTRQGLGVNAVFKTVDTCAAEFASTTPYHYSTYERPLERLDNAGRAIRLAQEDEVRPESRRKVMILGGGPNRIGQGIEFDYCCCHASFALRADGFATVMVNSNPETVSTDYDTSDRLYFEPLTLEDVLNVIEAEKPEGVIVQFGGQTPLKLALPLLRWLAGPEGQVTGTRLWGTSPESIDQAEDREQFEAILRQLNIRQPRNGLARSEAEARAVADRVGYPVVVRPSYVLGGRAMEVVFDEAELNRYMVEAVQVEPDHPVLIDQYLENAIEVDVDALADRQGMVVIGGLMEHIEPAGIHSGDSACALPAVSLSQQALATIRQWTEALALALDVSGLINLQFAVQAERVFIIEANPRASRTVPFVAKATGVPLAKIASLLMAGHSLSELGLISEPKPPLQNVKEAVLPFKRFPGSDTLLGPEMRSTGEVMGSGASFGMAYAKAEIAAGEALPISGTVFLSTHDRDKPSLVPVAERLSELGLALIATTGTAAVLREAGLEVESILKVHEGRPNIEDAIRSGRIQLIVNTPIGRQATHDDKYLRRAALDYAVPTVTTLAGARAAVEAIATLQSQELTVAALQDIHPRPAR

SEQ ID NO: 57645 - protein, 280 aa, Brassica napus
  misc_feature (70)..(70): Xaa can be any naturally occurring amino acid
  misc_feature (268)..(268): Xaa can be any naturally occurring amino acid
  unsure (1)..(280): unsure at all Xaa locations
MDHEADAYRTDLMTITRFVLNEQSKYPESRGDFTILLSNIVLGCKFVCSAVNKAGLAKLIGLAGETNIQXGEEQKKLDVLSNDVFVKALVSSGRTSVLVSEEDEEATLVESSKRGKYCVVFDPLDGSSNIDCGVSIGTIFGIYTMSHNDEPTTEDVLKPGNEMVAAGYCMYGSSCMLVLSTGTGVNGFTLDPSLGEFILTHPDIKIPKKGNIYSVNEGNAQNWDGPTTKYVERCKFPKDGSPAKSLRYVGSMVADVHPTLLYGGIFLXPADKKSPNGKLR

SEQ ID NO: 57646 - protein, 632 aa, Leptosphaeria maculans
DPIPADHEISRKQHPKQITAVASEIGILPHELEPYGATKAKVDLSLLKRLEHRRNGRYVLIAGITPTPLGEGKSTTTIGVAQALGAHLGRICFANVRQPSMGPTFGIKGGAAGGGYSQVIPMDQFNLHLTGDIHAITAANNLLAAAIETRMFHENTQKDAALYKRLVPTKKGKREFVPVMFRRLKKLGIDKTNPDDLTPEEITKFARLDIDPETITWRRVLDVNDRHLRSITIGQAPTEKGHTRETGFDISVASECMAILALSNDLADLRERLGRMVVASSRAGDPVTCDDIGAGGALTALLVDAIKPNMMQTLEGTPVFVHAGPFANISIGASSVLADRLALKLAGTEPDENHDEKTGFVVTEAGFDFTMGGERFFNIKCRASGLVPDTVVIVATVRALKNHGGGPDISPGAQLPEVYRTENVDILRAGCVNLKKHIQNAKAYGVPVVVAINRFATDTQAEIDVIREEAIAAGAEDAIPANHFAEGGKGAIDLAQAIVTASAKPKDFKLLYDPSTDTVQERMETIAKKMYGASAVEFSELAQKKVDTYVKQGLGNLPICVAKTQYSLSHDPSLKGAPTGFTVPIRDVRMAAGAGYLYALAADIQTIPGLPTAPGYLNIEVNTETGEIDGMF

SEQ ID NO: 57647 - protein, 435 aa, Oryza sativa (japonica cultivar-group)
MAAAKHFTYVILGGGVAAGYAAREFAKQGVKPGELAIISKESVAPYERPALSKGYLFPQNAARLPGFHTCVGSGGERLLPEWYSEKGIELILSTEIVKADLASKTLTSSADATFTYDTLLIATGSSVIKLTDFGVQGAEANDILYLRDIEDADKLVAAMQAKKDGKAVIVGGGYIGLELSAALKTNNFDVTMVYPEPWCMPRLFTSGLAAFYEGYYANKGIHIIKGTVAVGFDADANGDVTAVKLKNGNVLEADIVIVGVGGRPLTHLFKGQVAEEKGGIKTDAFFETSVPGVYAIADVAAFPMKLYNEIRRVEHVDHARKSAEQAVKAIKAKEAGESVPEYDYLPYFYSRSFDLSWQFYGDNVGEDVLFGDNDPTAAKPKFGSYWIKDGKVVGVFLEGGSAEENQVIAKVARAQPPVADVEALKKEGLDFAAKV

SEQ ID NO: 57648 - protein, 353 aa, uncultured bacterium
IGAANNLLAAMLDNHIQQGNALGIDVKKITWKRCVDMNDRQLRFVVDGLGGRANGTPREDGFDITVASEIMAVFCLASSMSDLKERLSRIIVAYTYDNQPVTAGDLKATGAMAALLRDALKPNLVQTLEGTPAFVHGGPFANIAHGCNSVMATRMAMRMGDYTVTEAGFGADLGAEKFLHIKCRMAGLTPDAVVVVGTVRALKMHGGLDKKQLANEDLAALERGIPNLLRHVNNITNVYQLPCVVAINRFPTDTDAEIDFIVRKCREMGVNTILSTVWAEGGKGGEDLAREVVRLCEEGKGNFTFSYELDATIEEKLEALTKKIYGGAGVALTPAAKKQAEQLTRLGFDKLPV

SEQ ID NO: 57649 - protein, 448 aa, Magnetospirillum magnetotacticum MS-1
MGAGKKRISLRPDFVWGVSTSAFQVEGATKEDGRGPSIWDTRCRLAGGVWTGANADVACDHYHRWPEDVRLIKDLGVDAYRFSIAWPRLLPKGKGAVNQKGLDFYDRLIDGVLEAGITPWVCLYHWDLPQALDDLGGWTNRDCAGWFADYAVLAAKRYGDRVKHFATFNEFSVFTMFGYAIDWAAPGVTDRAAHMKAIHHVNLAHGMGVDVLRDHVPGVSIGAIHNRQIVRPEGGLAENQAAADLLDAHWNGVFCDPQHLGHYPEIMARDVEPYVQAGDLARICRPTDWMGLNHYGPIYAKADPATTWGYGWGAPPESANHPEVGWPIFPEVFKDELLTLTRRYGLPIYVTENGCGGGAGSDTPDENGEVKDTHRLAYFREYQQAMLDAVAEGADLRGYFVWALLDNFEWGSGYGPRFGLYHVDFETQKRTLKNSGKWYRDMIKGHRT

SEQ ID NO: 57650 - protein, 91 aa, Brassica napus
  misc_feature (32)..(32): Xaa can be any naturally occurring amino acid
  misc_feature (46)..(46): Xaa can be any naturally occurring amino acid
  misc_feature (51)..(51): Xaa can be any naturally occurring amino acid
  unsure (1)..(91): unsure at all Xaa locations
MVFIMEWADNVVVGLMEDPKVIDGKVRERIYXYHDRCNKIEEMWAXPIGPXGLWPFERHRAQLRWDRQISGVAGCTDPGHDLSEAHPSSSS

SEQ ID NO: 57651 - protein, 455 aa, Rhodobacter sphaeroides 2.4.1
MRDDAPNSWESRADASSFYGFTDLPSVHQRGTVVLTHGKGPYIYDVHGRAYLDANSGLWNMVAGFDHPGLIEAAKAQYERFPGYHAFFGRMSDQTVMLSEKLVEVSPFARGRVFYTNSGSEANDTMVKMLWFLGAAEGHPERRKIITRVNSYHGVTAVSASMTGKPYNSLFGLPLPGFIHVGCPHYWRFGQAGETEAEFTQRLARELEATIIKEGPDTIAGFFAEPVMGAGGVIPPSEGYFQAVQPVLKRYGIPLIADEVICGFGRTGNTWGCQTYDFMPDGIISSKNITAGFFPMGAVILGPELADRLQAASEAVEEFPHGFTASGHPVGCAIALKAIDVVMNEGLAENVRALTPKFEAGLAYLAENPNIGEWRGKGLMGALEAVKDKATKTPFPGDLSVSERIANSCTDHGLICRPLGQSIVLCPPFIMTEAQMDEMFEKLGAALKKVFAEVA

SEQ ID NO: 57652 - protein, 353 aa, uncultured bacterium
ISAANNLLAAMLDNHIQQGNALGIDVKKITWKRCVDMNDRQLRFVVDGLGGKANGTPREDGFDITVASEIMAVFCLASSMSDLKERLSRIIVAYTYDDQPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLANEDLAALEKGIPNLLRHVNNITNVYQLPCVVAINRFPTDTDAEIDFIVRKCRELGVNTILSTVWAEGGKGGEDLAREVVRLCEEGKGNFTFSYELDASIEEKLEALTKKIYGGAGVALTPVAKKQAEQLTRLGFDKPPV

SEQ ID NO: 57653 - protein, 456 aa, Haemophilus influenzae 86-028NP
MTKHYDYIAIGGGSGGIASLNRAASYGKKCAIIEAKHLGGTCVNVGCVPKKVMFYGAHIAEAINNYAPDYGFDVEVKKFDFSKLIESRQAYISRIHTSYNNVLAKNNIDVINGFGKFVDAHTIEVTLADGTKEQVTADHILIATGGRPYRPNIKGQEYGIDSDGFFALTELPKRAVVIGAGYIAVELSGVLNSLGVETHLLVRRHAPMRNQDPLIVETLVEVLAQDGIQLHTNSTPSEIVKNADGSLTVKCDGQSDVTVDCVIWAAGRVPTTDKIGLENAGVETNEHGYVKVDKYQNTNVKGIYAVGDIIENGIELTPVAVAAGRRLSERLFNNKPTEYLDYSLVPTVVFSHPPIGTVGLTEPQAIEQYGAENVKVYKSSFTAMYTAVTQHRQPCKMKLVCVGKDEKVMGLHGIGFGVDEMIQGFAVAIKMGATKADFDNTVAIHPTGSEEFVTMR

SEQ ID NO: 57654 - protein, 353 aa, uncultured bacterium
IGAANNLLAAMLDNHIQQGNALGIDVKKITWKRCVDMNDRQLRFVVDGLGGRMNGTPREDGFDITVASEIMAVFCLASSMADLKERLSRIIVAYTYDDQPVTAGDLKATGAMAALLRDALKPNLVQTLEGTPAFVHGGPFANIAQGCNSVMATRMAMRMGDYTVTEAGFGADLGAEKFLDIKCRMAGLTPDAVVVVGTVRALKMHGGLDKKQLANEDLAALEKGIPNLLRHVSNIRNVYQLPCVVAINRFPTDTDAEIDFIVRKCRELGVNTILSTVWAEGGKGGEDLAREVVRLCEEEKGNFTFSYELDASIEEKLEAVTKKIYGGSGIALTPAAKKQAERLTALGFDKMPV

SEQ ID NO: 57655 - protein, 353 aa, Ashbya gossypii ATCC 10895
MGLFSKRSEQAATKPVDLIPVSRVIREPPANYPVPEAIPKLSTEQHEKYTHVLKYFQDEKLVLPLKSSKKQESAEQTAALSAYERFWLTRECLLRYLRATSWNVEAAIERLRKTLVWRREFGVTGDPDAPNSLKPETVEKENTTGKQVLLGFNPQRLPVYMMKNGRQNTEPSFTQVQHLVFFMEAAIAMMPQGVELLALLIDFRHYKEPGVIGAKSPPISLAKQILSIIQDHYPERLGKALFFDMPWYGWTFLKLMHPFIDPVTRSKLVYDEPISSYIDAEQLEATYGGKLDFQYNHEEYWPDFVSVFEERKDYQYARFLKFGAVIGLSEFDLKGKEAELRYPADYQEPSTEG

SEQ ID NO: 57656 - protein, 339 aa, Vibrio angustum S14
MTATNRQLLLASRPVGAPTTENFHLTETSIPTPQQGELLLKAVYLSLDPYMRGRMSDKKSYAEPVGINEVMVGGTVCQVTASHHPDYQVGEWVLAYSGWQDYAVSNGEGLIKLGINPTHPSYALGVMGMPGFTAYMGLLDIGQPKQGDTIVVAAATGAVGSMVGQIGKIKGCRVVGIAGGNEKCQYAKETLGFDECIDHHAADFAQQLADSCTDGIDIYYENVGGKVFDAVLPLLNTGARIPLCGLISQYNATSLPDGPDRMNMLMGQLLVKRIKMQGFIIFDDYAHRYDEFAQQMSQWLAEGKIHYREDRVEGLEQAPQAFIGLLEGKNFGKVVVKVS

SEQ ID NO: 57657 - protein, 352 aa, uncultured bacterium
ITSANNLLAAMLDNHIQQGNSLGIDPRQIVWKRCLDMNDRVLRNIVVGLGSKMDGMVREDHFVITVASEIMAILCLADDMHDLKKRLGRIIVAYSFDGKPVTADDLQATGAMAALLKDALKPNLIQTLEHTPAIVHGGPFANIAHGCNSVRATKASMKLADITITEAGFGADLGAEKFFDIKCRMAGLKPDAVVLVATIRALKYNGGVPKADLTTENLDALKKGIVNLEKHIENLQKYGVPVVVTLNSFITDTDAETNFVKDFCQERGCEFALSEVWEKGGEGGVELAKKVLYVLENKESNFKPLYENNLSLEDKIKTVATEIYGASDVTYSAAALKELKRIQELGMGDFPV

SEQ ID NO: 57658 - protein, 733 aa, Flavobacteria bacterium BBFL7
MTEVETLEENKRIAQGYKDLLKISYQTLTDEDKKLIRKAFDIAVEAHAPQRRKSGEAYIFHPIAVAKIVAKQIGLDASAIAAALLHDVVEDTAYTLDDIERLFGTTIAKIVDGLTKIAHLKKDADISQQAENFRKMLLTLNEDIRVIIIKIADRLHNMQTMDSMPDYKQVKIASETLYIYAPIAHRLGLYNIKTELEDLGLKYTEPEVFNDIQQSIKESKEEQDQFISDFAAVIDDSLDKEGLEYSIKGRPKSVFSIRRKMLKQNVTFDEVYDKFAVRIVFRSDRANEKFLAWKIYSIVTDHFRPNPVRLRDWISSPKSTGYEALHITVMGPDGRWVEVQIRSERMHEIAEKGYAAHYKYKQGNQEDGLDVWLNRLQDALENADSSAIDFVEEFKLNLYSKEIFVFTPKGELKSLPKGATPLDFAFSIHTEVGLKTRGARVNGKLVPLSHELKSGDQVDIITSENQKPTKNWLDYATTARARQKIKSALKDDQKDIALEGKAVLNRKLRSLKIPLDEKSINQMVNFFKLKTSHDLFYRVGLGTIDNKMIKEYANSRSNALYSFIKNKIRKPKESPDLHKEEVTENYDQLVFGKDQQKLDYSFSKCCSPLPGDAVFGFITVAEGIKVHKNNCPNAISMQSKFAYRIMSAKWIDSSQQEYRADVILTGIDRMGLVQEVTRVISENMHVNIRNISFTSNDGIFKGEITVVVPHKNMLVKLMENLNKLNGIDKVTRV

SEQ ID NO: 57659 - protein, 242 aa, Oryza sativa (japonica cultivar-group)
MKMESPGVQPAAAGEEEGGGGVFFCVAVTSRGRTDRLSYFQAEGDGDDAEEVARATAALCLDHAPEHHHWHHHTVVGRRTFAFLAGDDGRTYFAVADPTPGSAETVRFLQRVRDAFGSCGGGGGGGATRRRNQRDDAVDAVVWQFVRALRASAGRGTAALFPGDDSRGGGDASSADGDKDDEEEEDDRGGEAMAVAADGARRRTRRSWWRYSKVVIGVELVLFLVLFVVWMIVCKGFNCVQR

SEQ ID NO: 57660 - protein, 545 aa, Cryptococcus neoformans var. neoformans B-3501A
MKSSIIFCFFAAFGGWVFGYDIGYISGCLIMPNFIQYMGEQDPTTGEWILSSQRQSIITSLLSAGTFFGALLQSFTSDRLGRRGSIIFWSIIFSVGIIIQVSSFGLAQITVGRFVAGLGVGALSAIVPLYVGEAAPKKLRGALLVLYQVQIASGLFLAYIVDLGTHHLKSSASWRIPVGLQLVWGAFLIVGGLLLPESPRLLLGRGDEKGALKAIARLNDCEVDDPLTRDVIKDLEEAIREENEGGKAGWLECFSTRSMILSVWKRTLNGCMVQFLQQLNGQNFYYYYGPVFFESADVPLSAYSIQAILGGISLATVIPAMWTIEHLGRRKSLLFGAAIQAACALIAGLVGHYYTDVAGVTDSMVKTGGNVLIAFAVIHVSMYSLFWGPTPWVILGETYPLRVRPKAIALAAAVNWLWNFLLSYFSPLIADDIGPLILLIFFGCLIFAFVYVFFMLPETRGITLEEVDELYRSKIPAWKSNSWKPSSHHAALDALEGESRKPVEVPAQAPGTLDETKPADEHLENAPAAKARIEGERGAREKSIV

SEQ ID NO: 57661 - protein, 352 aa, uncultured bacterium
IGAANNLLAAMLDNHIQQGNSLGIDVKQITWKRAVDMNDRQLRRIVDGLGGRAQGVPREDGFEITVASEIMAVLCLASDLKDLKARLARIIVGYTYDGKPVTAHDLKAEGAMTALLKDAIKPNLVQTLEGTPAFVHGGPFANIAHGCNSVIATHTALKLADYVITEAGFAADLGAEKFLDIKCRVSDLHPSAVVIVATVRALKYHGGIPKAELNAENLEALEKGLPNLLQHVSNIKNVFGLPCVVAINAFPTDTEAELKLVEKKCRELGVNVALSEVWAKGGEGGIALAEEVVRLCEQPNSFTFSYPLVMSIEEKLETICKKIYHADGVTLDANARKQAEQLTALGFDKLPI

SEQ ID NO: 57662 - protein, 467 aa, Cryptococcus neoformans var. neoformans B-3501A
MKSSIIFCFFAAFGGWVFGYDIGYISGCLIMPNFIQYMGEQDPTTGEWILSSQRQSIITSLLSAGTFFGALLQSFTSDRLGRRGSIIFWSIIFSVGIIIQVSSFGLAQITVGRFVAGLGVGALSAIVPLYVGEAAPKKLRGALLVLYQVQIASGLFLAYIVDLGTHHLKSSASWRIPVGLQLVWGAFLIVGGLLLPESPRLLLGRGDEKGALKAIARLNDCEVDDPLTRDVIKDLEEAIREENEGGKAGWLECFSTRSMMWKRTLNGCMVQFLQQLNGQNFYYYYGPVFFESADVPLSAYSIQAILGGISLATVIPAMWTIEHLGRRKSLLFGAAIQAACALIAGLVGHYYTDVAGVTDSMVKTGGNVLIAFAVIHVSMYSLFWGPTPWVILGETYPLRVRPKAIALAAAVNWLWNFLLSYFSPLIADDIGPLILLIFFGCLIFAFVYVFFMLPEVSNLRDTFRFTR

SEQ ID NO: 57663 - protein, 430 aa, Methanococcus maripaludis S2
MLRNMDDSFDIYEIKARQVLDSRGNPTVEAEVLTAGGGYGHTIVPSGASTGTFEAVELRDKKEKYGGKSVLNAVSNVNDIIAQELIGEDARNQRLIDQIMLNLDGTENKGNLGANAILAVSLAVAKAAADTASLPLYKYIGGSNAYVMPAPMMNVLNGGQHAGNALDFQEFMIMPVGADSFAEAVRMCSETYQSLKKVVAEKYGKDAVNVGDEGGFAPPVKTIDEALAVLLEGVKKAGYEDEIVFTIDSAASEFYDEKSGSYMIAGEKVSTDKLIDIYKEMVEQYPIVSIEDPLFEEDFEGFKTATKELKGIQIVGDDLFVTNTKRLKKGIEMGAANSLLLKVNQIGTLSESIDAANMAFRNGYSLVVSHRSGESEDSTIADLAVALNAGQIKTGAPARGERTAKYNQLMRIEEELQISKYAGKDFKIPF

SEQ ID NO: 57664 - protein, 263 aa, Flavobacteria bacterium BBFL7
MDNRQIPHSVFGLIGQRLDYSFSKAYFTEKFEKLGLDDHEYRNFEIKTEDDLLRFRESVTYNPITKTTNGKNEIIRGLNVTIPYKESMLKICDRLTPEAQSIGAVNTVVIEDNEWIGHNTDVYGFAKSLEPFLPIKQNALILGTGGASKAISYTLDALKVPHLFVSRNPKGEYCIPYENIDGEVMKIISLIINSTPVGTYPDVEDKPNLPYEHMTKNHILYDLVYNPSNTMFMKMGKAKGARVTNGYQMLVHQAEKSWQLWNE

SEQ ID NO: 57665 - protein, 234 aa, Brassica napus
MRSSSSNKCVLFPCLFFACLLFTISEKLVAGESDKVKLNLYYESLCPGCQVFIVNYLVKIFDSDLHTVTDLKLVPFGNAKVSDNLTVTCQHGEEECKLNAIEACAIRTWPDSKKHYSFIRCVENDTTKWESCLKNSRSEKAINDCYNSDLPKTLILGYANMTLSLKPQHKYVPWVTLNSKPLNAESPDDFVAQICKAYKGKAALPKLCNSSAFSKSLESKVLKLQVSYADEARN

SEQ ID NO: 57666 - protein, 327 aa, Synechococcus sp. WH 7805
MAGTLLFNALREAIDEEMARDPHVCVMGEDVGQYGGSYKVTKDLYEKYGELRVLDTPIAENSFTGMAVGAAMTGLRPIVEGMNMGFLLLAFNQISNNMGMLRYTSGGNFTIPTVVRGPGGVGRQLGAEHSQRLEAYFHAVPGIKIVACSTPTNAKGLMKAAIRDNNPVLFFEHVLLYNLSEELPEGDFTCALDQADLVKEGADVTILTYSRMRHHCLKAVEQLEEDGIDVELIDLISLKPFDMETIARSIRKTHRVIVVEECMKTGGIGAELIALITEHCFDDLDARPIRLSSQDIPTPYNGNLENLTIIQPHQIVEAAQTIVRQGL

SEQ ID NO: 57667 - protein, 1016 aa, Escherichia coli K12
  misc_feature (196)..(196): Xaa can be any naturally occurring amino acid
  unsure (1)..(1016): unsure at all Xaa locations
MQVSRRQFFKICAGGMAGTTAAALGFAPSVALAETRQYKLLRTRETRNTCTYCSVGCGLLMYSLGDGAKNAKASIFHIEGDPDHPVNRGALCPKGAGLVDFIHSESRLKFPEYRAPGSDKWQQISWEEAFDRIAKLMKEDRDANYIAQNAEGVTVNRWLSTGMLCASASSNETGYLTQKFSRALGMLAVDNQARVXHGPTVASLAPTFGRGAMTNHWVDIKNANLVVVMGGNAAEAHPVGFRWAMEAKIHNGAKLIVIDPRFTRTAAVADYYAPIRSGTDIAFLSGVLLYLLNNEKFNREYTEAYTNASLIVREDYGFEDGLFTGYDAEKRKYDKSSWTYELDENGFAKRDTTLQHPRCVWNLLKQHVSRYTPDVVENICGTPKDAFLKVCEYIAETSAHDKTASFLYALGWTQHSVGAQNIRTMAMIQLLLGNMGMAGGGVNALRGHSNIQGLTDLGLLSQSLPGYMTLPSEKQTDLQTYLTANTPKPLLEGQVNYWGNYPKFFVSMMKAFFGDKATAENSWGFDWLPKWDKGYDVLQYFEMMKEGKVNGYICQGFNPVASFPNKNKVIGCLSKLKFLVTIDPLNTETSNFWQNHGELNEVDSSKIQTEVFRLPSTCFAEENGSIVNSGRWLQWHWKGADAPGIALTDGEILSGIFLRLRKMYAEQGGANPDQVLNMTWNYAIPHEPSSEEVAMESNGKALADITDPATGAVIVKKGQQLSSFAQLRDDGTTSCGCWIFAGSWTPEGNQMARRDNADPSGLGNTLGWAWAWPLNRRILYNRASADPQGNPWDPKRQLLKWDGTKWTGWDIPDYSAAPPGSGVGPFIMQQEGMGRLFALDKMAEGPFPEHYEPFETPLGTNPLHPNVISNPAARIFKDDAEALGKADKFPYVGTTYRLTEHFHYWTKHALLNAILQPEQFVEIGESLANKLGIAQGDTVKVSSNRGYIKAKAVVTKRIRTLKANGKDIDTIGIPIHWGYEGVAKKGFIANTLTPFVGDANTQTPEFKSFLVNVEKV

SEQ ID NO: 57668 - protein, 297 aa, Arabidopsis thaliana
MEDLDPTYIQAPEHRSDSNFIPNQPEEIPVIDLSRLDDPEDVQNVISEIGDACEKWGFFQVLNHGVPSDARQRVEKTVKMFFDLPMEEKIKVKRDDVNPVGYHDGEHTKNVKDWKEVFDIYFKDPMVIPSTTDPEDEGLRLVYNKWPQSPSDFREACEVYARHAEKLAFKLLELISLSLGLPKERFHDYFKEQMSFFRINRYPPCPRPDLALGVGHHKDADVISLLAQDDVGGLQVSRRSDGVWFPIRPVPNALVINIGNCMEVIISLNLCHILLLYITLKDSFIINEYYYIINMIM

SEQ ID NO: 57669 - protein, 438 aa, Penicillium citrinum
MPIAKVHARSVYVSRGNPTVEVDVVTETGLHRAIVPSGASTGQHEAVELRDGDKAKWGGKGVLKAVKNVNETIGPALIKENIDVKDQAKVDEFLNKLDGTANKGNLGANAILGVSLAIAKAAAAEKGVPLYVHISDLAGTKKPYVLPVPFQNVLNGGSHAGGRLAFQEFMIVPDTAESFSEGLRQGAEVYQKLKALAKKKYGQSAGNVGDEGGVAPDIQTAEEALDLITEAIEQAGYTGKISIAMDVASSEFYKTDAKKYDLDFKNPDSDPTKWLTYEQLADLYKSLAAKYPIVSIEDPFAEDDWEAWSYFYKTSDFQIVGDDLTVTNPLRIKKAIELKSCNALLLKVNQIGTLTESIQAAKDSYADNWGVMVSHRSGETEDVTIADIAVGLRSGQIKTGAPARSERLAKLNQILRIEEELGENAIYAGKNFRTSVNL

SEQ ID NO: 57670 - protein, 171 aa, Synechococcus sp. WH 5701
MIGSPLTDGPLIQLLDNGVLAWALIACGLAQLGKLLVELVEHGRWRPAVLFETGGMPSSHSALVTGACAGIGWELGFADPLFAFSCTIAFIVMYDASGVRRAAGLQAARLNALPGSLWTPEPLAQLKESLGHTRSEVLAGSLIGPAIALTGLALAGSPLHIAQGWGWLPLA

SEQ ID NO: 57671 - protein, 350 aa, Ashbya gossypii ATCC 10895
MFSGFGSFGGGFVPMPQKFEDFFRCYPIEMMNDRIRKEDANYGGKIFLPPSALNKLSMLNIRYPMLFKLSSQETGKVTHGGVLEFVAEEGRAYLPGWMMATLGVNPGSLLRISSTDVPQGQFVKIEPQSVDFLDISDPKAVLENVLRKFSTLTVDDIIEISYNKRIYRIRVLEVKPESECKSICVIETDLVTDFAPPVGYVEPDYQAANNNTQRKKKNTVDPASVSNGTMSRRIKYADIVKEAEQSATSFAGEGHKLSGKVVSAKDDIREIKISLDGKPAPLNLPEGQLFFGFPMVLPKEESEDQEGSQPNPHFKTQGQSLRQSNKRKGKKDHDAQRSKAPKSPEIIHID

SEQ ID NO: 57672 - protein, 353 aa, uncultured bacterium
IGAANNLLAAMLDNHIQQGNSLGIDVRKVTWKRCVDMNDRQLRFIVDGMGGKANGVPREDGYDITVASEIMAVFCLSNSIADLKARLSRIIVGYTYDDKPVTAADLKAVGAMTALLKDALKPNLVQTLEGTPAFVHGGPFANIAHGCNSVQATKLALKLADYTVTEAGFGADLGAEKFLDIKCRAAGLQPDAVVIVATVRALKMHGGLAKTELANEDLGALEKGIPNLLRHVSNIKNVYGLPCVVAVNRFPRDTDKEIEFIIAKCKELGVNVRLSTVWAEGGAGGEELAAEVVRLCEEEKGDFRFSYELDMSIKEKIEAVVKKIYGGKDITVMPAAQKQIEQLEKLGFGNLPV

SEQ ID NO: 57673 - protein, 295 aa, Oryza sativa (japonica cultivar-group)
MASDLRPPEHQVAGHRASADKLGPLVDGEGLFYKPLQAGERGEHEAAFYAAFTAHPAVPPRVRGAFFPRFHGTRFLPAPASPGGAPYPHIVLDDLLAGLPSPCVADVKIGACTWPPRSPDPYVAKCLAKDRETTSALLGFRVSGVRVVDARGGAVWRPDRSELKGIDAAGVRRVLRRYVSTGGGDGLDCALAAAVYGGEGGVLAQLRELKAWFEEQTLYHFYSASILFGYDANAAAAAAPGGGSGGVRVKLVDFAHVDDGDGVIDHNFLGGLCSLIKFIGDIVAEVTEKASSDHS

SEQ ID NO: 57674 - protein, 915 aa, Magnaporthe grisea 70-15
MAMLASKSPFPAPLATSGSGMMAGTAQASYPPSRRAPAVPPASQSFSPTESEFSDSDDHDSPKHWDEDKVCEYLRSVRCGEYEKLFRKNHINGENLLEMDKDVLKEMGIEKVGDRVRLFLSIKKLRTKAIAGQKKRNRDSFAGHESMYTPVSESPSKPFHSSSRVMPNPSVNKRYSRQIDLSGMAYDPSRPTTSSRPTSPLPSADFRTARTRNPYVGQQPTPTGSLRGLGSPPDSQANSRPVLTHTRTDSGMDGSLMAALPQNQDVIRVISTGGVTKVVKIADCNTCEEVMRVTLRKFALREDHERNYCFWVLSGLDPDPKQCRRLGDTELWRVIKDQKRPERNRLILRRVPAGEPGQSELERAAAIAMEEAQQSHSRAMDNVGARSQIKVQKVLGENWDNLQPPLSPVLYQDRERNVYNAARDLERPEPLDSGRLQPRRKVLRSFGGLRPPSELIASDLTTYFPDHPREDIDRTARLSMRRSARLSKVNSRLSVASSFSMASSIQDAPPIPTIADSWLQSTPLPKARPRDLQSRLQHGYRDSVASSMLDTLQEEGSPIEPNRKSYVSFADSGSDSAAVSVTDPDGNIVRHSYFDEGSTIGSGSGSGSFGDVSKALNEDGEDADEDLQSFLSGESWDDSKWMKGALIGQGSFGCVYLALHAITGELLAVKQVEAPSPGANSQNDARKKSMIEALKREISLLRDLRHPNIVQYLGCGSSAEYLNIFLEYVPGGSVQTMLNSYGALPEPLVRSFVRQILNGLSYLHEREIIHRDIKGANILVDNKGTIKISDFGISKKIEATNLLNGANNNKHRPSLQGSVFWMAPEVVKQTSYTRKADIWSLGCLVVEMMTGTHPFPDCTQLQAIFKIGGGKATPTIPEDASTEAKAFLAQTFEMDHNKRPSADDLMLSPFLTPIT

SEQ ID NO: 57675 - protein, 563 aa, Ashbya gossypii ATCC 10895
MAPKDTAVSETSTRSRYIKKGKTLENDIELQSVTPATGEFPEDHTEEGDYQETEVKRALKARHISMIALGGTIGTGLFIVIASPLRTAGPVGSLLAYIFIGTVVYSITQSLGEMATFIPVTSSVTVFSKRFLSPAFGVANGYMYWFNWAITFAVELSVVGQIIQYWTDRVPIAAWIVIFWVLVTLVNFFPVRFYGEIEFWIASVKVLTIVGYLIYAFIIVCGGSKQGPIGLPATGGIPARGARASSRTTRKRHGFLGWVSSLIKAAFTYQGTELVGITAGESTNPRKNVPKAINKVFFRILFFYIGSLLFVGLLVPYDDPRLNSESSTDVNASPFVISIKNAGTKILPDIFNAVVLITVISAANSNVYIGSRVAYSLALAGNAPKQLAFVTKQGVPYFGVLITSLMGLMSFLVLNHNASTAFDWLVNISTLAGLCAWLFISLAHIRFMQCLKHRGISRDDLPFKAKFMPWAAYYATFFVTVIIFIQGYTAFTPKFDVTTFFTSYISLFLMLLVFIGCQIYYKCRFLWAVEDIDIDSDRREIDAIVWEEDEPKNIWDKFWSAVA

SEQ ID NO: 57676 - protein, 353 aa, uncultured bacterium
IGAANNLLAAMLDNHIQQGNALGIDVKKITWKRCVDMNDRQLRFVVDGLGGEANGTPREDGFDITVASEIMAVFCLASSIKDLKERLSRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLANEDLAALEKGIPNLLRHVNNIKNVYQLPCVVAINRFPTDTDAEIDFIIRKCRELGVNTVLSTVWAEGGKGGEELAREVVRLCEEEQGNFTFSYELDASIEEKLEAVTKKIYGGAGVMLTPAAKKQAERLTELGFDKIPV

SEQ ID NO: 57677 - protein, 556 aa, Ashbya gossypii ATCC 10895
MTNIIYEPKGDGSSSSTITAKPGAIKAEVLNHNTSEVESLCEKPNQSDVKRELKPRHVTMISLGGTIGTGLFIGIASPIRNAGPVGSLLAYIFVATMAYCVTQSLGEMATFIPVTSSFTVFASRFVSPALGAANGYLYWLSWCITFALEISVIGRLILYWSDAVPITAWMAIFWVLLTAINLIPVKFYGEFEFWIASLKVIAILCFLFYGLVVVCGGSKLGRIGFRYWKDPGPWGVGIVSQEIHTAQFLGWVSSLIKAAFTFQGTELVGVTAGETKNPRRTVPKAINTVFFRILLFYIGSLLVIGLLVRYDDPQLIQDGSTTNANASPFVVAINAAGTKVLPDIMNGVIMVTIISAGNSNIYVGSRVLYGLGRSGLAPAFISRTTSRGVPYVAVLATSMFGALGYLNVSSKSGSVFDWLLSITAVSGFFTWLLISVSHIRFMQCLKKRGISRDDLPFKAKFMPYGAYYAAFFVIVIILVQGFTAFTPFSAVDFVAYYISAFIFVVIWLLFQFLFKGRWFHTVDEIDIDTDRRDIDAIIWDDDKPTTLWGKIWYHLS

SEQ ID NO: 57678 - protein, 352 aa, uncultured bacterium
ITSANNLLAAMLDNHIQQGNSLDIDTRQVIWKRCEDMNDRALRNIVVGLGSKMDGFVREDHFVITVASEIMAILCLADDMEDLKARLSRIVVAYNRAGDPVTAGDLKATGAMAALLKDALKPNLIQTLEHTPAIVHGGPFANIAHGCNSVRATKMALKLADYVITEAGFGADLGAEKFFDIKCRMAGLKPDAVVLVSTVRALKYNGGVPKSDLSEKNMEALAAGIVNLEKHIENLQKYQVPIVVTLNAFVADTEEEIEYVKNFCEERGCEFALSEVWEKGGEGGIALAQKLLYTLENKKSEFKLLYEDDLSLKEKIETVAKEIYGAAGVSYSAAAEKRLKKITEMGFGSMPV

SEQ ID NO: 57679 - protein, 328 aa, Flavobacteria bacterium BBFL7
MNQTIKKIGVMTSGGDSPGMNAALRSVVRTCAFHGVECLGIYRGYQGLIEGDFKEMTARSVNNIINKGGTILKSARSQEFRTVEGRKKAFEKVKASGMDALVVIGGDGSFTGGMVFNEEFNFPVMGIPGTIDNDIYGTSSTLGFDTALNTVVECIDKIRDTASSHNRLFFVEVMGRDVGHIALNAGVGAGAEEILIPEEDMGKDRLVESLKRSRESGKSSSIVVVAEGDKTGDNVFELKDYVEKNMPEYEVRVSVLGHMQRGGSPSCWDRVLASRMGVKAVESLLEGKTNYMVGINNNKIELCPLDKAVKGKTEIDQELLRVSDIMTV

SEQ ID NO: 57680 - protein, 352 aa, uncultured bacterium
IGAANNLLAAMLDNHIQQGNSLGIDPKAITWKRAVDMNDRQLRHIVDGLGGKAQGVPREDGFDITVASEIMAVLCLAADLKDLKARLARIIVGYTYDGKPVTAHDLKAEGAMTALLKDAIKPNLVQTLEGTPAFVHGGPFANIAHGCNSVTATHTALKLADYVVTEAGFAADLGAEKFLDIKCRLSDLHPDAVVIVATVRALKYHGGVPKSELSAENLDALEKGLPNLLQHVGNIKDVFGLPCVVAINAFPTDTEAELKLVEARCRELGVNVALSEVWEKGGKGGIALAEEVVRLCDQPNNFRFAYPLDISIEEKLETICRRIYHADGVLLEAGAKKQAQQLTELGFDRLPI

SEQ ID NO: 57681 - protein, 480 aa, Oryza sativa
LLSPPPLLPILISDTAAAISPISMAAPPQPQPEPEPAAGGAGLEALEGLALDTVIAKAGARQAAALACASTRLRDAAGDDALWRRFCADDLALHAPLAPDGRALPSFKDAYKVWLESFGMYPLPLVRRVKIFWSSLKSWLSENFPEAHKTLNKGVSEAQIQSAEDDLGFKLPLPTKLLYRFCNGQLPLSEHHHENMRMAHLGIIGGYVFYDHLINVHLSPLEQIVEETKEFYREFYDQGVFNMTNLIIVATSWYRPKTFFLNCSDDQLYVGTINLQDGEMLPCVPKSLIRPTNTDMPQDGLLLWLEEHLRRLQNGMIKIRMLKTSRYISLFPEASPSCTSAMTNGVKVRASAVFAPEHPESRRPGAKCLYAYSIRLSVPEACMLGGVYYSSCQLYSRHWIIRWRDRVVSDVNGEGVIGKYPLLTTGQEEFVYESCTPLPDSPGSVEGSFTFVPGKLSRPEGKPFEVTVAAFPLEIPEYIF

SEQ ID NO: 57682 - protein, 427 aa, Glycine max
MASAMFRRNIITHYSKFASSLSSLPRHSSIYNPLSMSVSSFHSESVGGGGGLPSSMRGAVYWEPNKPLTIEEFHMPRPKAGEVLIKTKACGVCHSDLHVMKGEIPFTSPCVVGHEITGEVVEHGALTDSKTIERLPVGSRVVGAFIMPCGNCSYCSKGHDDLCEAFFAYNRAKGTLYDGETRLFFRNSGKPAYMYSMGGLAEYCVVPANGVSVLPDSLPYTESAILGCAVFTAYGAMAHAAQVRPGDSVAVIGTGGVGSSCLQIARAFGASDIIAVDVRDEKLQKAKTFGATHTVNSAKEDPIEKILEITGGKGVDVAVEALGKPQTFAQCTQSVKDGGKAVMIGLAQAGSLGEVDINRLVRRKIQVIGSYGGRARQDLPKLIRLAETGIFNLGHAVSRTYTFEEAGKAFQDLNEGKIVGRAVIEII

SEQ ID NO: 57683 - protein, 475 aa, Rhodobacter sphaeroides 2.4.1
MQAAEPSFRESVDLMFNRAVALMDLSPGLEEKIRVCNSTYTVRFGVRLRGKIFTFTGYRSVHSEHMEPVKGGIRYALSVSQDEVEALAALMTYKCALVETPFGGSKGGLCIDPREWDEHELEQITRRFAYELAKRDLIHPAQNVPAPDMGTGEREMAWIADQYARMNTADINARACVTGKPINAGGIHGRVEATGRGVQFALREFFRHAEDKARAGLSGDLDGKRIIVQGLGNVGYHAAKFLTEEDGAKVTGVIERDGALVNPAGIPVEELRHWMMKTGSIRGFSQADFVEDGRKLLEEECDILIPAAMEGVITRENAARIKAPLIIEAANGPITFGADEILRQKGTVIVPDLYANAGGVTVSYFEWVKNLSHIRFGRMQRRAEEARSRALVEELERLSADQGLGWQLAPDFKQKFMQGSDELALVRSGLDDTMRIAYQSMREVWHGAEGAQDLRVAAYIVAIRRVAATYRSKGL

SEQ ID NO: 57684 - protein, 297 aa, Rosa hybrid cultivar
MPSRLINWQVQFFGREWDFMDLYHLTLFLGVPFVCLLAPFQFTWGALWVAISLYLVSGMGVTISYHRNLAHQSFKVPKWLEYSLAYCAVLSLQGSPLEWVSTHRYHHQFTEKLRDPHSPNKGFWFSHLNWLFDYHSRFGSYDGQLMKNVGDLECQLYYRFLHYTYFLHSVLLGVALYVAGGLPFVIWGMGVRVVVISQVTFSINSICHTWGKQIWDTGDASKNNWLFGLLAFGEGWHNNHHAFEYSARQGLERWQIDTSWYVIKFFQVVGLATHVKLPTEIQKKRKALAKNSIMKDK

SEQ ID NO: 57685 - protein, 1500 aa, Gibberella moniliformis
MASTYMGGTSVQPAKLPGLGPNLTANNQTTTSTHDPQTPVNPSSDTTPTNYSQDHMASKDETPAKSTTEDEEDSELERRHSIVRDLARQYTNQSQMSAISGNPFTADENSPLNPRSDKFRALAWAKAISKLHSGTGFINRKAGVCYQNLNVFGYGQPTDYQKNVANIWLDVASLPRQLMGYGKTRIDIIRDFDGVVKNGEMLVVLGPPGSGCSTYLKTISGETSGIYINDDAYFNYRGITAHEMHTRHRGEAIYTAEVDVHFPHLTVGDTLDFAAHARAPRSIPGGIDRETFISHSRDVVMAMFGISHTVNTKVGNEYVRGVSGGERKRVTIAEASLSGAPLQCWDNSTRGLDSANAVEFCKTLRLQTQMSDTAAMVSIYQAPQAAYDIFDKVVVLYEGRQIFFGGTKAAKRYFEDLGFECPARQTVPDFLTSMTSPQERIIRKGFEDRAPRTPDEFAAAWKASQANILLQQEIEEYKRDFPINGPEAEEFRANRRAAQAKNQRKKSPYTLSYWQQTKLCVWRGFKRLVTDPTITLTQLFGNFIMALIVGSVFYNINQTTSSFFQRGALLFLACLSNAFSSALEILTLYAQRPIVEKHDRYALYHPSSEAVASMLCDMPYKLNAFTYNLTLYFMTNLRREPGPFFFFLFMTFLVTLCMSMIFRTIASASRTLSQAMVPAALLILALVTFTGFVIQIDYMLGWCRWINYVNPLAYAFESLMVNEFHNRKFECNLFIPTYPDAAPENRVCSTVGSVQGEPMVSGDRYINLSFSYYHAHKWRNVGIVIAFTLLFLVTYMFFAEAVSAKKSKGEVLVFRRGHRLAKNKADAESSPAGRVAITEKEGYGEGQPSNFKSTSVFHWNNVCYDVKIKSENRRILDNVAGWVKPGTMTALMGVSGAGKTTLLDCLADRTSMGVIHGDILVDDKLRDASFQRKTGYVQQQDLHLSTTTVREALNFSAIMRQPKHIPVKQKIAYVDEVIKMLDMQDYSEAVVGILGEGLNVEQRKRLTIGVELAAKPPVLLFVDEPTSGLDSQTSWAILDLLEKLARSGQAILCTIHQPSAMLFQRFDRLLFLASGGKTVYFGDVGDHSRTMTRYFESHGAEPCPPEANPAEWMLEVIGAAPGSETNLDWPQIWKDSSEFAEVQKHLKELSHHQVEKSQDEDPHLYDEFAATFTTQLKYVTARVFEQYWRTPSYIYSKAALCTLVALFIGFSFYQAPNTALGLQNQMFAIFQVLTVFGQLTQQQMPHFVIQRDLYEVRERPSKTYSWQVFILSQIIVEIPWNTLMAAIMYFCWYYPIGLYRNAEPTDAVAERGALMFLLFLVFMLFTCTFTDFIIAGCSSAETGGNIANLLFMMCLIFCGVLATPDSFPKFWIWMYRVSPFTYLISAILSTAVANTEVVCAQNEYVVFPPPKGQICGEYMQAYIKRAGGYLVDESSNSTCTYCTIGDSNVFLAGVRSHYDERWRNFGLMWVYIIFNVFAALALYWLVRVPKNKKGEKEKKE

SEQ ID NO: 57686 - protein, 457 aa, Salmonella typhimurium LT2
MMDSQQHGEQLKRGLKNRHIQLIALGGAIGTGLFLGSASVIQSAGPGIILGYAIAGFIAFLIMRQLGEMVVEEPVAGSFSHFAYKYWGGFAGFASGWNYWVLYVLVAMAELTAVGKYIQFWYPEIPTWASAAAFFVIINAINLTNVKVFGEMEFWFAIIKVIAVIAMILFGAWLLFSDTAGPQATVRNLWEQGGFLPHGWTGLVMMMAIIMFSFGGLELVGITAAEADNPEQSIPKATNQVIYRILIFYIGSLAVLLSLLPWTRVTADTSPFVLIFHELGDTFVANALNIVVLTAALSVYNSCVYCNSRMLFGLAQQGNAPKALLNVDKRGVPVSSILVSAVVTALCVLLNYLAPESAFGLLMALVVSALVINWAMISLAHMMFRRAKQQQGVKTRFPALFYPFGNVLCLLFMAAVLIIMLMTPGMAISVWLIPVWLLILGVGYLCKEKTAKTVKAH

SEQ ID NO: 57687 - protein, 347 aa, Flavobacteria bacterium BBFL7
MLDYVVIGGAQAGLSMAYHLQNQNKKFVVVDGEKEIGASWLNRWDSLKLFTPTEYNHLPELKFQAPKNHYPSKFEVANYFKSYVEKFKIPVQLNTLITSVRKDKKNFIVEHKDGIIEAKNVVVATGPFHIPYTPPCHTKVSSDILQIHSNYYKNTDQLQDGDTLVVGAGDSGYQILNEISSDSSRTVYFSGDTTVKSLPQQFLGKTLWWWFTVTGFLKYNKYSWVGKKINSSTQPVIGTDVKGILSRVNVIPVGRTKDAFKEKIIFENKKISSIKNIVWATGYRPNFSWIEGLELDADNYPKNYRGVSNIKGLYFIGLPWMYTRGSATLGGVSNDARYLAQRISSQK

SEQ ID NO: 57688 - protein, 396 aa, Methanococcoides burtonii DSM 6242
MKAVILAAGEGTRMRPLTSSIPKVMLPVANKPMLEHIVDSAIEAGIDGFVFITGYHEEVIEQYFGNGDRWNVTIDHVHQEEQLGTANAIGYAKGHVKEKFIVLNGDVLVSSDHIEHMIERKEDAVITVKRVDNPSDFGVIETDGNKVINIIEKPEFPPTDLANAGIYLFSEAIFDLIEQTTLSPREEYEITDSLQMLINSDADVGYEILEEEWIDIGRPWDMLDANAVLLNQMEPSVKGVIEPNATLIGDVSVGRGTLIRNGAYIIGPVIIGNDCDIGPNCFIRPSTAIGNDVHIGNAVEVKNSIIMDGTNIGHLTYLGDSIIGRKCNFGAGTKVANLRHDGKNIKVKIKGKLTDSGRRKLGVIMGDDVHTGINSSINVGTVMESGSYTRPGEVVR

SEQ ID NO: 57689 - protein, 369 aa, Helicobacter pylori 26695
MELSYYEILEVEKHSNQETIKKSYRKLALKYHPDRNAGDKEAEEKFKLINEAYGVLSDEKKRALYDRYGKKGLNQAGASQGDFSDFFEDLGSFFEDAFGFGARGSKRQKSSIAPDYLQTLELSFKEAVFGCKKTIKVQYQSVCESCDGTGAKDKALETCKQCNGQGQVFMRQGFMSFAQTCGACQGKGKIVKTPCQACKGKTYILKDEEIDAIIPEGIDDQNRMVLKNKGNEYEKGKRGDLYLEAQVKEDEHFKREGCDLFIKAPVFFTTIALGHTIKVPSLKGDELELKIPRNARDKQTFAFRNEGVKHPESSYRGSLIVELQVIYPKSLNKEQQELLEKLHASFGYEGEPHKSVLETCISKIKDWFK

SEQ ID NO: 57690 - protein, 887 aa, Salmonella typhimurium LT2
MSERFQNDVDPIETRDWLQAIESVIREEGVERAQYLIDQLLSEARKGGVKVAAGAGASNYINTIAVEDEPEYPGNLELERRIRSAIRWNAIMTVLRASKKDLELGGHMASFQSSATIYDVCFNHFFRARNEQDGGDLVYFQGHISPGIYARAFLEGRLTQEQMDNFRQEVHGNGLSSYPHPKLMPEFWQFPTVSMGLGPIGAIYQAKFLKYLEHRGLKDTSKQTVYAFLGDGEMDEPESKGAITIATREKLDNLVFVINCNLQRLDGPVTGNGKIVNELEGIFAGAGWNVIKVMWGGRWDELLRKDTSGKLIQLMNETVDGDYQTFKSKDGAYVREHFFGKYPETAALVADWTDEQIWALNRGGHDPKKVYAALKKAQETKGKATVILAHTIKGYGMGDTAEGKNIAHQVKKMNMDGVRYVRDRFNVPVADADLEKLPYITFPEGSEEHKYLHERRQALHGYLPSRQPNFTEKLELPQLSDFGALLEEQSKEISTTIAFVRALNVMLKNKSIKDRLVPIIADEARTFGMEGLFRQIGIYSPNGQQYTPQDREQVAYYKEDEKGQILQEGINELGAGASWLAAATSYSTNDLPMIPFYIYYSMFGFQRIGDLCWQAGDQQARGFLIGGTSGRTTLNGEGLQHEDGHSHIQSLTIPNCISYDPAYAYEVAVIMHDGLERMYGEKQENVYYYITTLNENYHMPAMPAGAEEGIRKGIYKLETLEGSKGKVQLLGSGSILRHVREAAQILAKDYGVGSDVYSVTSFTELARDGQDCERWNMLHPLETPRVPYIAQVMNDAPAVASTDYMKLFAEQVRTYVPADDYRVLGTDGFGRSDSRENLRHHFEVDASYVVVAALGELAKRGEIDKKVVADAITKFNIDADKVNPRLA

SEQ ID NO: 57691 - protein, 462 aa, Arabidopsis thaliana
MASNGVDEQIKLVEGPAGYVLEDVPHLSDYILDLPTYPNPLQSNAAYSVVRQYFVDEDDTVQEKIVVHKDSPRGTHFRRAGPRQKVYFKPSDVRACIVTCGGLCPGLNTVIREIVCGLHFMYGVTEVIGVDCGFRGFYSKNTVALTPKTVSDIHKRGGTILGTSRGGHDTSKIVDNIQDREINQVYIIGGDGTQKGANAIYKEIRRRGLKVAVAGIPKTIDNDIPVIDKSFGFDTAVEEAQRAINAAHVEATSVENGIGIVKLMGRYSGFIAMYATLASRDADCCLIPESPFYLEGKGGLYEFIAKRLRENGHMVIVIAEGAGQDLVAESIEQQDASGNKLLKDVGLWMSLKIKEYFAKHNVMDITLKYIDPTYMIRAIPANASDNVYSTLLAQSAVHGAMAGYTGFVSGLVNGRHTYIPFNRITERQNKVVITDRMWARMLSSTNQPSFMNPPKGTTEFTD

SEQ ID NO: 57692 - protein, 474 aa, Salmonella typhimurium LT2
MSTEIKTQVVVLGAGPAGYSAAFRCADLGLETVIVERYNTLGGVCLNVGCIPSKALLHVAKVIEEAKALAEHGIVFGEPKTDIDKIRTWKEKVITQLTGGLAGMAKGRKVKVVNGLGKFTGANTLEVEGENGKTVINFDNAIIAAGSRPIQLPFIPHEDPRVWDSTDALELKEVPKRMLVMGGGIIGLEMGTVYHALGSEIDVVEMFDQVIPAADKDIVKVFTKRISKKFNLMLETKVTAVEAKEDGIYVSMEGKKAPAEAQRYDAVLVAIGRVPNGKNLDAGKAGVEVDDRGFIRVDKQLRTNVPHIFAIGDIVGQPMLAHKGVHEGHVAAEVIAGKKHYFDPKVIPSIAYTEPEVAWVGLTEKEAKEKGISYETATFPWAASGRAIASDCADGMTKLIFDKESHRVIGGAIVGTNGGELLGEIGLAIEMGCDAEDIALTIHAHPTLHESVGLAAEVFEGSITDLPNPKAKKK

SEQ ID NO: 57693 - protein, 405 aa, Methanococcoides burtonii DSM 6242
MKAVILAAGEGLRCRPLTLTRSKVMLPVANKPIIEHVIDSLAKNEIKDLILVVGYEKERIMDYFEDGIDFGINITYVHQKAQLGTAHAIKQVAELMGEEDETFLVLNGDNVIEANTIKDLLDNHNGNATILTARKENTRGYGVIVCDGKKVKKIVEKPTAEVSHVINTGIYMFDQNIFERIEQTPISQMGEFAITDTLQQMIDDGLQVDHTITNSLWIDAVFSWDILKDNSIVLDRSKDYGIKGTVEEGAIIRGNVSIGNNTIIRSGCYIVGPAIIGDNCEIAPTVVILPSTTIGDNVTIGSFSHLQNSIIMNNTRIGNHSHISNSVIGMNNSIGPYFITEDKENIKIELEDDIQTAEKLGTITGDDTIIGHGVLVKAGVMISSNCNIDSGKIISRNLPENSIVI

SEQ ID NO: 57694 - protein, 372 aa, Streptococcus mutans UA159
MNTIKTRAAVAWAPNEPLKIEELDLMMPQKGEVMVHITATGVCHTDAYTLSGKDAEGVFPCVLGHEGAGIVEAVGEGVTEFQVGDHVIPLYTAECGKCEFCLSGKTNLCSAVRETQGRGVMPDGTVRFFKDGQPIYHYMGTSTFAEHTVVSEYSLVKIQDNAPLEEVCLLGCGVTTGMGAVLNTAKVEEGATVAIFGLGGIGLAAIIGARMAKASRIIAIDINPDKFDKARKLGATDLVNPNNHAKPIQEVIIDITNGGVDYSFECIGNVEVMRAALECCHKGWGESTIIGVAPAGAEIHTRPFQLVTGRVWRGSAFGGVKGKTQLPGIVGQYMAGEFALSDFITHTMPLEQINDAFDLMHEGKSIRTVIHY

SEQ ID NO: 57695 - protein, 669 aa, Prochlorococcus marinus subsp. marinus str. CCMP1375
MVAAPVSLESLCINSIRMLAVDAVNKSKSGHPGLPMGCAPMGYTLWDKFLRHNPKNPKWFNRDRFVLSAGHGCMLLYALLHLTGYDSVTIDDIKQFRQWGARTPGHPETFETAGVEVTAGPLGAGISNAVGLAIAEAHLAAKFNKADAKIVDHFTYVIMGDGCNQEGVASEACSLAGHLKLGKLIALYDDNHITIDGRTDVSFTEDVLKRYESYGWHVQHVQEGNTDVDAIAKAIESAKAISDKPSIIKVTTTIGFGSPNKSDTAGVHGAPLGEEEAELTRKSLDWPYEPFEIPNEVYQQYQKAIVRGESLEKEWNQLLDNYRKKYSNEAEEFERMLRGELPSDWDKDLPSYTPKDNGLATRKHSQICLGAIGPNLPELIGGSADLTHSNYTDIKGESGSFQPETPEKRYLHFGVREHAMAAILNGIAYHNSGLIPYGGTFLVFADYMRGSMRLSALSELGVIYVLTHDSIGVGEDGPTHQPIETIPSLRAIPNMLVFRPGDGNETSGSYKLAIENRKRPSSLCLSRQGMPNQANSSSKKVALGGYVIEDCVGTPDLILIGTGSELNLCIEAAQELTNQGKKIRVVSMPCMELFEEQSASYKEEVLPPLVRKRLVVEAALSFGWHKYIGLDGDSVTMNSFGASAPGGTCMEKFGFTVENVINKAKKLLN

SEQ ID NO: 57696 - protein, 203 aa, Arabidopsis thaliana
MPTLYKKAGCLGIREFMDSSTSTKKNTKLFVRNQTCFKKSSLSSSNAKKTTNLSMREQTMFKKALELSTLCDIEVCVIYYGRDGKLIKTWPEDQSKARDMAERFSRLHERERCKKRTNLSLFLRKQILHDKKLSEKVLEMEDSLESGLRVLQDKLLLLQPEKNQTELGQSCAVYSTTYPLSSPSLIEDHQHQQQWTEPLSNTE

SEQ ID NO: 57697 - protein, 530 aa, Yarrowia lipolytica CLIB122
MNFPRNKMTGLRDENTSASMRLPRAKTAEPSDMDISIGENGALNARPALNDLSNVGLSGNVFKHTAASQARRALTSKTTNGAATNKPAVKPTFSAAVAGLSRTRQPYSNNPNTQQPSNITRASSTTTNPYTRPQRASLQTKSVSADFSIPVFQSKTGPLDVPPMTRKRPSQGAKDMEMPRLAARGGKHHQTMETFAYREEGPLAKKHKQEEDKTAVALEAEQEEVIRRPLIQVLAPGATGIDVEHDDLDAEDIDDPMAAGEYVDEIFTHLYNLEEEYQPNPRYIDDQKSLSWNTRAVLIDWLVEVHQKFRLLPETLFLAVNIVDRFMSRRVVALNKVQLVGITSLLLATKYEEVFTPALSNFVYVVDGSYPEDEILRAERFILQVLQFNLSYPNPMNFLRRISKADDFDIHSRTFGKYLCEIALVDHTFMEFKHSLVAAAAMHVGRMMLARSQWTNNLVYYSGGYTQKDIAPVCRKIFQFLIGPVEHEAFFKKYATKKFLKASIIAREWALGVQEQIKNGVNSYETNLFI

SEQ ID NO: 57698 - protein, 435 aa, Hyphomonas neptunium ATCC 15444
MRNGGRISAAISVLTDVLERHQPVKIAVRDWGKSARYAGSKDRAWVSGLVLDTLRRRNSTAQRMGFTDPRALVLGTLRFVWDWPAADIEQACYDEHGPTPLTNAERDALLNASDFAAPIHVQGDFPEWMTPHMERAFGEDTVAEAQAMAVRADVDLRVNALKTDTEKAALPLNTVRAEPSKLLTNAFHIPARDPTQREDSLENIPAFSKGWVEVQDAGSQIAAAAANAKPGEQVLDFCAGGGGKTLALAAPMGGKGQIFAYDIDSKRLSALVPRLKRSGTHNVQLVHPSEGTSLDPLVEQMDLVFVDAPCTGTGTWRRRPDSKWRVRPNQLGKRIEDQRGILIDAARFVKPGGRLLYATCSFLIEEDEDRVAEFLSGDTRFTEEDAAEAAIASGLLTDHGAEIVRKYRGPTGSVRLTPLRASTDGFFFAVLRRSA

SEQ ID NO: 57699 - protein, 367 aa, Pseudomonas syringae pv. syringae B728a
MNSANSHSLAPQTRFAALACMDKIQAVTGLALRGCCSPLFAMADIVERLTRDPSTSRRISVVRASKHMSRGQEGMLASAWPLRFAAQAGAVELPLIYMISSETSAELSALASESFQRGIFCNDIETLPSRWPKGAHPWLPLWLLSNRKCQPFDPADAAEARAITLHALHSLYVEGRSGFYYMALHDESNEEVSELSDAQAVAAVQGMYRIGDAVCGHEGRRVRLLGAGLALRSVRQAARLLREHWDVDCEIWSCPSYTRVARDAAAARRWNRFHSAQPARSWHLRDCLGEGQDAVVAVTGYPQAVVEQLREHVPGRFVGLGADSAAPQGTPATRPEWIVVQALTALAEGGQLGYEPLKLALRRYQLV

SEQ ID NO: 57700 - protein, 249 aa, Coccidioides immitis RS
MARNSEKAQSMLFRFRAAQAADLGILDIGRTRRPKAITSVDSIPICEKWRGQVLKEISRKVTRIQDQSLSDYQIRDLNDEINKLMREKWMWEVQIRNLGGPNYTRGGGRVYDEDGREIPGGGKGYRYFGRARELPGVKEMFEAAARKRSADELEDSGGGQNEMLRKHVDAAYFGYGLDEEDGTLLAYEFKKEKEAFENMLKRGDGPVDEGWQPLPGDGGDGVEWRVPTLDEVQEELVDRRRRKLLDKIL

SEQ ID NO: 57701 - protein, 538 aa, Vibrio parahaemolyticus RIMD 2210633
MASNQIEGAVVGIRVNDGIAAAPVVLFTHEMPAVPERDFQSEQGEIERVKRAIGVVVQHLQEQAKQPKGEIFSAHSMMLSDPELWASVESRIQTGMIAEQAWIESLQTLADEFRQAESQYMREREADVHDIARQVMVEMTGVTPNAIDIQEPSILLARDLMPSDVAGLDKSKVLGICLSEGGKTSHSAILARAMGIPAMVKAQGCLDAVRAGQVVTIDGFRGHLWFSPSDAIQQELEAQQIEWQSTRQSALASAQQAAATCDGVHIPVFANIGGPKDIDDALTSGAEGVGLFRTEFLFQNSDELPTEEAQYQVYRDIAAALGDKPLTIRSLDVGGDKPLAAYPMPAEDNPFLGLRGVRLCLQHESLFTAQLRAILRAFHEQPNIQLMIPMVAQVEEVRKVKALLAHQANQLGLDATHLPVGIMIEVPAAVLNADALAQEVDFFSIGTNDLTQYVMAADRGNAAVAELVNYFEPSVLKAIELTCAAGDRAGIPVSMCGEMAGDPNATETLLRVGLQKFSASPSLLPGLKAQIRQLSVDV

SEQ ID NO: 57702 - protein, 175 aa, Glycine max
MGTASSILTQYDIEEVQEHCNNLFSQQEIVSLYQRFCQLDRNAKGFISADEFLSVPEFAMNPLSQRLLKMVDGLNFKDFVAFLSAFSAKASAQQKIELIFKVYDSDRNGKVSFKDMLEVLKDLSGPFMSDEQREEVLSQVLREAGYTKDSYLTLDDFIKVLGQSDLKMDVEVPVD

SEQ ID NO: 57703 - protein, 375 aa, Rubrobacter xylanophilus DSM 9941
MPAGKRDYYEVLGLSRDASEQDIKRAYRRLARKYHPDANPNDPEAEERFKELNEAYEVLSNPEARRAYDTYGHQVPSGASGRPGGDPFGGFQDIFEAFFGDRFGDPFFDLGRRRQPSRGGDTEAEVEISLEEAAFGTEREVQVQTIRNCPACDGAGGTETRLCGACGGSGVVRTVRETLLGQVMHQQTCSACGGSGRVVVDRCRECRGSGRVSEVVGRRIRIPAGIEDGMRLRVPGWGHAGEPGASSGDLYVKIRVKEHPELMRDGEDLIHRASVTFVQAALGTEVEVPTLEGTETVRIEPGTQPGTTLVLRGEGMPRMRGVGRGDLKVVVDVMVPTRLTGEQRKLLERFEAASGEETYNGRSGSFFDRLRGVFR

SEQ ID NO: 57704 - protein, 352 aa, uncultured bacterium
IGAANNLLAALIDNHIFQGNELGINPSSIVWRRCVDMNDRQLRFVVDGLGGAKNGVPREDGYDITVASEVMAILCLSTSIQDLKARLGRIIVGYTYEGNAVTAADLKAAGAMAAVLKDALKPNLVQSLEGTPAFIHGGPFANIVHGCNSVLATRMALKCGEYTVTEAGFGADLGAEKFMDIKCRTTGLRPKAVVIVATIRALKMHGGLKKDNLATEDLGALEKGLPNLLRHVSVITDVYRIPCVVAVNRFPTDTEAELELIRRRCAELGVNAVLSEVWAKGGEGGRALAEEVVRLCTKESHLEFTYADSDPVETKISSIVTRIYGGAAVSYAPGVRTKIKKLEAAGFAGVPV

SEQ ID NO: 57705 - protein, 600 aa, Rubrobacter xylanophilus DSM 9941
MGNHGKLSRVSADRIRNFCIIAHIDHGKSTLADRLLDLTDAVPERERVDQILDTMELERERGITIKAQAVRLLYNRPDGVWTLNLIDTPGHVDFTYEVSRAIAACEGALLVVDASQGIQAQTLANLYLAMEHDLEIIPVLNKIDLPVADVPAATEELVELLGVEPEEVLKISAKTGEGVRGVLDAIVERIPPPRSEHPQTRALVFDSNYDPYRGVIALARVFDGGLKKGDRVQAMGSEEEFEILEVGCYSPKPTALPALQTGQVGYVVAGLKDIGALRVGDTITSADDPAPEPLPGYARVLPTVFCGLYPTEGDDFERLRDALARLQLNDASLFFEPENSRLGFGFRCGFLGLLHMEIVQERLEREFDLDLIVTSPSVKYQVVVDGEVREVTNPSDLPESYDEIREPVVRATIICPREHVGAVMGLCHEKRGVSVGMEYISSLRVQLTYDLPLAEVITDFFDQLKSRTRGYASYDYEPVGYQPADLVKVEVLVAGDPVDSLSIIVHRDKAYQRGRALVEKLKELIPRQQFEVPVQAAVGKRVIARETVRAYRKDVTAKCYGGDITRKRKLLEKQKAGKRRMKQVGRVEIPQEAFLAAIRI

SEQ ID NO: 57706 - protein, 352 aa, uncultured bacterium
ITSANNLLAAIIDNHIQQGNELGIDTRQIIWKRAVDMNDRALRNIVVGLGAKADGVPREDHFVITVASEIMAILCLADDMDDLKKRLSRIIVAYTRDGEPVTAGQLNAVGAMAALLKDAIKPNLVQTLEHNPVIIHGGPFANIAHGCNSVRATKTALGLSDITVTEAGFGADLGAEKFLDIKCRMAGLKPDAVVLVATIRALKYNGGVDKKNLGEENLDALKKGIVNLEEHIENIQKYGVPVVVTLNSFLTDTQAETEFVRQFCEERDCRFALSEVWAKGGEGGEALAKEVINTLENKPSNFAPIYSDDLSLMDKITTVAKEIYGADGVQFSGPAARQLAKIEEMGFGKLPV

SEQ ID NO: 57707 - protein, 352 aa, uncultured bacterium
IGAANNLLAAMIDNHIQQGNSLNIDPKRITWRRAVDMNDRQLRNIVDGLGNRTDGTPRQDGFDITVASEVMAILCLASDINDLKKRLGDIVIGYTYENKPVTARELKAQGAMAVLLKDAIKPNLVQTLEGTPALVHGGPFANIAHGCNSLIATRMAMKLGDYAITEAGFGADLGAEKFLDIKCRIGNLKPDAVVVVATIRALKHHGGAKKEDLNKENLECLAKGMPNLLRHVENITKVYKLPCVVAINAFPTDTAKELQYVEDECKKLGANVALSEVWAKGGEGGIRLAEEVIRLCETENDFSYSYTDDMSIYDKLCAVAKKVYHADGVDLIGNAPKQLKQLEELGYSRLPV

SEQ ID NO: 57708 - protein, 348 aa, Crocosphaera watsonii WH 8501
MSILLAGDIGGTKTILRLVSSENSKNSESLPQQTTLYENSYPSQDYDDLVPIVQEFYQEAKQELKEEISVKNACFGIAGPVVNNTSKLTNLNWPELTGDRLEKKLSLERVNLINDFAAIGYGILGLKPDDLHTLQGAEAKPNTPIGVLGAGTGLGECFLTPSESGNYSVFSTEGSHGDFAPRSELEFELLTYIRDKYSLSRVSIERIVSGMGISAIYQFLRHKYPEKESDKLKKIFQIWENEKNIDLSAEVSKAALENRDSLCQQTMEIFISAYGAEAGNLALKLLPYNGLYIAGGIAAKILPLMQTGTFMESFQAKGRMSSLLTEIPVNIILNPKVGLIGAALRAAK

SEQ ID NO: 57709 - protein, 353 aa, uncultured bacterium
IGAANNLLAAMLDNHIQQGNALGIDVKKITWKRCVDMNDRQLRFVVDGLGGKANGVPREDGFDITVASEIMAVFCLASSMKDLKERLSRIIVAYTYDDKPVTAGDLKATGAMVALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLAEENLEALEKGIPNLLRHVRNIREVYQLPCVVAINRFPTDTDAEIEFIIRKCRELGVNTVLSTVWAEGGKGGEDLAREVVRLCEEEKGNFTFSYDLEMSIEEKLEAVTKKIYGGAGVALTPGAKKQAERLTALGFDKMPV

SEQ ID NO: 57710 - protein, 536 aa, Thermoplasma acidophilum DSM 1728
MRDIEEIIKEIGLGRDDYELYGRYMAKLDLGLQNRGRPRAKLILVTAMTPTPAGEGKTTTTIGLGQAMKKLGKNVAIAIREPSLGPCFGIKGGATGGGKSKVEPSDRINLFFTGDFPTITAAHNLLSAMINNHMYHGNELNLDPKRITFPRTIDMNDRSLRSILVGVGPRDMGVLAGDSFVITPASEVMAITGLSLNYQDLKARLSRILAGFTTKNKPVFAGDLKAEGSMAALLRDALKPNLVQTTEGVPAFVHTGPFGNIAHGTSSLVADKIALNLFDYVITEAGFGSDLGAEKFFNLASRIGDLPINAVVLVATIRAIKHHGGSKKEGEDIDAVKTGSKNLIRHVQNIRNFGIDPVVAVNRFPTDTDGEIRALGEILDSNGIKWALSEVFAKGGEGGIDLANKVLASLGSHEIKRTYDLKDDIRTKIEKIARNVYGADGVIFEKKALSDMKKAEEIMENPYVCMAKTQYSFSDDASLLNDPHGFTIKVQSINISSGAGFVVPILGEIMTMPGLPKHPAAENIDLTDSGEITGLF

SEQ ID NO: 57711 - protein, 468 aa, Prochlorococcus marinus subsp. marinus str. CCMP1375
MIMRTSWVASRKGQSNVSQMYFARREVITEEMSFVAKKENLPESLIMEEVARGRMIIPANINHLNLEPMAIGIASSCKVNANIGASPNASDVNEELKKLHLAVKYGADTVMDLSTGGVNLDEVRTAIIQASPVPIGTVPVYQALESVHGSIEKLSEEDFLHIIEKHCQQGVDYQTIHAGLLIEHLPKVKGRLTGIVSRGGGILAQWMLYHHKQNPLFTRFDDICEIFKRYDCSFSLGDSLRPGCLHDASDEAQLAELKTLGELTQRAWKHDVQVMVEGPGHVPMDQIEFNVRKQMEDCLEAPFYVLGPLVTDIAPGYDHITSAIGAAMAGWYGTAMLCYVTPKEHLGLPNPEDVREGLIAYKIAAHAADIARHRSGARDRDDELSRARYAFDWNKQFELSLDPERAREYHDETLPADIYKQAEFCSMCGPKHCPMQTKITDKDLENLESILSSKGAKEINTMKLDKEV

SEQ ID NO: 57712 - protein, 392 aa, Magnetospirillum magnetotacticum MS-1
MAESQIQSYTINFGPQHPAAHGVLRLILEMSGEVVDRADPHVGLLHRGTEKLIEHKTYLQATPYFDRLDYVGTMNQEHAFVLATERLLGIDIPMRAKFIRTLYDEIGRILNHLLNVTAFIFDVGGMTPLLYGFEEREKLMEFYERVCGARLHANYYRPGGVAADLPNGLLEDIAEWCETFPAVLDDIETLATDNRIFKQRVVDIGTVTAEQALDWGFTGPNLRASGIAWDLRKAQPYEVYDQMEFDIPVGKNGDGYDRYLVRVLEMRESIKIMKQCIAKMPGGPVRIEDNKVTPPKRAEMKTSMESLIHHFKLFTEGFRVPVGETYTAIEAPKGEFAVYLIADGTGKPYRCKIRPPGYVHLQALDMMSKGHMLADVVANIGSIDIVFGEIDR

SEQ ID NO: 57713 - protein, 343 aa, uncultured bacterium
GAANNLLAAMLDNHIQQGNALGIDVKKITWKRCVDMNDRQLRFVVDGLGGKANGTPREDGFDITVASEIMAVFCLASSMADLKERLSRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLANEDLAALERGIPNLLRHVNNIKNVYQLPCVVAINRFPTDTDAEIDFIIRKCRELGVNTVLSTVWAEGGKGGEDLAREVVRLCEEEQGNFTFSYELDASIEEKLEAVTKKIYGGAGVVLTPAAKKQAERLT

SEQ ID NO: 57714 - protein, 548 aa, Methanococcus maripaludis S2
MDNSKDDLICIGFEGTAEKSGVGIITSKGEVLFNKTIIYTPPVQGIHPREAADHHAETFVKLLKEALNEVPLEKIDLVSFSLGPGLGPSLRVTATTARALSLSINKPIIGVNHCIGHVEIGKLTTDAVDPLTLYVSGGNTQVLAYTGKKYRVIGETLDIAIGNCLDQFARHCNLPHPGGVYVEKFAKDGNKFIKLPYTVKGMDLSLSGLLTSAMKKYDSKERIEDVCYSLQETSFSMLTEITERALAHTNKAEVMLVGGVAANNRLKEMLKVMCEEQNVDFYVPEKQFCGDNGAMIAWLGILQYLNGKRMDLKDTKPISNYRSDMVEVNWIHDESKNLNDGNIKSRKIPKHLIGKGAEADISKGRYLEFESITKERVKKGYRILKLDELIRTRRTVKEARFLAAVKECGIHAPSIYDIDKENKKIIMGYIHGKIAKDEIEEGNIEFCKSLGETIGKMHGSGIVHNDLTTSNFIISKNPYIIDFGLGKYSDLIEDKAIDLIVLKKSIMSIHYDKFDLVWNKIIDGYKTYELAESVLECIKEVEKRARYL

SEQ ID NO: 57715 - protein, 359 aa, Thermoplasma acidophilum DSM 1728
MSLKGVVMAGGKGTRLRPITYSIPKPLVPVAGKPVISYILDAFYRSGISDIIITTGYKFESLIKGVLENKNSQQNILFSVEKEAAGTAGGVKIAENFLDDTFVVGSGDILIDFDIGDMIKEHQRRKNKITIAVTKVDDPSQFGIAEIDEEGYIKRFLEKPGKNETFSDTINAGVYIMDRSLLRYIPSTGQFDFAKDLFPKLLSQGIKIGTYLIDGVWLDAGRPKDVIKANQIMVEKYGESFNGTGKAIIKSKVPQGCSIKPPIYIGEGVHVGNNSTISGSAVYDGVSIGDDVQIENSVIMASSKIMRGTKVVNSVIMQNTTIGEDCEIHDSVLSQKLNLQNGSKVFQVALSSEIVQDEN

SEQ ID NO: 57716 - protein, 331 aa, Streptococcus mutans UA159
MARKILEVIIAMLSKKQYLDMFLKMQRIRDVDTKLNKLVRRGFVQGMTHFSVGEEAASVGAIQGLTDQDIIFSNHRGHGQTIAKGIDIPAMFAELAGKATGSSKGRGGSMHLANLEKGNYGTNGIVGGGYALAVGAALTQQYDNTGNIVVAFSGDSATNEGSFHESVNLAAVWNLPVIFFIINNRYGISTDINYSTKISHLYLRADAYGIPGHYVEDGNDVIAVYEKMQEVIDYVRSGNGPALVEVESYRWFGHSTADAGAYRTKEEVDAWKAKDPLKKYRTYLTENKIATDEELDMIEKEVAQEIEDAVKFAQDSPEPELSVAFEDVWVD

SEQ ID NO: 57717 - protein, 337 aa, Streptococcus mutans UA159
MRRKRYMSETKVVALREAINLAMSEEMRKDEKIILMGEDVGIYGGDFGTSVGMLAEFGEKRVKDTPISEAAIAGSAVGAAQTGLRPIVDLTFMDFVTIAMDAIVNQGAKANYMFGGGLKTPVTFRVASGSGIGSAAQHSQSLEAWLTHIPGIKVVAPGTVNDAKALLKSAIRDNNIVIFMEPKALYGKKEEVNLDPDFYIPLGKGEIKREGTDVTIVSYGRMLERVLKAAEEVAAEDISVEVVDPRTLIPLDKDLIINSVKKTGKVILVNDAYKTGGFIGEIASVITESEAFDYLDAPVLRLASEDVPVPYSHVLETAILPDVAKIKEAIYKQVRKR

SEQ ID NO: 57718 - protein, 455 aa, Streptococcus mutans UA159
MAVEIIMPKLGVDMQEGEIIEWKKQEGDEVKEGEILLEIMSDKTNMEIEAEDSGVLLKIVKGNGQVVPVTEVIGYIGQAGEVLEIADVPASTVPKENSAAPAEKTKAMSSPTVAAAPQGKIRATPAARKAARDLGVNLNQVSGTGAKGRVHKEDVESFKAAQPKATPLARKIAIDKGIDLASVSGTGFGGKIIKEDILNLFEAAQPVNDVSDPAKEAAALPEGVEVIKMSAMRKAVAKSMVNSYLTAPTFTLNYDIDMTEMIALRKKLIDPIMEKTGFKVSFTDLIGLAVVKTLMKPEHRYLNASLINDATEIELHQFVNLGIAVGLDEGLLVPVVHGADKMSLSDFVIASKDVIKKAQTGKLKATEMSGSTFSITNLGMFGTKTFNPIINQPNSAILGVGATIQTPTVVDGEIKIRPIMALCLTIDHRLVDGMNGAKFMVDLKKLMENPFTLLI

SEQ ID NO: 57719 - protein, 581 aa, Streptococcus mutans UA159
MAVEIIMPKLGVDMQEGEIIEWKKQEGDEVKEGDILLEIMSDKTNMEIEAEDSGVLLKIVKGNGQVVPVTEVIGYIGSAGETIETNAAPAASADDLKAAGLEVPDTLGESAAPAAQKTPLADDEYDMIVVGGGPAGYYAAIRGAQLGGKVAIVEKSEFGGTCLNKGCIPTKTYLKNAEILDGIKIAAGRGINFASTNYTIDMDKTVAFKDTVVKTLTSGVQGLLKANKVTIFNGLGQVNPDKTVTVGSETIKGHNIILATGSKVSRINIPGIDSPLVLTSDDILDLREIPKSLAVMGGGVVGIELGLVYASYGTEVTVIEMADRIIPAMDKEVSLELQKILSKKGMNIKTSVGVAEIVEANNQLTLKLNDGSEVVAEKALLSIGRVPQLSGLENLNLELERGRIKVDDYQETSISGIYAPGDVNGRKMLAHAAYRMGEVAAENAIWGNVRKANLKYTPAAVYTHPEVAMCGITEEQARQEYGNVLVGKSSFSGNGRAIASNEAQGFVKVVADAKYHEILGVHIIGPAAAEMINEASTIMENELTVDELLRSIHGHPTFSEVMYEAFADVLGEAIHNPPKRR

SEQ ID NO: 57720 - protein, 973 aa, Agrobacterium tumefaciens str. C58
MPPSHVLKRRSKTMALVTEFDYGTPKSNATDMVTLTIDGRQVTVPTGTSIMRASREAGIDVPKLCATDMVDAFGSCRLCLIEVEGRNGTPASCTTPVAAGLVVHTQTERLKQIRKGVMELYISDHPLDCLTCAANGDCELQDMAGAVGLRDVRYGYEGDNHVKSRTGGGDINARWMPKDESNPYFTYDPSKCIVCSRCVRACEEVQGTFALTIEGRGFESRVSPGAHEAFLDSDCVSCGACVQACPTATLTEKSVIEIGQPEHSMVTTCAYCGVGCSFKAEMRGEELVRMVPWKDGQANRGHSCVKGRFAYGYATHRDRILNPMIRENIGDPWREVSWDAAFAYVASEFRRIQGKYGRESIGGITSSRCTNEETFLVQKLVRAGFGNNNVDTCARVCHSPTGYGLGQAFGTSAGTQNFDSVEQSDVVLVIGANPTDGHPVFGSRLKKRLRQGAKLIVIDPRRIDLVRTPHVEAAFHLPLLPGTNVAVLTALAHVIVTEGLFNEAFIRERCDWSEFEDWAAFVAEPQHSPEETERFTGVPAEDLRGAARLYATGGNGAIYYGLGVTEHSQGSTTVMAIANLAMVTGNIGRPGVGVNPLRGQNNVQGSCDMGSFPHELPGYRHISDDATRDVFEKLWGVKLNNEPGLRIPNMLDAAVDGSFKGIYIQGEDILQSDPDTKHVSAGLAAMECVVVHDLFLNETANYAHVFLPGSTFLEKDGTFTNAERRINRVRKVMSPKNGYADWEVTQKLAQAMGLTWNYTHPSEIMDEIAATTPSFASVSYAYLEEKGSVQWPCNEKFPEGSPIMHVDGFVRGKGKFIRTEYVATDERTGPRFPLLLTTGRILSQYNVGAQTRRTENVVWHEEDRLEIHPHDAEQRGVKDGDWIKLVSRSGDTTLRALITDRVAPGVVYTTFHHPGTQANVITTDFSDWATNCPEYKVTAVQVSPSNGPTEWQEEYDALARQSRRIAGKLEAAE

SEQ ID NO: 57721 - protein, 775 aa, Oryza sativa (indica cultivar-group)
MELEYESKRPLYIPYAGPILLEFPLLNKGSAFTEEERSHFNLHGLLPEAVETIEEQVERAYRQYQDFKNDNDKHIYLRNIQDTNETLFYRLLDSHLSEMMPIIYTPTVGEACEHFSDIYRRARGLFISYPNRDRIDDMLQNATKQNVKVIVVTDGERILGLGDQGIGGMGIPIGKLSLYTACGGISPAYTLPVVLDVGTNNPQRLNDPLYMGWRHPRISGEEYHAFVEEFIQAVKRRWPNVLLQFEDFAQNNATPLLNRYRDEICCFNDDIQGTAAVTLGSLIAASRAAGSQLRDQTVTFLGAGSAGCGIAEQIIAQMKSEGLSEDEARARVFMVDRFGLLTDKLPNLLDFQSKLVQKSDNLAGWETASDAISLLDVVRNAKPTILIGVSGQPGLFTEELIREMHKHCERPIVMPLSNPTSRVEARPEDIINWTDGAALVATGSPFAPVSYKEQLYPIAQCNNSYIFPGIGLGVLASGATRVTDAMLMAASRALADCSPLATDGHGALLPNIDDIQGVSKCIAMEVGKAAQLQGVAIVTSEDALSKAIEHNFWRPHWKTAPYVYDELQELPHRQVGVVLGTAKYYRTGVINQYYRYRIQGAINAYNSGKVKYLLLSGDNAQQSYNEPMTMRRDLIAAGVAPSDIVLDYAGFRTLDSIVRTRKVFDTNDFIIITQRFHCERALFIALHMGIQAQCYAVPSPKDMMTVRAREIFARLGALTDLYILKREPRFLGPLIPISAMHTVPEDAQGYPAVSPEQLVELEHKLKEEKQKAKQP

SEQ ID NO: 57722 - protein, 889 aa, Pseudomonas syringae pv. syringae B728a
MAQQPRFLDEDPQETREWLESIESVLNTEGRPRAHYLIDQLLDFDVAQHGDFYGRVTTPYVNTIPSDRQQPYPGDLQVEKRINAFIRWNALVMVLRAGKHSGVGGHIASYASAAVLYDVGFDHFFRGRTEQFAGDLVYIQGHSSPGIYGRAYLEGRLSEEQLDNFRRETDRDGISSYPHPRLMPDFWQFPTVSMGLGPITAAYQARFMRYLENRGLKEHQGRKVWAFLGDGEMDQPESQAAIALAGREKLDNIIFVVNCNLQRLDGPVRGNSKVIQEFESLYRAAGWNVIKVIWGGGWDALLEKDKSGLLRQRMMECVDGEYQNYKSQNGAYVREHFFGKYPELLELVSDMSDDDIWKLSRGGHDPEKVYNAYAAAMRHKGGPTVILAKTVKGFGMGEAGEGQNINHQLKKLGAEAIKAFRDRFSLDITDDQLGDMPYLKPAEGSTEALYLKARRAQLGGYIPARFSDAATLQIPPLSVLDTQLKNTGDRGISTTMAFVRILSTLLKDPNIGKLIVPIVPDESRTFGMENLFRQIGIHSHVGQLYTPQDAGQLSYYKESTDGQIMQEGLNESGAISSWIAASTSYANHGVMTVPFYIFYSMFGFQRVGDLAWAAGDARARGFLLGATSGRTTLMGEGLQHDDGHSHVMSSTIPCCVSYDPTFAFELAVIIQDGMRRMFAENEDIYYYITLLNENYPHPDLPEGAEAGILKGMYPLQASASINTGKHVQLMGCGSILLEVIAAARLLEDDFGVSSEIWSVTSLTELRREGQDAERWNLLNPQQEPRLSYVESCLADREGPVIVATDYMKIFADQIRPFVPMRRFVALGTDGFGQSDTRESLRHFFEVDRYFVAVAALKALADDGKVERKVVAQAIERYKIDPGKQNPVLV

SEQ ID NO: 57723 - protein, 402 aa, Helicobacter pylori 26695
MLAKMSFMQNVKNIQEVEVSHKRVLIRVDFNVPLDENLNITDDTRIRESLPTIQYCIDNKAKDIILVSHLGRPKGVEEKLSLKPFLKRLERLLNHEVVFSQNIVQLKQALNENAPTRIFLLENIRFLRGEEENDENLAKDLASLCDVFVNDAFGTSHRKHASTYGTAKFAPIKVSGFLLKKEIDSFYQAFNHPLRPLLLIVGGAKVSSKLTLLKNILDLIDKLIIAGAMSNTFLKALGYDVQDSSVEDALINDALELLQSAKEKKVKVYLPIDAVTTDDILNPKHIKISPVQDIEPKHKIADIGPASLKLFSEVIESAPTILWNGPLGVHEKQEFARGTTFLAHKIADTYAFSLIGGGDTIDAINRAGEKDNMSFISTGGGASLELLEGKILPCFEVLDKRH

SEQ ID NO: 57724 - protein, 286 aa, Salmonella typhimurium LT2
MAENTMWHETLHDQFGQYFAVDNVLYHEKTDHQDLIIFENAAFGRVMALDGVVQTTERDEFIYHEMMTHVPLLAHGHAKHVLIIGGGDGAMLREVTRHKNVETITMVEIDAGVVSFCRQYLPNHNAGSYDDPRFTLVIDDGVNFVNQTHQTFDVIISDCTDPIGPGESLFTSAFYEGCKRCLNPGGIFVAQNGVCFLQQDEALDSHRKLSHYFSDVGFYQAAIPTYYGGIMTFAWATDNDALRHLSSEIIQARFHAAGLKCRYYNPAIHAAAFALPQYLHDALSAQ

SEQ ID NO: 57725 - protein, 193 aa, Escherichia coli
GIDTANMFEFWDWVGGRYSLWSAIGLSIVLSIGFDNFVELLSGAHAMDKHFSTTPAEKNLPVLLALVGIWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQEYRD

SEQ ID NO: 57726 - protein, 347 aa, Colwellia psychrerythraea 34H
MNQNKQVNRQILLASRPFGAPSHDNFTLAQTAKPSPKQGEVLLRTVYLSLDPYMRGRMNDAKSYADPVALNEVMVGGTVCRVEESKHADYQQGDWVVSFGGWQDYSISNGVDLLKLGNDISNPSYALGVLGMPGLTAYMGLLDIGQPKAGETVVVAAATGAVGSLVGQIAKIQGCKVIGIAGGTEKCQYAVDTLGFDACLDHHSDELATLLAKTCTDGIDVYFENVGGKVFDAVLPLLNPKSRIPLCGLISQYNATELPDGPDRMSSLMGTLLVKRAKMQGFIVFDDYGHRYGEFNKAMMTWLSEGKIKYKEHRVEGLENSVSSFIGLLEGKNFGKLVVRVGPDDLT

SEQ ID NO: 57727 - protein, 473 aa, Synechococcus sp. WH 7805
MATTAQDVLRQIKDEGIELIDLKFTDLHGKWQHLTICSDLLEAESFNEGLAFDGSSIRGWKSIDASDMAMVPDPSTAWIDPFYSHKTLSLICSIQDPRTGDAYDRCPRALAQKALAYLSGSGLADTAFFGPEPEFFLFDDVRYSSSEGGSFYSVDTIEAAWNSGRLEEGGNLGYKIQLKEGYFPVSPNDTAQDIRSEMLLVMAQLGIPIEKHHHEVAGAGQHELGMKFAELIQAADNTMTYKYVVRNVAKKYGKTATFMPKPVFNDNGSGMHVHQSLWKGGQPLFFGEGTEANLSQTARWYIGGILKHAPSFLAFTNPTTNSYKRLVPGFEAPVNLVYSEGNRSAAVRIPLTGPNPKAKRLEFRSGDALANPYLAFAAMMMAGIDGIKNQIDPGAPTNVDLFELSAERLSEIDTVPASLNGALEALNADHHYLMEGGVFTKDFIDNWIDLKYEEVQQLRQRPHPHEFTMYYDA

SEQ ID NO: 57728 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPL

SEQ ID NO: 57729 - protein, 203 aa, Glycine max
MGMIVEVENENGDLNDAVLVPPPNFSMVEDCIFRSGLPNPSNFPFLQTLNLRSIIYLCPEPYPEENLDFLRSQNIRLFQFGIEGKTDISMPILKDSIMDALEVLIDVRNHPVLIHCKRGKHRTGCLVGCLRKLQNWCLSSVFEEYQRFAGAKSRTTDLTFIEMFDVLSLSQCLYSIIYQYHGSKKRRLLYKDENLQKPRLTSF

SEQ ID NO: 57730 - protein, 409 aa, Oryza sativa (indica cultivar-group)
MEPFKGNFSNLLNQGSSSQATNSDAQNSPSTQFPTSYPQNFRPSFLQNFHPFGPPSNYQPYRHPPIFQGAQQQDYYGQPTPGSLEGFQLQENLVHSSNQAFGFAANRSQFGMQYSTSIGAAANTSSHGSASPCHTRHNEKEVVEVEEASDSSEEGRRGTRINWTEDDNIRLMSSWLNNSVDPIKGNDKKSEQYWKAVAREFNSNMPSNGNKRNPKQCRTHWDNVKRYVTKFCGFYSKARTTFTSGYSDDMIMEKAREWYKKHNNQKPFTLEYMWKDLKDQPKWRRVLEESSHNKRNKISESGAYTSSSNQDTEEETERKEKRPEGQKAAKQRQKGKGAPSPLGDKPNQNMVLFHEAITTKAAALLKAAEATLIGAEAKKREGNCKKREGKGRKIPNVFKTDGEGYINLQ

SEQ ID NO: 57731 - protein, 203 aa, Carboxydothermus hydrogenoformans Z-2901
MELKFDEKGLIPAVVQDIDTREVLMVAYMNEESVKKSLETGQTWFYSRSRNALWHKGETSGNTQEIVEIRYDCDADCLLIKVRQKGVACHTGNYSCFYRTLWEGKGEREDLNEVLAKLWQIILDRKQKLPEGSYTAKLFQKGIDKIAQKVGEEAVETVIASKNDDKGELIYEAADLVYHLLVLLAAKDVALGDIAEELKKRFK

SEQ ID NO: 57732 - protein, 404 aa, Kluyveromyces lactis NRRL Y-1140
MLVSTILYRTYKVIVTFASMVIFIQGAISILVYQALINAFYSKNLSTRQKLMDLTKKRFILLLVTILSLVAPSHVRITTDNESIPKGTIYMDHHKGRLISKANSNAVVIANHQIYTDWVFLWWLAYVSERAGNVYIMLKKSLESIPLLGSGMTNYKFIFMNRKWEQDRINLSNKLHEIDLDARGVGIIAGNSPTTKTEEGLNIWDEAKVEKKGEQWPYWLMLFPEGTNLSAGTRARNKAFAEKSGLSPFKHVLLPRTTGLKFCLQKLRNSCEYVYDITIAYSGVRAEDYGQDIYKLGNIFLKGKAPKLVDIYIRAIRLDDIPLEDDDEFHSWLFSVWNLKDKLLDNYYKTGSFQLDPDLNHAVTGPCRVSILSLVSILLFPVLTMLPIFYYIGKKATSLVSKDS

SEQ ID NO: 57733 - protein, 449 aa, Haemophilus influenzae 86-028NP
MSKVASLDAFLTKVAQRDGYQPEFLQAVREVFTSIWPFLEANPKYRSEALLERLVEPERAFQFRVAWTDDKGQVQVNRAFRVQFNSAIGPFKGGMRFHPSVNLSILKFLGFEQIFKNALTTLPMGGAKGGSDFDPKGKSDAEVMRFCQALMAELYRHVGADTDVPAGDIGVGGREVGYLAGYMKKLSNQSACVFTGRGLSFGGSLIRPEATGYGLIYFAQAMLAEKGDSFAGKVVSVSGSGNVAQYAIEKALSLGAKVVTCSDSSGYVYDPNGFTTEKLAALLEIKNVKRGRVKDYAELFGLQYFEGKRPWEVQVDIALPCATQNELELSDAQRLIKNGVKLVAEGANMPTTIEATEALLAADVLFGPGKAANAGGVATSGLEMAQSSQRLYWTAEEVDAQLHRIMLDIHANCKKYGTIEGQENINYVVGANVAGFVKVADAMLAQGVY

SEQ ID NO: 57734 - protein, 212 aa, Campylobacter coli RM2228
MKKTILFDLDGTLIDSTDAILNSFQGAFKILGLTPKNNEEIKNLIGHPLEHMFKFLYHDKANLSEEFVLAYREIYSQIYLEQTTLLPKAKEALELAFEIADLGIVTTKGGKFTPLLLEHLGVKKFFKTLITLEDVTNPKPHAEPILLALEKMQKTKENAYMIGDTILDIQAAMAANITPLALSCGYGDEDELKRYSMVFPSAYKSVLYIKND

SEQ ID NO: 57735 - protein, 352 aa, uncultured bacterium
IGAANNLLAAMLDNHIQQGNSLGIDVKQITWKRAVDMNDRQLRRIVDGLGGRAQGVPREDGFEITVASEIMAVLCLASDLKDLKARLARIIVGYTYDGKPVTAHDLKAEGAMTALLKDAIKPNLVQTLEGTPAFVHGGPFANIAHGCNSVIATHTALKLADYVITEAGFAADLGAEKFLDIKCRVSDLHPSAVVIVATVRALKYHGGIPKAELNAENLEALEKGLPNLLQHVSNIKNVFGLPCVAAINAFPTDTEAELKLVEKKCRELGVNVALSEVWAKGGEGGIALAEEVVRLCEQPNSFTFSYPLEMSIEEKLETICKKIYHADGVTLDANARKQAEQLTALGFDKLPI

SEQ ID NO: 57736 - protein, 589 aa, Candida albicans
MTRTTRIDTQEATKHKDLPPVPSPLSLSSNPNPECLMESKSLGRKNFKKLSLDASPVKSTSGSLRSSDMMSIKEPTSLRQKRTRPPPILHLPTASSSATSTPTSNITGSSSASSIQFAQKSPGSGVIVSQTLSRPSSAGGIPSSGYSSLNVNQSNRNVDPDNVVSTDMILNQISNLDLTSMNHHRQHYQNSHHHLPTTNRKRQTVISSISPTKSSAASSPLEPQIQSLPASSQSPIATTSSLKLNNKDLLTLKQLGSGNSGSVSKILHIPTQKTMAKKIIHIDSKSVIQTQIIRELRILHECHSPYIIEFYGACLNNNNTIVICMEYCNCGSLDKILPLCENKQFPTFVLKKLSFAILSGLTYLYTTHKIIHRDIKPNNVLMTHKGEFKLCDFGVSRELTNSLAMADTFVGTSMYMSPERIQGLDYGVKSDVWSTGLMLIELASGVPVWSEDDNNNDDDEDDEDDAYVRQGSIAAERNGQNSPSRSRKNKQKGNGYNSYNGPEGILDLLQRIVNEDAPTLTNKINPVTKLPYDKYLCQFIDLCLIKDDSVRKTPWQLLEDKEHFFKGVEEGVYDKEHKSWAKKIRKCKV

SEQ ID NO: 57737 - protein, 838 aa, Hordeum vulgare subsp. spontaneum
MMRRMVMKVALEDRSQQRKALKAVSTLHGIDAIAADLRCGTITVVGVVDPVHVVAKLRRLFANAQIVSVGPAKEEKKDGDKKDGADKKKPEPVPPVYYPFPYYPPPRPRYEFTVGFLNSITDNFSEARIIVRGRHGIVYKGVLDNGQYIAVKKLHLMPGLDDEEFKNEFNNLMRVRHQNIIPLVGYCHHTKQVLVEHNGKHVSARVEERYLCSEYLEGGSLDKHLSNEPCALAWYTCYKIIKGICDGLLCLHKGFQEPIWHLELKPTKFLLDKDMMPKIGGFGFSRLFDSIETSSTSEVRGTSVYMPPEYISKRLITSRFNVFSLGVIILQIMAGKESYTKCVDIPPEEFTERVYGFWVNRMPGTVSKHTSNEVKTCIEIALKCVESNRVNRPTINEIIQRMDKIDIVECSSLGDLYKTREFAFEFLEHITNVFSEKNIIGRGACGVIYKGVLDNGEEIAVKKLHQTLSIDDGLFKKEVNNVMRAEHKNIVRLVGYCHHISPIIVEHEGKHVSASVIERVICFEYMQRGSLDDQLSAESCKLDWDRCYKIIKGICEGLHYLHNAVPPIYHGDLKPGNILLDKDMVAKIGDFGLSRVFDTTQTYMTTSGVIKGTPGYMSPEYINEHKISLKSDVFALGVIIIKMMTGKEDYSNYAHTPREEFIEHVCKKWQVRLHATMRSHVFEEVRTCIGIALKCVEDDRTQRPTMAQILNELSNIGIVKRSPVDRVQETMSTQVSEEVRTCIEIVLKCVEDDRTQRPTIAQIVNELSKIGIAKGSSISQISQATSSSPEQTTQGGGHQVNKLTATPLEEKSRSCPGQACKELKLKRKVKLKLRRNVK

SEQ ID NO: 57738 - protein, 475 aa, Bacillus halodurans C-125; identical to SEQ ID NO: 1386

SEQ ID NO: 57739 - protein, 352 aa, uncultured bacterium
IGAANNLLAAMLDNHIQQGNSLGIDPKQITWRRAVDMNDRQLRNIVDGLGGKAQGVPREDGFDITVASEVMAVLCLATDIIDLKKRLGNIVVGYTYGGKPVTAHDLKAEGAMTALLKDALKPNLVQTLEHTPAFVHCGPFANIAHGCNSVTATRMALKLADYIVTEAGFAADLGAEKFFDIMCRAADLHPSAVVVVATVRALKYHGGVPKEDLNKENLEALEAGLPNLLQHVSNIKDVFGLPCVVAINAFSADTKAELDLVEEKCRELGVNVALSEVWAKGGEGGTALAEEVVRLCELPNDFKPAYELDGTIEDKISAIAHRIYHAKHAMLLPAAKKKAQRLEELGFGGLPV

SEQ ID NO: 57740 - protein, 452 aa, Oryza sativa
STTTTVTIDDHASGSFSRSEAFLAVEAYLSASPCAARARRLRADRMALAVDDHEEVADDFRGATMWWRKSKAIPRANVISWAPRQDERRSYHLTFHRRHRALVEADYFPHVLAEGRAVTVRNRQRRLFTNNPGADWSGYDDARVWSHVKLEHPSTFATLAMDPVRKQEIIDDLDMFRDGKDYASVGKAWKRGYLLFGPPGTGKSTMIAAMANFLDYDVYDLELTAVESNTELRRLFIETTGKSIIVIEDIDCSIDLTGKRKKKKKDKKKKKMMPPSDDDDEEKKVTLSGLLNFIDGLWSACGGERIIIFTTNHKEKLDPALIRRGRMDMHIEMSYCCFESFKVLAKNYLGVEQHEMFGEIRQLLEEADMSPADVAENLMPRSKTKDVDACLERLVKALHEAKETKAAGGNDDDDESSSSSDDSDSSSDSEEQDKLAVVTKLDFSLAQPNYII

SEQ ID NO: 57741 - protein, 346 aa, Streptomyces cinnamonensis
MTTRPDTKTALSQKTALSQLLTEIEHRNPAQPEFHQAAREVLETLAPVIAARPEYAEAGLIERLCEPERQIVFRVPWQDDHGRVRVNRGFRVEFNSALGPYKGGLRFHPSVNLGVIKFLGFEQIFKNALTGLGIGGGKGGSDFDPRGRSDAEVMRFCQSFMTELYRHIGEHTDVPAGDIGVGGREIGYLFGQYRRITNRWEAGVLTGKGRNWGGSLIRPEATGYGNVLFAAAMLRERGETLEGRTAVVSGSGNVAIYTIQKLAALGANAVTCSDSSGYVVDEKGIDLDLLKQVKEVERARVDTYAQRRGASARFVPGRRVWEVPADIALPSATQNELDADDATALI

SEQ ID NO: 57742 - protein, 322 aa, uncultured bacterium
QGNPLNIDPRRIIWKRVVDMNDRALRNIVIGLGGKAHGVPREDGFDITVASEVMAILCLASNLHDLKERLKRIVVAYNYDGKPVTAEDLHAAGAMAALLKDAVKPNLVQTLEHVPAIIHGGPFANIAHGCNSVMATRTALRLADFTITEAGFGADLGAEKFFDIKCRQAGLAPDACVLVATVRALKMHGGVAKADLKEPNVEAVKKGLPNLGKHIENIFKFGVPVVVAINIFAQDTKEELQAVYDYCAGMGVNVALSDVFAKGGEGGVELAKEVVALAESGMARFKPVYPLDMPLRKKVETIVKEIYGGDRVEFQAKAAQAL

SEQ ID NO: 57743 - protein, 306 aa, Streptomyces cinnamonensis
MTLASSLEPTTEPLFNGLYVPLVTPFTDDLRLAPEALARLADEALSAGASGLVALGTTAEAATLTAEERETVIRVCSAACRAHGAPLIVGVGTNDTATAITALRELAARGDVAAALVPAPPYIRPGEAGTLAHFAALAEHGGLPLVVYDIPYRTGQTLGAGTITALGRLPEVVGIKHATGSIDPTTMELLDSPLPGFAVLGGDDIVLSPLVAAGAHGGIVASANLRTADYAEMIALWRRGSAAPARALGADLARLSAALFTEPNPTVIKGVLHAQNRIPSPAVRMPLLAASADSVRRAAPLAASRK

SEQ ID NO: 57744 - protein, 377 aa, Oryza sativa
MSTQGKVIKCKAAVAWGAKQQLKIEEIEVDPPKAGEVRIKITATGVCHTDAYTLGGEDSEAVFPVILGHEGAGVVESVGEGVTSVAPGDHVIPLYTPQCKNCEYCRSPKTNLCVKIRATQGKGLMPDGTTRFSINGQRLYHYMGCSTFSEYTVVADISVAKINPAAPLDKIGLIGCGISTGYGAALVTAKVEKGSTVGVWGLGAVGLAVIMGAKAAGAKEIVGIDINPNKFKTAIEFGATQCVNPNDFPDKPFQQTLIEKFDGGFDYTFECIGNVNTMRCALEASHRGWGVSVIIGVAGAGKEIATRPFQLVTGRTWKGTAFGGWKSVDQVPELVEKYLTKELKVDEFITHTMPLAEINKAFDLMHSGESLRSMIQF

SEQ ID NO: 57745 - protein, 317 aa, Corynebacterium glutamicum
MTESGSTASPLCGVGSSVMTETQETYQATTRVKRGLADMLKGGVIMDVVTPEQARIAEDAGASAVMALERVPADIRSQGGVARMSDPDLIEGIVNAVSIPVMAKARIGHFVEAQVLEALGVDFIDESEVLSPADYTHHINKWKFDVPFVCGATNLGEALRRITEGAAMIRSKGEAGTGDVSEAVRHLRTIRGDINRLRSLDEDELFVAAKEFQAPYDLVREVASTGKLPVVTFVAGGVATPADAALVRQMGAEGVFVGSGIFKSGNPAARAAAIVKAATLFDDPSVIADVSRGLGEAMVGINVSDVPAPHRLAERGW

SEQ ID NO: 57746 - protein, 353 aa, uncultured bacterium
IGAANNLLAAMLDNHIQQGNALGIDIKKITWKRCVDMNDRQLRFVVDGLGGRANGTPREDGFDITVASEIMAVFCLATSMADLKERLSRIIVAYTYDDQPVTAGDLKATGAMAALLRDALKPNLVQTLEGTPAFVHGGPFANIAHGCNSVMATRMAMRMGDYTVTEAGFGADLGAEKFLDIKCRMAGLVPDAVVVVGTVRALKMHGGLDKKQLANEDLAALEKGIPNLLRHVHDITNVYHLPCVVAINRFPTDTDAETDFIVRKCRELGVNTILSTVWAEGGKGGEDLACEVVRLCEEEKGSFTFSYELDASIEEKLEAVTKKIYGGAGVALTPAARKQAERLTQLGFDKLPV

SEQ ID NO: 57747 - protein, 133 aa, Rubrobacter xylanophilus DSM 9941
MEQTLVLIKGDGVRRRLIGEIIRRLENKGLAIRDLKMMRVSRELAEEHYAEHREKPFFGELVEFITSAPVVAMRVEGEGAIGVVRNLMGATDPAKAAPGTIRGDLALSMPDNLVHGSDSPQSAARELRLFFGG

SEQ ID NO: 57748 - protein, 357 aa, uncultured bacterium
VTSAHNTISALLDNYLYQHRKDGFSLREIFWKRVLDVNDRALRNVVTGLRGDGVVSETGFDITPASELMAILCLATSEEDLQRRIENIVLGITADGKLFKVKDLGVAGAITVLLRDALSPNLVQTTEHTPAFVHGGPFANIAHGCSSVVATKMAMSYCDYVVTEAGFGADLGAEKFFDIKCRKTGLQPRLVVIVATTQGLKMHGGVDLEQINEPNKKGLTEGLKNLNRHIRNMQGFGQPVVVTLNRHDTDLEEEIDIVRKNCEDLDVGFAVNEAFLRGGEGATELAQTVIDTIERQQPLPIHFTYKEADCLEDKIEKVCKRIYGASAVEYSKTAKKKLEALRATFTEKTGPLPTIPV

SEQ ID NO: 57749 - protein, 448 aa, Thermoplasma acidophilum DSM 1728
MAAMPEDLVSKTLKRIEEDKVEFLQMQFTDIIGNVKSLTVPKNRFENALTEGVVFDGSSVAGYAQIEESDMRAIPNLESYTLLPDEFGKNKIARFVCSVYSPDGTRFPGDPRYVLERILDQVHKEGNEFFVGPEFEFFLFKRDEHGNPTTEPSDYGGYFDNTPLDSASDIRQQIMKELYDLGYQPEAAHHEVAYGQQEVDLRYAPALKMADRIVMLKSIIKNIAERNGLYASFMPKPINGVNGSGMHIHQSIMSADEKTNRFYDKNAKYGLSDYAMHYLGGILKYINEASAVLASTVNSYKRLIPGYEAPVYISWANKNRSALVRIPAGEGVRKRMELRCPDPAGNPYLQFAVVLGMGLEGIKNRIEPPEPVEKDIFHMTPEERQAEGIMSMPESLGEALHHLRSSKLMRNVLGDHVYENFITVKQREWDQFRSYVGEWEIKRYLPTL

SEQ ID NO: 57750 - protein, 132 aa, Glycine max
LTFTDDQDIQNTFIYKLCKQKTLDHFRHIILLSSPQDGYVPYHSARIELCQAASRDKSKKGRVFLEMLNDCLDQIRANPSEHRVFMRCDVNFDATSYGKNLNSFIGRAGAVEFLESDIFARFIMWSFPELFR

SEQ ID NO: 57751 - protein, 540 aa, Streptococcus mutans UA159
MYAHDILNDPFLNKGTAFTMEERKKFGLIGLLPPHIQTLKEQAEQTYAQMQTKANNLEKRLFLMEIFNTNRTLFYYLFSQHLEELNPIVYDPTIADTIEGYSDLFVDPQYAGYLDINHPENIEATLKNAAGDRDIRLIVVTDAEGILGIGDWGTNGVDISVGKLMVYTGAAGIDPVTVLPLVIDAGTNREELRNNPNYLGNRHERVRGERYYDFVDQFVQTAERLFPKLYLHWEDFGRSNAANILEKYRKEIPTFNDDIQGTGIVTLGGIFAAMDITGEKLTDQVYLCYGGGTAGAGIASRVLREMVSEGLPEDEAYKRFFMVDKQGLLFDDMDDLTPEQKPFAKKRADFPNADQLTDLLQVVKTVKPTILVGTSTNPGAFTKEVVEAMCENTERPVIFPISNPTKLAEASAQDLITWSDGKAFVATGIPADTVSYKGVDYVIGQANNALIYPGLGLGMLASEASLLTDEMIGAAAHSLSGIIDITKPGAPVLPPFKYVGDVSIKVAEAVAKKAQEQGLARAEETDMAKAVRDFKWYPEY

SEQ ID NO: 57752 - protein, 220 aa, Salmonella typhimurium LT2
MKDIDTLISNNALWSKMLVEEDPGFFEKLAQAQKPRFLWIGCSDSRVPAERLTGLEPGELFVHRNVANLVIHTDLNCLSVVQYAVDVLEVEHIIICGHSGCGGIKAAVENPELGLINNWLLHIRDIWLKHSSLLGKMPEEQRLDALYELNVMEQVYNLGHSTIMQSAWKRGQNVTIHGWAYSINDGLLRDLDVTATNRETLENGYHKGISALSLKYIPHQ

SEQ ID NO: 57753 - protein, 906 aa, Ustilago maydis 521
MSQALDDSTNLDLPIFQDDLLRDRQRVFSEFLSKDEYQDAVRRMLRMDARRLIINIDDLRSYNRDFATGLLNEPNEYLPAFDAALHVSVELAHNPLKDDIKGKQYYIGLRGSFGDHHVNPRTLRSIHLGKMMSLEGIVTRCSLVRPKILKSVHYCETTHKFHQREYRDATMYGTLPPSSTVYPTEDENGNRLTTEYGHSLFRDHQMISIQEMPERAPPGQLPRSIDVVMDDDMVDRCKPGDRIQLVGMYRSLGNRVGQSASSTFRTLMIGNNLNLLSSKVGGGIAQAHITDTDIRNINKIAKRKNVFNLLSQSLAPSIYGHEYIKKAVLLLLLGGEEKNLPNGTHIRGDINILMVGDPSTAKSQMLRFVLNTAPLAIATTGRGSSGVGLTAAVTTDKETGERRLEAGAMVLADRGVICIDEFDKMSDIDRVAIHEVMEQQTVTIAKAGIHTSLNARCSVVAAANPIYGQYDVHKDPHKNIALPDSLLSRFDLLFVVTDDVDEQRDRMISEHVLRMHRYLQPGLEEGTPAVDNLDQALDVGAPEGTDADGAAMLGDTSPFEKYNPLLHSGVTSASRGSDKKEVLSIAFIKKYIQYAKSRIHPVLTRGAAEWIVNVYSNLRNDELSGNQKRTSPLTARTLETLIRLATAHAKSRLSNRVEERDAEAAEEILRFALFKEVLGGRRGIHKRRRTGNSPMSDDDHDEDDVEDDDSGDDAARSDPRAAYRSGRPARGRRRGRGGQRYGEEEHSSDDDDMQIQNEVVSSQRSTRSNGAYATRAAAATLTRSKPAMVGPGGMDEEAVDDEDALEAMRSVDVEVMTPPLPVPAAPSATISAQRTEAFKDELSDLLFSSDGRLAEMDAIPLDELLPVMNEGRRTEDLFDTNEARQVLEMMHRENSIMFSEDVVFKL

SEQ ID NO: 57754 - protein, 338 aa, Prochlorococcus marinus subsp. marinus str. CCMP1375
MKNPNVICFGEALVDRLGPLGGDPASDKPVDDCLGGAPANVASGLARLGINAAFVGCLGNDSIGNQFRELFMARGVNFAGLQIHESLLSRIVLVYRDLNGERSFGGFAGDQSNIFADQYLDLNVHKKIFPSLLDEAKWLLLGTIPLAVEHSREVVQWTIEQSLNNGLQIAFDLNWRPTFWDINMTPNNPPDTKTCSLITSFLEHASLIKLAKEEAEWFFNSKDPWEISNALPEKPSVIVTDGAQPINWVLGGFSGQTPALSPQKVVDTTGAGDAFMAGLMTQIISFSSQPKLFSEAEAMIQFSAGCGALVCGAPGAIEPQPSYSEVQSLLSSFLNDRS

SEQ ID NO: 57755 - protein, 444 aa, Bacillus cereus ATCC 14579
MFKWLKPAPAIERLPADMIDHVYRLLRIRVLIGISVGYAAYYLVRSNFTLSSTYLVQEYGFSTAEIGLLGSVMAIVYGFSKFFMGNLSDKAFAQRFIAVGLFLSGLVNICFGFASSFGMIVTLLVVNGIVQGMGAPPCSIVMTKWFSKKERGTKTGLWNISHNVGGMLVPPLVGIGVGIFGENHWQGGVFIFPAIIAMVIAVLVWINAKDTPESEGLPPIDEYRNDYENLEKADNANKMSPKEILMKYVVKNKFVWFLCIANAFVYLIRFGVINWVPLYLTTVKGFSKAEAHAAYAIFEGMAIPSSLIVGFLSDKLFKGKRMPLCIISMVGVVIGTFIYWQATSVLVVSIAVSIIGCLIYVPQFLIGLSAMELVPKFAVGTTVGMCGLFGYVGGSLVANAAIGVIVDSSGWDGCFILLLTGAILSTVFLFIVQRGHERKDPKVA

SEQ ID NO: 57756 - protein, 394 aa, Arabidopsis thaliana
MTTRKRQIKNFTLNFGPQHPAAHGVLRLVLEMNGEVVERAEPHIGLLHRGTEKLIEYKTYLQALPYFDRSDYVSMMAQEHAYSLAVEKLLNCEVPLRAQYIRVLFCEITRILNHLLALTTHAMDVGALTPFLWAFEEREKLLEFYERVSGARMHASFIRPGGVAQDLPLGLCRDIDSFTQQFASRIDELEEMLTGNRIWKQRLVDIGTVTAQQAKDWGFSGVMLRGPGVCWDLRRAAPYDVYDQLDFDVPVGTRGDCYDRYCIRIEEMRQSLRIIVQCLNQMPSGMIKADDRKLCPPSRCRMKLSMESSIHHFELYTEGFSVPASSTYTAVEAPKGEFGVFLVSNGSNRPYRCKIRAPGFAHLQGLDFMSKHHMLADVVTIIGTQDIVFGEVDR

SEQ ID NO: 57757 - protein, 904 aa, Oryza sativa (japonica cultivar-group)
MPPKPERRLFQYVSKPRRPAREPAPAPEVCGGGGEEVVASDADADAVYRMVTAAPTPSAMESALSASGVAISAPLLDLVLRRFRFAHGDPLRALSLLSLALDRHGVAPSPFALDTALYVLGRARRFAHMWDLLRSSRRLVPDAVTPRTAMVVLGRVAKVCSVRETVDSFRRLSRMLRGRGDDQEGQLFNALLRTLCQEKSMSDARNVYHALKYEFKVNRQTFNILLSGWKSAEDAEAFVAEMRELGVEPDLVTYNSLIDCHCKNRGVENAYKLLDEMREKDISPDVITYTSLIGGLGLIGQPDKAKHLLKEMHELGCYPDVPAYNTAIRNFVIAKRLGDAFALMEEMASKGLMPNATTYNLFFRCYYWAYDIGSAWQLYERMRSEGCFPNTQSCMFIVRLCHRHGRVAQALELWSDMVNNGFGSFTLVSDVLFDLLCDEGKLDEAERCFHQMIELGQKPSNVAFRRIKILMQLANREESIARLTAQMAQFGREITEKESSVLRYVVQAEDEVGGQDGGRGGGCGGGGGGIPTAWRARPSPPLRPKPPPKVRVSRTQVKLRGSPDAGQASREPGAAGPSREPDVAGPSREPDAAGPSREPGAAGGSREPGAAGGSRQPVPDAAQLAVVPYVEDIDRYLRSLEAEQTRRPMINYVQEIQGGIINMDVRGILVDWMADVAYVFNLQEETLHHAVSYVDRFLSKIAFPGDKLKLLGTTALFVASKYEEIHPPHVRNFSAVTVNTYTTQQVSKMELDILRFLNFDVGSPTVITFLRKFLTSCCGGNNSSNRKLELMCNYLAELSLLDDYYIRFLPSIVAAACLFVGKFTLNPNTRPWFGSVSTITPPENIKGGVEKYMVSRIYMCVFDLPMLFLMETWSSSGVSNHTKLQLKQNMMELPIENPTFISAS

SEQ ID NO: 57758 - protein, 389 aa, Ustilago maydis 521
MLDFVFSAVKNWYLNSEPTQEREGLATLQPRAAQRTVQPPICHPKYSSRNRESRITKRFSTYLFPLSLSPNEHVHRHLTTFDPVNPIDHRLGGCSLIMSARSLVSSTLFRAVSARSATSSSFRVATAAPVGVRTFSHSVARSSARPTIQGDGKGDRVNSVSPFIELAGSNPVDKYTDIAGPLHDFGSYITSCLPRFIQQFSVVKDELTLYVAPDAVIPTLSFLRDHTQTQFRACMDISGADYPTRSQRFEVVYHLLSVQYNARIRVKTYADEVHPVPSATAVFRSADWYEREIWDMYGVFFIGHPDLRRILTDYGFEGHPLRKDFPLTGYTEVRYDEEKKRVVSEPLQLTQAFRNFEANSPWEQVGEGESYKPNAFKLTPPKPKEEPKK

SEQ ID NO: 57759 - protein, 167 aa, Crocosphaera watsonii WH 8501
MFSMPIVSKKNILGTLGCTLAIITGTLTLETTPRNVQAQTLAPNSPLTVRSDIQEANSETGVVTARGNVQFFYPARQIQGTSVQAQYFSRERRLVLTGDVYVLQEGNSMRAESMTYLIDEGRFIATPETTQQVESIYLVTENQNNPSQPAPVSPAPPLDTTLPTPDF

SEQ ID NO: 57760 - protein, 291 aa, Glycine max
MASVASSSSFSTRLLLHSHTPLVCRRRCRPNFLRMVTRSCLDDSSALLRAAQHTVDTYVKSGMVVGLGSGHASGMAIQHLGSQLRTGNLKDIVGIPMSVSSASEAAKAGIPLDTYQGSSQIDFAFDDADVIEEGTLVAIIGRRKLQGGESIIQEKSIINSANKCVFIIEENQYKGGLEGSIPVLIQSLNWMTIAEEIDDMFLGDAEVWRRPSIGQAGPLGGDFPVVTKEGHNILDVIFTSPIENLAEVAKSLDKVDGVVDHGVVSKIPCTVVIASQTGLNILDKLTADIVG

SEQ ID NO: 57761 - protein, 353 aa, uncultured bacterium
IGAANNLLAAMLDNHIQQGNALGIDVKKITWKRCVDMNDRQLRFVVDGLGGKANGTPREDGFDITVASEIMAVFCLASSMSDLKERLSRIIVAYTYDDQPVTAGDLKATGAMAALLRDALKPNLVQTLEGTPAFVHGGPFANIAHGCNSVMATRIAMRMGDYTVTEAGFGADLGAEKFLDIKCRMAGLTPDAVVVVGTVRALKMHGGLDKKQLANEDLAALEKGIPNLLRHVNDITNVYQLPCVVAINRFPTDTDAEIDFIVRKCRELGVNTILSTVWAEGGKGGEDLAREVVRLCEEGKGNFTFSYELDASIEEKLEALTKKIYGGAGVALTPVAKKQAEQLTRLGFDKLPV

SEQ ID NO: 57762 - protein, 828 aa, Erwinia carotovora subsp. atroseptica SCRI1043
MKLSRRHFMKANAVAAAAAVAGITIPIAVRAATEQSDAIHWDKAPCRFCGVGCGVLVGTQNGRIVASQGDPEAPVNRGLNCIKGYFLPKIMYGQDRLTQPLLRMRNGQFDKEGEFTPISWDKAFDIMAEKFKTALKEKGPNAIGMFGSGQSTIWEGYASAKLFKAGFRSNNIDPNARHCMASAVVGFMRTFGMDEPMGCYDDIEQTDAFVLWGSNMAEMHPILWSRITDRRLSNSNVTVAVLSTYQHRSFELADNGMVFTPQTDLAILNYIANYIIQNNAVNEAFFTRHVNLRRGVTDIGYGLRPTHPLEKAAKNPGSDASEPMSFEEYKAFVADYTLEKTVAISGVPADQLEALAKLYADPKKKVISYWTMGFNQHTRGVWANNLVYNIHLLTGKISQPGCGPFSLTGQPSACGTAREVGTFAHRLPADMVVTNEKHRAIAEKLWQLPTGTIPEKIGLHAVAQDRALKDGTLNAYWVMCNNNMQAGPNINQERMPGWRDPRNFIVVSDPYPTISALAADLILPTAMWVEKEGAYGNAERRTQFWRQQVKAPGESKSDLWQVVSFAKRFTVEDVWPEELLAQKPAYRGKTLYDVLFANDVTTRFPLSELAENQLNDESREFGFYLQKGLFEEYAAFGRGHGHDLAPFDAYHKVRGLRWPVVDGKETQWRYSEGHDPYVKAGEAYRFYGKPDGKAVIFALPYEPAAEAPDEEYDLWFSTGRVLEHWHTGSMTRRVPELHRAFPEAVLFIHPQDAKARDLRRGEKVRIISRRGEVISVVETRGRNKPPRGLVYMPFFDAAQMTNVLTLDATDPLSKETDFKKCAVKLAKV

SEQ ID NO: 57763 - protein, 352 aa, uncultured bacterium
ITSAHMLLSAMLDNSIQQGNPLNIDPRRVIWKRVVDMNDRALRNIVIGLGGKAHGVPREDGFDITVASEVMAILCLASNLHDLKERLKRIVVAYNYDGKPVTAEDLHAAGAMAALLKDAVKPNLVQTLEHVPAIIHGGPFANIAHGCNSVMATRTGLRLADFTITEAGFGADLGAEKFFDIKCRQAGLAPDACVLVATVRALKMHGGVAKADLKEPNVEAVKKGLPNLGKHIENIFKFGVPVVVAINIFAQDTREELQAVYDYCAGMGVNVALSDVFAKGGEGGVELAKEVVALAESGMARFKPIYPLEMSLKEKVATVVKEVYGGDRVEFQTKAAQALDQYEKEGYGNLPV

SEQ ID NO: 57764 - protein, 132 aa, Magnetospirillum magnetotacticum MS-1
MSAIDAAAVLAKLKFNADGLVPAIAQQHDTGEVLMMAWMNKESVAETLETGRVCYFSRSRGGLWRKGESSGQQQRLKDFLIDCDGDTILLKVDQDGVACHTGRRTCFYTAARPEGLTEVAKVLVSPEELYKK

SEQ ID NO: 57765 - protein, 352 aa, uncultured bacterium
ITSANNLLAALIDNHIQQGNVLNIDTRNIIFKRCLDMNDRSLRNIVIGLGKKADGFVREDHFVITVATEIMAILCLAEDMADLKRRLSEIVVAYNLKGEPVTAGDLQAVGAMAALLKDAIKPNLVQTLEHVPAFVHGGPFANIAHGCNSVRATKFALKAADYVITEAGFGADLGAEKFFDIKCRKSGLKPDACVIVATIRALKYSGGADLKELGNEDLDALRLGISNLEKHIENIKKYGLNPIVTLNSFASDTEAETGFVKKFCEDGGCYFALSRVFTDGGEGGKELATEVLSAIERGDASFKVLYDDNLSLKEKVETVSKEIYGADSVSFAPEVLKTFDKLTDLGFGNLPV

SEQ ID NO: 57766 - protein, 430 aa, Oceanospirillum sp. MED92
MAQIANIKAREVLDSRGNPTVEADVILESGVIGSACAPSGASTGSREALELRDGDKSRYLGKGVQNAVAAVNGEIREALTGMDVTDQRALDNKMLELDGTENKEKLGANAILAVSLAAAKAAATEKGVPLYAHIAEINGTAGQFSLPLPMMNILNGGEHADNNVDIQEFMVQPVNFDKFSEGLRCGAEIFHALKAVLKAKGLNTAVGDEGGFAPNLASNEEALVVIKEAIEKAGYELGKDVTLALDCAASEFYKEGKYDLSGEGKVFDAEGFGDYLAALTENYPIVSIEDGLDESDWDGWAYLTKKIGDKVQLVGDDLFVTNTKILSRGIEQSIGNSILIKFNQIGSLSETLDAIKMAKDAGFTAVISHRSGETEDTTIADLAVGTAAGQIKTGSLCRSDRVAKYNRLLRIEEELGAAAIYNGLSEIKGQ

SEQ ID NO: 57767 - protein, 352 aa, uncultured bacterium
ITSANNLLAALIDNHIQQGNVLNIDTRNIIFKRCLDMNDRSLRNIVIGLGKKADGFVREDHFVITVATEIMAILCLAEDMADLKRRLSEIVVAYNLKGEPVTAGDLQAVGAMAALLKDAIKPNLVQTLEHVPAFVHGGPFANIAHGCNSVRATKFALKAADYVITEAGFGADLGAEKFFDIKCRKSGLKPDACVIVATIRALKYNGGADLKELGNEDLDALRLGISNLEKHIENIKKYGLNPIVTLNSFASDTEAETGFVKKFCEDGGCYFALSRVFTDGGEGGKELATEVLSAIERGDASFKVLYDDNLSLKEKVETVSKEIYGADSVSFAPEVLKTFDKLTDLGFGNLPV

SEQ ID NO: 57768 - protein, 372 aa, Candida albicans
MKKFTGPTQTRQVVFNISQNFKVLKILGEGAYGIVALAVHLPTETKVAIKKIEPFERPLFCLRTLREIKLLTKFKNHDNIVRLYDVQKPMNYDSFNEVYLIQGYMPSDLHNLIHTHLLSDQHVQYFIYQILKGLKMIHSARVIHRDLKPSNILVNEKCDLKICDFGLARLDTKHYNFDEAPRISMLTEYVATRWYRAPEIMLSASNYSTAIDLWSVGCILAELLTYRALFPGSDYINQLKLIFEVLGTPTDEDLQIIKSERAQKFIRSLPTKVKIDLSEFINNHPYRNIKHRGRDQVNPLAIDLLEKLLVFDPAKRITVQDALEHPYLNSYHEQLDEPVTSPIPIEEFDFDIDKKNLDTNDLKKQIFEIVMS

SEQ ID NO: 57769 - protein, 572 aa, Rhodobacter sphaeroides 2.4.1
MARILITSAIPYINGIKHLGNLVGSQLPADLYARYMRGRGHEVMFICATDEHGTPAELAAAKAGKPVEDYCAEMHEVQKEIAAGFRLSFDHFGRSSSARNHRLTQHFAGALAENGFIEEVVERQFFSVADNRFLPDRYIEGTCPNCGYDKARGDQCENCTKQLDPTDLIDPRSAISGSTELELRETKHLYLRQRALKDEIEAWIDSKTDWPVLTTSIAKKWLHDGEGLQDRGITRDLKWGVPVRKGSEPWPGMEGKVFYVWFDAPIEYIAGTAEWADANGKADADWERWWRTDRGAEDVRYVQFMGKDNVPFHTLSFPATIMGSREPWKLVDYIKSFNYLNYDGGQFSTSQGRGVFMDQALSILPADYWRWWLLSHAPENSDSEFTWENFQSSVNKDLADVLGNLVSRVTKFCRSKFGETVPAGGSPGEREHQLVAELQQRLAAYEACMEAMEVRKAASELRALWVAGNEYLQSAAPWTVVKTDPEQAQAMIRLALNLIRLYAVISRPFIPDAAASMMASLGCEDWSWPADVGRALEVLPAGHGFTTPEVLFRKITDEERAEWQTRFSGVRS

SEQ ID NO: 57770 - protein, 388 aa, Oryza sativa (japonica cultivar-group)
MEGKPPVTPMQQQQQHAPPPRVSRFRRLLVRVSASERLAGDGKERGEKEAEKVSASAAGGEVEAGSVGLDRMVLSFMEDSAAVERPQRGRCNCFNGSNYEESDDEEGFFLPSDHSSASAPAAAGDALESLKGLVQSASVAERNLLADASRIAERCCKGSKGKAECRRAVADGLRALGYDAAVCRSRWEKTSSYPAGEHEYIDAVVGEEVRLIVEVDFRSEFEVARSTKAYRAALQALPPLFVGTPDRLGQIVAVVAEAARQSLKKKGLHFPPWRKPEYMRAKWLSPHVRSGDKAAAAAKTVTSTTSATATPVSAASFSGAFELLFDRKQSGEIPAAEKITVVVSPSPWRPTEEASKKKPPPSPSPPQLWQQHQQPPKAKVVTGLAAVL

SEQ ID NO: 57771 - protein, 574 aa, Vibrio vulnificus YJ016
MISGILASPGIAIGKALLLQEDEIVLNTNTITEAQVEAEVQRFYDARSKSSAQLETIKQKALETFGEEKEAIFEGHIMLLEDEELEEEILALIKKEKMTADNAIYTVIEEQATALESLDDEYLKERATDIRDIGSRFVKNALGINIVSLSDINEQVILVAYDLTPSETAQINLDYVLGFACDIGGRTSHTSIMARSLELPAIVGTNDITKKVKNGDMLILDAMNNKIIVNPSEAQIEEAKAVKASFLAEKEELAKLKDLHAETLDGHRVEVCGNIGTVKDCDGIIRNGGEGVGLYRTEFLFMDRDALPTEEEQYQAYKEVAEAMEGQAVIIRTMDIGGDKDLPYMDLPKEMNPFLGWRAVRISLDRREILRDQLRGILRASAHGKLRIMFPMIISVEEIRALKEAIEEYKAELRAEGLAFDENIEIGVMVETPAAAAVAHHLAKEVSFFSIGTNDLTQYTLAVDRGNEMISHLYNPLSPAVLTVIKQVIDASHAEGKWTGMCGELAGDERATLLLLGMGLDEFSMSGISIPKVKKVIRNANFAAVKAMAEEALSLPTAAEIEACVEKFIAEHSK

SEQ ID NO: 57772 - protein, 466 aa, Helicobacter pylori 26695
MLSVYEKVNALDKRAIEELFLSEDILMENAAMALERAVLQNASLGAKVIILCGSGDNGGDGYALARRLVGRFKTLVFEMKLAKSPMCQLQQERAKKAGVVIKAYEENALNQNLECDVLIDCVIGSHFKGKLEPFLNFESLSQKARFKIACDIPSGIDSKGRVDKGAFKADLTISMGAIKSCLLSDRAKDYVGELKVGHLGVFNQIYEIPTDTFLLEKSDLKLPLRDRKNAHKGDYGHAHVLLGKHSGAGLLSALSALSFGSGVVSVQALECEITSNNKPLELVFCENFPNLLSAFALGMGLENIPKDFNKWLELAPCVLDAGVFYHKEVLQALEKEVILTPHPKEFLSLLKLVGINISMLELLDNKLEIARDFSQKYPKVVLLLKGANTLIAHQGQVFINILGSVALAKAGSGDVLAGLILSLLSQNYTPLDAAINASSAHALASLEFKNNYALTPLDLIEKIKQL

SEQ ID NO: 57773 - protein, 226 aa, Glycine max
  misc_feature (74)..(74): Xaa can be any naturally occurring amino acid
  misc_feature (109)..(109): Xaa can be any naturally occurring amino acid
  misc_feature (216)..(216): Xaa can be any naturally occurring amino acid
  unsure (1)..(226): unsure at all Xaa locations
WWFKVVVVIRSRKKRDFKGLRSRDQARAKWTSQITSSQEATIPLRYRVDNEQKRVVMAEASGDFVDVLFSFLTXPLGTIIRLGNQFNQPVQIGSINNLYESVQNLSPDXFLEMLLSPRNPLEASYQRLKVKVDDTEPTKYFICHSCSKGSDLLLSSFDGARCSCRKLMQKKMELLEESKDEASVVDGIFVKGDAMFLIFDDLTVLRSSPSDSVQRXLQLGHKNFSS

SEQ ID NO: 57774 - protein, 243 aa, Glycine max
  misc_feature (171)..(171): Xaa can be any naturally occurring amino acid
  misc_feature (191)..(191): Xaa can be any naturally occurring amino acid
  unsure (1)..(243): unsure at all Xaa locations
MSAAVSSTTSHLEEELKNNNNNNNNVGGESDQPPYNEGANSDVAEETEPEEDDDSKLESNKELDLGPQFTLKEQLEKDKDDVSLRKWKEQLLGSVDMSVVGSESKDPEVKILSLIITSPDKPDLTLPIPFTTDAKKSLFILKEGSKCQMKFTFTVSNNIVSGLKYTNVVWXTGVRVDSRKKMLGTFSPKQXPYTFELEEETIPSGMFVRGTYAARTKFVDDDRKCYLDVSYYFEIQKNRPTPQ

SEQ ID NO: 57775 - protein, 390 aa, Oryza sativa (japonica cultivar-group)
MEQMNTAAAKSIRCRAAVSRVAGQPLEMEEVEVAPPRAHEVRIKILCTSICHTDITFWRMEGNHPSIFGHEAVGVVESVGEHVQEVAVGDMVVPVFAAQCSECPDCLSDRSNLCSKLPNVAGLMPRDRTTRFSSVSTGEPIRHFLSVSSFAEYTVVDITHIVKLDVGFPPAMACLLSCGISTGVGAAWKVAAVEPGSSVAVFGLGAVGLAVAQGARMRGAKRIIGVDLNPDKFDVGKRLGMTDFINPNDTGGKTVSEVIKEMTGGGGADYCFECIGSTSVMAEAFQSTRNGWGKTILLGVSGNKAPISIPSHEILRGRSVIGSLFGGIKPKNDIPMLAQKYLDKELELEEFITHEMGFEEINRAFELLTQGKSIRCIIWMDGAKVIDNGE

SEQ ID NO: 57776 - protein, 245 aa, Oryza sativa (japonica cultivar-group)
MDFKVASFLLLLLIVTCGAAQGQGNDFVVLDLKTTEIGEDASPMYKEQIASTKIPVTLLRSKHSSLCSACENITSEAVNFLSEKQIQDKIRTILHDTCSQTFSFEQKCLETMDSYATLVFAKIAEIKPAAFCKQYGLCRDMALLSAVKSESTCLFCHHIIDEITSKLKDPDAEFEIIQLLLKECNKIEGHQQQCKRMVLQYVPLVLVNGEKFLEKNDVCAMIQACDAGKRKALNLFSARKLVRDA

SEQ ID NO: 57777 - protein, 545 aa, Candida albicans SC5314
MSSKIERIFSGPALKINAYLDKLPKIYNVFFIASISTIAGMMFGFDISSMSAFIGSGPYMKFFHSPGSDIQGFITASMALGSFFGSIASSFVSEPFGRRLSLLICAFFWMVGAAIQSSSQNRAQLIIGRIISGVGVGFGSAVAPIYGAELAPRKIRGFIGGMFQFFVTLGILIMFYISFGLGHINGVASFRIAWGLQIVPGLCLFLGCFFIPESPRWLAKQGQWEAAEEIVAKVQAHGDRENPDVLIEISEIKDQLLLEQSSKHIGYATLFTKKYIYRTFTAIFAQIWQQLTGMNVMMYYIVYIFQMAGYSGNSNLVASSIQYVINTCVTAPALYFIDKIGRRPLLIGGATMMMAFQFGLAGILGNYSVPWPDSGNDSVNIRIPLDNKSASKGAIACCYLFVASFAFTWGVGIWVYCAEIWGDNRVAQRGNAISTSANWILNFAIAMYTPSGFKNISWKTYIIYGVFCLAMGTHVYFGFPETKGKRLEEIGQMWEENVPAWRSRSWQPTIPIASDAELARKMEVEHQEDKLMNDDSNSESKENQV

SEQ ID NO: 57778 - protein, 374 aa, Leptospira interrogans serovar Lai str. 56601
MSFHFQTFYGIFSLEFTDPQKNSVGIIFLEESMSVHPTQTLSLSQYLIEEQLKLPQATGDFTALMSHLVYAAKIVSREVRKAGLLENILGATETVNVQGETQMKLDEYADKVFNHTLTRSGHLCILGSEEHEETVPVPNGYKIGKYTIAIDPLDGSSNIDANVSIGTIFSVHLRKSPAGTPGTLSDLLQQGSGQRAAGYVLYGSSTMLILCTGKGVSGFTLDPSCGEFILSHPDMQIPETGGIYSINEGNYNYWSDEVKNYIRDIKSIEGGRKPQSGRYIGSLVADFHRNLLKGGIFLYPNDTKSTKYPNGKLRLLYEAAPMAFIAEQAGGMAVTVYGERILDLTPKELHERTTLVVGSKKEVEHFLKFAPKKS

SEQ ID NO: 57779 - protein, 386 aa, Escherichia coli K12
MTRKQATIAVRSGLNDDEQYGCVVPPIHLSSTYNFTGFNEPRAHDYSRRGNPTRDVVQRALAELEGGAGAVLTNTGMSAIHLVTTVFLKPGDLLVAPHDCYGGSYRLFDSLAKRGCYRVLFVDQGDEQALRAALAEKPKLVLVESPSNPLLRVVDIAKICHLAREVGAVSVVDNTFLSPALQNPLALGADLVLHSCTKYLNGHSDVVAGVVIAKDPDVVTELAWWANNIGVTGGAFDSYLLLRGLRTLVPRMELAQRNAQAIVKYLQTQPLVKKLYHPSLPENQGHEIAARQQKGFGAMLSFELDGDEQTLRRFLGGLSLFTLAESLGGVESLISHAATMTHAGMAPEARAAAGISETLLRISTGIEDGEDLIADLENGFRAANKG

SEQ ID NO: 57780 - protein, 333 aa, Staphylococcus aureus subsp. aureus Mu50
MQNKQILFNKIPEGMPQEDTFKIEEIDTPKLESDGVLVQTLYISVDPYMRGRMTKADSYVQPFEIGKPIVSHVVAKVIDSTLADYKKGDVVVGMLPWRIINHVQADQITKVPTTDVPLDLYLSVLGMPGQTAYHGLLDIGQPKAGDTVVVSAASGAVGSVVGQIAKIKGCRVVGIAGGDKKVNYLTETLGFDAGIDYKKEDFAEALAQAVPDGIDVYFENVGGTVGDEVFKHLNRFARVPVCGAISSYNHPEADIGPRIQGTLIKKQVMMRGFLVSEFANAFKEASEQLATWVQEGKIQSQVTIEDGFENAPHAFKNLFTGDNFGKQVIKVTE

SEQ ID NO: 57781 - protein, 470 aa, Staphylococcus aureus subsp. aureus Mu50
MTKTLPEDFIFGGATAAYQAEGATNTDGKGRVAWDTYLEENYWYTAEPASDFYNRYPVDLELSEKFGVNGIRISIAWSRIFPNGYGEVNPKGVEYYHKLFAECHKRHVEPFVTLHHFDTPEVLHKDGDFLNRKTIDYFVDYAEYCFKEFPEVKYWTTFNEIGPIGDGQYLVGKFPPGIKYDFEKVFQSHHNMMVAHARAVKLFKDGGYQGEIGVVHALPTKYPFDPSNPEDVRAAELEDIIHNKFILDATYLGKYSRETMEGVQHILSVNGGKLNITDEDYAILDAAKDLNDFLGINYYMSDWMRGYDGESEITHNATGDKGGSKYQLKGVGQREFDVDVPRTDWDWMIYPQGLYDQIMRVVKDYPNYHKIYITENGLGYKDEFIESEKTVHDDARIDYVRQHLNVIADAIKDGANVKGYFIWSLMDVFSWSNGYEKRYGLFYVDFETQERYPKKSAYWYKELAETKEIK

SEQ ID NO: 57782 - protein, 183 aa, Glycine max
  misc_feature (155)..(155): Xaa can be any naturally occurring amino acid
  unsure (1)..(183): unsure at all Xaa locations
MGASGRWFKSLLPFRKTSTDQEKGGDNKSKKKRKLWRASSEGSMKNVGGGGAAAASDSSLTYAVAVMVPKDFKLIKQEWAAIRIQAVFRAFLARRALRALRAVVRLQAIFRGRLVRKQAAVTLRCMQALVRVQARVRARNVRNSPEGKAVQKLLXDEHHNHADPFNLIEQGWCDIPGTVDEVK

SEQ ID NO: 57783 - protein, 661 aa, Magnetospirillum magnetotacticum MS-1
MWIGGRRGKLSAWLPLLVASLITICSGLVLFKVYALQAERRHEAARAELLSRLSVLRAHLEYNLTAPLLISRGLVAQIILHDGLTDAEFARAASLVIKDYDSVRNLTMSRGTVISAVYPEAPNRAVLGVDYHSKPDQWPSVERAISSRKPVVAGPVNLIQGGTALIGRVPVYMPDHGGGESRFFGLISVVIDLPKVFSASGLDAGMMSMELAVRGHDGLGRLGDMIRGDESIFGRSPVEMEVSLPDGTWIMAAIPKGGWAADDGQLRVTGGMGAVLFLLTVLASFGWAFYARRQQRASRLVAESEQRYRALMETVPVAVVVHREGIILFANTQAARTVRMAAGETLVGRKVMDFVLPEDRQSVAERVATVLAKPDQEAGGPVRYVTCDGQVIETEVVSIRVGLEDQPAVLSVVLDVSLRKKAERERESLLDSLRRSNEDLQQFAYIASHDLQEPLRNVSGYVQLLGRRYRGRLDKDADDFISFAVEGTKRMQEMIANLLDYSRLQHDDGVTERVDSRLPLDEALADLGAAIDESGAVVEVVGHMPVVFARRVELARIFLNLIGNAIKYRRSDTVTLIRISARREGTNWVICVADNGIGMEPAYLDRIFTLFQRLHSRDTYDGTGIGLAICRKLVQHNGGRIWAESELGRGSTFNFSLQAAD

SEQ ID NO: 57784 - protein, 415 aa, Magnetospirillum magnetotacticum MS-1
MPALSPTMTEGNLAKWLKNEGDAVKSGDILCEIETDKATMEFEAVDEGVLGKILVAGGTSGVAVNTPIAVLLEEGEDASAISAAPAPKAVAAPASVAAAPIAAAPAAAPAAAHGGDRVVASPLAKRIAKDGNVDLKAVKGSGPHGRIVKADVEAAIKAGPAKPAAATPAAAAAAPKPAPAPASASPFEPAFEEIPNSSMRKVIARRLTEAKSTIPHFYLSIDCELDSLLKVRADLNGRSDAYKLSVNDFVVRAVALALKKVPAANASWGEDAIKRYKDVDISVAVATPSGLITPIVHHADHKGLAEISNEMKALAGKARDNKLKPEEFQGGGFTISNLGMFGIKDFAAIINPPQGCILAVGAGEQRPVVKAGALAVATVMTCTLSVDHRVVDGAVGAEFLAAFKKLIEDPLSMLL

SEQ ID NO: 57785 - protein, 1420 aa, Cryptococcus neoformans var. neoformans B-3501A
MSSPYSEDPGAATVVQSPASSSHTFEGELTNAYQQAKHDKTEDVPISYPKIFDQPGSIPLPNAGYHSLGVVWEDVTVHGAGGGKKYVESLDISVFKFFDFYSFMKKIFQITTGPTRPLIRNFSGVVEEGEVLLVLGRPGAGCSTLMRALANVNEPFVKIEGDISYSTIPAHEAKKFYDGEIIFNSEEDEHQPLLTVEETIKAALYLKEPRKKGDKEKRPEYVESLFSRILDTFGMPHTRKTKVGNQFVRGVSGGERKRVSLAEILTTNAAVTCWDNPIRGLDSAVALHFYKVLRELSKSLGMVNIISTYQTAQDAWQCVDRVVVIYEGRQIFSGRANQAQAYFEYMGWYKKPRQTTPDFLTAVTSPNERQVREGFEGKVPQTPDEFERYFLDSQEYKELQQDIQNYKQRHAEANHSDEFRHAVKSSKHPGAGKATAYRVNFAQQVAILCKRQLQLTRSDMTSFVYRIGSNVLQAVLVGAVCYKPPNNSAGSFAIAGALFFCILYYTIFALGEVPATVNSRPLLKKHRALGFYHPAAHTLAQIVCDIPVYVFQTLLFSAIFYFMVGLSVGAKYFFTFWFVIFTMYETISVMYRMIGSWTPNLSVAIRYGCLALSVVLSASGFVLPPPRQLRWISWLRRATPCAWAFEALIANEFRARVLSCDVSDLIPYGEGYDDIAYQVCSIQGAQPGATTVPGMDYIAFVYGYQTSHIWRNVGILWAFFVGYVIMIVIGSSLLIRESPDSSQKVYKRGGKAAIMDPKEKAEEGKTAMEKVQGPKGSGGEVPVYTFEDVYYTVQVAGKDKPLLNGISGYVKGGSLTALMGASGAGKTTLLDTISLRKTTGKVEGKMTIDGKPLDASFSRQTGFAMQADIHEPMSTVRECLQFSALLRQSNDRTREERLEFAENIIKLLELEDIADALIGAPGEDGLGVEERKRVTIGVELAADPEFLLFLDEPTSGLDSQASYEIVRFLKRIAASGLAVLCTIHQPSGDLFEMFDSVVLLAPGGHTVYVGETGENAETVVKYFGDRGAYCPPEANPAEFILGTVAPVGGTTIDWPGLWKESAEAAEVQRKINEFTSRNNLAVDPEKAITETQQKSGSDAYASSFMTQSKELIIRNFRAQWRDGSFWTTQLAILIFFGLFVGFYWFKIDHSPNNMSAASLGILVAIQGLPGIAMDIGINYLAKLDMFLARERLGIYSWQALVTSLLIVSIPVLFVGWNILFFCFYWTIDLIGTRADGVLIWLCFLSCAILNGSFGVLLGAVSPNRLSLPYILSLVWNLLNCLSWALVFYSGLPSPFHYFFSWLSPLRYLYGAMMTASLGDLTLNCIEEDLVTFYPPPGQTCYDYAANYLATTSGYLVDGNSTTSCQYCTSSTGYDYIQEMGYSLGTKWRDWAITIIWCLSNIFFCYLFTWLVKIRPLYKKS

SEQ ID NO: 57786 - protein, 669 aa, Thermoplasma acidophilum DSM 1728
MTLTVCPYCGTGCQIEVDYSGDHYTVHGYTRSAVNEGKLCIKGYQGLSYASSHDRITSPMLRSGDTWVKVSWDEAIDYVVKRLKEIRDRYGPDAIAFQASAKCTNEENYLLQKIARMIGTNNVDHCARSCHSSTVAGLIRTLGTAAATGSIKSLKSTQTFFVIGSNTTEQHPIIGTTIIKQKKAGKKLIVADPRRTKLASIADVFLQFKPGSDVALLNSMMFVILKRGLIDSEFIKSRTEGFEAFAEEIEKYPPELTEQITGVPPDLVEKAAEIYASNRPSAILYGMGITQHIHGTENVMSVSNLALMTGNLGRYGSGIFPLRGQNNVQGSSDMGALSEFYPGYVPPDSPGVEKFERIWEAKLPRKVGLMLSEMFDAAIDGRVKAIYLMGENPVITEANLSDVERGLKNLELFVVQDIFMTDTARYAHVILPATSALEKEGTFTNTERRIQRVVPVKDPPGDARPDWWILSQIYSKIFDREAYRSPEDIFNEIRLAIPNYSGVRYSDLYPDGKQWPINDQHPEGAEILHVDKFARGLGRFMAIPYKSPSESPDEEYPFILTTGRNYYHWHSGTMTRRSEILERESPNPYVEISVNDAKKLSIRNGQTITIESRHGSIKLPAMVTSKIPDGIVFVPFHFKEARVNLLVGENLDPYSKIPEFKVVAVKVKA

SEQ ID NO: 57787 - protein, 586 aa, Triticum aestivum
  misc_feature (239)..(239): Xaa can be any naturally occurring amino acid
  misc_feature (371)..(371): Xaa can be any naturally occurring amino acid
  unsure (1)..(586): unsure at all Xaa locations
MERILKAARESGSLNLSNRSLSEVPGEVYNNLETGSLDDKWWEGVDLQKLILAHNNLEVLREDLMNLSSLVVLNISHNQLSSVPAAIGDLPLLKSLDVSFNQIKLIPEEVGLATALVKVDFSNNCLTELPASLGRFMNLSELKASNNNISRLPDELSGCCKLNKFDLEGNKLVLLQENMFTSWTLLIELNAAKNQLTTIPASIGALSKLVRMDLHQNKITSIPSSIKGCSSLAEFYMGXNLLSTIPDDIGMLSKLGTLDLHSNQLKEYPVGACKLKLSFLDLSNNALSGLPPELGTMTTLRKLLLSGNPMRALRSSLVSGPTSTLMKYLRSRLSSEEEASGSRTTPTKDDQISAARRLSVSSKELNLSGLXVPNVPPAAWETSDVVKLDLSKNLIEDLPNELSLCSSLQALILSNNKIKKWPGMVVSSLPSLTSLKLDNNPLAEISPTDLESLSKLEVLDLSGNASSLSEPSVVSSLPQLQELYLRRMKLQEFPIGLVQLKHLRILNLSQNNLSTIPEGIKDFTALIELDLSDNNITRLPAELGLLEPSLQVLKLDGNPLRSIRRTVLERGTKAVLSYLKEKLPSN

SEQ ID NO: 57788 - protein, 183 aa, Brassica napus
GPISRRPTRPCHIGALGTALLCYVTPKEHLGLPNRDDVKAGVIAYKIAAHAADLAKQHPHAQAWDDALSKARFEFRWMDQFALSLDPMTAMSFHDETLPADGAKVAHFCSMCGPKFCSMKITEDIRKYAEENGYGTAEEALRKGMEAMSQEFNVAKKTISGEQHGEVGGEIYLPESYVKANQK

SEQ ID NO: 57789 - protein, 304 aa, Cytophaga hutchinsonii ATCC 33406
MNYQAILNQIQGDIQPYLGQGKVADYIPALAGINPSKFGMSIHTIDGITATIGDAQEQFSIQSISKILTLTMAVSLDDTNIWKRVGREPSGSKFNSLIQLELEQGIPRNPFINAGAHVITDLVYSHFDDPKEAILAFTRMVSMNDSISYDYVVAQSERETGNRNLAMGYFMKSFGNIENKVRDVLDVYFHQCSLAMSCTDLSKAFLYLANEGVLPTSEKTIITKKNSDRINALMLTCGMYDSVGDFAYRVGLPSKSGVGGGIVSIVPGEMVIAVWSPGLSESGNSLAGTKALELFVNYTGKTIF

SEQ ID NO: 57790 - protein, 628 aa, Rickettsiella grylli
MCGIVGILSNLDKSFHISNLLNSMSGTLTHRGPDGSGVYLDDNIAMAHRRLSIIDLSSNANQPFSSYDKSLVLIFNGEIYNYSKIKNLVYNYPFKSTSDGEIILPLYQKFGPDFIKHLEGMFAFALYDKKQKLLFLVRDRVGEKPLYYTWYKNCLFFSSELKSFWEITDFRPPLSKIAILNYLAYTQSPAPYSMYENIYKVIPGHYLIIDCKNKVTQKNYWNIDFTNKTKITAYEATEQLDTLLRDTMKKTLVSDVSIGITLSGGIDSSVLLGHMSGIYSEAINSFTLGSNHQPNSIDPELDRAKIVAKLYQTHEHFCDFKDISFKDFLKANSYYDEPVGILDTVHSMFLSQYISQYHKVVITGNGADEVFGGYKSYSNFLRKNFLKQCLIQASRKYAIKNIQSFFTKTVLKTISNYSLKFLTNDMILFSNNPYLIEYLDVYYKMSNFDNLLDGKLFFELLVTLNHCASMSDTLGMTHSLEIRSPFLNHHIVEFAASLPVYYKVKFFSPSNRNKYILKRLALKYMPKELIFIKKYGCGSFINYHGKFKTSWRADIEQILFHSAAGIYEFFSKEKTRCLWIKFLSGVLSPNEKMLLNKLIILFAWYNSVFLKRKSSFQLASNQIQPNLH

SEQ ID NO: 57791 - protein, 676 aa, Arabidopsis thaliana
MVPPELEFNKYLGKGSYGSVSLFKYSKPRTTLYTAVMTCNYKNAESLEKEFGILSEFKGCSRIVQCYENRVIENLDVEGNKEYMMLMEYAAGGSLRTFMKRSEDKKLPDPLIREFTRMILEGLATIHGQGYVHCDLKPDNILVFPRCVYKKRAWRSSYELKISDFGLSKRDGDSKWWHPHRPFVGTAIYMSPGSVSHGETGRGLDLWSLGCVVLEMYTGKKPWWHNNYDLKDLKNWYAPMIPSDLPCDAKHFIMACFALNTNERRDALTLLEHSFLRGVVNKITKPHVKNENPKEIALALGRVVRRPSKVLTSIFKRAGELMKIIKKQPRAPRSNLLPVLLKACCQIYQKNSIVVLFAMVALDLEFERYPGERSFGSVSLFKYKRQRDGETQYAAVKTSSDENAKSLYKEFQILSQFKGCSRIVQCYGNGVKEIFNDKGYVEYKIAMEYAFGGSLSDFMDRFKDRKLSDSMIREFTRMLLEGLATIHRHGYVHCDLKPENILVFPSSVYKNGAWIRSYELKISDFGMSKRDGDTQWWQPRKPYVGTPIYMSPESISHGEIGKGLDLWSLGCVVLEMYTRKKPWWHTNYELEELMKCYEPLFPRNLPCDAKLFLMTCFASEPDERKDALTLLRQSFLHGDVNKFTNRQMNVKIDSADDFTLQLEKVSQMLSEIRTMC

SEQ ID NO: 57792 - protein, 243 aa, Staphylococcus aureus subsp. aureus Mu50
MRNDLETLKHIIDSSNRITFFTGAGVSVASGVPDFRSMGGLFDEISKDGLSPEYLLSRDYLEDDPEGFINFCHKRLLFVDTKPNIVHDWIAKLERNQQSLGVITQNIDGLHSDAGSQHVDELHGTLNRFYCNACHKSYTKSDVIDRTLKHCDNCGGAIRPDIVLYGEMLDQPTIIRALNKIEHADTLVVLGSSLVVQPAAGLISHFKGDNLIIINKDRTPYDSDATLVIHDDMVSVVKSLMTE

SEQ ID NO: 57793 - protein, 394 aa, Oryza sativa (japonica cultivar-group)
MASGTDEKAKMEGLTSAAAFVEGGIQDACDDACSICLEAFCESDPSTLTGCKHEFHLQCILEWCQRSSQCPMCWQPISLKDPTSQELLEAVERERNVRTNQTRNTTIFHHPALGDFEVQHLPVVGNDAELEERILQHLAAAAAMGRSHHLGRREGHRGRSGSHGRPQFLVFSSHPNMPSAGSVSSSSVQGEVDNESSPVHTTGELSLHANTHEEAGNQSPGMLTYDADQDAVVSSGNSTPVSSPRFFNRRHSTGQSTPVNNDRAGPSDLQSFSDSLKSRLNAVSMKYKESITKSTRGWKERLFSRNSSVADLGSEVRREVNAGIASVSRMMERLETRGSNGRTSDGPAISTSEVIPSTESSNERVTENNPTTAATSTSNTSASSAPCVTTTGSN

SEQ ID NO: 57794 - protein, 245 aa, Antirrhinum majus
WVLVQFGAFIVLCGATHFISLWTFQLHTRTVAVVMTTAKICTAVVSCATALMLVHIIPDLLSVKTRELFLKNKAAELDREMGLIRTQEETGRHVRMLTHEIRSTLDRHTILKTTLVELGRTLGLEECALWMPTRTGLELQLSYTLRHQNPVGFTVPIQLPVINQVFNTNNAVKISPNSPVARLRPAGKYMPGEVVAVRVPLLHLSNFQIHDWPELSTRRYALMVLMLPSDSARQWHMHELELVEV

SEQ ID NO: 57795 - protein, 414 aa, Zea mays
MAAAATTSSSSHLLLLSRQQAASLRCRLSFLGQPRRPGRVTAQAPAAKDVRCMAAVDTTAASTAAAETSPKSSSYEIVTLTTWLLQQERTGAIDNEMTIVLASISTACKQIAALVQRAPISNLTGVQGAVNVQGEDQKKLDVVSNEVFSNCLKSSGRTGVIASEEEDVPVAVEQSYSGHYIVVFDPLDGSSNIDAAVSTGSIFGIYNPNDECLADVDDNDTLDSVEQRCIVNVCQPGSNLLAAGYCMYSSSVIFVLTVGTGVYVFTLDPMYGEFFVLTQEKVQIPKAGKIYAFNEGNYALWDDKLKLYMDSLKEPGDSGKPYSARYIGSLVGDFHRTLLYGGIYGYPRDKKSKNGKLRLLYECAPMSFIVEQAGGKGSDGHQRILDITPTEIHQRVPLYIGSVEEVDKVEKFLA

SEQ ID NO: 57796 - protein, 394 aa, Rubrobacter xylanophilus DSM 9941
MKSPEVVVVGCGGLGSAALYWLSRRVGSSALGIEQFRIGHERGASQDHSRIIRLAQHQSEYAALAPQAYETWHELEEQSGQRLVIKTGGLVIEASEERDPAKVGTRNVDGYVATFEEHGFDYELLEPEELISRWPQFRLKGNERIVYQKDSGIVDARKANATHVALARAQGARILEETPVRSVRPSGAGVEVVTDHETFFADRVVITADAWTNNVLEGVGLRLPLTVTQEQVTYYATPNLKDFSPERFPVFMWHGKHNFYGFPVYGEVATKLGQHMGGHEVTAETRTFEPDPVRQERYRNFLSKHIPGFLGPELYTKTCLYTIPPDQNFIIDTLPEHPQISVAIGAGHAFKFASLIGRILSELALDGSSSFPIEPFTITRPAITDKTFQRSFHA

SEQ ID NO: 57797 - protein, 503 aa, Rubrobacter xylanophilus DSM 9941
MSAPASEVHPKLFIANEWRPSHTGQTFETVDPSTEEVIASIPRGGAEDVDEAVSAAREAFNGPWRRLTPEDRARFLYQVARSLESRLEEFARLETLDTGKPLQHSRNEIRNCVRYFDYYAGAADKIHGETIPLGPNYLDYTVREPLGVTAHIVPWNVPLGMVCRSLAPALAAGNAAVVKPAEQTPLTALKLAELFLELDAPPGVYNVVTGFGEEAGRALSEHPGIDSITFTGSVETGRAVLRAAAEHVRPVVLELGGKSPQVVFADCDLDFAADEVAKGIYSNSGQYCDAGSRLLIDGSIKEPFLEKVIERARAIKLGAGMDEPDMGPLVSEEHFKRVLGYIEVGNKEGARMLTGGRAEGFERGYFVAPTIFDEVESNMRIAQEEIFGPVLATLSFGSEVEAIEIANDSSYGLAAGIFTRDIDRALRFASEIQAGYVMINEYFSGGMGSPFGGYKQSGIGRERGLIALDNYTQIKNVVVKVGQRLPRRSAGIQDALAPITKPG

SEQ ID NO: 57798 - protein, 393 aa, Oryza sativa (japonica cultivar-group)
MSLPLTRKDLMIVNMGPQHPSMHGVLRLIVTLDGEDVIDCEPILGYLHRGMEKIAENRTIIQYLPYVTRWDYLATMFTEAITVNAPEFLENIQIPQRASYIRVIMLELSRIASHLLWLGPFMADLGAQTPFFYIFRERELIYDLFEAATGMRMMHNYFRIGGVAADLPYGWIDKCLDFCDYFLRGVIEYQQLITQNPIFLERVEGVGFISGEEAVNWGLSGPMLRASGIQWDLRKVDLYESYNQFDWKVQWQKEGDSLARYLVRIGEMRESIKIIQQAVEKIPGGPYENLEVRRFKKAKNSEWNDFEYRFLGKKPSPNFELSKQELYARVEAPKGELGIYLVGDDSLFPWRWKIRPPGFINLQILPQLVKKMKLADIMTILGSIDIIMGEVDR

SEQ ID NO: 57799 - protein, 302 aa, Prochlorococcus marinus subsp. marinus str. CCMP1375
MSTVPEISSAPFGRLLTAMVTPFDTAGAVDFALAARLARYLVDQGSDGLIVCGTTGESPTLSWEEQYQLLETVRNAVNGSAKVLAGTGSNSTSEAIHATAKAAEAGADGALVVVPYYNKPPQAGLESHFRAVAQAAPDLPLMLYNIPGRTGCSISPITVQRLMNCSNIVSFKAASGTTNEVTDLRIRCGSRLAIYSGDDGLLLPMLSVGAVGVVSVASHIVGMRLKAMIEAYFAGENSLALSHHEQLQPLFKALFATTNPIPVKAALELIGWPVGAPRSPLLPLENQMKNELMKTISALLQT

SEQ ID NO: 57800 - protein, 465 aa, uncultured bacterium 105
MVTKETKAHSHTATSYTSDVLASVLERNTAEPEFHQAVEEVFTSLGPVLERRSDYRNARILERIVEPERVIMFRIPWQDDQGGIHVNRGFRIEMNSAIGPYKGGLRFHPSVNLGILKFLAFEQVFKNALTTLPMGGGKGGSDFDPKGKSDSEVMRFCQSFMTELARHIGPNTDIPAGDIGVGGREIGYMFGQYKRLRNEFTGVITGKGLNWGGSLIRPEATGYGSVYFAAEMLATKGKSLEDKVCLVSGSGNVAQYTVEKLIQLGAKVVTLSDSSGYVYDEAGIDKEKLEFIFDLKNVRRGRIKEYADKYKNVEYTASNPALDHNPLWNHQAQCAFPSATQNEINEKDAMAMLKNGVELVSEGANMPVTINGINQFLDAGIFYGPGKAANAGGVATSGLEMTQNAQRLVWTRAQVDERLQHIMKAVHKACYETAEHFGMPNNYLVGANIAGFVKVADSMLDQGIV

SEQ ID NO: 57801 - protein, 426 aa, Salmonella typhimurium LT2
MSKSENLYSAARELIPGGVNSPVRAFTGVGGTPLFIEKADGAYLYDVDGKAYIDYVGSWGPMVLGHNHPAIRNAVIEAAERGLSFGAPTEMEVKMAELVTNLVPTMDMVRMVNSGTEATMSAIRLARGFTGRDKIIKFEGCYHGHADCLLVKAGSGALTLGQPNSPGVPADFAKHTLTCTYNDLTSVRAAFEQYPQEIASIIVEPVAGNMNCVPPLPEFLPGLRALCDEFGALLIIDEVMTGFRVALAGAQDYYGVVPDLTCLGKIIGGGMPVGAFGGRRDVMDALAPTGPVYQAGTLSGNPIAMAAGFACLNEVAQPGIHETLDELTTRLAEGLCEAAQEAGIPLVVNHVGGMFGIFFTDAESVTCYQDVMACDVERFKRFFHLMLEEGVYLAPSAFEAGFMSVAHSMDDINNTIDAARRVFAKL

SEQ ID NO: 57802 - protein, 290 aa, Helicobacter pylori 26695
MDYKCFKGKHANIVIEIISLLEKGVKKAQEILEKPDAGSYTKLENSSGDTPIKADLALDKFLEENFLSLENIKSVFSEEKETPVTKENGSYLIAYDPLDGSSVMEANFLVGTIIGIYEKDYKAQNLAASLYVVFGHKIELVVALEEVYRYSFYQNKFHFIETIVLENKGKIVASGGNQKDFSLGLKKALEGFFAENYRLRYSGSMVADVHHVLVKKGGMFSYPQKKLRKLFEVFPLALMVEKAKGEAFYFDKGVKKRLLEQSVENYHEKSECYLASQHEAHILEKYLKGE

SEQ ID NO: 57803 - protein, 231 aa, Oryza sativa
  misc_feature (180)..(180): Xaa can be any naturally occurring amino acid
  unsure (1)..(231): unsure at all Xaa locations
RHEATFPHLSLSLVSRAAAEGESKASSAMGNSLPVESKVTVEEENDRIKYVVSSMQGLGDKMEDAHAAILSLDDTTSTSFFGVYDGHGGAEVASYCAKQFHIELCNHEDYHNDLTNALNNVFFSMDENRQQSDAWRELVIPRDNGWMYFLKAGICANFWPFATYTGPAYEGSTACVVQWXVIRGNQMIVGHVGDSRCVLSRQGGLAIDLSFDHKPCTRTESERERVQNAGG

SEQ ID NO: 57804 - protein, 496 aa, Brassica napus
MAMIGLLEVFVAFLFFLVFKHFFLHKKSPGQPILKSWPVLGMLPGMLPHIPRIFDWTFEVLEATNLTFFFKGPWFSGTDMLFTADPRNIHHILSLNFGNYPKGPEFKKIFDVLGDGILSVDLELWEDLRKSNHAIFHHPDFLKLSASSNTIKLKEGLVPFLDNAAHENIVIDLQDVFKRFMFDTSSISLTGYDPMSLSIEMPEVEFGEAAETGEEAIYYRHFKPVILWRLQNWLGIGLERKMKSSLVTVNRMFAKIISTRREEISRGEGEQLMDALTYYINVDTTKYKLLKPSNDTFIRDVAFSLLLAGRDTTSSVLTWFFWLLSKHPHVLTKIRQEINTKFDPTYLEKLVYLHAALYETMRLYPPVPFNHKSPLKSDVLPSGHKVKAESKIVICIYALGRMRSVWGEDALDFKPERWISESGELKHEPSYKFMAFNAGPRACLGKHLALQQMKIVAVELIQNYDFKFTEGHKIEAVPSIVLRIKNGLSVTVTKKM

SEQ ID NO: 57805 - protein, 372 aa, Glycine max
GSSPCQEVNGSKAAMLFIGLYLVALGVGGIKGSLPAHGGEQFDETTPSGRKQRSTFFNYFVFCLSCGALIAVTFVVWIEDNKGWQWGFAISTISIFVSIPVFLAGSPTYKNKIPSGSPLTTILKVLIAALLNSCTYKNTSSAVVNMTSSPSNPHSGRTESQQETVKASTTTETPTSNLKFLNKAVTNKPRYSSLECTVQQVEDVKVVLKMLPIFACTIILNCCLAQLSTFSVEQAATMDTKLGSLKVPPSSLPVFPVVFIMILAPIYDHIIIPYTRKATKSEMGITHLQRIGFGLVLSIVAMAVAAIVEIKRKRVATQSGLLDDPTKPLPITFLWIAFQYLFLGSADLFPLCFINVVTCPSIFVLRGPIQVV

SEQ ID NO: 57806 - protein, 564 aa, Ustilago maydis 521
MQKIGPYTQYDANTGIFTSNITYSPKTATCVFEYLLGAVDFDDQQEVLRECGTGRAISLGQLKLDAQRLGVGLVNKCKLKPGETVLLYLYSSIDFAVALLACQFAGLRTALANPDYLSTELRHVYCLTKPKKVFVASQYMHRLSKAAIRGQSVIITDGDVAGFGGVLSIKGLLADEVSARQAKVHVPADLNDTAYLPFSSGTTGLPKAVEISHGNVINMVEIFRHTPSLFLKHDDGTEMQFRTLNFLPFFHAYALILMLHFPIRTRGHTSIMRPFQPEAYCRLIKELNINFLALVPPVLTLLTKHPDATQEAFCSVKQSICGAAPLDFETQTAFTLKTGVPVKQAFGMTETTVGALGVHGDQASGSVGCLYPATMARIRDVETGKNLGPGERGELLVKGPQVCKGYYGNPSATRDTFQEDGYLCTGDIAIVDPRTGEFSIVDRLKELIKYKGFQVAPAELEGVLVSHPSIAAAAVVGIYDKQQGTELPLAFIELKAAHQNPDKMAEDIDAFVRSKVSHHKYLRGGIRFLDKIPVSASGKILRKQIRKLIPAETEVEHASGKAKL

SEQ ID NO: 57807 - protein, 554 aa, Cytophaga hutchinsonii ATCC 33406
MAELIKMPKMSDTMTEGVIAAWHKKVGDKVKSGDLLAEVETDKATMEMESYEDGTLLYIAAEAKSAVPIDGVIAVIGKDGENIDALIKEIKGGGAPAEAPKTEAKAEAEVPKAEKPAEAAKQAAPAVDLSSIKAEAILMPKMSDTMVEGTIVAWHKKVGDAVKSGELLAEVATDKATMEMESYEDGTLLHIEVKEGDAVQIDGLIAIIGEKGTDVTPIINAYKNGGKPSAAPAAASEPAKQETASAPASNNAPAAQASSSSDERAKISPLARKIASDKGIDIKQVKGSGDHGRVIKRDIENFKAAPAEAAPAKGSGAPAASLPNIVGQEGFDEVPVSQMRKVIVKRLSESLFTAPHFYLTMEINMDKAIEARASINEVATAKVSFNDMVIRASAAALRKHPMVNASWQGDKIRVNHHIHIGVAIAIEDGLVVPVVRFADSKSLSHISQEVKELGGKAKSKKIQPADMAGNTFTISNLGMFGIDEFTSIINSPDACILSVGGIKQTPIVKNGQIVVGNIMKVTLACDHRVVDGAVGSAFLQTLKSYLEDPVRILA

SEQ ID NO: 57808 - protein, 124 aa, Streptomyces anulatus
MSIEKPEVDFPGGEPPADLAIKDIWEGDGPVAQAGQTVSVHYVGVAFSTGEEFDASWNRGTPLQFQLGAGQVISGWDQGVQGMKVGGRRELIIPAHLAYGDRGAGGGKIAPGETLIFVCDLVAV

SEQ ID NO: 57809 - protein, 376 aa, Colwellia psychrerythraea 34H
MSDKFIKSKAAIAWGPNQPLSIEEVDVMLPREGEVLVKVVASGVCHTDAFTLSGDDPEGIFPVILGHEGGGIVEQIGAGVTSVKVGDHVIPLYTPECGECKFCLSGKTNLCQKIRETQGKGLMPDGTTRFYKDGQPIFHYMGCSTFSEYTVLPEISLAKVNKDAPLEEVCLLGCGVTTGMGAVMNTAKVEEGATVAIFGLGGIGLSAVIGATMAKASRIIAIDINESKFELAKKLGATDFINPKDYDKPIQDVIVEMTDGGVDYSFECIGNVNLMRSALECCHKGWGESVVIGVAGAGQEISTRPFQLVTGRVWRGSAFGGVKGRTELPDYVERYLAGEFKLSDFITHTMPLEDINESFELMHKGESIRSVIHFDK

SEQ ID NO: 57810 - protein, 472 aa, Zea mays
MGKAARWFRSFLGKKEQRPTKDQRRLQQQDDQAPPLPPPSAKRWSFGRSSRDSAAAAVVSAGAGNAAIARAAEAAWLRSAACAETHRDRDQDQDQSKHAIAVAAATAAAADAAVAAAQAAVAVVRLTSKGRAPLFAVAAAVRIQTAFRGFLAKKALRALKALVKLQALVRGYLVRRQAAATLQSMQALVRAQATVRARRAGAAALPHLHHLPGRPRYSMQERCADDARIEHGVAAHSSRRLSASVESSSYGYDRSPKIVEVDPGRPKSRSSSRRSSAPLLDARSSGSGGGEEWCASANPASSPLPCYLSAGPPTRIAVPTSRQFPDYDWCALEKARPATAQSTPRCLLQAHAPATPTKSVVAGHSPSLNGCPNYMSSTQASEAKARSQSAPKQRPELACCCGGARKRVPLSEVVLVDSSRASLSGVVGMQRGCSTGAQEAFSFRTAVVGRIDRSLEVAGGENDRLALLQRRW

SEQ ID NO: 57811 - protein, 384 aa, Triticum aestivum
  misc_feature (339)..(339): Xaa can be any naturally occurring amino acid
  unsure (1)..(384): unsure at all Xaa locations
MVAGPEVMHQVVPMLEASFRRCPVRGVEEVVVGVGVSSPPPPPVDSQSQVDLEVPDLVKTPLETLQFVPKIRSGSFPDIGPKPYMEDEHIRIDNLSGHLGSLLLCPSPNAFYGVFDGHGGSDAAAYMKRHAMRLFFEDSEFPEGLQEDDFFSESVANSIRKAFLSADLALADDSVISRSSGTTALTALIFGRQLLVANAGDCRAVLCRKGMAMEMSRDHRPTYEAERQRVTECGGYIEDGYLNGVLSVTRALGDWDMKMPQGSQSPLIAEPEFQQTILTEDDEFLIIGCDGIWDVMTSQQAVTLVRKGLRRHDDPERCARELAMEAKRLQTFDNLTVIXVICFASELGGCLRSSEEASSRRIRSCKSLSAEALCNLRRLLESDQ

SEQ ID NO: 57812 - protein, 211 aa, Triticum aestivum
MADEDEYRCFVGNLSWSTTDESLKDAFSKYGKVTEAKVVMDKFSGRSRGFAFVTFDEKKAMEEAIEDMNGLDLEGRAITVDKAQPQGVGRDRNGDRDFDRDRGSRGGRDYGGGRAPRGGGGGGDCFKCGKPGHFARECPDGDGGRGDRYGGRDDRYGGGRSDRGGDRSDRGGDRSDRDGDRSERGSDRYSSRSRDGGSGGDRYSCDRSGPY

SEQ ID NO: 57813 - protein, 116 aa, Erwinia carotovora subsp. atroseptica SCRI1043
MTTPTIEKIQRQIAENPILLYMKGSPKLPSCGFSAQTVQALSSCGERFAYVDILQNPDIRAELPKYANWPTFPQLWVDGELVGGCDIVVEMFQRGELQQLIKETADKYKAQQADQE

SEQ ID NO: 57814 - protein, 356 aa, Saussurea medusa
MVAVSGNTRVESLATSGIHQIPKEYIRPQHELQTITNIFDEQNDQNAPQLPTIDLNDIHSHDPMTRQRCRDELTKAATEWGVMHLVNHGISGELIDRVKAAGESFFNQPVEEKERYCNDIGSGKIQGYGSKLANNACGQLEWEDYFFSSRLPRGERDLNVWPTTPDDYIPATTEYAKQLRALATKILSVLSLGLGLEEGRLEKEVGGMEELLLQLKINYYPKCPQPELALGVEAHTDVSALTFILHNMVPGLRLFYGGQWVTAKCVPDSIIVHIGDTIEILSNGKYKSILHRGLVNKEKVRISWAVFCEPPKEKIVLKPLPETVFEKEPPLFPPRTFHQHMEHKLFRKNNDIVDPK

SEQ ID NO: 57815 - protein, 554 aa, Vibrio vulnificus YJ016
MCSVFGILDIKSDAAALRPIALEMSKKLRHRGPDWSGIYASDRAILAHERLAIVGLNSGAQPLYSPDKKLILAVNGEIYNHKEIRARYEGKYDFQTDSDCEVILALYQEMGADLLEELNGIFAFVLYDEEKDQYLVGRDHIGIIPLYQGYDEHGNYYVASEMKALVPVCKTISEFPPGSYYSSTDAGPQRYYIRDWNEYAAVQGNTSSKEELTAALEAAVKRQLMTDVPYGVLLSGGLDSSITSAVAKRYAAMRIEDDEQTEAWWPQLHSFAIGLDGAPDLKAAREVAAKIGTVHHEMTYTIQEGLDAIRDVIYHIETYDVTTIRASTPMYLMGRKIKAMGIKMVLSGEGADEIFGGYLYFHKAPNAQEFHEETVRKLLALNMFDCARANKSLAAWGVEGRVPFLDKEFIDVAMRLNPADKMCGNGKMEKHILRECFEHYLPDSIAWRQKEQFSDGVGYGWIDTLKAVAEEKVTDQQMEAAKFRFPYNTPTTKEGYVYREIFEELFPLPSAAECVPGGPSVACSSAKAIEWDESFKNCIDPSGRAVKAVHNEAY

SEQ ID NO: 57816 - protein, 796 aa, Vibrio sp. Ex25
MFLEKDMQKNTLWFNGLSMDDVDKVGGKNASLGEMVSNLANAGVSVPNGFATTSYAFNQFLDHEGLDERIHQLLDELDVEDVEALRKTGATIRQWVLEAPFPADLEQEIRENYQELIEGNPELSVAVRSSATAEDLPDASFAGQQETFLNVKGIDAVLEATKHVYASLFNDRAISYRVHQGFDHRGISLSAGIQRMVRSDKASSGVMFTLDTESGFDQVVFITSSWGLGEMVVQGAVNPDEFYVHKPMLEAGEHPIVKKTFGSKLIKMIYSDNQEIGKQVDIVDTSDEERNTFSLNDEEIKELAKQAMIIEKHYQRPMDIEWAKDGIDGKLYIVQARPETVCSQTEQNVIERYELQNKADVLIEGRAIGQRIGKGAVRLVDSLDQMSLVQEGDVLVTDMTDPDWEPVMKKASAIVTNRGGRTCHAAIIARELGIPAIVGCGDATSKLTDGATVTVSCAEGETGYVYQGELEFDVKRSSVDELPLLPTKVMMNVGNPDRAFDFAQIPNEGVGLARLEFIINKMIGIHPKALLNFDAQSDELKAEIKQRIRGYKDPIDFYVSKLTEGIATIASAFWPKRVIVRMSDFKSNEYSNLVGGKAYEPHEENPMLGFRGASRYISPVFEDCFELETQAIKRVRNEMGLKNVEIMIPFVRTPSEAASVIDLLAKFDLRRGDQGLKVIMMCELPSNAVLADEFLKYFDGFSIGSNDMTQLTLGLDRDSGDVAHLFDERNAAVKIMLKMAIDAATKAGKYVGICGQGPSDHEDLAEWLMEQGISSVSLNPDTVIDTWLQLGKVSSK

SEQ ID NO: 57817 - protein, 252 aa, Sulfolobus acidocaldarius
MYLVEEAKKVAEMILSSVNAIAFTGAGISTASGIPDFRGPQGLWKKYSPELASIEYFQKYPDAFWQFYSTRMKSLFEAKPNRAHYALAQLEKMGLIKAVITQNVDGLHSVAGSRNVIELHGNMRKSYCTSCLRSYDSLEVLARVEKGEVIPRCECGGILKPDVVLFGEPVHGIYEAMRIANESDLVLAIGSSLTVYPANQIPLIVKRNGGGLIILNGEETPYDEYADLVIRERIEIFLPEVISHIQSLHRSS

SEQ ID NO: 57818 - protein, 181 aa, Leptospira interrogans serovar Lai str. 56601
MPKVLVPFAEGMEEMEAVIIVDVLRRAGIEVLSASLKEGPVKASRGIRILADTTLDEINFEDFDMIVLPGGGGGTKVLSAEPKVSELLKNAKEKNKWIAAICAAPSILVHQNILTSKDRFTAFPGIISNNSGYTGSRLEISGKIITSIGPGSAFEFALELVKILSGEESMLKVKSALQLAS

SEQ ID NO: 57819 - protein, 470 aa, Hyphomonas neptunium ATCC 15444
MSVDILMPALSPTMEEGTLSKWLKKEGDAIKSGDVIAEIETDKATMEVEAVDEGVLAKIVVPEGTENVKVNAVIAVLAEDGEDVSKEASSKPKEEKAEAASESEEVKESKQAVPEQEDPKPKAPEQPRAAIVKDPSLPEGTTFTETTVRDALRDAMAEEMRKDERVFVMGEEVAQYQGAYKVTRELLQEFGDRRVVDTPITEHGFAGLGVGAAFAGLKPIVEFMTFNFAMQAIDQIINSAAKTLYMSGGQMGCPIVFRGPNGAASRVGAQHSQDYSAWYAQIPGLKVIAPYDAADAKGLLKAAIRDPNPVVFLEHELLYGQSFPVPDIDDHIVPIGKAAVKREGTDVTLVAHSRMVGFALQAAERLAEEGISAEVIDLRTLRPLDTDTVIESVKKTNRLVCCEEGWRFMGVGAEIAATVVAEAFDYLDAPPIRVHQKDVPLPYAANLEAMSLPNADDIVAAAKKVCEGAF

SEQ ID NO: 57820 - protein, 246 aa, Leptospira interrogans serovar Lai str. 56601
MKEFITKHRDKFQKISAISGAGISAESGIPTFRGSEGLWKNFRAEDLATPQAFSKNPKLVWEWYLWRRNIIETKRPNPGHFALVELERIHPDFFLITQNVDGLHSQAGSKKLTEIHGNIFINRCISCGQESKETISENTTPLPPQCQNCNSFLRPGVVWFGESYDDFKLNLSIQRMKHTDLLLVLGTSGSVSMPVYLAQIAKDSGALLIEINPERSSFSSSVDLFLQGKTGEVLPELIREILDNPS

SEQ ID NO: 57821 - protein, 379 aa, Candida albicans SC5314
MSIDPETRRKLLNLQKTGENKKCFDCSAPNPQWASPKFGIFICLECAGVHRGLGVHISFVRSITMDQFKPEETLRMEIGGNERLKKYFIDNGVDLNLSPKQKYDNYVAEDYKEMLTCEVEGKEFVAKDHSGEKLPDINNTASTTTDPVSRGRPTPVPLTNEQKQKNEAYFADLGAKNDQRPDHLPPSQGGKYGGFGNTPAPSNTTSNNNNNNNSNNNNNNNNNNSSLSSFTLDNFQNDPLGTFTKGWGLFSSTVVKSVQEVNNSVIKPSIDQIQSSEITGQAKTAMAQFGQKMQQTGKYGQETFQTFTKDINENGLNKTLDSTFGGIFGHNNNNNGSNQGNQVPNAFGFKKPDNGVKYESLSGGSKKNDDDDDDKWDDF

SEQ ID NO: 57822 - protein, 387 aa, Thermosynechococcus elongatus BP-1
MDWATRVMRVTPSVTLAIDAKAKAMRAAGEDVCSFSAGEPDFDTPAHIREAVKTALDQGKTRYGPAAGEPALRQAIATKLNRDNHLPYRAENILVTNGGKQALFNLMLALINPGDEVIIPAPYWVSYPEMVHLASGTPVIVATTPETGYRITPAQLEDAITPKTRLVVLNSPSNPTGMVYTPEEIRELAAVIVRHQLWVVSDEIYEKILYDGAEHLSIGAVSGAAFERTIVCSGFAKAYAMTGWRVGYLAGTTEIVKVATKIQSHSTSNVCTFAQYGALAALEGSQDCVAEMVAAFRERRAYMYAGICEIPRLRCLKPKGAFYLFVDIGDTGIGSVEFCDRLLEEEKVAAVPGKAFGMDDHIRLSYATDLATIEKGLTRLAKFVQRL

SEQ ID NO: 57823 - protein, 373 aa, Zea mays
  misc_feature (212)..(212): Xaa can be any naturally occurring amino acid
  unsure (1)..(373): unsure at all Xaa locations
MLWVARLSGFLSAAMVMVVLSPSLQSFPPAEAIRSSQFDGSVRFPGQIAGGARGVAFRRAPSFRNAADCGAGAGNGTAANVCDPSLVHTAITLDEEYLRGSVAAVHSVVQHARCPESVFFHFLVSDPSLGDLVRAVFPQLRFKVYYFDPGRVRGLISTSVRQALEQPLNYARNYLADLLEPCVRRVIYLDSDLVLVDDVAKLWRTDLGGRTXGAPEYCHANFTKYFTSRFWSDQRFAGTFVGRRPCYFNTGVMVLDLERWRRAGYTQRIERWMEIQKSPPGRISELGSLPPFLLVFAGHGAPIEPRWNQHGLGGDNVLGSCRDLHPGPVSLLHWSGSGKPWARLGAGRPCPLDALWAPFDLYGPAGAGGEESR

SEQ ID NO: 57824 - protein, 450 aa, Colwellia psychrerythraea 34H
MNSIIYPTTNFKHTATLIIERGDGAYVYDSNGKQYLEALAGLWCTSLGYNNHELIETASEQMSKLSFSHMFGGKTHQVGIDLAEKLSAMVPVENAKIFFGNSGSDANDTHIKMLRYYFNAIGKPQKYKIIARERSYHGVTVASASLTGLKPNHTHFNLPFDALGVLRTDAPHYYRNALPNESEAQFIDRIVNNLEQLILLEGADTIAAFIVEPITGASGVIVPPEGYYQKVQAVLQKYDILLWADEVITAFGRTGNDFGCKTVGIEKPAMMTLAKQLSSAYMPISASVIRGDMYDAMVEQSAQVGVFGHGYTYSGHPVSCAVALKTLEIYQRENIFDHAAKIGAYMQKRLHEFIHHPLVGEVRGKGMIGAIELVANKKTGQAFPDGTVGNFAMQACQNNGMICRAVAGSSLAFCPPLIVNKSQIDEMIEKTAKSLDQTLDFVVREGLLVR

SEQ ID NO: 57825 - protein, 738 aa, Glycine max
MKNLWLCFSYLFPAAIILVLLTPSSVAQLSPSEGRILFQVQKLLEYPQALQGWNRWTNLCFLPSSPSLKIVCSNGHVTELTIIGNKTSPSLHNPKESAWTSLQTLSGRFSIDSFFTVMTKLSNLKMLSLVSLGLWGPLPAKINRFWSLEVLNISSNFIYGGIPQSLSSMRNLRSLVLVDNLFNGSVPDLQRLTSLEELNLGGNNLGAQFPSVGKNLVTIMLRNNSLRSHIPPQLVHFDKLQVFDVSSNNFFGNIPSFLISLPSLQYLNLASNHLSGNLSVNMACSSSLTFVDISHNLLVGKLPSCFGSVSSKAKVLYSGNCLSTEKRLNDQQHPFSFCKREGALAVKPPAKNLKKESGSGAKLGLMLGIIVGIVLIGGLLVLLVVCIFRKSKAERSHPKMDKSVANKYSISVSPRPIGTRHIPQAMKQAAVGLPPYRIFTSEEIEDATNNFDPSNLIEEGSLGQLYKGWLRDGSVVLVNCVKIKQKGLPHSIMQQVEVLHNLRHRHMVSVLGHCIITEQEHPQTTSTVFIVFEYISNVSLRDQLSDGRKREMLKWPQRMAMSIGIARGVQFLHTGVAPGIYGNNLKIENILLDDSLNAKVSRYNIPLPSKIAHIEQNATNHIGSTNDAEKEDIYQLGIILLEVITGKQITSSSEIEELKEELENGSSEATSVIRSAIDPSLRGTYAYESMKTAVQITINCLSKVSSQRPSIEDVLWNLQYAMQVQESWTSSGNLSTKL

SEQ ID NO: 57826 - protein, 234 aa, Antirrhinum majus
VLVQFGAFIILCGATHLISLWTFSLHSKTVAIVMTVAKIATALVSCVTALVLVHIIPDLLSVKTRESFLRKKAEELDREMGNIIKQEETSRHVRMLTHEIRSTLDRHTILRTTLVELGRTLELEECALWMPGQRGPNLQLSHTLNNLIPVGSTVPINLPIVNGVFNSEEAIKIPHTCPLAKIRPLGGGYVPPEVVAVRVPLLHLSNFHINNWPEQSSKSYAVMVLILEWHKNMA

SEQ ID NO: 57827 - protein, 673 aa, Triticum aestivum
  misc_feature (273)..(273): Xaa can be any naturally occurring amino acid
  unsure (1)..(673): unsure at all Xaa locations
TARLIRKPPAPVVDAVVPLPEEVAATAASVVDVERAVAAPVNRRRAPNGVAEQEPRSGGIRGEVKPRIIDVPNGVVGEHVAAGWPRWLTEVATEAVRGWQPRKAESCEKLDKIGQGTYSSVYKARDLENGKIVALKKVRFANMDPESVRFMAREIHILRRLDNPNVIKLEGLVTSRMSSSLYLVFEYMEHDLAGLAATPGIKFTEAQVKCYMHQLLSGLGHCHSRGVLHRDIKGANLLLDNNGALKIADFGLATFFNPNQKQNLTSRVVTLWXYRPPELLLGATNYGATVDLWSAGCILAELLSGKPIMPGRTEVEQLHKIFKLCGSPSEEFWANLKLSRATIFKPQHPYRRCVNDVYKDFPPSALALLDRLLAVEPDNRGTAASALESEFFTTKPYACDPSSLPKYPPSKEYDAKLRDEEARRQRAAAAKGHESETGRRKQLAAQNGTIDLQQRRVPVNPKSSSNKFTPKEDGVTGFPMDPLVVDNGHARHVPLMNAGRSSSTLGRSSGTDPNGQRFYTSQIAAAEMSNPSTATGQRGNTGKLSNLGDSARKQYLREHRSSSRYSQLAAADQSDKPKWSQSHQFQERPSSSHRKDEVVADKEPTGVNGTRKNRIQYSGPLMPPGVNMEEILKEHERQIQQAVRRARLDKGKGKHAERDQSESLLYAAHNGRS

SEQ ID NO: 57828 - protein, 310 aa, Prochlorococcus marinus subsp. marinus str. CCMP1375
MVSSVIEATAPLRRPVSADKALAASEKLQVKTKKELRYPRKFKRRWGTVGFMGAIHALTIFALLPRFWSLQNIAALLILYWVTACLGVTLGYHRLLSHRAFKVPHWLERFFATCGALSCQHGPIDWVGLHRHHHTFSDTDADHHNSKKGFWWSHMGWMFEPIPALQTVPNFSGDLIQDPYYRFLNKNFLLLQIPLGALLYWIGHGSESGGWSMVLWGIPFRLVVVYHVTWLVNSATHCWGNVAFDSGDGSKNNWWVAALTFGEGWHNNHHAYPSSARQGLFKGQIDLTWQHIRLLHALGLAKKIRLPMKP

SEQ ID NO: 57829 - protein, 172 aa, Glycine max
PATGQWERVASPTEVREKWMHASAVVGERIYAMADRGGIAYEPSSGAWESVGVELDHGWRGRACVVEGILYCYDYLGKIKGFDVGRGVWEELKGLEKGLPRFLCGATMADLGGKLCVVWECQGNENEMEIWCAEIGVKKNSDGELWGQLVWFGKVLSVPKGSSIVNCSSVSL

SEQ ID NO: 57830 - protein, 591 aa, Coprinopsis cinerea okayama7#130
MPGRTHFSISGPDSAPSSRSASPAPAYDFNDIVKTEKLNGVEDVSPGQGPTDVYDTTLPAWRAAVRRILVKTVEKESRVIARMQNAIRTPWLDSYFVYTSLLGTHTFFMILLPAFAFFGHQDIARGLVMVLAAGVYLSSVLKDMFCSPRPFAPPVVRLTIGSHHLEYGFPSTHSTNSISIALFFFSIVHSLTYTSTPTISPQEFSVFTAILVFYAFSIVFGRLYTAMHSFTDCIMGTILGAGIWWGHGSWGGHPVVISLSNPLSTFFTTFGFGQPFDENHIVVYLGKCLGAGRWIEQWSENGGWKVPVILIPLCLLAVNQHPQPVDDCPCFEDAIAFGSVVLGALVGRWAMHSAGLNPEMNGLSLMPGSGWVQTDLGEWIAVERTWGDIGVWWAVAALKMAVGILTIFVWRIIAKAALHLILPPTFRLLSRVFRLPNRRFYLPATEYKNVPSDIHVTEDGTIALQAIPSVIDLPSSAGMMFETGGIGSGVDGSSHWNQSNGNGAEMKMRAVNGNGTGKAVPSKLAQEINGGEVHAAKRVDEEDQESKVKGAKHYDADVLTKVIVYAGIAFLACEALPLMFEHLGWGLRYSV

SEQ ID NO: 57831 - protein, 468 aa, Vibrio sp. Ex25
MSNKTQQLLEIDRQRVFHASTHLKQYAAGELSGRIISSGSGIRITDSEGIELIDGFAGLYCVNIGYGRTEMADAIYEQAKELAYYHTYVGHTNEALVTLSDRIIKMAPEGMSKVYYGMSGSDANETQLKLVWYYNNARGLPEKKKIISRDRGYHGSSIASGSMTGLPLFHAHFDLPLERIKHTMAPYYYRREDDSMSELEFSQYCADQLEAMILEEGPETVAAMIAEPVLGTGGIVPPPEGYWQAIRKVLDKYDVLLIADEVVCGFGRLGSDFGSLHYDMKPDLITVAKGLTSAYQPLSGVIVGERVWSVLENGTDQWGAIGHGYTYSGHPMGAAAANCNLDIIEREGLVQNAAEVGAYLQQRMAETFNDHPLVGDTRGVGLLHALEFSSDKLRRAHFDPNLKVGPQIAAACLEQGLIARAMPHGDILGFAPPLIANRNDIDTIVDKAHQAVNKVMDNLVTSKQWQPK

SEQ ID NO: 57832 - protein, 506 aa, Vibrio sp. Ex25
MTALHISHAEELKASHDMMAIMKDVRLVRGLAYVNGKWVSGDQFHPVDNPADGTVIGYITKLSQQQLYQAIDEADQAFRQWRKMQAEERAEILMRWHDLILESKQDLARLMVMEQGKTLGDALGEIDYGASFVRWFAEEARRSYGETIPSHIPNAQLSTVREPIGVAALITPWNFPNAMVTRKAAAALAIGCPVLIKPASETPFSALALAELADRAGFPPGVFNVITGDAVMVSQTLCHSDKVKALSFTGSTRVGKLLLRDAAQTVKKCSMELGGNAPFIVLPDMDVEQAAKAAVDAKFQTAGQDCLAANRIFVPDDKYEAFLEAFAKEMNHIVLGNGLDEKTTMGPLINRAAVDKAHDLVRDALDKGARLVAGYHQPVPGENFFAPTLLADVTPDMAVYREENFCPVAGVLPYQDLDTVIEMSNDTEYGLAAYVYGHDIHQIWRCMRGLEFGMVSVNSVKMTGHPIPFGGVKQSGLGREGSRHGFEEYSEIKYCCLGALPTVSGS

SEQ ID NO: 57833 - protein, 568 aa, Nocardioides sp. JS614
MRPDERPWASSYAPGVPLDIDVPDESLVDLLEASAARFGARTALDFFGATTTYAGLGDLVARAAEGLRRVGVGAGDRVALVLPNCPQHVVAFYAALRLRAVVVEHNPLYTEEEMAFQLADHRPTVVVAWDKVAPMVRRIVEPLGAPTVLAVHLPSALPRRKQLALRLPVPRAARTRAALSGPARGIRRWESILRGPALAADHPRPTSADVALLQYTGGTTGRPKAAVLTHRNLRANAAQGRAWMPGLVDGDEVVYAVLPLFHAYGLTLCLTFSMSIGATLVLMPRFDVDLVLEAMRRRPATFLPAVPPVYQRLAAAAAEHGVDLSSIRYAISGAMSLPAETAELWEAATGGLLVEGYGMTETSPVALGNPAGDARRIGAIGVPFPSTEVRVVDRHDPSRELPAGQAGELLLRGPQVFAGYWERPAETAEVVLADGWIRTGDVVVMSEDGFFTIVDRIKELIITGGFNVYPSEVEHALRELPGIVDAAVVGLPSGRGDEDVVAVVVLEPGTTLDEDAVRAGCREHVAAYKVPRRVYAVDALPVSIIGKVLRRQVRDELQERFEAAPPAT

SEQ ID NO: 57834 - protein, 460 aa, Kineococcus radiotolerans SRS30216
MVDRQRVVIVGGGFTGLYAGKKLEKLLPASTAELVIVSPTDHLTYSPLLPDVTASVIEPRHVAVSLRQALPRHKLVVGHTTSVDPEAKTITISRSERGVVGEDTQVLSYDKLLLAPGSVTRRFPIPGVSENARGVKTITEAAFVRDHLISQLDAADALPDDPRFDAERRERMTVVAVGAGYTGTEIVAQTHRWLTRVADRWSNIDAADVRWLLIDVAPAVLPELGPRLGQYALSALKGRGIDVRLGVSVASVEGNVINLTDGTPIPSRTLIWGAGIVANPLMGTLGLPLDRGRLVVDAKMKVAGAEDVWAAGDAAAVPDLVKPKPADGPQPVTPPTAQHAQRQGTAVGKNIAASFGIGQAADYVHKDLGLVADLGGGTAVAKPLGIEMTGLPAKIVARGYHLYALPAMSNRIRVLTDWALHVLLPVQAVALNQTRPEDALITPAQNTDIYTKAEDKPKVG

SEQ ID NO: 57835 - protein, 387 aa, Bacteroides fragilis NCTC 9343
MKTVFPIHKFRELPTPFYYYDTKVLRDTLACVNREVARYDNFSVHYAVKANANPKVLTIIRESGLGADCVSGGEIRAAIKAGFPAGKIVFAGVGKADWEIDLGLDYDIFCFNVESVPELEVINELAAAKGKVANVAFRINPNVGAHTHANITTGLAENKFGISMHDMDKVIDVALELKHVKFIGLHFHIGSQILDMGDFIALCNRVNELQDKLEARHILVEHINVGGGLGIDYDHPNRQPIPDFADYFRTYDEHLKLRPHQTLHFELGRAITGQCGSLISKVLYVKQGTNKQFAILDAGMTDLIRPALYQAHHKMENLTSQDPVVETYDVVGPICESSDVFGKAVDLNKVKRGDLIALRSAGAYGEIMASGYNCRELPKGYISEELV

SEQ ID NO: 57836 - protein, 234 aa, Zea mays
IVRQLGEDSRQAGRGSVGGMIAAVNRVPAGWGGDGMSVLPRHTKVVVTGNNRTKSVLVGLHGVVKKAVGLGGWHWLVLTNGIEVKLQRNALSVIEPPTGNEDDDKFDCENMQWNSSDMASDDALSPKPQRSRSRQHRGFHRKSISRSMSCDSHSKTSVSSSSRAHTKVDLSKLELTALLRYWRHFNLDACPNPSREQLVDAVQRHFTAQQLDELQVIVGFVQAAKRLKTTMKVA

SEQ ID NO: 57837 - protein, 369 aa, Xanthomonas campestris pv. campestris str. ATCC 33913
MKSRAAVAFGPGKPLEIVEIDVAPPQAGEVLVRITHTGVCHTDAFTLSGDDPEGIFPSVLGHEGGGIVEQIGEGVTGVKVGDHVIPLYTAECRKCKFCLSGKTNLCQAVRATQGKGLMPDGTTRFSYNGEPIFHYMGCSTFSEYTVVPEISLAVVNPEAPLEKVCLLGCGVTTGIGAVHNTAKVKPGESVAVFGLGGIGLAVIQGAVQAKAGRILAIDTNPGKFDLARSMGATDCINPKDYDKPIQEVIVELTDGGVDFSFECIGNVNVMRSALECCHKGWGESVIIGVAGAGQEISTRPFQLVTGRVWRGSAFGGVKGRTQLPGMVEQSMKGEIDLDPFITHTMPLEQINEAFDLMHEGKSIRTVIHF

SEQ ID NO: 57838 - protein, 443 aa, Carboxydothermus hydrogenoformans Z-2901
MSPTKEDILKIVEEKGIRFIRLQFTDIYGIPKNVAITAEQLEKALDGELMFDGSSIDGFVRIEESDMYLKPDPSTFMILPWADQRYAEARLICDIYTYDGKPFSGCPRGNLKRILQEAKQMGIDEMYVGPEAEFFLFQTKEDGTLTTVTHDEAGYFDLAPVDRGENARRDMVLALEQMGFEVEASHHEVAPGQHEIDFKYDSAVRTADKVITFKTVVRKIAKKHGLHATFMPKPVYGIAGSGMHLNISLAAKGQNIFYDPSTPHQLSDIALYFIGGLLKHARAISAITNPLVNSYKRLVSGFEAPVYIAWSFRNRSPLIRIPAKRGPSTRIELRSPDPSANPYLAFAVCLKAGLDGIKNKIMPPPPCDRNIYHMDEEERKAWGIGNLPASLGEALKELEQDEVIREALGEHIFERYMEGKRLEWDTYRMQVHEWELKEYLVKY

SEQ ID NO: 57839 - protein, 943 aa, Nocardia farcinica IFM 10152
MIRYSLGGSWGRDEGGVVDPRQQAVLIRKSVGQPYSNRTRDVTALRLGAAGPVVTFSGGGSYRYGWDRVLILDHPHIVRPGPGTRIMVRGQLRSDVTTAYHFAGRGEEWWHLVRGDGEYEVRRGSSVEIVTDAGREPRTGTILAYWRAIADLLPEGGQSLRKAYGDELILRPDSALYRYLNGTPITPTAPPVGPPLYPFHTNLSQREALQKALTHPLSVIDGPPGTGKTQTILNLIANVIVDETKTVAVVSSNNAAVDNVHAKLVKAGFGYVIANLGRRSKKERFFADQDVRNSEVDRLRMSAEAVPMPPAELVALDGRLLALREMERELAQLTTERSAYELERSHFAEHLENHRLPGEDLLPVLRWSSTKILSFIAATDPELARTSGLARHIERIRNYFRFRSLRFADSQDVDLMLRLQRQYYDRKIAELDQRIDELQSMLSRRRFDQLAEEQRTRSVAWLTEHLRRRYAGRPTRRYDNRYLAQWGEFSRDYPVIASTCHSLGASIGRGRLVDYLIIDEASQVDLLAAGAAMACCRHLVVVGDLRQLAPVVDVPASSCPAAPAPAYDYHRHSILSSLLELHGDHLPRTMLREHYRCDPGIIGFCNQKYYADDLVPFTRATPGHRAMVLVRTERGNHMRTHRDGGKINQREIDVVREEVLPEFCAEFGDEQIGITTPFRRQADLVTDQLIRSIESDTVHSFQGREKEAIVMTTVLDETRSGYRGLEFADKPQLVNVAVSRARKRFVLVTNFDLLPRSRNLRDLIGYIRYQNPRDDVFDSSIVSVFDLLYRDYSARLAPLAARLRGNGRYKSEAIMRALLETVLAEPEFEGYWFREQVFVKNLLPDTTRLDPEQREYVQGRASVDFDVFNRITKERLCVIEVDGFEFHAKSPEQQARDAIKDRICVAYEIPLLRFPTTGSGEVERLRRELGALIRARDESAPPR

SEQ ID NO: 57840 - protein, 480 aa, Cryptococcus neoformans var. neoformans JEC21
MTEDIYKDDLYGDLDLEDLDASQLEELVEPPELDTAPTSTPAASNAAAAPSQPAITASSSTSAPVEPGSQQYDHQPSYDAATPYQQGQQDNNFGQQQDGQDRIKPSDMPDEGKMFIGGLNWETTEAGLSEYMGQFGEIDACTIMRDPSGRSRGFAFLTYRDPASVTKVMAQTHHLDGKQIDPKRAIPRAEHERTAKVFVGGLAPSVTGESLKSFLCQFGQVMDATVMFDKETGRSKGFAFATFQDEESVGRAMAASGVELEGKQIEIKKAQPRGTAQGSKFGGNMNPRFNQGTGFSGGMGSFGGGFDPSSVAMMYQNMMKTGGNMMGGFDPSAMAMMYQNMMKSMGNAPAINPSLAMRNNAGGTTAGAAAGGAMPMGMGMGAMGGMGGMGGMGGMGGMGMGGMGMGGMGMGGMGGMGGMGMGGGMNRMGNTRQIPNAPRGPAAMRGPGQQPMGGAGNAPQGGGPGAQRYSTQGNARARPY

SEQ ID NO: 57841 - protein, 287 aa, Prochlorococcus marinus subsp. marinus str. CCMP1375
MFENENPNGSWLDEYQNDVRYGLKGKKIIEEISNFQKITIFESNRYGKALLLDNCWMTAEYQEKQYHECIVHPALCGSKEINKVLIIGGGDGGSARECLKYQELKNLDLIEIDKRVVELSQQYLSVIGGNCWKDQRLNLKLTNGINWVKDAKDNSYDVIIIDGSDPKGPAKGLFNKDFFKDCHRILKPDGVLGAQTESPESFEDIHINTVKMIKEVFKYADPLYGYVPIYPSGIWSWTFASIKKPRHLYPIISRANTISKTCQVWSPRWQRGGFDAIPANIERKLQQ

SEQ ID NO: 57842 - protein, 282 aa, Psychrobacter arcticus 273-4
MMTLPAWLTAVNFNADGLIPAIAQDHESGRILMMAWMNAESLQLTADTQTAVYFSRSRAKLWHKGESSGHTQRVHDIRLDCDADVIVLSVTQAGGIACHTGRESCFYQRLDLSGQTPEWQTVDKVIKDPAEIYHSNEVANPPPTNDATAHNSVSFDADANQAKADKTSILQQLDRVLAERKQADADSSYVASLYDKGLNKILEKVGEESTESIIAAKDFANCDENIDKSQYDEARSELIYEVADVWFHTLVGLAWFGIESDAVLNELGRRFGLSGIDEKAAR

SEQ ID NO: 57843 - protein, 530 aa, Oryza sativa (japonica cultivar-group)
MAGGVVVNNGGGKDYPGKLTMFVLFACIVAATGGLIFGYDIGISGGVTSMNPFLIKFFPSVYRKEQAAEKNQSNQYCKFDSPLLTMFTSSLYLAALVASFFASTVTRVAGRKWSMFGGGVTFLVGAALNGAAKNVLMLILGRVLLGVGVGFANQSVPLYLSEMAPARLRGMLNIGFQLMITIGILCANLINYGTAKIKGGWGWRVSLALAAVPAAIIAVGALFLPDTPNSLIDRGHTDAAKRMLRRVRGTDDIEEEYNDLVAASEESKLVAHPWRNILQRRYRPQLTMAIAIPLFQQLTGINVIMFYAPVLFKTLGFADDASLMSAVITGLVNVFATFVSIVTVDRLGRRKLFLQGGTQMLACQIVVGSLIGAKFGFSGVADIPKAYAAFVVLFICAYVAGFAWSWGPLGWLVPSEIFPLEIRSAGQSINVSVNMLFTFIIAQAFLPMLCRFKFILFFFFGAWVVIMTLFVAFFLPETKNVPIEEMVLVWKSHWYWGRFIRDEDVHVGADVEMPAAGNRNGKVDPAKLAN

SEQ ID NO: 57844 - protein, 207 aa, Xanthomonas campestris pv. campestris str. ATCC 33913
MSLLIEQARYHLSAHNARQLPDDGGYEVAFAGRSNAGKSSALNALTRQNSLARVSKTPGRTQQLVFFQIQPERYLVDLPGYGYAKVPQDLQAHWQAFIDRYFRTREALRGLVVVMDIRHPLKDYDLQMLGYAAERGLPAHGLLTKADKLGRGQQMQTLQKVKKEVSSRFGDSVTVQTYSGESRQGVDELRGIVGGWLGLDVEPPADA

SEQ ID NO: 57845 - protein, 279 aa, Thermosynechococcus elongatus BP-1
MFMTQATVAKPPIAWPTATFIIFVHLGALLAFLPSMFSWQAVLLALVLHWLTAGIGITLGWHRLVSHRSFQVPKWLEYFLVFCGTLSMQGGPIWWVGLHRHHHLYSDQPNDHHDSRKGFWWSHIEWMFHEVPAEAEIPRFTKDIADDPVYRFLDRYFLPIQVVLAIVLYLWGGWPFVVWGIFVRLVTVYHTTWLVNSATHTFGYRTFETTDHSTNCWWVALLTFGEGWHNNHHAYQYSARHGLQWWELDLTWLTIRFLQLLGLAKKVRLVEAPAASCQD

SEQ ID NO: 57846 - protein, 707 aa, Oryza sativa (japonica cultivar-group)
SVQARLEEAIERGGAAVHLPQVGHGVPRRPPHRRHRVAHQPRHREHLRPQDAPHGAARPQEKYWAGFLYFAGVNFGLTFIAAMLCVVFAPTAAGPGIPEIKAYLNGVDTPNMFGAPQLIVKIIGSICAVSSGLDLGKEGPLVHIGACLANLLSQGGSGRHRLRLRWLRYFDNDRDRRDLITCGASSGVCAAFRAPVGGVLFALEEVATWWRSALLWRTFFSTATVVVVLRGFIEVCRNGRCGLFGEGGLILFDVGDVAVRYHAGDLLPVTIVGVLGGVLGALYNHVLHKVLRVYNLINEKGRAAKLALALAVCALTSALLYVTPFAVPCTPCDPAFGGACPTLGKSGNFKRFNCPEGHYNDLATLLHATNVDATRNIFSTGTAGEFRLDSLLIFFAVYCVLGLFTFGIAVPSGLFLPIILMGSAYGRVTALVLSRFARIDHGLYAVLGAAALMSGSMRMTVSLVVIFLELTNNLLLLPITMFVLLIAKTVGDAFNPSIYEIILDLKGLPFLEAKPEPWMKDLTVGELAAAKPRAVALQVVERVSTVVEALRATRHNGFPVLDRPRPGVSELHGLVLRSHLVAALRKRWFLPERRRTEEWEAREMFSSAELADKCGGVDELEISPEEMGMYVDLHPLTNTTPYTVVETMSVAKAVVLFRSVALRHMLIMPKFQGPEISPIVGILTRQDLIAHNILGAFPHLASKRKTH

SEQ ID NO: 57847 - protein, 110 aa, Zea mays
  misc_feature (52)..(52): Xaa can be any naturally occurring amino acid
  misc_feature (98)..(98): Xaa can be any naturally occurring amino acid
  unsure (1)..(110): unsure at all Xaa locations
HFSHSHDDHHHHSHGDGGGHAAGGSWVGEDGLVWLSDVGLVRDFQEPMDSPXVLTMHAPSVASRDFFDLAFTVGIGGPVSTVKTALMLALCRFLHDKXYSLAAVTEGIFT

SEQ ID NO: 57848 - protein, 278 aa, Arabidopsis thaliana
MEWGMEEYRRTLEEMERMEAAELKELEEKAETARRTGNLMEKAATIAAKRHIAAAMGSAAASMRSAWKTAAGNKCFNMGGKKTKIEIKKIINKPAKTVAFTKRREGLFRKASQLCLLSPATQIAILAAPMTSKSHASFYSFGHSSVDNVVSSLLYDHPPLTANQDNRSGLGFWWEDKRFDVSENVEELKEAVDAVSRMLNNVRCRLNDAVKSTQRDGGLEILHHQEEEVLQTRNDETKTNQTHEFEGGETSGSASWLENEDDILHFDDDFYTGIDPLF

SEQ ID NO: 57849 - protein, 512 aa, Arabidopsis thaliana
MGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAEGDRREDDTTYLAGITRPIDSSSHKQFYDGYAYHGTTFEQTYRCYPSSFIDKPQIESGDKIIMPPSALDRLASLQIDYPMLFELRNASTDSFSHCGVLEFIAEEGVIYIPYWMMQNLLLQEGDMVRVRNVTLPKGTYVKLQPHTTDFLDIANPKAILETALRNYSCLTVGDSIMVPYNNKKYFIDIVEAKPSNGISIIETDCEVDFAPPLDYKEPERPVAPAPAKGEAKAKEVDVAEAEPKFNPFTGSGRRLDGRPLSYEPQPGAANSNGQSHPVASSSSSGSEKATQQNRGKLVFGSNVERSTKETTKVGAGKDRKQEEEAEKEAKFQAFSDEEMLKLTLPADPRSTSAPSVGLNQINTKSFFHIIRRIPSAEDSMPPP

SEQ ID NO: 57850 - protein, 335 aa, Legionella pneumophila str. Paris
MNFFMMPHDLAQYAIVADIGGTFARFSRVNLVNLQMDKIEISPCAEFISLESALLTYKTRHSLQEIKHIAIAIACPVIDDLVSMTNCHWQFSITELKQRLGLEVLEVMNDFTAIAMSLPVLSTQDLVQIGNGYLDASKVRVVLGAGTGLGVAYLIPHQHHYSAFAGEGGHADWGAKTEQEWFIYRYLKSKYSHVSYERLLSGQGLENLYQALAAYHSKKVEFLSAAQIISLALNQECFIAHKAVAQFFSSLGSFAGDLALTYGAFGGVYIAGGIMPRLLSLVHQSDFRIQFEDKGRFSDFNALIPTYVIAAAQPGILGASVSLKQILTGASHVLF

SEQ ID NO: 57851 - protein, 473 aa, Legionella pneumophila str. Paris
MAWIVAIIGSIAGFLFGYDEGIIAGSLGLVKNHFNLNATHIGVMASALPFGALFGSLLIGAFMASKSVKRFGRRSLLSFAGFLFFVGALGAGFAETISMLILSRLILGLAIGMASVLTPLYLAETAAMRSRGAVVAIYQLALTVGIVCSYSVNYLLIEQQAWRAMFASSAIPALLLTLGILFMPESPRWLCSVGRHDAAANSLRKLRGKQPVEQELKDIEATLANEPKQGNWLLLFQKPLLPVLMLGTILFCLQQLSGINVVIYFAPEIFKNLGLGSTTGQILATMGIGLVNLLVTIIAILYVDKLGRRKLLLLGFAGTSLSLFALSLFSLNHVAWLSYLSVICLMVYIFSFAISVGPIPHIAMAEIFPLHVRGAGMGMSSMSNWSFNTIVIFSFPVLHQMFGIEVTFVLYAVICFLGFIYAYIYMPETRNISLEQIETYIMSGKPLRFLGREDEEVNAVSTKSESSLLASTN

SEQ ID NO: 57852 - protein, 364 aa, Psychrobacter arcticus 273-4
MSMMKSLIFIEPGKIEVAEKKIPDVGPNDALIKITTTTICGTDIHIFKGEYPVAKGLTIGHEPVGIIEKLGSAVMGYQEGQRVIAGAICPSFTSYASQDGFPSQDGGYIQPDGTCACHGYKATGGWRFGNIIDGTQAEYVLVPDAQANLAPVPDGLTDEQVLMCPDIMSTGFKGAENANIKIGDIVAIFAQGPIGLCATAGAKLRGASTIIAIDGNNERLAMSKKLGADITLNFKEVDVVDEIMKITGGRGVDSSIEALGLQSTFEQGIKVLKPGGTLSSLGVYSADLKIPMAYFASGLGDHTIRTALCPGGKERMRRLLNVVESGRVDFSEMVTHTYALDDIVEAYDLFMHQRDGVLKIAIKP

SEQ ID NO: 57853 - protein, 294 aa, Psychrobacter arcticus 273-4
MCIVAIAWQLFDELPLVLLSNRDEFLQRPTEALHQWLDKPIYAGRDSQGGGTWLGIHQQPMSPSRQTTDSQNDNANNSQHECYHQNGRWAAVLNFRDGVQASTNERSRGVLVTDFLTSTLSPIAFARQINLQDYAGFNLIVGDAKQAVIVNNRGHAPTPLYAGLHVFSNGQPEEAWFKTERLRARFRQEVLPLISEDGIPEYWQDAAFAVLSDTTPAPTDELPDTGVDIDLEHALSAIYIEPVALTGLKVTMPIYGTRTQSILTVSHDAQSTSSQANYTARLNSRAYRHHISNQ

SEQ ID NO: 57854 - protein, 506 aa, marine gamma proteobacterium HTCC2080
MIPSIGHIPAAAAKKFGDKTALVLPERSLSFNDLEKLSNNFANALVTLGIQPGDRVTLYSGNCWEWVVSYYGALKTGAVINPINVMLTPSEVEFVANDCGASIVIASHEKALSLKSVKENAQVRELIAVGDAALPEGMLSFNELLAAGSDAFQIPDIDPDSLSTIGYTSGTTGHPKGACLSHRSIVLNVAMTALMHQRSDHDTVVTALPCPHVYGNVVMSGAIQNGMTLVLHPSFEEQTILKSIQEHKATLFEGVPTMFMFLLNHPDFNQYDLSSLRCCTVGGQTMPKPKMEEVEARFGCPLIELWGMTELGGLGSTFAANGPVKHGSIGVALPYTEARIAHPENANETLPVGEVGELMVKGGIVMLGYYGNEQATRDTIEPDGWLHTGDLASMDDDGCIFIVDRKKDMILTAGYNVYPAEIERVVAGHPDVALVAVGSIPDEEKGELAKAYIVPKVGATPSADNVIAYCREHLAAYKVPRAVQFVDDLPKTSTGKVMRRELKTLD

SEQ ID NO: 57855 - protein, 788 aa, Oryza sativa
  misc_feature (141)..(141): Xaa can be any naturally occurring amino acid
  unsure (1)..(788): unsure at all Xaa locations
MEEEQSPRLAAGEPERKLEDGVTDAEDPGCTGNAAMSSLEQPLLKRSNTLTASHLAMVGAKVSHIESLDYEIIENDLFKHDWRRRSNVEVLQYIFLKWAMAFLVGLLTGVIASLINLAIENISGLKMLHMFLMVKNLPSAXKRYWAGFLYFAGVNFGLTFIAAMLCVVFAPTAAGPGIPEIKAYLNGVDTPNMFGAPQLIVKIIGSICAVSSGLDLGKEGPLVHIGACLANLLSQGGSGRHRLRLRWLRYFDNDRDRRDLITCGASSGVCAAFRAPVGGVLFALEEVATWWRSALLWRTFFSTATVVVVLRGFIEVCRNGRCGLFGEGGLILFDVGDVAVRYHAGDLLPVTIVGVLGGVLGALYNHVLHKVLRVYNLINEKGRAAKLALALAVCALTSALLYVTPFAVPCTPCDPAFGGACPTLGKSGNFKRFNCPEGHYNDLATLLHATNVDATRNIFSTGTAGEFRLDSLLIFFAVYCVLGLFTFGIAVPSGLFLPIILMGSAYGRVTALVLSRFARIDHGLYAVLGAAALMSGSMRMTVSLVVIFLELTNNLLLLPITMFVLLIAKTVGDAFNPSIYEIILDLKGLPFLEAKPEPWMKDLTVGELAAAKPRAVALQVVERVSTVVEALRATRHNGFPVLDRPRPGVSELHGLVLRSHLVAALRKRWFLPERRRTEEWEAREMFSSAELADKCGGVDELEISPEEMGMYVDLHPLTNTTPYTVVETMSVAKAVVLFRSVALRHMLIMPKFQGPEISPIVGILTRQDLIAHNILGAFPHLASKRKTH

SEQ ID NO: 57856 - protein, 490 aa, Xanthomonas campestris pv. campestris str. ATCC 33913
MPRFPDQLLYIGGRYVPARGGHTFEVVNPATGEVLANVHNADADDLDAAVDSAKAGQRHWAALTVVERSRILLRAVALLRERNDALAELETLNTGKPLSETRSVDIVTGADVLEYYAGVAQALQGVQVPLREGSFFYTRHEPLGVVGAIGAWNYPIQIALWKAAPALAAGNAMIFKPSEVTPLTALKLAEIFTEAGLPDGVFNVLPGDGASVGHALTEHPEIEKISFTGGTATGRKVMASASSSSLKDVTMELGGKSPLIVCADADLDLAADIAMMANFYSSGQVCTNGTRVFVPRALRTAFEARLLARVQRIHIGDPLDERTTFGPMVSAAHMQRVLEHIEQGKAEGARLLFGGERLRDGALAQGCYVAPTIFSDCTDVMTIVREEIFGPVLSLLTYDDEDEAITRANATSYGLAAGVVTPDLSRAHRLIHRLEAGICWINTWGESPAPMPVGGYKQSGVGRENGLATLQAYTRTKSVQVELERYASVF

SEQ ID NO: 57857 - protein, 352 aa, Alkaliphilus metalliredigenes QYMF
MDKVDLLSLTMEEMESLFLEIGEKKFRAKQAFQWVNKGIKQYEEMTNLSKKLIKQLSEETRITHNRIEEKFVSKIDGTVKYLFLLDDGHIIEGVLMKYKHGFTACISTQVGCAMGCQFCASTTGGLIRNLRAGEMIDQILLMQQDQGERISNIVLMGSGEPLHNYDETIRFLKIVNDPEGLNIGNRHITLSTCGLVPEIKKLGALQIPINLAISLHAPNDQLRKQTMPIAQKYTIDQLIQSCYDYLENNNRRITFEYALIEDVNDGEKEAHELSKLLKGLLCHVNLIPINPIEERTYQKSKDSQVKKFQQILKSNGIEATIRREMGTDIQGACGQLRRKYVDDQEKKEISEV

SEQ ID NO: 57858 - protein, 301 aa, Zea mays
METSKSPQSSKNSHIVVPSDSNGPRFDNDGFSSEAASNQMVVFNSEAGDKEQDELGENRLQKSIITRGISPSIGAFTVQCAKCFKWRLIPTKEKYEEIRERIIEEPFVCKRAREWRPDVTCNDPEDISQDGSRLWAIDKPNIAQPPRGWERQIRIRGEGGTKFADVYYTSPTGRKLRSLVEVDRFLQENPEYGAQGVTLAQFSFQIPRPLRQDYVKKKPKLINPSDEASMIASKSFQPEEVKPIAWAVATKHEGDASEEASLTDEAPTSEVMLARKRKAGSSLSIEPNHLSDELEPKLEDA

SEQ ID NO: 57859 - protein, 374 aa, Carboxydothermus hydrogenoformans Z-2901
MKIVIVGGGIAGVSAAAAAREVSDTAEITLISAEKYYPYYRLKLSEYLSGELKEESLLLHPPSWYEERKIKVILGKKVTGARLESRELTLHDGTVVPFDRLILTTGSYAFKPPVSGGDLPGVYTLRNLDDLKAIRDRAEKARRAVVIGGGVLGLEVAYYLGKRGVWVGVVEHNDRLLPRQVDEEGSKILSRAAQEAGVELYLARDVDRIEGIEQVEKVVFKDGSSVATDIVVFSTGVRPYLEVANMLTLGINRGIIVDKYMATSRENIYAAGDVAEFEGQMPGIWPVAMEQGKVAGANAAGASKIYTPIPPQNVLKVFGKTVFSIGTVMGEGVTSRREDRGDNFLKYYYKDEKLVGALLIGDVKLVNEVRKLFS

SEQ ID NO: 57860 - protein, 382 aa, Thermosynechococcus elongatus BP-1
MVACEFSPGLDGIPVAQSAISYVDGQAGILEYRGVPIQELAEKSTFLETAFLLIWGYWPNREELAAFEHDITYHRRVKYRIRDMMKCFPESGHPMDALQASAGALGLFYSRRALEDPEYIRAAVIRLLAKIPTMVAAFQLIRKGNDPVMPCDELDYAANFLYMLNERRPDPFAARVFDICLILHAEHTMNASTFSARVTASTLTDPYAVVASAVGTLAGPLHGGANEDVINMLEEIGSVENVRPYVEKCIQNKIKIAGFGHRVYKVKDPRATILQKLAEQLFDKFGGDRYYDIALKLEEVVGEYLSYKGIYPNVDFYSGLVYRRLGIPSDLFTPVFAIARVAGWLAHWKEQLEANRIYRPTQVYTGAHNQPYVPMEERNHRP

SEQ ID NO: 57861 - protein, 505 aa, Thermosynechococcus elongatus BP-1
MKPTFPAIVTTAEMQAIEGAMFNGGLPIPALMEKVGQRLSHYLQAHFPTSQYPRVAVLAGPGHNGGDALVVARELWHRGYQVKLWQPFERLKPLTADHARYARFLGLPFVERVEALQEVDVIVDGLFGFGLERELTGELAHAIDEINTWPQPRVSIDVPSGLHSDTGAVLGTAIRADRTLCLGLWKRGLLVEEAQPWVGQGVLIPFDIPSVVIETALASAPRRYCLDDSCWQALPLSRSPITHKYQQGQLLLIGGSGQFGGSILLSALAARCTGVGMLVVAVPQSLKSLVLSRVPDAIVVGCPETPRGAIARLPEGLELGKFSAIACGPGLTPEAVSVVATVLRAETSLVLDADALNILATLSPWPLPSGTILTPHYGEFRRLFPDLVGTAGDRLDQVIAAARWSNAIVLLKGARTAIASARGDLWINPHSTPALARGGSGDVLTGLIGGLLAQQEALRATYGGVWWHAQAALEAEQQATSLGVYPEQLIAHLLPTLRRALAARV

SEQ ID NO: 57862 - protein, 478 aa, Nocardia farcinica IFM 10152
MLDPGAYSANNLINGELVAAESGRLLDVLEPATGEVLARVPASGKEDVDAAVTAATQAFRSFRRTTPGERAEMLLTLAAKIEEHAEHIAMLESRNVGKPLPVARDEVAFAVDNLRFFAGAARTMEGRAGGEYLRGYESYIRREPIGVVAGIAPWNYPLLMATWKIGPALAAGNCSILKPSRQTPLTALYIAALAQDVFPAGAFNVLSGSAADIGDHLVADRRIGLVSLTGDTSTGRHIAEVAAAHVAQTHLELGGKAPVIVLDDADLGAVVAGIATAGFANSGQDCTAACRVIATPGIYDRLLEALVPAVQAIRVGDPQAGDDIDMGPLISAAHRQSILDVLAKTDGTILAGGKALPGNGFFLEPTVVANPSQADVLVQTEQFGPVVTVQRADDIDQAFEWANDVEFGLASSIWTQNLNHAARAVRDLDFGCVWVNDHMPVLSEMPHGGFKQSGYGKDMSIYALEEYTRIKHVMTKTN

SEQ ID NO: 57863 - protein, 515 aa, Nocardia farcinica IFM 10152
MTHAFSALTPVRFLDRAASVHGERTAVVDGPRTLTYRELHDRCRSLAGALVDRGVQPGDRVAVLSHNTLEMLEAHYGVPYAGGVLVPLNARLSATEIAFILDHSGARVLIATDPLTSLALEAVALTPGPMTVIAGAEEYEAIVASGAPVDISSHDELAPIAINYTSGTTGKPKGVVYTHRGAYLQSVAMAFHSGMDLNSVYLWTLPMFHCNGWCFTWAVTAAGATHVCLPKVEADAIWAAIGDAGVTHLCAAPTVISTITSDAPTTTSPRRVWVATGGAPPAPALLARARRCGLDVTHLYGMTETYGPAVINEWDRAWDAAPEAERDRLNARQGVGNIITGGVRVVDEAGGDVPADATTIGEIVLRGNNVTAEYYRDPAATAAAVSDGWFRTGDLAVRHSDGYIEIRDRAKDLIISGGENISSIEIERAILEHPAVLEAAVVRVPHEHWGERPAAFVSLRPGAELSSGELRAHLLDRLAKFKVPDRIEFATLPKTATGKIQKFQLEQQLIARPPD

SEQ ID NO: 57864 - protein, 392 aa, Shewanella sp. MR-7
MNEVLLQIKALTNSDPLLTAVIVGVLTFTLIGLIGYILKDVPAKLLNWLSSLLFVRLTIDDSHQARTEIFNKLSFLISNTTIPFFSRSISEAVYFDYGVNYDGRVSVKSIGYGMHLFKYDSCFMLATRTKVDSTMAYDSITVRAPWWAKDKLHSFLEDTRGDISTEPKVNIFEDTEWCRYGTLKSSGFSDLVLDEGFKQELMREVDNFASRGKSVVSKLTILLHGKTGTGKTGIARALAVEYHRDLYILNLSTVNDATIHKAIRKVAPGAMLLIEDCDCVKATVSRAAESNVDNPPLTLGGVLNALDGIIPLDDCLVIMTTNHLDHLDPALIRKGRVDVSMEVPLISAKQVNEDYFERFGAVLNRTEPLLGCEVYELHRRAKLRYGRVHHSM

SEQ ID NO: 57865 - protein, 360 aa, Solibacter usitatus Ellin6076
MQRILGIESSCDETAAAVVEDGERVLSSVVASQMSTHGRYGGVVPELASREHLRAIVPVVREALERSATRLEDLAAIAVTVGPGLVGSLLVGLTYAKSLSLASGVGLIGVNHIEGHIHAVILEARRDGTPVEFPALALVASGGHTHLFEVREDFTYRLLGKTRDDAAGEAFDKVGKLLGFGYPGGPVIDRLAPHGDPLAVRFTFAKMKGNALDFSFSGLKTAVLRWVEAHDMEAEIAARKALVRDNPSPDLDQWLAVTPKRTLDLAASFQHAVIHELLTRAAASAERIGARSLIVSGGVACNSGLRSAAYASRLPYAVHFPSFGLSTDNAAMIAAAAFPKLARREFSGLDIAAQANLTLA

SEQ ID NO: 57866 - protein, 498 aa, Zea mays
MAVVDRWAGLGSALASFLFLWSMVQRHVPVTISHRVATWANKLVSYFNPYVEITISEYGAERFRRSDFFLAAEAYLSDACAPRARKLKAELGRDSSNLQVSVGDNDEVTDAFQGATVWWYVVKKLPRSNVISLYANQDDPRTYRVVFHRRHRDLVVGKYLPHVLKEGRAVTVRNRQRRLFTNNPSGGGRGRGDVWSHVPFEHPSTFDTLAMDPDDKEAVVDDLEAFREAKDYYTKVGKAWKRGYLLYGPPGTGKSTMIAAMANLLDYDVYDLELTAVNNNTDLRKLFIETTGKSIVVVEDIDCSVDLTGKRKDKKQADKKSEREADDKPKLPMEPDKDEGSKITLSGMLNFIDGLWSACGGERIIIFTTNHKDKLEPALIRRGRMDRHIEMSYCRFPAFKVLAKNYLDVEEHELFDQIGQLLEETDMSPADVAENLMSMSKKKKRDANACLESLVKALKQAKEEAAKAKVEAEAKKKVEAAAEAATSKEEDEAKEGSG

SEQ ID NO: 57867 - protein, 357 aa, Nocardia farcinica IFM 10152
MTVTAQAPAPAQAPAALSVAERLQRAAFTALGSIPGGLLRRIAPRVVNADGDVLAPEIALLLKATASAPDFSDGTPEQARAIVANDSRVFADKAPAGVRVEPEIVLPTGLRATMYRPAVPSNALVLFLHGGGFVLSSRQDYDVPVRLIADGAGVNVLSVEYGLAPESPFPGPVDDAVTAWRFAVEHCAQWGIDPARIVLLGDSAGGNLCAVLANIVAGEQVRPFLQVLMYPVVDAVGNYASRKEFADNAALSAKQIDWLTDLYLPDRTYALDPRVSPILAEDLSGAPPTLITVAGFDPLRDEALAYAARLEEAGIPVRVFRESGLVHGYVSMTRISPTARAALDRVTDAVRTALEES

SEQ ID NO: 57868 - protein, 429 aa, Nocardia farcinica IFM 10152
MALESSRTAFERARRSVGGGVGSGLRAAMRPHPLFVREARGAHLWDLDGDRYVDYVMAWGPLVLGHSDPRILSAVSEAATKMQVVGTGHALEYLAAEAVLDAVPHGERLLWSNTGTEAVQVALRLARAATGRRRVLKFAKSYHGWHDTVYAGMSEDDSDRPARPGSKGQSPSVLDDLVVARFNDIHLAERLLRESVERDIAAVLIDPVMSNAGVEAPAPEFLSTLRDLCDRHGVVLVFDEVIAGFRIARGGAAEKYGVLPDLSVYGKAMAGGFTQSAVVGRADLVDQVTTGVTHAGTFNANPIALAAVEATMRVLADPDVYEALETISAEFHSVVGAVLGSVPGSGSFNRVGSLLQYVPAGGTTGLHGTGGLWTTIMEGMLRRGFLFMPSGKIFLSTAHTTADIEATAAALLHVISLSSSRDGSDRTLD

SEQ ID NO: 57869 - protein, 130 aa, Psychrobacter arcticus 273-4
MSNKHPLVQVIENAQLIERPSFAPGDTVVVQVKVREGERERLQAFEGVVIAKRNRGLNSAFTVRKISSGVGVERAFQLHSPIIDSIEVKRRGAVRRAKLYYLRERSGKSARIREKLAPRAPKVVKPKADA

SEQ ID NO: 57870 - protein, 314 aa, Rhodococcus sp. RHA1
MALDAHAAELIAGLQAQGLKAFEHSTVEEARAVVATFAGLQAPPEPVARVEDAHYESGGAQIALRVYVPEGRAPHPVVLYFHGGGFVAGDIDVVDEPARAVANGAGAIVVAATYRRAPEHRFPAAADDAAAALQWVADNVASYGGDPGNVVVMGDSAGGNLAAVTALRARDEGGPRLRGQVLIYPVIDPNADLPSRQEFAEGYVIGAGDLDWFWSNYLSSPEDAKHPYAVPSRAAGFEGLPPALVLTTENEVARDEAEAYAESLRQAGVDTEAIRFDGLIHGSFWMSGVVPRSAEMRSAVVEFVKRVTATAPVV

SEQ ID NO: 57871 - protein, 146 aa, Solanum tuberosum
MPRSRFAGSLISPKVDVYIDMGNPFLNHTVDAFLNIGTVAATKTVAEETYGMVTRGSVSSHNFEKSLKKMCKEGAYWGTVAGVYAGMEYGAERIRGTNDWKNAMIGGALTGALISAACNNNRDKIVMDAITGGAVATASEFLNYLT

SEQ ID NO: 57872 - protein, 177 aa, Glycine max
MLPNNPSTIVPDAVARHHTHVVSPQQCCSAVVQEIAAPVSTVWSVVRRFDNPQAYKHFVKSCHVILGDGDVGTLREVHVISGLPAAVSTERLDVLDDERHVIGFSMVGGDHRLFNYRSVTTLHPRSAAGTVVVESYVVDVPPGNTTEDTRVFVDTILRCNLQSLAKFAENLTKLHQR

SEQ ID NO: 57873 - protein, 459 aa, Saccharomyces cerevisiae
MPSNVRSGVLTLLHTACGAGVLAMPFAFKPFGLMPGLITLTFCGICSLCGLLLQTRIAKYVPKSENASFAKLTQLINPSISVVFDFAIAVKCFGVGVSYLIIVGDLVPQIVQSIFYRNDDNMSGSQEHHMFLDRRLYITLIIVFVISPLCFKRSLNSLRYASMIAIVSVAYLSGLIIYHFVNRHQLERGQVYFMVPHGDSQSHSPLTTLPIFVFAYTCHHNMFSVINEQVDKSFKVIRRIPIFAIVLAYFLYIIIGGTGYMTFGENIVGNILTLYPNSISTTIGRLAMLLLVMLAFPLQCHPCRSSVKNIIIFIENFRKGKLYDNRASFIPLDNFNSEDPQEAPTQQNNEEPNLRSESLRHINIITLCILLFSYLLAISITSLAKVLAIVGATGSTSISFILPGLFGYKLIGSEFTGTNERVPTSIKIFKYLSLSLFIWGIAVMVASLSAIVFLGTSSH

SEQ ID NO: 57874 - protein, 1380 aa, Burkholderia thailandensis E264
MSKHRQAPGPRGSLVMGNLAAYKRNPITMLLRLHQQYGDVARNRLGPFVTHALAHPDHIQYVLQENHRNYVRGRFYDNFKMFFGDGLLTTDGEFWRRHRRAVQPLFHKKQVDAHTAAVGDAALALAHRWSALPPGKAVDVVEEMMHLSLRMLGLMVFNTDVSSHAEAVGPAVRFGIEAMMPQGNMNDFIPRWAPTRFNRRIAHARRAIDTIIAKIIADHREARCEPSDVISLLLNARDPDTGAPMTQQEVHDEVMTVFLAGHETTGAGLAWALYALAQHPAVLRQLRDELDARLGGRAPTVQDFEQLPYLSQVVDEVLRVYPPIWGFTRDLVEDDEIGGYRIPARSSVFMSPYVTHRHPAFWRNPDAFDPENFASDAPARHRFVYFPFGGGMRKCIGFQTALLQMRVLVAVVAQHFDLNALPGHPIELGAAISLRPVHGIRLIVKPRERQQSHLARVREHESARALRPLGDTAEAAGAVCPMTDAAHEICVSADAAMVEAGAPGDANAGGAAAAVERAAARQHEPAAAAPLPFATSAATGAPPAASPVAAAAAGASARSVPAWRFTWRPVPVDPVPDEPSPALSGKRIALVNGRGGTIERVAAALARTCAKVSVFAPAANADHAEAARAFVNEAGPLDGIVDLGLEAPFALDDASAWEAPMRRTVELLKACYGDWAAEDDTSRLFYVALTWMDGQMGYGDDAGAQPLGGLWAGLAKTLPQELPNCNVRVLDIAPDETGRVDRLVVNELYRWGLFEVGYRNGVRYTLHAKRDELPPLAVDARAALGPGDTVLFSGGARGIGLLCARALAERHGCTVLVTGRETPPDGGEPWMALDEAGFKRYGLEQLRAATPERPPKAIRASLQRLKHRRELKAALDEMAALGLPVHYRVCDVTDRAAVRALCDELGDSLRIVIHNAGVDQPVRLIQKRADDFAHTVRTKVLGFANLCDAVRARPRLAQFCNVGSLTGRWGGMTGETDYAAANEALARLGLWAAKHALPPACGVKTLVWPTWEGVGMITNFAVTQRYVSPMNVEEGVRHWLRELASPGGGEVMFMGAVGRAPTPVQIKGFQPIRELPNIGELVTRRHHVGEPVRFRPFKRFEGRYAIDPAVAPYARAFRFNGRAVLPASLVLEHACAVGDWVMPPTGEPRELSEMTNVVLRLDALPDVPAGDAPVEIASEAAGYMIGDVWCVDVRCSDARTQAELLSMTLVYRPQPEQIGAAYARAPDTKPEPAPLTSAPHAAWDGELLPAGDWSVPDDASAGIVRIGRVPPAAVLSLWTLPFPLELRLPVNHVEHVLRVLLAEWGAAQTDAPSVWRIGAAKLARLPAASADGVVEYATGRFAVLDARGYVLLRVDDTRVDSDAAHAAPAETVALADPLTA

SEQ ID NO: 57875 - protein, 211 aa, Mycobacterium bovis AF2122/97
MANTDRPALPHKRAVPPSRADSGPRRRRTKLLDAVAGFGVTLGSMFKKTVTEEYPERPGPVAARYHGRHQLNRYPDGLEKCIGCELCAWACPADAIYVEGADNTEEERFSPGERYGRVYQINYLRCIGCGLCIEACPTRALTMTYDYELADDNRADLIYEKDRLLAPLLPEMAAPPHPRAPGATDKDYYLGNVTAEGLRGVRESQTTGDSR

SEQ ID NO: 57876 - protein, 534 aa, Oryza sativa (japonica cultivar-group)
MADAATTPLLTSHEAKPAKALSIDDAIETYIGATGARQLLTAMLLAFAWAFEAQQVFMSVFTDAEPTWHCTGVAAGDPGSFCSLAAASASASACALPPGTWEWDRPAETSVVSEWALKCGGGGPALVSLPASSFFAGNLAGGFLLTTLADTLLGRRKMLVLSLVTMSVAGVLTVFSPNVWVYAALRFVCGFCRSTAGTSAMVLSTELVGKWWRNTVSVAAFVFFSVGFMSLPALAYTLREASWRNMYVWTSLPSLCYAVLLYFLVQESPRWLLVRGRKQEAIAALRQIASLNGGEGITTSSFTKLETCAGEVGDGVAGGEGMFSTLRSICERRWALRRLAAITTATFGVGVVYYGMPLSVGSLSSDLYLSVAYNAAAELPSSVLSWLLMGRFNRRSSLVALTAASGLCSLACVVIPDPEAGAGGSHLRLAAELASFFASCAAYDVLLMYSIELFPTSVRNSAVGLVRQAGVLGGVVAPMLVALGRERSYWSFGVFGLTVGCLGLFVTFLPETKGRRLSDTMEDEEEAAAVLSGG

SEQ ID NO: 57877 - protein, 666 aa, Bacillus cereus E33L
MSHSIEQLSINTIRTLSIDAIEKANSGHPGMPMGAAPMAYTLWTQFMKHNPNNPTWFNRDRFVLSAGHGSMLLYSLLHLSGYDVTMDDLKNFRQWGSKTPGHPEYGHTAGVDATTGPLGQGIATAVGMAMAERHLAAKYNRDAYNVVDHYTYAICGDGDLMEGVSAEASSLAAHLQLGRLVVLYDSNDISLDGDLNRSFSESVEDRYKAYGWQVIRVEDGNDIEAIAKAIEEAKADEKRPTLIEVRTTIGFGSPNKSGKSASHGSPLGVEETKLTKEAYAWTAEQDFHVAEEVYDNFRKTVQDVGETAQAEWNTMLGEYAQAYPELANELQAAMNGLLPEGWEQNLPTYELGSKAATRNSSGAVINAIAESVPSFFGGSADLAGSNKTYMNNEKDFTRDDYSGKNIWYGVREFAMGAAMNGIALHGGLKTYGGTFFVFSDYLRPAIRLAALMQLPVTYVFTHDSIAVGEDGPTHEPIEQLAALRAMPNVSVIRPADGNESVAAWRLALESTNKPTALVLTRQDLPTLEGAKDDTYEKVAKGAYVVSASKKETADVILLATGSEVSLAVEAQKALAVDGVDASVVSMPSMDRFEAQTAEYKESVLPKAVTKRFAIEMGATFGWHRYVGLEGDVLGIDTFGASAPGEKIMEEYGFTVENVVRKVKEML

SEQ ID NO: 57878 - protein, 1499 aa, Candida albicans
MSTANTSLSQQLDENPWVDASDNSSVQEYQGFDATASHNIQDLARKLTHGSTNGDHHSANDLARYLSHMSDIPGVSPFNGNISHEQLDPDSENFNAKYWVKNLKKLFESDSDYYKPSKLGVAYRNLRAYGIANDSDYQPTVTNALWKFTTEAINKLKKPDDSKYFDILKSMDAIMRPGELTVVLGRPGAGCSTLLKTIAVNTYGFHIGKESQITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSATILDTTPLIAIYQCSQDAYELFDNVVVLYEGYQIFFGKASKAKEYFENMGWKCPQRQTTADFLTSLTNPAEREPLPGYEDKVPRTAQEFETFWKNSPEYAELTKEIDEYFVECERSNTGETYRESHVGKQSNNTRPSSPYTVSFFMQVRYVIARNFLRMKGDPSIPLISILSQLVMGLILASVFFNLRKSTDTFYFRGGALFFSVLFNAFSSLLEILSLYEARPIVEKHRKYALYRPSADALASIISELPVKLLMTMSFNIVYYFMVNLRRTAGNFFFYWLMCASCTLVMSHMFRSIGAVTTTIATAMSLSTVFLLAMIIYAGFVLPIPYILGWSRWIRYINPVTYIFESLMVNEFHGREFECGQYIPSGPGFENLPVENKVCTTVGSTPGSTVVQGTEYIKLAYQFYSSHKWRNFGITVAFAVFFLGVYVALTEFNKGASQKGEIVLFLKGSLKKHKRKTAASNKGDIEAGPVAGKLDYQDEAEAVNNEKFTEKGSTGSVDFPENREIFFWRDLTYQVKIKKEDRVILDHVDGWVKPGQITALMGASGAGKTTLLNCLSERVTTGIITDGERLVNGHALDSSFQRSIGYVQQQDVHLETTTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDKLLFLQKGGRTAYFGELGENCQTMINYFEKYGADPCPKEANPAEWMLQVVGAAPGSHAKQDYFEVWRNSSEYQAVREEINRMEAELSKLPRDNDPEALLKYAAPLWKQYLLVSWRTIVQDWRSPGYIYSKLILVISSSLFIGFSFFKSKNNLQGLQSQMLAVFMFFVPFTTFIDQMLPYFVKHRAVYEVREAPSRTFSWFAFIAGQITSEIPFQIVVGTISYFCWYYPVGLYANAEPTDSVNSRGVLMWMLLTAFYVYTSTMGQLAISLNELIDNAANLATTLFTLCLMFCGVLAGPNVIPGFWIFMYRCNPFTYLIQAILSTGLANAKVTCAPRELVTLKPPMGETCSSFIGPYTEAAGGYFSTNSDGTCSVCRIDSTNQFLESINALFSQRWRNFGIFVAFIGINIILTIFFYWLARVPKGNREKKMKK

SEQ ID NO: 57879 - protein, 638 aa, Oryza sativa
MRSSWADSAANAEESAPAAAANHGNSRLPRSSYVPPHLRGQAAPAAPAQAGALPSAAAAAQPSVGQPGVVGGPRWAGIVNGGGGGGGGSVGGSRPGFGAGGRGGGGGGGGGAWNSRPGGWDRRDREPDPFANSEAAEVDFEGENTGINFEAYEDIPVETSGHDVPPPANTFAEIDLGDALNENIRRCKYVKPTPVQRYAIPISIAGRDLMACAQTGSGKTAAFCFPIISGIMRSRPPPRSRGSRTAYPLALILSPTRELSVQIHEEARKFAYQTGVKVVVAYGGAPITQQLRELERGVEILVATPGRLMDLLERARVSLQMIKYLALDEADRMLDMGFEPQIRKIVEQMDMPPRGERQTMLFSATFPKEIQRMASDFLADYIFLAVGRVGSSTDLIVQRVEFVLDADKRSYLMDLLHAQRANGTHGKQALTLVFVETKRGADALENWLYNNGFPATSIHGDRTQQEREYALRSFKSGATPILVATDVAARGLDIPHVAHVINFDLPNDIDDYVHRIGRTGRAGKSGLATAFFNESNTPLARPLSELMQEANQEVPQWLERYAARSSFGGGGGRNRRSGGGARFGGRDFRRDRGSGGGGYGGGGGGYGGGGYGGGGGGGGYGGGSSYGGGGQGFSSAWD

SEQ ID NO: 57880 - protein, 358 aa, Zea mays
  misc_feature (90)..(90): Xaa can be any naturally occurring amino acid
  misc_feature (253)..(253): Xaa can be any naturally occurring amino acid
  unsure (1)..(358): unsure at all Xaa locations
MSAYCGKYKDELIKNAAYIGTPGKGILAADESTGTIGKRLSSINVENVEENRRALRELLFCCPGALQYISGVILFEETLYQKTKDGKPFXVDVLKEGGVLPGIKVDKGTIEVVGTDKETTTQGHDDLGKRCAKYYEAGARFAKWRAVLKIGPNEPSQLAIDLNAQGLARYAIICQENGLVPIVEPEILVDGPHDIDRCAYVTETVLAACYKALNEHHVPPWRVPLLKPNMVTPGSDSKKVTPEVIAEYTVRTXLQRTVPAAVPAVVFLSGGQSEEEATRNLNAMNKLSTKKPWSLSFSFGRALQASTLKAWAGKVENLEKARAAFLARCKANSEATLGTYKGDAAADTESLHVKDYKY

SEQ ID NO: 57881 - protein, 110 aa, Oceanospirillum sp. MED92
MSDVLTQLGEVLEQRKGASPDSSYVSSLHAKGLNKILEKVGEEATETILAAKDAETSGDNKDVIYETADLWFHSLVALSHLGEKPQVVLDELARRFDLSGLEEKASRNKK

SEQ ID NO: 57882 - protein, 1581 aa, Arabidopsis thaliana
MSVIRPSPIPIPRCRSQVEDTAIESTARSPEAAGGKMVVELVGAFNEVTERMNSVWLSTSSSRLLFKALKLSIPILQSLPLASDGRSPLSKALSLSIILADLQMDAEVISASILSEVVDANAISIYEVRDHIGTGTAHLLHEIFRVKNIPFKVDVLDDETAASLRKFYLTYYDIRAVIMDLVSKLDEMRHLDHLPRYRQQILSLEVLKIYSPLAHAVGANHLSLELEDISFRYLFPCSYIYLDSWLRGHENGSKPLIDVYKEQLHRSLKDDLVLAEMVNDVYIKGRYKSRYSMMKKLLRDGRKPEEVNDVLGLRVILMPNSVVNDVEVGEKACYRTSEIIRSLWKEIPHRTKDYIARPKENGYRSLHMAVDVSDSDQIRPLMEIQIRTMDMDGSANAGTASHSLYKGGLTDPKEAKRLKAIMLAAADLAAIRLKDISSNKHQSFKTTTNQRDRVFCLLDKNGDGMISIEELMEVMEELGAPGEDAEEMMQLLDSNSDGSLSSDEFDTFQKQVEFMRKWEDRDNEYKSLLDEKLHDLPHQDTTALVRSFFIPCEIAMMTLQSSPMSVLTEDLVEDILSRVPATSLVRLRSTCKQWNAILNDRRFIKKHFDTAEKEYLDMLLRSLRVSSMSVNLHGLHDNIDPSIELKRELNLKGLLCNSGKVESFEVFHCNGLLLFTNTSTIVVWNPCTGQTKWIQTESANTRYHKYALGYENKNLCRDYKILRFLDDGTNFELEIYEFNSSSWRVLDSVEIDFELDIGSQGMSVKGNTYWIVIDDHEVDGELVNCFLTSFDFTRERFGPHVCLPFQTSWYSDVISLSSVREERLSVLFHEEDSLTMEIWVTNDITDTIVTSWSKFLRVDLYTHRFYNGVTFFIDEENKAAVFSEDVPDDSDDIHSIVYIIGQDRLRIVDLEDGPFWPQMFCYVPKDLVEEILSRVPAISLKRLRYTCKQWNALFNDQRFSKKHRDKAPKTYLGLTLKDFRIYSMSSNLHGLLHNNNIDLLMEFKDSWFGTPVPVKPGGSNAGIVGCVIPLLLDMTTARQQFEYEIFEFSSNSWRVLDVNPNCIIEETFQKLPLPFHIFDYNDSRALSAFREEQLSVLHQSFDTEKMDIWVTNKIDETTDWSWSKFFTVRLINSRFLLLPRDKMMSNLPLDLVEEILSRVPATSLKRLRSTCKSWNNCYKDQRFTEKHSVIAAKQFLVLMLKDCRVSSVSVNLNEIHNNIAAPSIELKGVVGPQMQISGIFHCDGLLLCTTKDDRLEVWNPCTGQTRRVQHSIHYKTNSEFVLGYVNNNSRHSYKILRYWNFYMSNYRVSEFEIYDFSSDSWRFIDEVNPYCLTEGEVSLKGNTYWLASDEKRDIDLILRFDFSIERYQRLNLPILKSDYETEALSVVREKQLSVLLKRNDTLEREIWVTTNDKIDHTTKNLLWIKFLAIDQRTCYHWSCVSFFIDEEKKMAVFCDGYIGGINETSRRMFYIIGEDKYYRELYVGDSPIRSHRPFVFNYVPSLVQIPQATVIPKRRRQQLSLVLQRCRASKVDVWITDKIDTKEVQWSKFFTVDVDIGGRAMLSYDSFFIDKEKGMALLCGL

SEQ ID NO: 57883 - protein, 255 aa, Oryza sativa
WRPPGKVIKCKAAVAWEAAKPLVIEEVEVAPPQAMEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGTDLNANRFEEARKFGCTEFVNPKDHDKPVQQ

SEQ ID NO: 57884 - protein, 218 aa, Oceanospirillum sp. MED92
MSSDQRIVHYNSARFNKSAAKLHQCPEDIGAEVAFAGRSNAGKSSAINTLTNNGKLARTSKTPGRTQLINFFDLNLEGVRLVDLPGYGYAKVPVEMKVHWQKHLGEYLEKRQCLQGVVLVMDIRHPMKEFDQMMVEWCENSQMPLHVLLTKADKLKKGPAQSTMLKLRKELQAVLGDLVTVQTFSALKKQGVDQLRNRLDHWLLPEETDFESEVITEE

SEQ ID NO: 57885 - protein, 356 aa, Cryptococcus neoformans var. neoformans JEC21
MKAQENSQRANRWDKGIKIGEGTFANVYKGTEKATGRKVAIKKIKVGEMKHGLDMTALREVKFLQELKHPNIISLLDVFSVKQNINLVLEFLDTDLEAVIRDKALIFQNADIKSWMAMSLRGLEYIHRNGVLHRDLKPNNLLIAANGELKIADFGLAREFGDAGNKMTCQVITRWYRPPELLFGSRYYSPTVDIWSMGTIFVELILRVPFLAGETDIDQLKKTFHAMGTPTEQDWPGYTKLPDYHEVGSFPKNPWWNMISSIGREGQDLARELLRFDPAQRPSAKKALLHSFFTSYPPPTPPIALPKPLAELRPRELAPDETQGKPLLTSGAGQSLKRKAESPRTSQSVPRKLIFT

SEQ ID NO: 57886 - protein, 70 aa, Zea mays
NLVHIILWDSGSTVGEFDGHSKRVLSCDFKPTCPFRIVICGKDILANFYEGPPFKFKHSIRSHSFAMSVI

SEQ ID NO: 57887 - protein, 377 aa, Pseudoalteromonas tunicata D2
MKKPPIIWTNVLFFTLTFCAALILVPWYGINYGFSAANWTAFVGCMFFAGLSITAGYHRLWAHKTYEAHPVVEAIFALGGAFAIQNSALHWSSDHRIHHGQVDDPIKDPYAATNGFWYSHIGWMLRDYQGDNYTNYNNCRDLQKNKIVMWQHRHYLLLTILTNVGIPLLLGIVFGDIWGMLILAGVLRLVLSQHFTFFINSIAHIWGSRPYTESNTARDNALLALFTYGEGYHNYHHIFASDYRNGIRWWHYDPTKWMIKSLSYFGLTSKLKTTPIERIEKAKADTLLNKTALTLQQTTLGQAKIELLQQEYDVLLKKLQSYCKLKKQLLDAKKNTMLKQCEKSAIMNQYREFELAWQKQKQSWLELNAQLLRARYS

SEQ ID NO: 57888 - protein, 137 aa, Brassica napus
MDRLLQPPSSSILAPSKSQLRAPPLLLRVHRLDSPSLIPASPRRVSSISCLFRHNPSPTTSPGSNQARNLSSSSPKADESKPNPGFLEQIVRSYEQRKTLSAGTIILISAVVALLLNPIVAPPAFASFQAAAKSSGA

SEQ ID NO: 57889 - protein, 306 aa, Glycine max
SVAKCGTRLKDTVLDWEDALPTKEMNPAEKHCKQADIVLCLGTSLQITPACNLPLKALRGGGKVVIVNLQKTPKDKKASLVIHGFVDKQVIAGVMDQLNMQISPFVRIDLFQIILVQALSNDKRYVNWTLQVASAHGQKAALPFIKSVEISFLDREDYKAAILDKQPFRLKRRTAYNKAFEMVLKLNFSDGCGCSSLEIDVPVDFKVSTDCFDFDKDYIFQKLRDKAVLESRCGQNAVIERKTILTPRSDVTTYAIVTNVVQYSKTCKAALDSLSNGDFKKRKASVTGTGSSRKRSKGSSKCKREC

SEQ ID NO: 57890 - protein, 349 aa, Solanum tuberosum
MKTIQGQSATTALTMEVARVQAISSITKCMDTIPSEYIRSENEQPAATTLQGVVLEVPVIDISNVDDDEEKLVKEIVEASKEWGIFQVINHGIPDEVIENLQKVGKEFFEEVPQEEKELIAKKPGAQSLEGYGTSLQKEIEGKKGWVDHLFHKIWPPSAINYRYWPKNPPSYREANEEYAKWLRKVADGIFRSLSLGLGLEGHEMMEAAGSEDIVYMLKINYYPPCPRPDLALGVVAHTDMSYITLLVPNEVQVFKDGHWYDVNYIPNAIIVHIGDQVEILSNGKYKSVYHRTTVNKYKTRMSWPVFLEPSSEHEVGPIPNLINEANPPKFKTKKYKDYVYCKLNKLPQ

SEQ ID NO: 57891 - protein, 385 aa, Gossypium hirsutum
MVHCLPKVSVIQDKPMLPPTAAVAKNKHRPLAFDASILGSEISSQFIWPDDDKPCLDAPELVIPTIDLGAFLLGDSLAVSKAAEAVNEACKKHGFFLVVNHGVDSGLIDKAHQYMDRFFSLQLSEKQKAKRKVGESYGYASSFVGRFSSKLPWKETLSFRYCPHTQNIVQHYMVNWMGEDFRDFGRLYQEYCEAMNKVSQEIMGLLGISLGLDQAYFKDFFDENDSILRLNHYPPCQKPELTLGTGPHTDPTSLTILHQDQVGGLQVFADEKWHSVAPIPRAFVVNIGDTFMALTNGIYKSCLHRAVVNTETVRKSLVFFLCPKLERPVTPAAGLVNAANSRKYPDFTWAALLEFTQNHYRADMKTLVAFSKWVQEQESNNKLIP

SEQ ID NO: 57892 - protein, 263 aa, Haemophilus influenzae R2866
MARRPLVMGNWKLNGSKAFTKELIEGLKAELHDVTGCDVAIAPPVMYLGTAEAALSGCGCSCGGKSVIQLGAQNVDINVKGAFTGDISSEMLKDFGAKYIIIGHSERRTYHKESDEFVAKKFGALKEAGLVPVLCIGESEAENEAGKTEEVCARQIDAVINALGVEAFNGAVIAYEPIWAIGTGKSATPAQAQAVHAFIRGHIAAKSQAVAEQVIIQYGGSVNDANAAELFTQPDIDGALVGGASLKAPAFAVIVKAAAAAKN

SEQ ID NO: 57893 - protein, 394 aa, Zea mays
  misc_feature (19)..(19): Xaa can be any naturally occurring amino acid
  unsure (1)..(394): unsure at all Xaa locations
PRRYLAQTKAVKPPWPCPXKPPPPPPPATASGGTARKLILALLTCLSSALLYRQIQPLPPKIPGTPGGPPVTATRTRLSDGRYLAYLETGVPREKAKHRLVFVHGFDSCRHDALPISTELAQELGVYMLSFDRPGYAESDPHPARTEESIALDIAELADNLQLGRKFYLAGFSMGGEIMWSCLKYIPHRLSGVAILGPVGNYWWPGLPSNVSRDAWYQQLPRDQWAVWVAHHLPWLTYWWNTQKLFPASSVIAYNPALLSQEDEMLMAKFGYRAYMPQIRQQGEHECLHRDMMVGFGKWSWSPLQLENPFADADADDGQGAGKVHLWHGAEDLIVPVSLSRYISQKLPWVVYHELPKSGHLFPIAEGMADIIVKSLLLGDDHLSSSASQPPHSP

SEQ ID NO: 57894 - protein, 169 aa, Oryza sativa (japonica cultivar-group)
MAATADNGEKMILLISSDGERFELSEAAASQSKTLSHMIEDDCTDNGVPLPNVTAVVLAKVVEYFKKHAAVTPKPATEAVAADKAKREEELKSFDAEFVDVDRTMVFELILAANFLNAQDLLDLTCQHAADLIKDMSVEEVREVFNITNDFTPEEEAEVRKENAWAFDN

SEQ ID NO: 57895 - protein, 666 aa, Deinococcus radiodurans R1
MTDQSVSQNVARLSVNTIRTLAIDAVQAANSGHPGAPLGMAPMGYVLWHKFLRHNPAHPEWPGRDRFVLSAGHASMLIYSLLHLTGYQEMTLDDLRHFRQWGYHTPGHPEFFHTKGLDATTGPLGQGAAMTVGMAMAEAHLAARYNREGFPIFDNRTYAIMGDGDLQEGINHEAAALAGHLKLGKLIWLHDDNHIQLDTPTNKAESEDTAARFRAYGWNVLKVEDGDNLDEIEKAIAEARSQSERPTLIQVRTIIGFGSPRAGTSKAHGEPLGEEGVAETKKALGWEYPAFTVPDEVAAHMNARAKGAQLEADWEKLMADYRTAHPDLGKEVDALLARELPANLADLLPKYEVGGKAAATRNASGEVINALAKVLPGLMGGSADLSGSTKTTIKDGGEMEAGTMGGRNVLFGVREFGMSAAGNGLSLYGGLHPMVGTFLVFADYLKPAFRLSALQMQPVTYVLTHDSIGLGEDGPTHQPVDQLAMLRAVPGAHVIRPADANETAAAWLMALEYDKGPTALALSRQDLPILPANIEGVKKGAYVLRDVDGADGQGAQVILIASGSEVALALSSAERLAEEGVQARVVSMPCMEVFRQQEQSYRDSVLTPGVKRVAIEAASPQPWYEWTLGGPVIGMTTFGASAPAKVLFEKFGFSVENVVKVVHSVL

SEQ ID NO: 57896 - protein, 480 aa, Haemophilus influenzae R2866
MFGPFKPAPHIAELPAEKIDSTYKRLRWQVFAGIFFGYAAYYFVRANFDLAQPGLIQAGLYSKAELGVIGSAAGLAYGLSKFVMAGMSDRSNPRVFLPFGLLLSGLCMTLMGLFPWATSGIAIMWVMIFLNGWFQGMGWPPCGRTMVHWWSKSERGSIVSIWNTAHNIGGMVPGAMVLLASAIFFSTHGIEAQAKDVWQQSLYFPGIAAMICAIPVYFVMRDTPQSCGLPSIEKWRNDYPDDYNEKTYENDLTAKEIFVTYVLKNKLLWYIALANVFVYLIRYGVLKWSPVYLSEVKHFNIKGTAWAYTIYELAAVPGTLLCGWVSDKVFKGKRGLTGFIFMILTTAAVVAYWMNPATPEAELANYSAWYQNPYQLTDFVLMTLIGFLIYGPVMLIGLHALELAPKKAAGTAAGFTGLFGYLGGTVSASAVIGWAAQHYGWDGGFFVMIGGGVLAVLLLLIVMVEEGKHKAKLGDTYGTK

SEQ ID NO: 57897 - protein, 358 aa, Cryptococcus neoformans var. neoformans JEC21
MDLASQENSQRANRWDKGIKIGEGTFANVYKGTEKATGRKVAIKKIKVGEMKHGLDMTALREVKFLQELKHPNIISLLDVFSVKQNINLVLEFLDTDLEAVIRDKALIFQNADIKSWMAMSLRGLEYIHRNGVLHRDLKPNNLLIAANGELKIADFGLAREFGDAGNKMTCQVITRWYRPPELLFGSRYYSPTVDIWSMGTIFVELILRVPFLAGETDIDQLKKTFHAMGTPTEQDWPGYTKLPDYHEVGSFPKNPWWNMISSIGREGQDLARELLRFDPAQRPSAKKALLHSFFTSYPPPTPPIALPKPLAELRPRELAPDETQGKPLLTSGAGQSLKRKAESPRTSQSVPRKLIFT

SEQ ID NO: 57898 - protein, 400 aa, Arabidopsis thaliana
MNNLDEIKIESKTCLNDQEQEVKIDNMHMSDQDKNKIEIKNKSGLGEKWPEPIVRVQSLAESNLTSLPDRYIKPPSQRSQTTIIDHQPEVADINIPIIDLDSLFSGNEDDKKRISEACREWGFFQVINHGVKPELMDAARETWKSFFNLPVEAKEVYSNSPRTYEGYGSRLGVEKGAILDWNDYYYLHFLPLALKDFNKWPSLPSNIREMNDEYGKELVKLGGRLMTILSSNLGLRAEQLQEAFGGEDVGACLRVNYYPKCPQPELALGLSPHSDPGGMTILLPDDQVVGLQVRHGDTWITVNPLRHAFIVNIGDQIQILSNSKYKSVEHRVIVNSEKERVSLAFFYNPKSDIPIQPMQQLVTSTMPPLYPPMTFDQYRLFIRTQGPRGKSHVESHISPR

SEQ ID NO: 57899 - protein, 1430 aa, Cryptococcus neoformans var. neoformans JEC21
MVPPARAHTHNTTNTKQAQLSSAYHELANELGTDNISVVGNYTLGRVIGQGTYGSVHLATHRLTGTRAAVKKVPKSFTPHLTRELHHHRRLHHPHIVHLHEIIATESHIWLVTELCSGGELFDYLVERGRILEGEARRLFGELTLAVGWLHMHGVVHRDLKLENVLLDGELRIKLGDLGFAREWQKGRLMDTYCGTTGYASPEMLACQKYLGVETDIWSLGIILYTLLCGGLPFDDDDERVMKELIQKGEYEEPDWLSQEARDLIRGMLQHDPSKRLSIREILTHPWFKMTIVDKVYPNGDVPSIPPSPNPTSPTAAGDDFFAESALRQQQQQQSRLTPHVAGRSPLSTHLPTTPRQNSGSSEAENGDSRTERKASNMQRLNSAEFSTTEKELEQLHLCTSRPAATATGSGAISPRSISSPSMRGKTLRTLPEGQVDVDETPAGLPPPLSLIDEHPHLPVALHSRTPSRTKRRSVSSTLSLERRLSHHSSHNSYITFPPEDYLSKLDPSLLPNPDSSSSSTTTPPARSFTTPSETRLLRQLDDLGLDVGQLKHSVETDACDASAGLWWLLRQKQEERGETDEVVRRREKEVVRREEKVAEYAKEERRKAREAERERERIPTSPMGILGTRPGKRDSIEKSSEGLRFKEEQPPSIPTTPSYTSVIDLGPPVLPVDVDVDVERTAVGRDAPREAAGEEMKSWKRVESPQSVAISSQSSLDPAPTLPPPAAAGGGGAAGAKTQKEDGRDQAGLDPVAVATPMSNANSSTGASTVAKPEPNVNASANANTSANPRLKAKSPSMNMLQRATSVLGGVGKKGDDKDKDKNGMNEKREESTNDSLHPKRGGSSSPNKLKKPMPAGMKGLTSTLSRSESESEGLLAGGGGGGGGGDSPAVSASGSKTVTPGSSPRRKGLTPQGTPRGGLRDAGAKDSSGERASGNGNGNAGGGNEKGKGGKKDSLWTTFRHLFYEDRRRRKRESVTPSASSPLLLPPSDIKLPAGAVVLSRGANSRTSQFKRSNVGYAPSTGSRRTSLDGNRPVYSRRSSSVHTTSRRSSVGSLHFQDHQAMISDLSRRASQRSHGSQTPTSDREYLDYPSAAAPISRPGSSHSIRGGVGGGSRRSSFSVRSPSLHPETFSASAGGPTSTRFKSSVPPPASPLLGYRRRPAGGNDSSRVRHIKVIPESQIMRSSSVASSIRSNASSRASSMDRDRDRDRESEYESGRDDVSLRSGKRQKRRSGSQRSLAQQIHRTRSPLALSLENTYGSNSVANVGLGIGGASRIPKKPLRDVFQKKGKRKDGGDDDWVSEDEDGFACGLGQGRGIAKSFSNANANGTVWMNVNAKTNPARSAAAFPTSKMVAQPTAQGGTSRRRERGRRSSLEEERGRPQEGKGKAKGETAAQGLMGIESLSGRSRRNLPDRSTAPGIIEEEEEDEE

SEQ ID NO: 57900 - protein, 752 aa, Shewanella sp. MR-7
MTNPVPVNADGSTAYNLSAGQPFPLGATVDDGGVNFALFSAHATGVELCLFDAQGEVEIQRIALTEQTQQIWHLYVHGLSAGQLYGYRVYGPYEPQLGHRFNPHKLLLDPYARQLVGRYHHHIANFGYEIDNPNEDLSFSTLDNADFVPKCKVVDTRPLFDAAKAHAIRPLSSKREPLPLEQCIIYEMHLKGFTALHPEIDAPLRGTFSGLASNAAIDYLVNLGVNCVELLPVQAFFSEPFLLEKQLSNYWGYNSIGFFAPEPSYLSSEDIGEFRTMVDALHGAGIEVILDVVYNHSAEGSRLGPTFSFRGIDNLSYYRLHPNDKRFYINDTGCGNTLNLNHPRMLQLVLDSLRYWVEVMGVDGFRFDLAACLGREAYGFDPGSGFFDALLQDPVLCRVKLIAEPWDIGPGGYQLGNFPVAFSEWNDRYRDTMRRFWRGDHGMLPEFARRFHGSGDFFEHSGRPPAASINFLTSHDGFTLKDLVSYCERHNWANGEENRDGHHENFSHHYGVEGDTDDATILALRARQQRNLLTTLFLSQGVPMLLSGDETGRTQGGNNNAYCQDNPLNWFDWSSDGMDSSLLSFTSQLIALRKRFPLLCSKRFIHEQLVANAFDWSSESSSSHAASPVLTPTGARLDWFSRQGEPMSKSLWSESMGRSLCVVLSGNLTATQPQTQGDNLQALLLMVNADEHPLAFTLPVFDGLGPWQCLLHTQTDPQFLTPTEPLDAQSSPTRYLLQDRSLMLFHADFIRN

SEQ ID NO: 57901 - protein, 173 aa, Zea mays
MVPFISSKSHQQIPNSSEYQATMSERGKGAKDLGKRGAKRHRKVLRDNIQGITNPEIRRLARRGGVNRISLLIYQETRGELNIFLDNVIRDVVTYTEHARRKTVTAMDVLYALKRQGLTLYGFRGCKALPPLVDVAKVLARGQEIYSILDDVLSIIISLSLGLIVSGCCTLPL

SEQ ID NO: 57902 - protein, 371 aa, Medicago truncatula
MLFHSKSTLFLFIFFSYSFLLFQANATRSLSNNVKEFEVKVDSFIQFKEAPEYRNMQKCKVVDRKIDIDQYVCDPSLVHISMTIDWDYLRGSMAAIHSVLKHTSCPKNLFFHFIASDSRLENKDEFTRIVHGSFPSLKFKVYVFNESLVENLISPSIRQALENPLNYARSYLADLLEECVERVIYLDSDVIVVDDIQDLWKVSLTDSKVIGAPEYCHANFTRYFSYEFWSSYEFSEVFKGRKNRPCYFNTGVMVMDLMKWREGEYTKKIEKWMEIQKERKVYKLGSLPPFLMVFGGDVEAIEHRWNQHGLGGDNVVDSCRSLHPGPVSLLHWSGKGKPWRRLDAMRPCSVDFLWKPYDLYMPHVGYGHSLI

SEQ ID NO: 57903 - protein, 338 aa, Arabidopsis thaliana
NLEQIRCIITADEVSLLNSLDNYVLRYVVELQQRLKASSVTEVWNQDSLELSRRRSRSLDNVLQNSSPDYLPFEFRALEVALEAACTFLDSQASELEIEAYPLLDELTSKISTLNLERARRLKSRLVALTRRVQKVRDEIEQLMDDDGDMAEMYLTEKKKRMEGSLYGDQSLPVYRTNDCFSLSAPVSPVSSPPESRRLEKSLSIVRSRHDSARSSEDATENIEELEMLLEAYFVVIDSTLNKLTSLKEYIDDTEDFINIQLDNVRNQLIQFELLLTTATFVVAIFGVVAGIFGMNFEIDFFEKPGAFKWVLAITGVCGLVVFLAFLWYYKRRRLMPL

SEQ ID NO: 57904 - protein, 302 aa, Synechococcus sp. WH 8102
MTSPAALSPTPFGRVVTAMVTPFDDSGAVDLPLAGRLARHLVEQGSDGLVVSGTTGESPTLSWQEQLQLLQAVREAVGSDAQVLAGTGSNCTAEAVEATRQAAAAGADGALVVVPYYNKPPQDGLAAHFRAIAEAAPELPLMLYNIPGRTGCSMAPETVAQLMDCPNVVSFKAASGTTEEVTALRLACSSKLAIYSGDDGLTLPMISVGAVGVVSVASHVVGPQIRAMIDAYMQGDAAVALALHEQLQPVFKALFATTNPIPVKAALQLNGWSVGDPRPPLSPLPDDMRSTLAQTMAALRQT

SEQ ID NO: 57905 - protein, 341 aa, Alkaliphilus metalliredigenes QYMF
MSKAVNIDWSTLGFSYMKTDFRYVSKWKDGQWDDGALVEDNNLSISESSTALHYGQQCFEGLKAYRTKDGEIQLFRPDQNAKRMKNSCSRVLMPEVSEEKFIDACIQVVKANEAFVPPYGTGATLYLRPFVIGVGDNLGVRPAPEYIFSVFCVPVGAYFKGGVAPVNFMTSEFDRAAPYGTGAAKVGGNYAGSLFPHQVAVKKGFADCIYLDPATHTKIEEVGAANFFGITTDDKFVTPISPSILPSITKYSLMHVAKEYLGLEVEERDALVDNLGEFKEAGACGTAAVITPIGGISHKDNLHVFHSETEVGPVTKKLYDTLCGIQFGDVKAPEGWIVKVK

SEQ ID NO: 57906 - protein, 419 aa, Yarrowia lipolytica CLIB122
MDEEEHKDHQEEEDPHHFAFSDNYSEAVLGGEISATVFDVTGKVVHVAHKMTKYEFLLEHGLYPRDLRNIDPSPVSIIPSILARGRKGAGRCILVNLLHIKALILHDKVLIFDTHSKNKSDTHRLGMFLYELENKLKPTINPEKMHTDMTVLPFELRVLEAILVNVMTTLDGELQVHLKTLNEILVGLEDHVDREQLKELLIGNKNVSRFYQKAVLIRDVLEELLESDDDLQQLYLGTHPKEGLAEVELLIESYCKQADEIVQQASNVRSHIRSTEEIVNIIVDANRNALMLLELKVTIVTVGFAVGAFVAALYGMNLENFIEETNEGMVLVVGVACLGGLLVTWFNLTKLHKTQKIAMFSNAATHTASKPYMLQWIIGLLRRKRTKSRFDNIDMSRPKMKGKKSNILHQLTKMTGKRR

SEQ ID NO: 57907 - protein, 535 aa, Thermosynechococcus elongatus BP-1
MTHSTLHQPDTATGQGLQRQLIVILDFGSQYSELIARRIRETQVYSEVISYRTTAEQLAQLAPKGIILSGGPNSVYDENAPQCDPEIWNLGIPILGVCYGMQLMVQQLGGTVERAIAGEYGKAALFIDDPTDLLTNVEQETIMWMSHGDSVTELPPGFRVLAHTDNTPIAAIAHPERKLYGVQFHPEVVHSVGGIALIRNFVYHICDCEPTWTTAAFVEEAIREVRAKVGDKRVLLALSGGVDSSTLAFLLHRAIGDQLTCMFIDQGFMRKGEPERLLKLFQEQFHIKVEYVNARDRFLAQLVGVTDPEEKRKRIGHEFIRVFEEESQRLGPFDYLAQGTLYPDVIESANTNIDPQTGERVAVKIKSHHNVGGLPENLRFKLVEPLRKLFKDEVRQVGRSLGLPEEIVQRHPFPGPGLAIRILGEVTPERLEILRDADLIVRQEINRAQMYHELWQAFAVLLPIRTVGVMGDQRTYAYPVVLRFVTSEDGMTADWARVPYDLLERISNRIVNEVPGVNRVVYDITSKPPGTIEWE

SEQ ID NO: 57908 - protein, 338 aa, Nocardioides sp. JS614
MRATTIHGLRDIRVSEVPDPAITAPTDAIVKVVAGCICGSDLWPYRGENDIRPGATIGHECVGVVEEVGAEVRSVRPGDFVIVPFDHCDNTCPHCLAGAQSACVNLGFTVSGQAEYARVTQADGSLVATQGTPDAGLVPSLLTLSDVLPTGWHAAVSAGVREGGTAVVVGDGAVGLCGVLAASVLGAETIVAMSRHEPRQELARRFGATHIVAERGDEGTAAIMEITGGVGADAVLECVGTDQAMRTAFSTARPGSTVGFVGVPHGVELPVREMFQRNIGLAGGMAPTRRYIPELLELVLADRIEPGLVFDSTLPLDQVAEGYRAMDERQAIKVLIEP

SEQ ID NO: 57909 - protein, 877 aa, Oryza sativa
MQVQGFFDRLTGRNKEAWKEGRIRGTAVLVKKDVLGLGDFHASLLDGVHNILGHKEGVAFRLVSATARDPSNGGRGKLGKPAHLEELVVTMKSTAAGESVFRVAFEWDESQGIPGAVVVTNSNRSEFFLKTLTLDGVPGKGTVVFVANSWIYPADNYQYERVFFANDTYLPSKMPAPLIPYRQEELNILRGDGKIGPYKEHDRIYRYDYYNDLGQPDKGSKLVRPVLGGSQELPYPRRGRTGRAPTKTDPNTESRLPLLDLNIYVPRDERFGHLKMSDFLGYSLKAIVEGVLPIIRTYVDTTPKEFDSFQDIMELYEGGLKVANASALAEIKKRVPFELIKSLLPVAGDQVLKLPLPHVIKEDKFAWRTDEEFAREMLAGVNPVMIKRLTNFPAKSTLDPNVYGDHTSKITEAHIKHNMEGLTVQNALKGNRLFILDHHDHFMPFLDKINKLDGNFIYASRTILLLKDDGTLKPLAIELSLPHPDGQQHGAVSKVYTPANTGVESQIWQLAKAYASVNDSAWHQLISHWLNTHAVIEPFVIATNRQLSVVHPVHKLLSPHYRDTMNINALARQTLINADGIFEKTVFPGKYALEMSSVVYKNWKFTEQALPVDLVKRGVAVPDPTSPYNVRLLIKDYPYAVDGLVIWWAIERWVGEYLAIYYPNDGVLRGDEELQAWWKEVREVGHGDLKDQDWWPKMDTVQELTRACTIIIWIASALHAAVNFGQYPYAGFLPNRPTVSRRPMPEPGTEEYAKLERGGDEADLVFIHTITSQFQTILGISLIEILSKHSSDEVYLGQRDTPEWTSDAKALDAFKRFGSRLVDIENRIKDMNGNSALKNRNGPVKMPYMLLYPNTSDVTKEKGQGLTAMGIPNSISI

SEQ ID NO: 57910 - protein, 337 aa, Thermosynechococcus elongatus BP-1
MVLLGRSAAELKAWVEAQGQPGYRGQQLHQWLYRKGARSLQEITVFPKQWRAALADVEIGRSEIRYRHDAQDGTVKLLLALADGETIETVGIPSSDRLTVCVSSQVGCPMACDFCATGKGGYRRNLACHEILDQVLTIQSEMGRRVSHVVFMGMGEPLLNLPAVLQAITCLNRDIGIGQRHITISTVGIPQQIQRLAQHQLQTTLAVSLHAPNQALREQLIPSAKHYPLSQLIADCRAYVQQTGRRITFEYTVLAGVNDRPQHAEELAQLLRGFQSHVNLIPYNPIAEAAYQRPTDQHLRQFLSQLQALGVTASIRRSRGLDRQAACGQLRQAQLIA

SEQ ID NO: 57911 - protein, 391 aa, Streptococcus agalactiae NEM316
MTLEKRFNKYLDRIEVSLIRQFDQSISDIPGMVKLTLGEPDFTTPDHVKEAAKSAIDANQSYYTGMSGLLALRQAAADFAKDKYNLTYNPDCEILVTIGATEALSASLIAILEAGDVVLLPAPAYPGYEPIVNLVGADIVEIDTRENDFRLTPEMLETAIIQQGEKLKAVLLNYPTNPTGITYSRQEIASLAEVLKKYDIFVISDEVYSELTYTGQQHVSIAEYLPNQTILINGLSKSHAMTGWRVGLVYAPEAFIAQIIKSHQYMVTAASTISQFAGVEALSVGKNDTLPMRQGYIKRRDYIIDKMSKLGFKIIKPSGAFYIFAKIPDSYPQDSFKFCQDFAYQQAVAIIPGVAFGKYGEGYIRLSYAASMEVIETAMARLKVFMESYEG

SEQ ID NO: 57912 - protein, 382 aa, Deinococcus radiodurans R1
MWASQRASSVPGSVFSLMDAAKMRARGRGLNVTDLSIGSSDQHPPLSVLDELRAATHDPATYRYPLFSDTQPLRDAAAAYLARRFGVRLNADTEVLPLIGAQEGLAHLLLAVTDPGDTLLLPDPCYPPYWGAAAVAGLNVVTLPLLPERGFLPDLSRVPANVRPRVLLLNYPNNPTSAIASAEFFREAAAWCRERGTLLVHDHPYAELTFGDYRAPSALEAGMEGVVELHSLSKTHHLGGFRVGFAAGDAGAVAALARVKGAIDFHPYLGIQRAAAHALGLPDEVGRVGARIFEERRDALLSALRDLGWEVQTPQASMYAWAQVPGLRDSVAFAVRAAEETGVVVSPGQAFGERGEGFVRFALVQPPEVLRGAAAKLGEVGV

SEQ ID NO: 57913 - protein, 130 aa, Arabidopsis thaliana
  misc_feature (29)..(29): Xaa can be any naturally occurring amino acid
  misc_feature (54)..(54): Xaa can be any naturally occurring amino acid
  misc_feature (68)..(68): Xaa can be any naturally occurring amino acid
  misc_feature (111)..(111): Xaa can be any naturally occurring amino acid
  unsure (1)..(130): unsure at all Xaa locations
RVQKGSSMHSSATMVASPAHAIMVAHFNXLKSSAAFTSTRIANNNITSIRSNGXRVNCIQVWPPIWKXRTFLTHSYLRDIEESKMDMEFDDLNRLKFIPCVEIYLQHRFLXRDHGKSPRYYHGLYSIMLN

SEQ ID NO: 57914 - protein, 157 aa, Zea mays
MAAAATATPAVAPEAGDRKAVAPPVDAVDLELELEEKHVLAVDDSSVDRAVIAKILRSSKYRVTTVDSATRALELLALGLVPDVNMIITDYWMPGMTGYELLKHVKESSALRAIPVVIMSSENVPTRISRCLEEGAEDFLLKPVRPADVSRLCSRIR

SEQ ID NO: 57915 - protein, 479 aa, Oryza sativa (japonica cultivar-group)
MLAGGGSRVSGGGGGFNLASYKYKDPLLGRGGRSFLFGNTWFLLSTYPARLLHTADRRAPAAFFAAINRTPCVRTHCTGQSLLQRGIVMAACGYAFRRAELGAAKRQPEKDSSVGTRISCVVAMGSAGSTPRPEVSFRHRGVEYCKKVGVSLKCREPWGPSRAFWTNAIGPSYKLSFSVEPWLRDFSTSCVAPYSAGATEHQLSLDEAVQDKQMDNSTVGPDGKPRAPGPLKLVSGSCYLPHPAKEATGGEDGHFICVDEQAIGVADGVGGWADHGVDAGLYAKELMSNSMSAIKDEPQGTIDPSRVLEKAYTCTKARGSSTACIVALKEQGIHAVNLGDSGFIIVRDGRTVLRSPVQQHDFNFTYQLESGGGSDLPSSAQTFHFPVAPGDVIIAGTDGLFDNLYSNEISAIVVEALRTGLEPEATAKKIAALAQQKAMDRNRQSPFAAAAQEAGYRYFGGKLDDITVIVSYVTSASAT

SEQ ID NO: 57916 - protein, 193 aa, Sulfolobus solfataricus P2
MSRSANITRETKETKIEVLLDIDRKGEVKVSTPIPFFNHMLITLLTYMNSTAIVSATDKLPYDDHHIVEDVAITLGLAIKTALGDKRGIKRFSHQIIPMDDALVLVSLDISNRGMAFVNLNLKRSEIGGLATENVPHFFQSFAYNSGITLHISQLSGYNTHHIIEASFKALGLALYEATRIVDNEIRSTKGII

SEQ ID NO: 57917 - protein, 215 aa, Pseudomonas aeruginosa UCBPP-PA14
MSEKNPIVGLCQKASFLISAAQVDQCPPDEGLEVAFAGRSNAGKSSALNTLTHANLARTSKTPGRTQLLNFFALDDSRRLVDLPGYGYAKVPIPLKQHWQRHLEAYLSSRASLAGVFLMMDIRHPLTDFDRLMLDWAQASQLPIHVLMTKADKLAFGAAKNALLKVRREVQQGWGDVATLQLFSAPKRQGVDEAQMVLAQWLGLLDEDQEAFEEA

SEQ ID NO: 57918 - protein, 483 aa, Burkholderia vietnamiensis G4
MSSGVRHDYAPLRLYIDGRFHDADGRRTQPVVDPGTTRVLGELPHATAHDIDAAVQAAHRAFVTWRHESPLVRSDLLRRAAALARERAETIGRHITMDQGKPLREAIAEVVSAAEQLEWHAEEGRRTYGRVVPARSPDVMQTVLREPIGVCAAFSPWNFPFSQAMHKIAAALASGCTLVLKGPEESPSAIVALAQLFHDAGLPPGCLNIVWGVPGDVSKQLIEAPQVRKISFTGSVPVGKQLAALAASLMKRMTMELGGHAPVLVCADADVERAAAMLAAYKFRNAGQVCVSPTRFFVQRAAFDRFVCAYLDAVGTIRVGYGLDAGVTMGPLAHARRVDEIDAFVADATAKGAQIATGGMRLPGPGHYFAPTVVLGPTRDTRLMNDEPFGPIVGIVPFDDLDDALAEANRLPFGLASYAFTTSARNAHRISRALEAGMVNINHFGMGPAEIPFGGVKDSGFGSEGGMEAFDGYLVTKFVTQMN

SEQ ID NO: 57919 - protein, 180 aa, Brassica napus
MLYIIGLGLGDERDITLRGLEAVKKSQKIYMEAYTSLLSFGLSSDGLSNLEKFYGKPITLADREMVEEKAGEMIEEAIDNDIAFLVVGDPFGATTHSDLVVRAKKLGVKVEVVHNASVMNAVGICGLQLYLYGETVSIPFFTETWRPDSFYEKIKKNRALGLHTLCLLDIRVKEPTFESL

SEQ ID NO: 57920 - protein, 97 aa, Sulfolobus solfataricus P2
MHDMSNEIVDELYKIILDRIEKRPTGSYTAEIVNKGKPYVARKVGEESVETIVASLAENKERFISEVADLIYHLLVLMALEGVTPEDIYRELERRRK

SEQ ID NO: 57921 - protein, 85 aa, Sulfolobus solfataricus P2
MVGNMNREALFKTLTTGYLHFWSLSRKKLWLKGETSGNFQIIEEFKVDCDADAVLFKVTSLGPICHTGNYTCFYRSYDELVNSKS

SEQ ID NO: 57922 - protein, 376 aa, Arabidopsis thaliana
MEKLKQQFSKDRLITPSSNLVRNYIDSIPVDLLIDILSRFPPKSIARFYCVSKLWESILRGPDFTELYLTKSVALRRLFFALKVNTELLVFSSPQPQIPDENSSLVVEATPYKCFPKKIPTEICTALGGLVFLGTFLSRQPLVIVNPLTGEFITLPKLKTIGTKRFSFGYDPISKKFKVLCVTWSPCGTLPNIHQVLTLETGERLWRTIHDPVIPRYSINYDAICINGVLYSEAYYQGSSKIVCFDFKIEKVSFVNIDGMCNLRLFNCKGKLGVHQYDVQSRNEKLVFHVLEDAEKHKWSKSICILPSVVSGKRIVEITCTGEIVFSPSGGSLHPFYIFFYNIERKTYTRVQIKGFKKYADCVHTFLDFVEDTKLI

SEQ ID NO: 57923 - protein, 420 aa, Saccharomyces cerevisiae
MLAASFKRQPSQLVRGLGAVLRTPTRIGHVRTMATLKTTDKKAPEDIEGSDTVQIELPESSFESYMLEPPDLSYETSKATLLQMYKDMVIIRRMEMACDALYKAKKIRGFCHLSVGQEAIAVGIENAITKLDSIITSYRCHGFTFMRGASVKAVLAELMGRRAGVSYGKGGSMHLYAPGFYGGNGIVGAQVPLGAGLAFAHQYKNEDACSFTLYGDGASNQGQVFESFNMAKLWNLPVVFCCENNKYGMGTAASRSSAMTEYFKRGQYIPGLKVNGMDILAVYQASKFAKDWCLSGKGPLVLEYETYRYGGHSMSDPGTTYRTRDEIQHMRSKNDPIAGLKMHLIDLGIATEAEVKAYDKSARKYVDEQVELADAAPPPEAKLSILFEDVYVKGTETPTLRGRIPEDTWDFKKQGFASRD

SEQ ID NO: 57924 - protein, 95 aa, Aegiceras corniculatum
MAKVGGIHEKEGSANSVEMDELARFAVDQHNKKQNALLEFVKVVNVKEQVVSGTLYYITLEATGGGQKKLYEAKVWVKPWMNFKELQDFQLASDA

SEQ ID NO: 57925 - protein, 569 aa, Pseudoalteromonas tunicata D2
MSKPNSKQDPNAKFADNERLKTQSNFLRGTIEQDLKDEITGGFTADNFQLIRFHGMYQQDDRDIRAERAKQKLEPLHNVMLRARMPGGIITPAQWLAIDAFAEERTSYGSIRLTTRQTFQFHGVLKPNIKDMHQMLDSVGIDSIATAGDVNRNVLCTTNPVESELHQEAYQWAIKISEHLLPHTKAYAEIWLNGEKSETTEEPILGSTYLPRKFKTTVTIPPNNEVDVHANDLNFVAIAEDGKLVGFNVLVGGGLAMTHGDTDTYPRKADDFGYIPLEHTLKIAEHVVSVQRDWGNRVNRKNAKTKYTLDTFGSDEFKAEVEARAGIKFETSRPYEFTTRGDRIGWVEGIDGKFHLTLFIQNGRILDYPNQPLKTGCRKIAEIHQGDFRMTANQNLIVAGVPADQKAAIEQIARQHGLIDDGHTAQRFNSMACVSLPTCPLAMAEAERYLPSLIEKVELLLAKHHIAQDSIILRVVGCPNGCGRAMLAEVGLVGKGPGKYNFHLGGNLAGTRIPKLYKENVAEDVILAELDQLIGRWATERLDNEGFGDFVIRTGVIAEVKVSKTDFYA

SEQ ID NO: 57926 - protein, 187 aa, Leptospira interrogans serovar Copenhageni str. Fiocruz L1-130
MSSREITILKIQEPTRSIASLTRIMEEELSQYRKTLPKGFREEVDCDEDTVLFLHVDFLPLDFQKTTELLLTGKKDLVPVVAIDLQGQILMQAFGNEESQTLSLKTGYAHYFSRSRNQLWKKGDTSGHTQKILQILSPTDRSFLVYQVEQEVAACHEGYYSCFFRERMEGVTWKLLPVPRNFLPEKS

SEQ ID NO: 57927 - protein, 206 aa, Actinobacillus pleuropneumoniae serovar 1 str. 4074
MLKLNYHKTHFLTSAPDIRHLPEDNGVEIAFAGRSNAGKSTALNALTNQKNLARTSKTPGRTQLINLFEVEPNCKLVDLPGYGYAAVPEQMKIQWQKALGEYLQKRECLRGVVILMDIRHPLKDLDQQMIEWAVSAQLPVLLLLTKADKLSQSARSKTVKMVREAILPFQGDIQVEAYSALNKVGIDKLSGKLDSWFAEQFLNQGA

SEQ ID NO: 57928 - protein, 299 aa, Citrus junos
MGEEKKPQSAGVWPTVKPFVNGGASGMLATCVIQPIDMIKVRIQLGQGSAGTVTKTMLKNEGFGAFYKGLSAGLLRQATYTTARLGSFRILTNKAIEANDGKPLPLYQKALCGLTAGAIGASVGSPADLALIRMQADATLPAAQRRHYTNAFQALYRIVTDEGVLALWKGAGPTVVRAMALNMGMLASYDQSVEFFRDACGLSELPTVIGASTVSGFFASACSLPFDYVKTQIQKMQPDAQGKYPYTGSMDCAMKTLKAGGPFKFYTGFPVYCVRIAPHVMMTWIFLNQIQKLEKKVGL

SEQ ID NO: 57929 - protein, 181 aa, Hyaloperonospora parasitica
VPLSTDYKKLFEAISGYGLGGSSIAMFGRVGGGIYTKAADVGADLAGKVVENIPEDDPRNPATIADNVGDNVGDVAGMGSDLFGSLAEATCACLVISTQSPEIIAAGWPAVLFPLVITATGVFVSAMVSFLATHVWPVKKEKDVETVLKVQLFASTLLMTVLVIPVAMWLLPSSFSIGGFV

SEQ ID NO: 57930 - protein, 163 aa, Thermosynechococcus elongatus BP-1
MGRWLRSLVDLGEQLVILLQDNQRFLHLLSQIEGIATRVLAIGMLLVVIVAIIDLGRILTVELLSPPLGQFSLELVKIFGLFLNVLVALEILENITVYLQTHVSSQIVELVIVTSLIAIARKIIILDISQPETVAKLLGLAIAILALSASYWIVRRLNYRRRP

SEQ ID NO: 57931 - protein, 392 aa, Synechococcus elongatus PCC 7942
MPNFRLSQRLAPLQRNVFADMDRAKAVAIAAGREVIDLSLGSSDLPAPDHVVAVIAASLQDPSTHGYLLHQGTLPFRQVAAAWYERKFGLGVDPETEVLLLIGSQEGTAHLPLAVMEPGEIALLQDPGYPSHAGGVYLAGGEIYRLPTTADRGFLPDFSTIPTEILSRSRLLVLSYPHNPTTAIAPLAFFEEAVAFCRHHQLVLAHDFPYPDLGFDGVEVPSIFQADRQKQQAIEFFSLSKSYNMGGFRVGFAIGNAELIGALRRLKAVVDFNQYQGILAGAIAALTGPQACVEATRQRFRDRRDIFINALAATGWTIPKPVSTMYLWAPLPEPWQTRSLEFCEKLVAETGVAASPGIGFGDCGEGFVRFALVHDRDRLEEAARRITQFLAR

SEQ ID NO: 57932 - protein, 398 aa, Glycine max
APPPPPPFFSFLGLFQFSMEVPEMEGKTESHVTSAEAFVEGGVQEACDDACSICLEDFCKSDPATVTNCKHEFHLQCILEWCQRSSQCPMCWQPISLRDTTSQELLEAVELERSLRDTPSRNAAIFHHPALGDFELQHLPMAMNEADIEERIIQHLTAAAAMRRSHHLGQREGHRTRSSAHGRPHFLVYSTQPSAPPFAAGGESEPAAIPVGIPSTPLTFDGNEQSSPQQIPYFQTRGSSLTSGSTVATTNLQGVHSNDRRFASHSFPASQDRAQPSEQSFSDSLRSRFNAVSTRYKESISKGTRGWKERLFSPNSSMSELGSEVRRELNAKIASVSRLMERLETRENNSAAGTSLSNHLVNRSIAETSNQSNVEARGENSLHGNNTPTTFSASSDSK

SEQ ID NO: 57933 - protein, 416 aa, Triticum aestivum
MAGHGRKKAAPPSQVMDGPDGQDPKYGAPPLPMGRPKAAAAAVAASNAWLAGHAAARSDSSLQVDWGNDVYPPGGFVNYLNNSSSFSLPQQIPPPPAMTHGANFAAPLTFASQKNPITAVKKRSKRAHVEIADDAGEGKTMKRLPWTSEEEDRLMSAWLKNSNDPIGGNFKKNDKYWGDVVADYNSNTPSDRKRQVNQAMNRWHRVNKMINNFHSIHGEISGVYASGQSNQQLMEKVHKAYENRHGGPFLLESTWQVVRHYPKWSTYNAELNGLKKIDVADLGKAEDHEAADSDDIPRPPGTKTAKRDGNGNDKRKLKSEDLEELEKFLEAQKEATKSRTDVLEVQKRIAADKLESSRLILLAAKENKEAKTRGKMLEQYGKLLTQDMAGMTEFQKAEHAIALKLMREELFPNARQ

SEQ ID NO: 57934 - protein, 384 aa, Triticum aestivum
MLLRLRCYILTQLLSSPSASPASQLHRLFSAAAPGASPNPSFAVEEYLVATCGLTRPQALKASAKLSHLRSPANPEAVLAFLAGLGLSDADVAALVARDPQFLCASVERTLTPVAAGLSGLGLSRSDIARLASLAAHKFRQKSVLSKLQYYLRLFGTSHNFLRVMKFSNILSHSIERVVKPNVAYLRECGLQDCDIAKFCIQRPRMIISNPEHVQAMVACAENIGVPRASGMFRHALQAVAFLGEEEITVRVGYLKSTFRWTDAEVGMAVSKFPPLLRGSEKSLQRRFEFLISEVGLEPAYLTQRPAMVCYSLEGRMRPRYHVVKFLKENGLLKRDPSYYTVFKESEKYFMDKFICPHKEAAPHLAEDYAAACGGEVPARFRFT

SEQ ID NO: 57935 - protein, 509 aa, Burkholderia vietnamiensis G4
MRACRGAAPGKAESGVTCRRPRSIRTSRKRSSRPRCDVAAHAAPHRVHALEERYLMDYQKRQKRFWHPMSSAAAGHTTPTVIIARGDGNYVYDVEGHRMLDGVGGLWNVNVGHNRPEVKAAIARQMDELSYYQTFDGVAHPRVYDLADRLCAMFEQEDMQRVMFGSGGSDAIETALKMARQYWVAAGEPSRTKFLSLRNGYHGVHMGGTSIGGNGVYHYNHGPLLPGCVLLDTPWLYRNPWNCDDPDQLVEHCIRQLEDTIAFHGQQTIAAFVAEPVQGAGGLIVPPASYWARVRNVCDRHGILLIADEVVTGFGRTGSMLGSRGWGVAADILCVAKGISAGYVPLGATLYNGRIAQAIEHGAGFSHVVMHGYTYSGHPLACAASLAVLDIVEAEDLPGNAARMGQRLLEQLLPLTRDFETVGDVRGKGLMLALDLVTDKASRTPLDPGKGFAARVADAARKRGVLVRAIANKIVMSPPLTLQPKETDLIAHALRDALQECCADARAIA

SEQ ID NO: 57936 - protein, 481 aa, Burkholderia vietnamiensis G4
MMKIQNLIGGRHCDASTGRTFDKLAPATGDRICTVPASSADDVDRAVRAAHDALHDDAWARAGGAARARWLYRLADLVERESEALESLLAVEQGRPPAEMRMMDLPMTIDTLRYFAGWADKLEGRTIPTDGFMGRPTLSYTRRAPVGVAGQIVPWNAPLMIAVWKLAPALAAGCPVVIKPSEDAPLAVARLGKLACEAGLPAGVVNIVHGMGAEVGAALVAHPLVSKISFTGSTEVGRTIACDAARTFKRVTLELGGKAAQIVFADADLDRAIPSLVAGMFANQGQTCAAGSRVLAHRSIADALEARLADAARTIRVGPPTEAGVQMGALINPRHLARVRAHVAAALAEGAVMLAGDEQVPPRGCFMRPTILGGVHPGMRIAREEVFGPVGMVMPFETEDDAIRIANDTPFGLSASVWTQDVGTAHRVAERLDVGAVAINAWSPIDARLPWGGTRQSGIGRDLSKAALDSYLEEKIVTAAL

SEQ ID NO: 57937 - protein, 274 aa, Triticum aestivum
  misc_feature (139)..(139): Xaa can be any naturally occurring amino acid
  misc_feature (216)..(216): Xaa can be any naturally occurring amino acid
  misc_feature (238)..(238): Xaa can be any naturally occurring amino acid
  unsure (1)..(274): unsure at all Xaa locations
MAAAEPSGSSQPGAPGRWSLHGKTALVTGGTRGIGRAVVEELAALGAAVHTCSRKEAELGERLKEWEARGFRVTTSVCDLSVREQRERLIGDVAERFGGKLNILVNNVGTNIRKPTTEFSAEDYSFLMATNLESAYHLXCQLAHPLLKASGLGSIVFISSVCGLVAVFSGTLYAMTKGAINQLTKNLACEWAKDGIRTNSVAPWYITTSLTEGLLXANKEFEASVVSRTPLGRVGEPXEVSSLVAFLCMPGSTYITGQTISVDGGMSVNGFYPA

SEQ ID NO: 57938 - protein, 438 aa, Aspergillus fumigatus
MPISKIHARSVYDSRGNPTVEVDVATETGLHRAIVPSGASTGQHEAHELRDGDKTQWGGKGVLKAVKNVNETIGPALIKENIDVKDQSKVDEFLNKLDGTANKSNLGANAILGVSLAVAKAGAAEKGVPLYAHISDLAGTKKPYVLPVPFQNVLNGGSHAGGRLAFQEFMIVPDSAPSFSEALRQGAEVYQKLKALAKKKYGQSAGNVGDEGGVAPDIQTAEEALDLITEAIEQAGYTGKIKIAMDVASSEFYKADVKKYDLDFKNPESDPSKWLTYEQLADLYKSLAAKYPIVSIEDPFAEDDWEAWSYFYKTSDFQIVGDDLTVTNPGRIKKAIELKSCNALLLKVNQIGTLTESIQAAKDSYADNWGVMVSHRSGETEDVTIADIAVGLRSGQIKTGAPCRSERLAKLNQILRIEEELGENTVYAGSKFRTAVNL

SEQ ID NO: 57939 - protein, 181 aa, Oryza sativa
MGEEDISNDSKSSCGCEDGTVEAPAAAAPKENGRAADPRLQAISDAIRVVPHFPKPGIMFNDITALLLRPAAFKDAVDMFVERYRGMRIAAVAGIEARGFIFGPAIALAIGAKFIPLRKPKKLPGEVISETYILEYGTDCLEMHVGATEPGERVVVVDDLVATGGTLCAAIKLLVYHVLLI

SEQ ID NO: 57940 - protein, 501 aa, Saccharomyces cerevisiae
MSKIVKRKEKKANDELTSLAEKIRAKALENQKKLIEAEKEGGSESDSEEDATAEKKKVLKSKSKSTVSTQNENTNEDESFESFSELNLVPELIQACKNLNYSKPTPIQSKAIPPALEGHDIIGLAQTGSGKTAAFAIPILNRLWHDQEPYYACILAPTRELAQQIKETFDSLGSLMGVRSTCIVGGMNMMDQARDLMRKPHIIIATPGRLMDHLENTKGFSLRKLKFLVMDEADRLLDMEFGPVLDRILKIIPTQERTTYLFSATMTSKIDKLQRASLTNPVKCAVSNKYQTVDTLVQTLMVVPGGLKNTYLIYLLNEFIGKTMIIFTRTKANAERLSGLCNLLEFSATALHGDLNQNQRMGSLDLFKAGKRSILVATDVAARGLDIPSVDIVVNYDIPVDSKSYIHRVGRTARAGRSGKSISLVSQYDLELILRIEEVLGKKLPKESVDKNIILTLRDSVDKANGEVVMEMNRRNKEKIARGKGRRGRMMTRENMDMGER

SEQ ID NO: 57941 - protein, 352 aa, Erythrobacter sp. NAP1
MSTDVKTDASAEAQAERRINMIEAINEALDIMLERDDDVIVMGEDVGYFGGVFRCTAGLQEKHGKTRVFDTPISECGIIGVAVGMGAYGLRPVPEIQFADYIYPGLDQLISEAARLRYRSATEYIAPMTVRSPFGGGIFGGQTHSQSPESIFTHVSGLKTVIPSTPYDAKGLLISCIEDNDPVIFFEPKRIYNGPFSGFYDKPVEPWKKHKDSVVPEGYYKIPLGKARTVQEGEALTVLAYGTMVHVAEAVCREKGVDADILDLRTLVPLDIEAIEASVKKTGRCLIVHEATRTSGFGSELSALVTERCFYHLEAPVERVTGFDTPYPHSLEWAYFPGPVRIGEAIDKILKD

SEQ ID NO: 57942 - protein, 431 aa, Deinococcus radiodurans R1
MGERKCGGWPPKVFLHSLSPGGAGGSTKAVVWHGIGDIRLDDVPEPKIEAPTDAIVRLTASAICGTDLHFIRGTMSDMVPGTILGHEGVGIVEAVGPEVRNFVPGDRVVIPSSASCGYCPPCREGNTSQCDNANPNGPSAGTAFYGGPKSSGPLNGMQAEKVRVVYANSSLVKLPDNVSDDQAIMISDIFPTAYFGAEIAGVKTGSVVVVLGCGPVGQFSIISAKLLGATRVIAVDRLDDRLDMARKNGAEVINFEKEDPVEAVKKLTGGLLADCVIDAVGVDAQHAHAGPAKPDAEKEQKFEQEVQEVAPDAKPEKDGQWTPGDAPSQASEWAIEMTKKAGQIGIIGVYSPQMTTYPIGKAMNKNLTIRMGNCNHRAIIPGLVDLVAAGVVDPARVLTEHEHLGSAIEAFEAFDKRQPGWIKVELEPQAG

SEQ ID NO: 57943 - protein, 137 aa, Hyaloperonospora parasitica
VHAVSGLLVGSLTSGVQLAISQSNTGGAWDNAKKFVEKGCVSIEDKEGKPIVQGKGSAIHKAAVIGDTVGDPLKDTSGPALNILMKLMAIISLVFGDFFKSINDGRGLLNVPTGAVAEAVADVAAVPVAVVAAGPPM

SEQ ID NO: 57944 - protein, 496 aa, Deinococcus radiodurans R1
MHLAVMARAGQCSSSAWGGLDARDFYRREARALRARRPWRSAFLRWTWSSEKKATAEACFCLSSPPPAHYTFPMTQTAAPPPLPDLPPQRRVVLGLQHSIAMFGSTVLVPILVGLSPSVALFGAGVATLIFHLLTRGQVPIFLGSSFAFIAPTALVIKEMGPAAAAGGLIAAGLMYVLFSGLVKLFGTERLLRVFPPVVTGPVIIVIGLGLSSVAVDQAKTNWGLALVTLLAAIIASIYGRGLFRMIPILIGVVTGYLVALATGQVGAKALADIAAAPLLGLPPFHGPALDWRAVAIIAPVAIVTFIEHVGDVVVNGRVVGKNFLANPGLSRTLLADGIANMSSAVMGGPAATTYAENTGVLALTRVYDPRVIQIGAVFAILFGCSPKLAAVLQGLPQGVLGGVSILLFGMIASVGIRTLAEAQVDFAHSRNLIIVSLILVLGLGGASFPLNVAGTKLELHGMALAALVGIVANLLLPRQRPEISGKADGMGPGVG

SEQ ID NO: 57945 - protein, 505 aa, Pyrobaculum aerophilum str. IM2
MEKVLVVNFGGQYAHLIARRIREVGVYAEIASPEEAVIKASKEEVKAVILSGGPSSVYEPGAPDIDEGIFALSKPVLGICYGHQMIAKKLGGKVERGKGEYGKTIVKILVNDPLFDGWKPEEAVWMSHSDFVEEPPPGFHVLAISENGYIAAMRKGLIYGVQFHPEVHHTSKGRVMFENFLRKIARISDVWRPEDQITRIVEEIRSRVKGGDVIVGVSGGVDSTVTAVLLYKAVGQRVKAVFIDHGLFREGEPEEAASLLKSIGIDVVYIDAKERFLKRLEGVADCEEKRRIIGETFAEVFSDAVKQMPNVKYLAQGTLYPDVVESGAVKGADKIKSHHNVGGLPPWFQLELIEPLREFYKDEVRRIAKALGLPEDVVYRHPFPGPGLAVRIIGPFTREKLAIVRKATKIVEEELRKAGLFRKVWQAFATVGEDKWVGVKGDRRAMGYIVTVRIVESEDAMTADWSRIPFEILEKISSRITSEIPEVTMVTYAVTSKPPSTIEPC

SEQ ID NO: 57946 - protein, 127 aa, Medicago sativa
KSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 57947 - protein, 406 aa, Nocardia farcinica IFM 10152
MTSDRRFVIVGGGLAAATLAQELRAADFPDSITLIGAEEHLPYERPPLSKEFLFGKKQLADFTVEPAQWYRDHHVELLLGTTVTGLDPRARTVTLPDGSTLPYDKLALATGSTPRRLPVPGADAPGVYTLRTIDDARALAGLFARGRLAIVGAGWIGLEVAAAARAADCAVTVVETAPQPLMGPLGPEMGAVFADLHRAHGVDLRLGARLDAVTTGADGAVTGLALADGGTVAADAVLMAVGAAPNIALAADAGLAVGTGVLVDASLRTSDPDIVAVGDIAEQAHPRLGGRIRVEHWANALNQPAVAAATMLGRAAEYDRLPYFFTDQYDLGMEYTGYATADRTARVVVRGSLADREFVAFWLDAENRVLAGMNVNVWDVTDRIKELITSATPVDPDRLADPTQPM

SEQ ID NO: 57948 - protein, 472 aa, Coccidioides immitis RS
MKARSGLRAWRGLVSASTSSRPTSSICSQCLLHTRKRFAYVPPTLSFTYRSYHPSRRKNQQSILSAAVSTAQNIISKTLPTKPPPATAGIPEISVDPLRMVAKELKFLKKNIRQLLGSGHPLLDRVAKYYARSEGKQVRPLLVLLMSQATALTPRSPQDRQILNTEGINASISSPAILADTNPDYNLLTAPMTGNETAYSFAEGDVNILPSQRRLAEITELIHTASLLHDDVIDNAVTRRSVASANLEFGNKMAVLAGDFLLGRASVALARLRDPEVTELLATVIANLVEGEFMQLKNTAQDERNPAWTEDIIAYYLQKTYLKSASLISKSCRAAALLGQTAPEVVEAAYTYGRNLGLAFQLVDDMLDYTISGEELGKPAGADLELGLATAPLLFAWRSHPELGALVGRKFCHEGDVQLARQIVAQSDGLEQTRALAQEYADKAVEAISIFPDSEAKRGLIDMCEKVMTRRK

SEQ ID NO: 57949 - protein, 124 aa, Medicago sativa
GGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 57950 - protein, 386 aa, Arabidopsis thaliana
MFALTFVLLVYAKCCHIDLRSGSGDRRRHDRRLRQGIFFNRSTASSDRFSGLDKTAIESLPLFRFSALKGSKQGLDCSVCLSKFESVEILRLLPKCRHAFHIGCIDQWLEQHATCPLCRDRVSMEEDSSVLTNGNSFRFLNQSEIREDSSLELYIEREEEEERIHREELSGSSRFSIGESFRKILKLGNKEKTLLDEHVNDKDEKKLMHKFNHRIVVSDVVFKNRWSNVSSSDLMFLNSEMVNSISSERFSSLDHVKRGDEEDQIGILRIKEEMEAKRMLENKLTSMTTMFSSENGDSGSKSRSVMIEPGRRSVSDITAVPRLSISIHGDCSGSAAETASALQNGGNETEERRRRLWLPIARKTAQWFANREKRSQINTTHQHFDV

SEQ ID NO: 57951 - protein, 989 aa, Pichia pastoris
MPEPSISDLSFTSFVTNDDNLFEETFNFYTKLGFHATRSYVKDNRSDFELTGISTDSIKEIWLESFPLSEVVEASGGRELRKPLQESVGYESEALLGYSPYQSGGVVIKLRLSNHDLEKNNDLPGEVTFFTASIDKLKAKLIEIGAEIIPSKIDLVEFSTRDPMGDVISFSSYPSLNSKKITSPDFFLHPKKEVRSEESIVEQVKSEEGKKKIAIITSGGDAPGMNAAVRAVTRAGIFYGCKVYACYEGYTGLVKGGDMLKELQWQDVRGLLSIGGTIIGTARCKEFRERWGRLQACYNMVSNGIDALVVCGGDGSLTGADLFRKEWPELIKELLGEDKITKEQYETHRNLTIVGLVGSIDNDMCGTDSTIGAYSSLERIIELVDYIDATAASHSRAFVVEVMGRHCGWLGLMSGIATGADYIFIPERPPSESNWKDDLKKVCLRHREKGRRKTTVIVAEGAIDDQLNPITSEEVKDVLVEIGLDTRITRLGHVQRGGAPCAFDRFLATVQGVDAVRAVLESTPAIPSPVISILENKIVRQPLVESVAQTKTVSAAIEAKDFDKALQLRDQEFATSYENFLSVSKYDDGSYLVPESSRLNIAIIHVGAPTSALNPATRVATLNSLAKGHRVFAIRNGFAGLIRHGAVRELNWIDVEDWHNTGGSEIGTNRSLPSDDMGTVAYYFQQYKFDGLIIIGGFEAFTALYELDAARAQYPIFNIPMCCLPATVSNNVPGTEYSLGSDTCLNTLSGYCDAVKQSASASRRRTFVVEVQGGYSGYLASYAGLITGALAVYTPENPINLQTVQEDIELLTRTYEEDDGKNRSGKIFIHNEKASKVYTTDLIAAIIGEAGKGRFESRTAVPGHVQQGKSPSSIDRVNACRLAIKCCNFIEDANFQVKHNANLSADERHLRFFYDDGVKTSAVSGKSSVIDDNTSVVIGIQGSEVTFTPVKQLWENETHHKWRKGKNVHWEQLNIVSDLLSGRLSIRTT

SEQ ID NO: 57952 - protein, 479 aa, Arabidopsis thaliana
MHDWLVEYLYNSRTVVVPMPFTTYTYIADPINVEYVLKTNFSNYPKGETYHSYMEVLLGDGIFNSDGELWRKQRKTASFEFASKNLRDFSTVVFKEYSLKLFTILSQASFKEQQVDMQELLMRMTLDSICKVGFGVEIGTLAPELPENHFAKAFDTANIIVTLRFIDPLWKMKKFLNIGSEALLGKSIKVVNDFTYSVIRRRKAELLEAQISPTNNNNNNNNKVKHDILSRFIEISDDPDSKETEKSLRDIVLNFVIAGRDTTATTLTWAIYMIMMNENVAEKLYSELQELEKESAEATNTSLHQYDTEDFNSFNEKVTEFAGLLNYDSLGKLHYLHAVITETLRLYPAVPQDPKGVLEDDMLPNGTKVKAGGMVTYVPYSMGRMEYNWGSDAALFKPERWLKDGVFQNASPFKFTAFQAGPRICLGKDSAYLQMKMAMAILCRFYKFHLVPNHPVKYRMMTILSMAHGLKVTVSRRSG

SEQ ID NO: 57953 - protein, 585 aa, Hordeum vulgare subsp. vulgare
MCGILAVLGCADDTQGKRVRVLELSRRLKHRGPDWSGMHQVGDCYLSHQRLAIIDPASGDQPLYNEDKSIVVTVNGEIYNHEQLRAQLSSHTFRTGSDCEVIAHLYEEHGENFIDMLDGVFSFVLLDTRDNSFIAARDAIGVTPLYVGWGIDGSVWISSEMKGLNDDCEHFEIFPPGHLYSSKEGGFKRWYNPPWFSEVIPSVPYDPLALRKAFEKAVTKRLMTDVPFGVLLSGGLDSSLVAAVTVRHLAGTKAAKRWGTKLHSFCVGLEGSPDLKAAKEVANYLGTMHHEFTFTVQDGIDAIEDVIYHTETYDVTTIRASTPMFLMSRKIKSLGVKMVISGEGSDEIFGGYLYFHKAPNKEELHRETCQKIKALHQYDCLRANKATSAWGLEARVPFLDKEFINEAMSIDPEWKMIRPDLGRIEKWVLRKAFDDEEQPFLPKHILYRQKEQFSDGVGYSWIDGLKAHTESNVTDKMMSNAKFIYPHNTPTTKEAYCYRMIFERFFPQNSAILTVPGGPSVACSTAKAVEWDARWSGNLDPSGRAALGVHLSAYEQEHLPATIMAGTSKKPRMIKVAAPGVAIES

SEQ ID NO: 57954 - protein, 452 aa, Arabidopsis thaliana
MDEDREKHVRAKGSDEVDWISKLPDCLLCEVLLNLPTKDVVKTSVLSRRWRNLWKHVPGLDLDNTDFQEFNTFLSFVDSFLDFNSESFLQKFILKYDCDDEYDPDIFLIGRWINTIVTRKVQHIDVLDDSYGSWEVQLPSSIYTCESLVSLKLCGLTLASPEFVSLPSLKVMDLIITKFADDMGLETLITKCPVLESLTIERSFCDEIEVLRVRSQSLLRFTHVADSDEGVVEDLVVSIDAPKLEYLRLSDHRVASFILNKPGKLVKADIDIVFNLSSVNKFNPDDLPKRTMIRNFLLGISTIKDMIIFSSTLEVIYDFSRCERLPLFRNLSVLCVEFYGYMWEMLPIFLESCPNLKTLVVKSASYQEKGENIILPGPRRFLSSLEYVKIERPLKGEAMEMKLVSYLLENSTILKKLTLCLDDSVKKEDSVILKELLAIPRLSTSSKVVVLG

SEQ ID NO: 57955 - protein, 251 aa, Oryza sativa (japonica cultivar-group)
MATTTTKRMSVAEVSLVEAVLFDIDGTMCVSDPFHHRAFSELLQALGYNSGVPITPEFGMAHMAGRSNHQIGSFLFPDWPQHRLDAFFADKEALFARYAAEGLREVAGLTDLCRWAAARGLKRAAVTNAPRANADLMISILGLSDFFQVIVAAADDCDLPKPSPEPYLRALSLLGASPRHTLVFEDSVVGVQAGVAAGMPVIAVAEEAREAKVVAAGASLVIRDYKDHKLWAALDKLQAAAAAQSNGQLGA

SEQ ID NO: 57956 - protein, 183 aa, Brassica napus
SFACICFELATGDVLFDPHSGDNYDRDEDHLALMMELLGMMPRKIALGGRYSRDLFNRHGDLRHIRRLRFWPMNKVLTEKYEFSEQDANELSDFLVSILDFVPEKRPTAAQCLLHPWINSVPRSLEPSLSPQDQNPEEKLDTERKKREKEEQEAMVVKMGNVAISSPKSKPGMSKSSSYKQAI

SEQ ID NO: 57957 - protein, 493 aa, Leptospira interrogans serovar Copenhageni str. Fiocruz L1-130
MFMVTELSYCQKMTQLKRSLNLFDSISLMFSSMVGPGIFITTGYILHQVPNPNIVLLAWILGGFLAVAGAMSYAKSASLFPYAGGDYVYLKEAYSPIVAFASGWLSLSINFSASISLSALAFSKSFFSLINPSWDIYFFEIPFLGLTISIGTAQILAMSAILVFTIVNFFGISTASRIQNLFTSVKILGLVSFVILGFVIGNYDISRFKSFSLFPSDLKGFELLFAGVIPVTYSYLGWNMITYVAEEVKDPDKNIYKAVLYSCALVTILYILMNFLFLSSGTLSELSGDKIGITASSALFGPKATVFITVFICWAFLASISAYIIGGSRIYFAMARDGFFFQNMAKLHSKHKSPYMSLLFQCGYACLFCFVKEIESLLYLITCSTLLLATITAYTPILFEKRNYKLKFRIPGYPYTTYLYIASNFGIIATLLWNKPTEAFWGVGFTFLSIPMYYYFKIMQNTLSKNSTPLETPEVLATSLLPENEPVPIASGE

SEQ ID NO: 57958 - protein, 686 aa, Aspergillus nidulans FGSC A4
MSPSSPISIPLFAENQQQLLLKEHEAEVSSSKLASTAFASPLTRRTLQASGHALTGIILSQCRTGLGGRLVGEFTADAAISTGGTKGKGKDDDDAKSNIAANGKLKLGTHGIRVGDVVRVNEVVSAGKKAVGSGKDKKKDGDSAKGPEGVVTRVGESSVWVAFGQSGGGGRSKEEDEEVIEELYGKKLWLIKLANDVTFRRMNQTMEKMAKMSESDYTHFVRVAFGHTTPVQPDYEAAGPVEFIDPTLNDSQKEAIQFALASRDIALIHGPPGTGKTHTLIELIIQMVKRNLRVLVCGPSNISVDNIVERLAPSKIPVVRIGHPARLLPSVLDHSLEVLTQTSDAAAIVRDVRKEIDEKHASIRKTRFGREKRAIYQDIRELRREFRERESKCVDNLVRGSSVVLATLHGAGGHQLKNQKFDVVIIDEASQALEAQCWIPLLSAPKVVLAGDHLQLPPTVKSTPHKTKEAGEDGEQDANGSFSLEKTLFDRLLSLHGPGIKRMLTTQYRMHENIMRFPSDELYESKLIAAESVKSRLLKDLPYNVHETDDTKEPVVFWDTQGGDFPEKVDDEEFAKKESLLGESKSNEMEALVVARHVDNLVQAGVRPEDIAVITPYNGQLAVLSQMLREKYPDLELGSVDGFQGREKEAVVVSLVRSNSEHEVGFLGEKRRLNGMPPAHNSYYLE

SEQ ID NO: 57959 - protein, 665 aa, Erythrobacter sp. NAP1
MTLDAARLQPMANAIRALSMDAVQAANSGHPGMPMGMADVATVLFDRHLKFDPSRPDWADRDRFVLSAGHGSMLIYSLLHLSGYARPTMDEIANFRQLGSPCAGHPENFLLEGVECTTGPLGQGLAMAVGMAMAERHLNAQFGDELVDHRTWVVAGDGCLMEGINHEAIGLAGHLNLGRLIVLWDDNAITIDGATDLSTSENVKARYEATGWHVVSCDGHDFDDIERAIEEAKADPRPSLVACKTIIGKGAPNKQGTSATHGAPLGPDEVAAAREVLGWEAEPFNVPQDILVEWRKTAERGRHDHGEWERRLNESPHSDAFEKQLAGVAEGADTAIQQHIRTLAAEPQKAATRKASEMALGPLTENLPQLIGGSADLTGSNNTKTPSTLPMSADDYSGRYIYYGIREFGMAAAMNGMALHGGVVPYGGTFLIFSDYCRNAIRLSALQKTQAIYVMTHDSIGLGEDGPTHQPVEQVMSLRLIPNLYTFRPCDTIETAECWALALKAEETPSVLALTRQGLPQLRGEGDEAWTGESNRCAKGGYRLRSASADRRVVIVASGSEVALAMECADQLEEAGVGADVVSMPCTELFDAQDDAYKADLLPHDTLIVSIEAGSTLGWERYTGRGGLNIGMESFGASAPASDLFAHFGFTADAIVPQIQNKLNN

SEQ ID NO: 57960 - protein, 335 aa, Erythrobacter sp. NAP1
MATKVAINGFGRIGRLVARAILERDDHDLELVSINDLADTKSNALLFQYDSTHGRFPGTVEVADGAMVVNGKSIAVTSERDPGNLPHGDQGVDIVLECTGFFQSHEAAEPHLKAGAKRVLISAPAKNVSATIVYGVNHETLTAEDVIVSNASCTTNCLSPVAKVLNDTVGIERGFMTTIHSYTNDQRMLDQMHSDMRRARGGAQNMIPTTTGAARAVGLVLPELAGKLDGSSVRVPTPNVSLVDLVFTPGRDTSAEELNEALKAAAEGPMKGVLEYTDQPLVSSDFNHQPASSTVDSLETSVMEGKLARVVSWYDNEWGFSNRMIDTAGVMAKFL

SEQ ID NO: 57961 - protein, 290 aa, Campylobacter lari RM2100
MHEFLSELNYKPILIMSSKLQGGKKLRSKLLLKIAGESDISYKICAIIELIHAASLLHDDVIDEAKLRRGVKSINAQFGAKNAIMLGDILYSKAFYELSLIDLKLAKIISNAVVMLSVGELMDVNLSETFNTDKNAYLQMIYNKTAVLIEASARCGALLANLNEDDFAEYGKNLGLAFQIVDDILDIKGDEQTLGKPAMNDFKEGKTTLAYMYLHEKLDSQDQKTLKSYYKKDLSVDELAWIKNKMQEHEIFNQVGQELNTYANNALKAIKKYNIKDLEDIIKSMIEREF

SEQ ID NO: 57962 - protein, 238 aa, Actinobacillus pleuropneumoniae serovar 1 str. 4074
MKQIEKLFANNHAWATRMKDEQSDYFKQLAEHQKPTYLWIGCSDSRVPAEKLTGLGPGELFVHRNVANLVIHTDLNCLSVVQYAVDVLEIEHIIICGHTNCGGIQAAIGTVEDYGLISNWLLHIRDLWFKHSYLLGNLPSEQRANMLTRLNVAEQVYNLGRSSIVTAAWKRGKKLSIHGWVYDVNDGFLIDQGVIATSTETLEITYRNAIAKLATEVEEMIANKPVEQSNPIENNHID

SEQ ID NO: 57963 - protein, 915 aa, Pyrobaculum aerophilum str. IM2
MEKYVYSFKEADYRNKKLFGGKGASLIQMTQLGLRVPPGFIITTEACKKFYEPRRREISELEGILLKNPPPEVRDEVIKKLHAIIDSLDLPGEIWSQVVSYMRELEKETGKRFGDPENPLLVSVRSGAAVSMPGMMDTVLNLGLNDETVKGLAKQTGNEWFAYDAYRRFLQMFGKIVLSIDEKLFSTAWEEIKRKYGVKDDPDVQLEGLKEAVERFKEIIVRARGGFPQDPWEQLKLAIKAVFRSWMSPRAIFYRIIEKITPDIADCTAVNVVTMVFGNAGWDSGTGVVFSRDVATGENKLYGEFLPVAQGEDVVAGIRTPMDIEEFRKRFPHLYEELYQGVKLLEKVNKDVQDVEFTVERGKLYFLQTRNAKMTALARVKTAVDMAKEGIITKEEALLMVSPDHVLQLLYPRIDPKAKATLVAQGLPASPGAVSGQVVFHPDDAVRWAAQGKRVILARVETKPDDVHGFYAAVGVLTSRGGMTSHAAVVARAIGKPAVVGAESIEIHEEEKYLKVGTHVIREGDWITIDGHTGNVYIGVVPTIEAELIPELEELLRWADEIRRLGVRANADLPEDAAIARKFGAQGIGLLRIERMFRKPERLELLRRIILAESPEERRPHLEALYKMLKNDFKEVFKIMDGLPVVVRLIDPPLHEFLPKPEEILEQIYQRKMRGDDASELEKLYRRVKALQEANPMLGHRGVRVGVTHPDFYYYLNKAILEAAAELKKEGFNPVVEIMIPQVSDVREIIYVKEKAIIPALKDVEASTGVKLDVKIGTMIETVRACLTIDEIAKHVDFISFGTNDLTQAVFSFSRDDAENKFIPQYLDLKILDADPFETIDIKGVGKLVEYAAKTAKEVNPSIEVGVCGEHGGDPKSIYFFHNKVDYVSASPFRVPLARLSAAQAAIINRQNPHY

SEQ ID NO: 57964 - protein, 369 aa, Festuca arundinacea
MVMMVDPPNGMGNHGKHYYTMWQTMFEIDTKYVPIKPIGRGAYGIVCSSINQETNEKVAIKKMNNVFDNRVDALRTLRELKLLRHLRHENVICLKDIMMPVHRRSFKDVYLVSELMDTDLHQIVKSLQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMSDSDLEFIDNRKARNYIKSLPYTPGIPLSNMYPQVHPLAIDLLQKMLVFDPSKRISVIEALAHPYMSELYDPAANPPAQVPIDLDIDENIGVETIREMLWQEMLQYHPEAATMVNM

SEQ ID NO: 57965 - protein, 411 aa, Synechococcus elongatus PCC 7942
MSESLESLARLAHWRHELRTPINAILGYSQLLLEDWAGTAIATDLERIESAGQELLRLVNEILDPHSSDRGLSLDTYQARLRYALRTPVNTVCGYVELLLEEDSPELAESRVDLERISAAGERLLEQLEAMAAWDQPASQASAVALSEMEVEVAESVLRYRQAAVSASAVTGGRLLVAEDNEINRDVLERRLRRLGHDVVCVASGQEALNQLAQQPFDLLFLDVMMPGLTGFEVLQQLKADPTLAELPVLMISALDDLESVIRCLRLGATDYLTKPFEPTLLQTRLETCLQHKRLRDRELDYLRNVAIVTDAAVAVEAGDYDRDRLQTVAERSDALGQLARMFRQMTRSVEQRETQLKQTIRRLELQIDTATVKSQVKEITESDYFRDLESRARQIRRDRSYRSSPPDRHA

SEQ ID NO: 57966 - protein, 260 aa, Candida glabrata CBS 138
MSYTPLPNINDFPTLGNPLEDAKRAAAYRAVDENLNFDEHRIIGVGSGSTVVYVAERIGQYLKDEKYHDKVSKFICIPTGYQSRNLIQDNGLILGSIEQHPHVDIAFDGADEVDHNLQLIKGGGACLFQEKLVSTSAKIFIVVADSRKKSDTNLGINWKRGVPIEIVPSAWSRVQHDLTSILHANSAPVRQGGSAKAGPVVTDNMNFLIDADFGEIQDPKALHEQIKMLVGVVETGLFIDNAHRAYFGKPDGSVEVIDKK

SEQ ID NO: 57967 - protein, 312 aa, Symbiobacterium thermophilum IAM 14863
MDRPVVVVGSLNLDLVVNPERAPAAGETVFAPRLDQFPGGKGANQAVAAARLSAPVAMVGRVGQDAFGDRLLESLRADGVATEGISRSATAGTGTAVITVEATGQNRIVVVSGANAEVTPELVEAHGPLIASASALLLQLEVPVEACVRAAELAAAAGVPVILDPAPAPAEPLPEPLRRNTWLITPNETEAAALTGVPVAGRCGAEEAARVLWAQGFRQVLIKLGSEGAYLFRGGAGQWFEPFRVPVVDTTAAGDAFAGGLAAALHRGMALEEAVRWGMAAGALAVTRPGAQPAMGNLDELMTLLRTGRLDA

SEQ ID NO: 57968 - protein, 71 aa, Glycine max
  misc_feature (20)..(20): Xaa can be any naturally occurring amino acid
  misc_feature (41)..(41): Xaa can be any naturally occurring amino acid
  unsure (1)..(71): unsure at all Xaa locations
PGAGMVVPFTGLKSMVGFPXRKTTIDFTSIVTTGEKFQCMXQVWPPFGKKNFKTFSYLPNLDDPQWAKEVE

SEQ ID NO: 57969 - protein, 127 aa, Shewanella sp. MR-7
MKSIIHAERAPAAIGPYSHGTNYGNLIFTSGQLPVCKEKGGVVDGGISEQSVQCLENLKYVIEAGGGSLETVLKTTCYLSEISDFAAFNEVYKSYFKTDCPARSCFAVKDLPLGVKVEVEAIAHIHA

SEQ ID NO: 57970 - protein, 574 aa, Coccidioides immitis RS
MSFKNPYSDTYAPGPERARWPPLTRMLMSGEMSGEPPRDLTMKEKFDRWMVNEGWRRLTVAVFVLAHLMIFGFGLMHYGLKDNLTGSRATFGVTFTIARAAALVLHFDVGLILFPVCRTLISLMRQTPLNGIIQFDRTNTVTVVAWSIVTFSWIHTVAHWVNYAQLAAKQGLGVAGFLLANVVTGPGWTGYIMLIALMAMALTSIGKRRRANFERFWYTHHLFVIFFFFWAFHGAFCMIKPDYPPFCAGIGVFWMYWIYGAVIYLVERLLREIRGRHKTYITKVVQHPSNVVEIQMKKEKTKTRAGQYIFLCCPTVSVWQYHPFTLTSAPEEDYISVHIRCVGDFTKALAKTLGCTFDEGKGKGGKGKTGVVGVNNQMAPDDVDPSIRRVLPRIYVDGPFGSASEDVFKYEVAVLVGAGIGVTPFASILKSIWYRMNYPQTKTRLRKVYFFWICRDFGSFEWFQSLLLAIEAQDTANHIEIHTYLTAKIRPDDATNIMINDANAEQDTITGLRAPTNFGRPNWDMVFRSIRKLHAPAEAGVFFCGPKPLGSVLHVKCNMYSEPGFNFVWGKENF

SEQ ID NO: 57971 - protein, 461 aa, Burkholderia thailandensis E264
MTSRDERLHRGLEERHINLMALGATIGVGLFLGSATAIRAAGPAILLTYMLGGIAIFLIMRALGEMAIDNPVAGAFSRYARDYIGPLAGYLTGWTYWFMWIVTCMAEITAVGVYMHMWFPDVPNWIWTFAALIVMGAVNFIAVKLYGEFEFWFALIKIVTIVLMIAGGALMIVAGVGNGGVPTGVSNLWAHGGFLPNGLAGVVDALPIVMFAYLGVEMLGLTAGEARNPEKSLAKAVNSVFWRVVIFYVGALFVIMSIYPWSQIGTQGSPFVMTFSRLGIPAAAGIINFVVLTAALSSCNSGIFSTARMLFNLAEQGQAPERLASVNRRGVPVHGVLISVALLFVGVALNYYAPQKVFVWLTSVSTFGAIWTWCVILIAQLRFRRRVSAERLARLPLRVPLYPMSSFVALAFLAFVVVLMAFSPDTRVALVIGPLWIAALTVYYHLSQAGRRAPLGAPTDG

SEQ ID NO: 57972 - protein, 359 aa, marine gamma proteobacterium HTCC2080
MKAAVCRAFGHPLTIEELDIAEPKAGEVKVRLTACAICHSDVILIDGGWGGDLPAVYGHEASGVVESIGSGVVDLKPGDPVVVTLIRSCGNCHYCNQSIETQCDGAFPLDQQSPISDSSGQVVSQGLNSGAFAEQVVVEQSQVCVIPEDIPLDVASILACGVLTGFGAVVNTAQVKAGSTVAVIGCGGVGINSIQGAVHAGASQVIALDLLDDKLELAQQFGATHAVNSAEKDCIDQVIALTAGRGVDYVFVTVGAKAAIEQSVSFLAKSGTAVIVGMPASGVMAQYDPGELAARGQSVLGSKMGSGSVKRDIPKLAALYQSGELKLDQMISGRYALEEINEAIASVKRGEALRNVVIF

SEQ ID NO: 57973 - protein, 328 aa, Gibberella zeae PH-1
MDNYQRIEKVGEGLSQLITHLIHLLTQLSGTYGVVYKARDLGHSGRIVALKKIRLETEDEGVPSTAIREISVLRELNHANVVSLLNIVHADGHKLYLVMEFLDLDLKKYMDSLPVTDGGRGKPLPTGTATVIRNLGMSDKVVEKFMLDLCQGIKYCHSRRILHRDLKPQNLLIDKEGNLKLADFGLARAFGVPLRSYTHEVVTLWYRAPEVLLGGRQYSTGVDMWSVGTIFAEMCSRKPLFPGDSEIDEIFKIFRTLGTPDEDAWPGVTAYPDFKPSFPKWQRDFSTPLCPNLNEQGLELLDYLLICDPVTRISAKAALNHPYFDDIL

SEQ ID NO: 57974 - protein, 386 aa, Saccharomyces cerevisiae
MVNLNTIPPKNGRDYYIALGLEGSANKLGVGIVKHPLLPKHANSDLSYDCEAEMLSNIRDTYVTPPGEGFLPRDTARHHRNWCIRLIKQALAEADIKSPTLDIDVICFTKGPGMGAPLHSVVIAARTCSLLWDVPLVGVNHCIGHIEMGREITKAQNPVVLYVSGGNTQVIAYSEKRYRIFGETLDIAIGNCLDRFARTLKIPNEPSPGYNIEQLAKKAPHKENLVELPYTVKGMDLSMSGILASIDLLAKDLFKGNKKNKILFDKTTGEQKVTVEDLCYSLQENLFAMLVEITERAMAHVNSNQVLIVGGVGCNVRLQEMMAQMCKDRANGQVHATDNRFCIDNGVMIAQAGLLEYRMGGIVKDFSETVVTQKFRTDEVYAAWRD

SEQ ID NO: 57975 - protein, 402 aa, Erythrobacter sp. NAP1
MTAFKTLDDLGDVTGKVALVRVDLNLPMKDGSATDLTRVEAVKPTILELADKGAKVLLLAHFGRPKGQRSSVLSTSMVVGDVEKVLDKELMFIPEVHGPVVEQSIGILRNGDIGLLDNTRFWPGEEGNDPNFAQAIAAHGDFYVNDAFSAAHRAHASTEGITHFLPSYAGRAMERELKALDAALGNPEAPVAAVVGGAKVSTKLAVLENLVGRVQHLIIGGGMANTFLAARGVDVGKSLCEHDLTDTASKIMDEADHSGCTVHLPYDVVVAQEFAANPASLRTCNVHEVSSDEMILDIGPQATEALADVLKTCRTLVWNGPLGAFETEPFDTATVALARHAAALTQEGSLTSVAGGGDTVAALAQAGVTEDVTYISTAGGAFLEWMEGKELPGVAALERAHG

SEQ ID NO: 57976 - protein, 172 aa, Lactobacillus reuteri
MALDLYKYVASVPDYPEKGIIFRDILPLMADGAAFKQATDELVDYAKDKKVDMVVGPEARGFIVGCPIARELGVGFAPARKKGKLPRKAISASYDLEYGTATLQMEADAIKPGQRVLVVDDLLATGGTISATIDMVEQMGGIVVGCAFLIELKDLHGRDKLKDYDMKALMEF

SEQ ID NO: 57977 - protein, 115 aa, Yarrowia lipolytica CLIB122
MDNPAELLNKDKSTLTDVELQKLEEYEFSHGPLSLLQRAVQNHTQVLISCRNNKKLLARVKAFDRHSNMVLENVKEMWTEKTKTASGKPGKTVTKDRFISKMFLRGDTVILVVSA

SEQ ID NO: 57978 - protein, 477 aa, Burkholderia thailandensis E264
MSYRLNNESAWIQPAAPAPGAHAHRTSAEYRALDAAHHIHPFSDMGSLNRAGSRVIVKAEGVHLWDSDGNKIIDGMAGLWCVNVGYGREELIAAGSRQLRELPFYNTFFKTTHPPVIELSALLAEIAPPAFNRFFYCNSGSEGNDTVLRIAHQYWRTQNRPQKKFVISRRNGYHGSTIAGATLGGMGYMHEQMPSKVEHIVHIDQPYYFGEASEGQTPEAFGLERARQLEAKILELGAQNVAAFIGEPFQGAGGVIFPPSTYWPEIERICRQYDVLLVADEVIGGFGRTGEWFAHQHFGFEPDLMTLAKGLTSGYVPMGAVALSDRIADALIAHGEFNHGMTYSGHPVAAAVAVANLKVLRDEKIVERVKTDTGPYFQQLLRETFANHPIVGDIAGAGLVAGIQLAREPGARKRFENGGEVGTICRDYCFNGNLIMRATGDRMLLSPPLVISRPEIDEIVEKAKRAIDATAQQLGLS

SEQ ID NO: 57979 - protein, 421 aa, Zea mays
MSLLWCRGAAGGWRRPGEDCSAAAKGFKMLACIACSAKDGGDQDGSRAATPHGRDAGKSLTSQLKDMVLKFSGSGRQYKAAAASPSFRGNRFHRNSRLAAYTGVIDDSGFTSDGATEGYGYMRTTTHATGATAGTKVGRGFPQHVRSPSASWIPSIGEEDDEEDEEVVVVEEDRVPREWTAQVEPGVQITFVSTAGGAGNDIKRIRFSRDMFNKWEAQRWWGENYDRVVELYNVQTFSRQQGVSTPTSSIDDATQRDSSFYSRAGSTRDSPVILPPTAVGREQPIARATSCRATAAAASTARAACNPSSSAVPDPSDHVWAHHFNLLNSAPAPAPAAPHLDPSRATTSSLDEASVSVSNASDLEATEWVEQDEPGVSITIREFGDGTRELRRVRFSRERFGEERAKVWWDQNRNRIHAQYL

SEQ ID NO: 57980 - protein, 376 aa, Fucus vesiculosus
MADEDVQALVVDNGSGMCKAGFARDDAPRAVFPSIVGRPKHPGIMVGMDQKDAYVGDEAQSKRGVLTLKYPIEHGIVTNWDDMEKIWHHTFYNELRVAPEEHPVLLTEAPLNPKANKERMTQIMFETFNVPAMYVNIQAVLSLYASGRTTGCVLDSGDGVSHTVPIYEGYALPHAINRLDLAGRDLTDNLMKVLTERGYSFTTTAEREIVRDIKEKLTYVALDFDQEMKTAAESSQLEKSYELPDGNVIVIGNERFRCPEVLFQPSFIGMESSGIHDCTFKTIMKCDVDIRKDLYGNIVLSGGTTMFPGIGERMTKELTALAPSTMKIKVVAPPERKYSVWIGGSILASLSTFQQMWISKAEYDESGPSIVHRKCF

SEQ ID NO: 57981 - protein, 720 aa, Coccidioides immitis RS
MAAPTQLAYRTLKGIGILDAAPVYEPLPGFTRPEGNLRCCTYSPCGRYFAWASPEGVSIIDPSVGHLIATLPAENVYELGFSPLGTFVITWQRPSKDENGDAVRNLKVWRVVEGPPSDNGDEPPRVPTGSFVQKSQTGWNLQYTADEKYCARVVTNEVQFYQSGNLTTVWNKLRVEGVVDFAISPGQNHTVAVFIPERKGQPASVKVFNVPQFNLPLSQKNFFKGDKVQMKWNKSGTTLIVLAQTEVDKTGKSYYGETTLYLLSTNGFDSRIDLDKEGPIHDVTWSPNSKEFGVVYGYMPAKTTVFNSRGAATHSFPLAPRNTIVFSPHGRFVIVAGFGNLAGQMDIYDLEKNYTKVATVEASNASVCEWSPDGKHILTATTSPRLRVDNGVRIWHVGGGLMYNEDMNELYDVHWRPQSSVSHPLENPLHPMPNPHPSALAYLANKKTPSKPVGAYRPPGARGQSAPMTFRREDEGGAAFIRDERPNAFGPSANAFGKPRRRVVPGAEPMDEFLPPGAAPGGGVALPPGAQADEKLSKSAAKNKKKREAKKAKENAEKAQNLSVENGGSGEQSPAGVNADRREKRAHSRSRSRGNLDPNAHGRQNRDRSRSSHRRQRSDAHGKGNNNAAQGRPNGKAKAGQPPNGALAAPVPDVTVTSPTTGNASTPQEKKIRGLLKKMRAIDELKMRLAGGEKLEDTQMKKIKTEESVRKELEALGWSG

SEQ ID NO: 57982 - protein, 455 aa, Emericella nidulans
MSAPTADIRARAPEAKKVHIADTAINRHNWYKHVNWLNVFLIIGIPLYGCIQAFWVPLQLKTAIWAVIYYFFTGLGITAGYHRLWAHCSYSATLPLRIWLAAVGGGAVEGSIRWWARDHRAHHRYTDTDKDPYSVRKGLLYSHLGWMVMKQNPKRIGRTDISDLNEDPVVVWQHRNYLKVVFTMGLAVPMLVAGLGWGDWLGGFVYAGILRIFFVQQATFCVNSLALWLGDQPFDDRNSPRDHVITALVTLGEGYHNFHHEFPSDYRNAIEWHQYDPTKWSIWAWKQLGLAYDLKKFRANEIEKGRVQQLQKKLDRKRATLDWGTPLDQLPVMEWDDYVEQAKNGRGLVAIAGVVHDVTDFIKDHPGGKAMISSGIGKDATAMFNGGVYYHSNAAHNLLSTMRVGVIRGGCEVEIWKRAQKENVEYVRDGSGQRVIRAGEQPTKIPEPIPTADAA

SEQ ID NO: 57983 - protein, 213 aa, Cardamine flexuosa
MVRGKTQMKRIENATSRQVTFSKRRNGLLKKAFELSVLCDAEVSLIIFSPKGKLYEFASSNMQDTIDRYLRHTKDRVSSKPVSEENMQYLKFEAANMMKKIEQLEASKRKLLGEGIGTCSIEELQQIEQQLEKSVKCIRARKTQVFKEQIEQLKQKEKALAAENGKLSEKWGSHETEVWSNKNQESGRGDEESSPSSEVETQLFIGLPCSSRK

SEQ ID NO: 57984 - protein, 904 aa, Pseudomonas fluorescens PfO-1
MNRQTTASTCCYCGVGCGVLIEHDGERILGVSGDPAHPANFGKLCSKGSTLHLTGDLAARALYPELRLGKGLARSRCDWDTALDHATNVFADTIAEHGPDSVAFYISGQLLTEDYYAFNKLARALVGTNNIDSNSRLCMSSAVVGYKRSLGADAPPCSYEDLELSDCVVIVGSNMAYAHPVLFRRLEEAKSRRPQMKVVVIDPRRTDTCDLADLHLAILPGTDVALFHGILHLLLWEDWIDRDFIKAHTDGLAELKSLVRDYTPAMVSQLCGISVEQLQQCAEWIGTAPSFLSLWCMGLNQSTAGSAKNSALINLHLATGQIGRPGAGPFSLTGQPNAMGGRETGSLSNLLPGHREVANPEHRAEVAAYWGVDKLPENTGLSAIELFEQVRGGKIKALWIACTNPAQSMPDQTAVRAALETCPFVVLQEAFRTTETAAFADLLLPAASWGEKEGSVTNSERRISHVRQAIAAPGEARPDWAITVDFAQRLEKRLRPQQPGLFAFEQPAQLFDEYKQLTRGRDLDLSGISHGLIDELGPQQWPFPAGARQGTARLYGDGIFPTANGRARFVADPYRAAKEQRDARFPLTLITGRLRDQWHGMSRTGTAAQLFGHVSEAVLSLHPDELRRHRLQPGDLVNLKSRRGAVIVAVASDDSVRPGQAFLPMHWGDRFLKGGVNSLTLPAFDPLSKQPELKHSGVRLEPVDLPWQLFALIEGDVQRHFEALRPLCEAFSYASLSLVGRERPALLIRAASAVAPEPRLLREIDQCLALIDGPVLAYDDPRRAIGKRVRIENGRITAIRLAGETLAQHWLQGLWLEGRADEQLRRWLLAPMSAPPGNAGAQVVADKTLCNCKNVSHSAVCAGIREGLDLQGLKNKLGCGTQCGSCVPEIKRLLAAEVRPVAVI

SEQ ID NO: 57985 - protein, 1051 aa, Sulfolobus solfataricus P2
MRETPKKVLVIGSGPIKIAEAAEFDYSGSQALKALKEEGIETVLVNSNVATVQTSKKFADKLYMLPVVWWAVEKVIEKERPDGIMIGFGGQTALNVGVDLHKKGVLQKYNVKVLGTQIDGIEKALSREKFRETMIENNLPVPPSLSARSEEEAIKNAKIVGYPVMVRVSFNLGGRGSMVAWTEEDLKKNIRRALSQSYIGEVLLEKYLYHWIELEYEVMRDKKGNSAVIACIENLDPMGVHTGESTVVAPCQTLDNLEYQNMRTYTIEVARSINLIGECNVQFALNPRGYEYYIIETNPRMSRSSALASKATGYPLAYVSAKLALGYELHEVINKVSGRTCACFEPSLDYIVTKIPRWDLSKFENVDQSLATEMMSVGEVMSIGRSFEESLQKAIRMLDIGEPGVVGGKVYESNMSKEEALKYLKERRPYWFLYAAKAFKEGATINEVYEVTGINEFFLNKIKGLVDFYETLRKLKEIDKETLKLAKKLGFSDEQISKALNKSTEYVRKIRYETNTIPVVKLIDTLAGEWPAVTNYMYLTYNGTEDDIEFSQGNKLLIIGAGGFRIGVSVEFDWSVVSLMEAGSKYFDEVAVLNYNPETVSTDWDIARKLYFDEISVERVLDLIKKEKFRYVATFSGGQIGNSIAKELEENGVRLLGTSGSSVDIAENREKFSKLLDKLGISQPDWISATSLGEIKKFANEVGFPVLVRPSYVLSGSSMKIAYSEEELYEYVRRATEISPKYPVVISKYIENAIEAEIDGVSDGNKVLGITLEHIEEAGVHSGDATMSIPFRKLSENNVNRMRENVLNIARELNIKGPFNVQFVVKENTPYIIELNLRASRSMPFSSKAKGINLINESMKAIFDGLDFSEDYYEPPSKYWAVKSAQFSWSQLRGAYPFLGPEMKSTGEAASFGVTFYDALLKSWLSSMPNRIPNKNGIALVYGNKNLDYLKDTADNLTRFGLTVYSISELPLQDIETIDKMKAEELVRAKKVEIIVTDGYLKKFDYNIRRTAVDYNIPIILNGRLGYEVSKAFLNYDSLTFFEISEYGGGI

SEQ ID NO: 57986 - protein, 823 aa, Pseudomonas fluorescens PfO-1
MLPENLMKKLKLVMIGNGMAGVRTLEELLKLSNELYDITVFGAEPHTNYNRILLSPVLAGEQTFEEIVLNDLDWYLENNIKLLLNRKVVEIDRVKRRVIAEDGTEAEYDRLLIATGSTPFILPIPGNTLQGVIGYRDIADTQAMIDTAKTHKHAVVIGGGLLGLEAANGLMLRGMHVTVVHLGEWLLERQLDKTSGQLLQTALESRGLHFRLCEQTQALHDAGNGRVGSVQFKNGDIIPADLVVMAAGIRPNTELAEKAGIPCNRGILVNDTLQTYDPRIYAIGECASHRGIAYGLVAPLFEQAKVCANHLAQLGFARYQGSVTSTKLKVTGIDLFSAGDFMGGEGTETITLSDPIGGVYKKLVIKDDVLVGACLYGDTADGGWYFRQIRENHAIGEIRDHLMFGENALGDVGHQGQDKAMSMADNAEVCGCNGVCKGTIVKAIQEHGLFSVDEVKKHTKAASSCGSCAGLVEQILINTVGGAADVKPKSEKAICGCSDLNHGQIRQAIREQHLLTIAGTMSYLNWRTPNGCATCRPALNYYLISTWPGEAKDDPQSRLINERAHANIQKDGTYSVVPRMWGGVTNPSELRRIADVADKYQVPMVKVTGGQRIDLLGIKKQDLPGVWKDLDMPSGHAYGKSIRTVKTCVGSEFCRFGTQNSTQLGIDLEHDLFNMWSPHKVKLAVSGCPRNCSEAGIKDVGIIGVDSGWEMYIGGNGGIKTEVAEFFVKLKTAEEVREYNGAFLQLYREEAFYLERTVHYLQRVGMEHIKKAVLEDPERRKALNERLQFSLSFEQDPWKERLAQPQLKKEFDVLPVKNLEVPA

SEQ ID NO: 57987 - protein, 203 aa, Zea mays
NISKIYVLTQFNSASLNRHLSRAYGNNIGGYKNDGFVEVLAAQQSPDNPNWFQGTADAVRQYLWLFEEHNVMEFLILAGDHLYRMDYEKFIQAHRETDADITVAALPMDEKRATAFGLMKIDEEGRIIEFAEKPKGDQLKAMMVDTTILGLDDERAKEMPYIASMGIYVFSKDVMLQLLREQFPGANDFGSEVIPGATSIGKR

SEQ ID NO: 57988 - protein, 339 aa, marine gamma proteobacterium HTCC2080
MTVNRQWLLAKRPDGMIGPDNFKYTETPVPTPGDQEVLIRNLYFSFDPTQRNWMVDRPSYLPPVGLGEVMRAGSVGQVVESRHSDFNVGDLVQTTGCWQDYVVLAPGEGPMGLNVLPPGVPPELMLSVLGITGITAYFGLLDVGKPIAGDTVLVSGAAGATGSVAAQIARIKGCRVVGIAGGPEKCAWLTDSAKLDVAIDYKAGDLDAQIGAACPDKWNVFFDNVGGSTMQAALNHISLNARIAMCGGISGYNDIEPQPGPNNLMNLVTNRGRMEGFIILDYLHRAAEAVQELIGWVGSGEIQYQVDVQEGFDNIPATLQRLYTGQNKGKQLLKIADPE

SEQ ID NO: 57989 - protein, 525 aa, Parvularcula bermudensis HTCC2503
MDGSAFPSPQEPGGGRPEGDEGQYDVVIVGAGISGINAAYRLTESDPTLTYKIFEGRERLGGTWDLFKYPGIRCDSEMSTLAFPFRPWEEKSLIGSGYEIRDYLEDTARENGIYPRIEFQTYVKSAAWSSEENLWTVKIVNAAGTERTVKGRYIYLGTGYYDYGSGYTPDFPGLESFGGQMIHPQHWPEDLPLKDKKAVIIGSGATAITLVPAMADEGAEVTMLQRSPTYVIAMPSSAAPARALRAVFGRNLGNKIERWRSHFLGDTFYKASKAFPGLIRNILQRRAQSLLGKNVSVDPHFTPKYNPWDQRLCLDPDAKLFKTLRKGKAKVVTDHIERFDETGIQLKSGDHLDADIVVSATGLNVKMFGDIDLSVDGRPIDPADHFVYRGMMLDGVPNFFLAIGYVNASWTLKVDLTAQLAASVIGRAKAGGHQRVAAIPLSDMGKESPLLDLTSGYVQRALERLPRQGAEEPWVVHQDFKKDIKSTREGMKGDEAVKFDPSPDQLKPFQPRTPSATAPELQAAE

SEQ ID NO: 57990 - protein, 500 aa, Parvularcula bermudensis HTCC2503
MSVTPIHKKQIYDVLIFGAGVSGIGCAATLRQKSPEKTWTILEMRHDLGGTWDLFKYPGIRSDSDLYTFSYEFKPWDRKRSIARGDEIKDYLDDTAKEFDVKDHIQFHTKILSCSWDSQQALWTVRVENTKTGEQSDVFGRWIFSGTGYYDYDKGYRPSFPNEDAYKGEIIHPQHWPEDLDYSGKRIAVIGSGATAVTLLPSLAEKAAHVIQVQRTPTYVLPVPQVDPWQYLFRPFVSKNTLHRLMRAKNILRQKLLWGASRRFPRMMRQFIRLVNKVYLPSHYPVDTHFNPPYDPWDQRLCAVPDGDLYKSLRKGECSIVTGTIARFTEKGIEMSSGETVEADIIVTATGLNIKLLGGVTYTVDGEEIDWSQRVVFKGMMYNGIPNFVMALGYTQSSWTLKVGLLCEYLCRLFAEMDRRGMAVCTPELPDRPMELRPLLDFGAGYVRRAIDKMPRQGDAFPWEMTFNYSEDAEMMKEGEVVAPELRLSPLPEALAYAAE

SEQ ID NO: 57991 - protein, 306 aa, Synechococcus sp. WH 8102
MIDRLGPPGGDPAIDGPLDDRLGGAPANVACGLARLGTSVAFLGRLGADAIGDRFATLFLQRGVDVDSVQWDAQRPSRIVLVRRSADGERQFRGFAGDEGLGFADQALASVELPKQARWLLTGTLPLAAHASADSLRGAVAQSKARGIALAVDVNWRPTFWDSAARPDAGPSQQAIELIRPLLEQAALIKLAREEAIWLFGSTDPRAICTQLPQEPDVVVTDGAEPVRWWMDGASGTQPAFHPPQVVDTTGAGDAFTAGLLHRWSASPAERVRFASACGALVCAGAGGIDPQPTEAQVEAFLGGVS

SEQ ID NO: 57992 - protein, 532 aa, Yarrowia lipolytica CLIB122
MFSLTGKPLLYFTSVFVSLGVFLFGYDQGVMSGIITGFYFKEYFHEPTRAEIGTMVSILEVGAFVSSLMVGRIGDIIGRRKTIMYGAFIFIIGGAFQTFAVSMSEMILGRVVAGFGVGMLSTIVPVYQSEISPPHNRGKLACIEFTGNIVGYASSVWVDYFCSFINSNMSWRIPLFLQCAMGALLFGGSFLIAETPRWLLDNDHDEEGLVVLANLHGGGDIDSPLAKQEYREIKQSVLIHRLEGERSYTDMWKKYKKRVLIAMSSQMFAQLNGINVISYYAPLVFEEAGWVGRSAILMTGINGIVYVCSTIPPWYLVDKWGRRPILLSGAVIMAISLASVAFWMRLDFAHTPALVVISVVIFNAAFGYSWGPIPWLYPPEIMPLTIRAKGASLSTATNWAFNWLVGYMTPILQETIKWRLYLMHAAFCSLSFVLVYFTYPETSGINLEDMDSLFGDKSVVNTPDSRSLLGDRDTPEPDVPHSYTDAATDRLPAGMQGYGSAPSSRGGSVVGSPRRGNSVVGSPKRDFPQPPV

SEQ ID NO: 57993 - protein, 129 aa, Actinobacillus pleuropneumoniae serovar 1 str. 4074
MTKVIHTEKAPAAIGPYVQAVDLGNLVLTSGQIPVNPQTGEIPTDITQQARQSLENVKAIVEQAGLSVADIVKTTVFVKDLNDFATVNAEYEAFFRENNHPTFPARSCVEVARLPKDVGLEIEAIAVRK

SEQ ID NO: 57994 - protein, 98 aa, Dianthus caryophyllus
MATVGGIKDSGGSSANSLEIDELAKFAVDHYNSKENALLEFQRVVNTKEQVVAGTIYYITLEATDGGVKKLYEAKVWVKPWVNFKEVQDFKYVGDASA

SEQ ID NO: 57995 - protein, 175 aa, Draba nemorosa var. hebecarpa
MVRGKTQMKRIENATSRQVTFSKRRNGLLKKAFELSVLCDAEVSLIIFSPKGKLYEFASSNMQDTIDRYLRHTKDRISSKPVSEENMQHLKHEAANMMKKIEQLEASKRKLLGEGIGTCSIEELQQIEQQLGKSVKCIRARKTQVFKEQIEQLKQKEKALAAENEKLSEKWGSNE

SEQ ID NO: 57996 - protein, 376 aa, Hypocrea jecorina
MEEEVAALVIDNGSGMCKAGFAGDDAPRAVFPSIDGRSRHHGIMIGMGQKDSYVGDEAQSKRGILTLRYPIEHGVVTNWDDMEKIWHHTFYNELRVAPEEHPVLLTEAPINPKSNREKMTQIMFETFNAPAFYVSIQAVLSLYASGRTTGIVLDSGDGVTTVVPIYEGFALPHAIRRVDMAGRDLTDYLMKILAERGYTFSTTAEREIVRDIKEKLCYVAHDFEQEIQTAAQSSSLEKSYELPDAQVITIGDRFRAPQALFHASVLGLESAGIDVTTFNSIMKCDVDVRKELYGNIVMSGGTTMFPQGISDRMQKEITASAPSSAMKVKIIAPPERKYSVWIGGSILASLTTFQQMWISKQEYDESGPSIVHHKCF

SEQ ID NO: 57997 - protein, 104 aa, Zea mays
  misc_feature (8)..(8): Xaa can be any naturally occurring amino acid
  misc_feature (48)..(48): Xaa can be any naturally occurring amino acid
  misc_feature (53)..(53): Xaa can be any naturally occurring amino acid
  misc_feature (65)..(65): Xaa can be any naturally occurring amino acid
  unsure (1)..(104): unsure at all Xaa locations
MSGRGMDXKGLCKGCSKRHRKVLRDNIQGITKPGIRRLDRRGGVKRIXGLIYXETRGVLNIFLEXNVIREADTYTEHALRMTETDMDVLYALNRHGRTLYGFGG

SEQ ID NO: 57998 - protein, 377 aa, Zymomonas mobilis
MTAIVSIHGRQVVDSRGNPTVEVDVTLEDGSFGRAAVPSGASTGVHEAVELRDGDKTRWGGKGVTKAVHAVNNEIANAIIGLEAEDQELIDQTMIKLDGTPNKGKFGANAILGVSLAVAKAAAEARGLPLYRYVGGTAAHVLPVPMMNIVNGGMHADNPIDFQEFMIAPVGASSINEAVRIGTEVSHTLKKELSAKGMNTNVGDEGGFAPSLDSASSALDFIVDSISKAGYKPGEDVFIALDAASSEFYNKDQNIYDLKGEGRKLTSAQLVDYYVELCGKYPIYSIEDLAEDDFEFWKILTEKLGDKVQLVGDDLFVTNVKRLSDGIERGIANSLLVKFNQIGSLSETLAAVNMANDASYTPVMSHRSGGNRRHHDC

SEQ ID NO: 57999 - protein, 911 aa, Wolbachia endosymbiont of Drosophila simulans
MIGSSILRDNEGDSKFYYAISKLLKNLGEPIIRKAVKQAMSMLGNHFVVGETIEEALRYAKLDDNSKFLYSFDMLGEAAHTTEDAEEYFNSYMHSIKAIGESTEINDCFKSHGISIKLSALHPRYEFSQFGRIAGEIFTKVLELCREAKKYNISLCIDAEETERLEISLILFEQLRLDESLSEWEGLGLAVQAYQKRALSVLDFVEDVAIRSKHKIMVRLVKGAYWDSEIKCTQELGLNDYSVFTRKSYTDVSYLVCAQKLLSKPNSFYPCFGTHNVYTFASIMELADKNHPGFEFQRLHGMAKDLYDYAMSELATNVSCRVYAPVGEHSDLLPYLIRRLLENGANSSFVNQISNPNVKIDELISDPLEKAINFNYEPHPGIPLPQDILGPERKNSLGMDISDSVIVSQFADDIKGFSEKKWQVGPIIDGKALFDNAEFIEVVNPAHLENVIGEVSSATSDQALNALEIAHSAFAKWQNVSAEERAKCLEKAADLLEERMKELIYILIVEAGKILSDAIAEVREAIDFLRYYAMIAKNELSDWKKLPGPTGEDNFIFFEGRGVFLCISPWNFPLAIFIGQVSAALAAGNAVLAKPAEQTPIIAYEAVKILHEAGIPKNVLHLIPGDGGYLGKILVPDNRIAGVAFTGSTQTAQIINKMLANRDGPIVPLIAETGGLNAMIVDSSALLEQVTTDVLLSAFRSAGQRCSALRVLFIQEDIAEKQIKMICGAAQELKIGDPIQLSTDIGPIIDKASIDMLTQHTQKMSEDKDSNLLFKVPMDTNSHNGYFFPPYIYEIQKISQLKQEVFGPILHIIRFNKSQLNEVISDINSTGYGLTFSLQSRIQSQIDTISKKISVGNVYINRNQIGAAVGIQPFGGRGLSGTGPKAGGPHYLQRFSTEKVVSVNTTAFGVT

SEQ ID NO: 58000 - protein, 433 aa, Shewanella sp. MR-7
MRFESFSFCPEILRAISDCGYQKMTPIQQQAIPAIRRGQDVLASAQTGTGKTAAFALPILQKMVENPSETLKSNARVLILTPTRELAAQVADNVEAYSKYLNFSVLTIYGGVKVETQAQKLKRGADIIVATPGRLLEHLTACNLSLSSVDFLVLDEADRMLDMGFNADIQKILQAVNKKRQNLLFSATFSSAVKKLANDMMVKPQVISADKQNTTADTVSQVVYPVEQRRKRELLSELIGKKNWQQVLVFTATRDAADTLVKELNLDGIPSEVVHGEKAQGSRRRALREFMSGKVRVLVATEVAARGLDIPSLEYVVNFDLPFLAEDYVHRIGRTGRAGKSGVAISFVSREEERTLADIEKLIGQKIRRITVPGYEVGSRDLLLKQLQTRRSFAKKQQRLDNVSEQIVAEKSMQGRRVKMKVGQAPSKAKKLK

SEQ ID NO: 58001 - protein, 407 aa, Pyrobaculum aerophilum str. IM2
MVRIAVIPVGGEAVRLRPLTVETSKAMIRFLNRPLVELSILHLARQGIEEFYFGVRGYHNYRDIYDYFREGSWFAVKYGVNIKIRYMPRVETRGNAEAVLATLEYYDINEPVLVIQGDNIFNLDVKEMYSFHSSKKAFITIALKEETGDLSEFGVAAVDDNMRILKFVEKPKRREEAPSNLVNTGLYLLSEDFKSFFKGELGGKLYSEGRLDFGGDVIPAVIEAGLPVYGYHTKGYWFDVGTPERYLKAVQYLLRHLTAYELEAEEIAPSVFAQGKSEQSKALKEKIAEAIKNGQIKAEGRLLLGRHVQIGDNSYLRDTVIDNYVIIGDNSVIEDSVVMDRSYIGRGVVIRRSIIGRHVQIGDGAVIEDAVVADNVIVGDGAHLRRVKVWPHKTVERGVRLEGFSLI

SEQ ID NO: 58002 - protein, 462 aa, Zymomonas mobilis
MAIELKMPALSPTMEEGTLTRWLVKEGDSIKAGEILAEIETDKAIMEFEAVDEGVITKILIPEGSENVKVGTAIAYLGTDANDVTLDGASAETKAEESAPVASPAKTEAAAVEEAATPSLGKVINSAPEIPEGTEFFQQTLREALRDAMAEEMRRDDRVFVMGEEVAEYQGAYKVTQGLLQEFGARRVVDTPISEYGFSGIGVGAAMEGLRPVIEFMTMNFSMQAIDHIINLRPKRIICPAAKCRCPIVFRGPNGAAPPVGEQHTQNFGPWYAAVPGLVVLAPYDAIDAKGLLKAAIRSDDPVVFLECELLYGKTFDVPKMDDFVLPIGKARIIREGKDVTIVSYSIGVSFALTAAEALAKEGIDAEVIDLRTLRPLDKETILQSLAKTNRIVTVEDGWPVCSISSEIAAIAMEEGFDNLDAPVLRVTNADTPTPYAENLEKKGLVNPEAIIEAVRKVCYRK

SEQ ID NO: 58003 - protein, 387 aa, Zea mays
  misc_feature (29)..(29): Xaa can be any naturally occurring amino acid
  unsure (1)..(387): unsure at all Xaa locations
PRVRDELRRYRRVQALLKRLNKPALRSIXHSPDGDLIDCVPAHLQPAFDHPRLRGQRPLAGPPPARPKGNRLRDPIRNDTAEAAGVQQLWAASGESCPEGSVPIRRVTESDVLRASSVRRFGRAPAGRVRRDSVSGGHEHAVGYVAGDEYYGAKASINVWAPQVSTASEFSLSQIWVIAGSFGNDLNTIEAGWQVSPELYGDNAPRFFTYWTTDAYQTTGCYNLLCSGFIQTNSRIAMGAAISPTSAYNAGQFDISLLVWKDPNHGNWWLEFGSGELVGYWPSLLFSHLASHASMVQFGGEVVNTRASGSHTATQMGSGHFAGEGFGRASYFRNLEVVDWDNSLVPLAAGFHVTADHPSCYDIQGGVNAVWGNYFYYGGPGRNVRCT

SEQ ID NO: 58004 - protein, 609 aa, Saccharomyces cerevisiae
MKNSTAASSRWTKSRLSHFFPSYTNSSGMGAASTDQSSTQGEELHHRKHCEEDNDGQKPKKSPVSTSTMQIKSRQDEDEDDGRIVIKPVNDEDDTSVIITFNQSISPFIITLTFVASISGFMFGYDTGYISSALISINRDLDNKVLTYGEKELITAATSLGALITSVGAGTAADVFGRRPCLMFSNLMFLIGAILQITAHKFWQMAAGRLIMGFGVGIGSLISPLFISEIAPKMIRGRLTVINSLWLTGGQLIAYGCGAGLNHVKNGWRILVGLSLIPTVLQFSFFCFLPDTPRYYVMKGDLKRAKMVLKRSYVNTEDEIIDQKVEELSSLNQSIPGKNPITKFWNMVKELHTVPSNFRALIIGCGLQAIQQFTGWNSLMYFSGTIFETVGFKNSSAVSIIVSGTNFVFTLIAFFCIDKIGRRYILLIGLPGMTVALVICAIAFHFLGIKFNGADAVVASDGFSSWGIVIIVFIIVYAAFYALGIGTVPWQQSELFPQNVRGVGTSYATATNWAGSLVIASTFLTMLQNITPTGTFSFFAGVACLSTIFCYFCYPELSGLELEEVQTILKDGFNIKASKALAKKRKQQVAEGAAHHKLKFEPTQEIVES

SEQ ID NO: 58005 - protein, 322 aa, Zea mays
MAKKRKRTDAPAEATGAEKPDDSAPARPERTLFGFKDPVPDAEPASAGAEAAVAPFRNREKVLITCSRRITYRYRHLMQDVLSLLPHAKKDSKVESKQSKGNALNELLELRSCSSCLFFECRKQKDLYLWMVKSPGGPSVKFLVNAVHTMEELKLTGNHLKGSRPLLTFSTNFDEQPHWKLVKEMITQIFATPKDHRKAKPFHDHVFVFSIVDGHVWFRNYQISVPHNEIDKVDKGGLDKMTLIEVGPRFCLNPIKIFGGSFGGPTWYENPYYISPNQIRALEKRQKAGKYAKKVKAKVRRKMHEMENTLEPDEFAELWKGE

SEQ ID NO: 58006 - protein, 567 aa, Acidobacteria bacterium Ellin345
MPEVAQETKAQRVERLKREKNAWERIDEIRTFAREGWDSIPPEWLGTYFRSWGVYTQGDGVGAVGGKGGEGRAVPFFMVRIRIPNGILTTSQLRVIADVSRRYARGIADITVRQNVQLHWVKIEDLPDLLAALENAGLTTLGACGDVTRNITGCPLAGVDGDEIFDASPIALELNRLFVGNAEFYNLPRKFKISITGCRHWCTYPEINDVGLTAVIRRRNGVEEKGFSIRVGGGLSTQPFLGVRLNAFVPYDKAVVTARTIAEIFRDQTVLRESREQARLKFLFLKHGWSADAMLAEVERRLSFHFDPAEPEDLVGDEFRDHIGIHPQRQPGLSYVGASVLRGRTGADQLSAVADLADRYGNGEIRTTTMQNLIFVNVPSAQTGRLAAELEALGLQVEPSPFWRGAVACTGTEFCKLAITETKSFTRWLVDELEERAPEFTEPLRINVTGCPNSCGQHWISDLGLEGKKLKVNGVMQDAYYFCVGGAVGLHQAIARPVGYRCLATDVPDAIARLLSRYLDDKHEAKSLREFLGRHTIDDIRGFLAGTSITGVPRDVAAGPVPHGVEG

SEQ ID NO: 58007 - protein, 325 aa, Zea mays
FKLSSALVSSSSCLRCRTSTDDITRLRLITAVKTPYLPDGRFDLEAYDSLINMQIEGGAEGVIVGGTTGEGHLMSWDEHIMLIGHTVNCFGSRIKVIGNTGSNSTREAVHATEQGFAVGMHAALHINPYYGKTSAEGMISHFEAVLPMGPTIIYNVPSRSAQDIPPEVILAISGYTNMAGVKECVGHERVKHYADKGITIWSGNDDECHDSKWKHGATGVISVTSNLVPGLMHSLMYKGENATLNEKLSPLMKWLFCQPNPIALNTALAQLGVARPVFRLPYVPLPLEKRAEFVRIVESIGRENFVGQKEAQVLDDDDFVLISRY

SEQ ID NO: 58008 - protein, 512 aa, Aspergillus nidulans FGSC A4
MSFFKNSRVYMLSAVAYMGSFLFGYDTGVMGSVLALDSFKHDFHMATGSTGFASSKEAEISSNVVALLTAGCFFGAIAGAIANDRYGRKNSLLVLSVIFMIGAAVQTGGRGTIAYIYGGRVIAGFGIGGMSAITPIYVSENCPPNVRGRIAGLFQEFLVIGVTVSYWLCYGVEKNIAPSTKQWRIPIGFQLVPSGLMFIGLWFLKESPRWLMKQGRREEATASLAFTRRADPNSDEVQQELAEIRASIEEELRSTEGVTWREVLLPGNRLRFLNAFLIMFWQQFSGTNSIGYYAPQLFQTIGVASTDTSLFTTGIYGVVKVVSTGLFLLIGIDRFGRKWSLVGGGWAMAVFMFILGAVLVSYPPVNTDTISNASIAMIVMIYLYVISYSASWGPIPWVYISEIFPTRLRAYGVGMGSATQWLFNFVVTKFTPSAISNIGWRTFIMFGVFCFAMGLWVCIFIKETKGKRLEDMDDIFGGKTVEQMQKDIEQADVEEQTEVEKTQTRHEEQVVR

SEQ ID NO: 58009 - protein, 176 aa, Triticum aestivum
  misc_feature (114)..(114): Xaa can be any naturally occurring amino acid
  misc_feature (139)..(139): Xaa can be any naturally occurring amino acid
  misc_feature (144)..(144): Xaa can be any naturally occurring amino acid
  misc_feature (150)..(150): Xaa can be any naturally occurring amino acid
  unsure (1)..(176): unsure at all Xaa locations
MPKIMLLLLLVCWTQARPAEEETPPGAGVKVSFRPSVAIVVGIFTMIFSLTFLLLMYAKFCHPANTPLLPATTASPSRPPATTAEAAAALEEAGAGVGKAVIESLPFFRFAALXGARQGLECAVCLARFEDADLLRLLXPRCRXPFHLEXVDCWLHSRAKLPVFAGPGWNPKEAEP

SEQ ID NO: 58010 - protein, 472 aa, Arabidopsis thaliana
FASSGSDDNDVVIIGGGPGGYVAAIKAAQLGLKTTCIEKRGALGGTCLNVGCIPSKALLHSSHMYHEAKHVFANHGVKVSSVEVDLPAMLAQKDTAVKNLTRGVEGLFKKNKVNYVKGYGKFLSPSEVSVDTIDGENVVVKGKHIIVATGSDVKSLPGITIDEKKIVSSTGALSLTEIPKKLIVIGAGYIGLEMGSVWGRLGSEVTVVEFAADIVPAMDGEIRKQFQRSLEKQKMKFMLKTKVVGVDSSGDGVKLIVEPAEGGEQTTLEADVVLVSAGRTPFTSGLDLEKIGVETDKGGRILVNERFSTNVSGVYAIGDVIPGPMLAHKAEEDGVACVEFIAGKHGHVDYDKVPGVVYTYPEVASVGKTEEQLKKEGVSYNVGKFPFMANSRAKAIDTAEGMVKILADKETDKILGVHIMSPNAGELIHEAVLAINYDASSEDIARVCHAHPTMSEAIKEAAMATYDKPIHM

SEQ ID NO: 58011 - protein, 444 aa, Marinobacter sp. ELB17
MSFSSLGLSEPLVRATLDQGYETPSPIQLKAIPAVLAGKDVMAAAQTGTGKTAGFVLPILQMLEQNPRTGKGPRVLILTPTRELAAQVHDSVNLYSRYVPTRAAVVFGGVKINPQMMKLRKGLDVLVATPGRLMDLYQQNAVRFNEVEFLVLDEADRMLDMGFIRDIRKILAMLPAKRQSLLFSATFSNEIRTLAKGLLNDPVQIDVAVRNTTAESVIQSVYPVDQSQKTALLSKLVRDNSWEQVLVFTRTKHGANRLTEKLGKDGITAAAIHGNKSQGARTRALAEFKQGDIRVLVATDIAARGLDIKQLPQVVNFELPNVPEDYVHRIGRTGRAGESGHALSLVSADELSMLVGIEKLIKKQLPRKEVEGFEPKNNVALKPKAKADPSKARNRSGGNGGGNGRPSDKPRSFGDKPGGRSAGRSQNGNGGQRGRSGQRQNQGA

SEQ ID NO: 58012 - protein, 206 aa, Cupriavidus necator
LQPGSAQVAAGYALYGPTTMLVLTVGNGVNGFTLDPNLGEFFLTHPHLRVPPDTQEFAINASNSRFWEAPVQRYIGECMAGKSGPRGKDFNMRWIASMVAEAHRILMRGGVFMYPRDTKDPAKPGRLRLLYEANPIAFLMEQAGGRASTGRQTLMSVAPGALHQRIGVIFGSRNEVERIEGYHTNQTDPDLPSPLFNERSLFRASA

SEQ ID NO: 58013 - protein, 159 aa, Cupriavidus necator
LQVPADTQEFAINASNSRFWEAPVQRYIAECMAGKSGPRGKDFNMRWIASMVAEAHRILMRGGVFMYPRDSKDPAKPGRLRLLYEANPIAFLMEQAGGRASTGRQTLMSVAPGALHQRIGVIFGSRNEVERIEGYHTDQTDPDLPSPLFNERSLFRASA

SEQ ID NO: 58014 - protein, 542 aa, Pichia pastoris
MVVSREEVREIIGRGNAIVIYEDHLLNLNGWLERHPGGEKAIHHMIGRDASDEMNAYHDPETVKTFKRWSIGRVKLPWDNLVPPIQGGNYSFDKVDQRVIYKKLGIFPGVKIEPKVQENIVLTEKSASKLLPVGGVRDPKTIIEDFDNKLVYEDIKQIPSLDHETQRNLSLQYNELHQTIINRGYYQCDYWQYFKEFCRISSLFLLFVLFLRSKWYTLSAISIGLMWQQLVFIAHDAGHISITHNYQIDNIIGIIIANFIGGLSLGWWKRNHNVHHLVTNDPVHDPDIQHLPFFAVSSRLLGNVFSTYYEKYLWFDKIAQKMLQIQHKLYYPILSFGRFNLYRLSWSHLIMGLGPRKGKAAWFRYLELIGLCFFSYWFFYKTMSYIPTKTLRFWFLLISHWTTMIVHVQIVLSHFAMSTSDLGSTESFVSRQLRTTMDVDCPEWFDFFHGGLQFQAIHHLFPRLPRHNFRKVQPLVIEFCKNTGLHYSIYGFVDGNGKVVNKMADVASQVVILNDCLHSIHLENTTGKNLYEAKVESVSIKG

SEQ ID NO: 58015 - protein, 427 aa, Pyrobaculum aerophilum str. IM2
MAHISGVYINSAFLENTLYTIKRGIELSGLPVEFYEIITKPKRIHIVYIPVKMDSGRIEVFEGYRVQHNDALGPFKGGIRFHPEVTLADDVALAILMTLKNSLAGLPYGGAKGAVRVDPKRLSQRELEELSRGYARAIAPLIGDLVDIPAPDVGTNSQIMAWMVDEYSKIAGRNAPAVFTSKPPELWGNPVREYATGFGVAVVAREMAKRLWDGIEGKTVAVQGLGNVGRWTAYWLAKLGAKVVAVSDINGVAYKKEGLNVDIIANNRGLGGPALLEAFVSKDGAQYVKDPDAILAVDVDIFIPAAIENVIRSDNAGRVKARLVVEGANGPTTPEAERVLYQRGVVVVPDILANAGGVIMSYLEWVENLQWLSWDEEETRKRLEAIMVNNVARVYQRWQKEKWTMRDAAIVTALERIYKAMKLRGWI

SEQ ID NO: 58016 - protein, 429 aa, Pyrobaculum aerophilum str. IM2
MPDGLAVWRVLRGAGVKLVKFIVVDIFGRPRAEVLPIEAAREAFLDGVAYDGSSIPAYTTVNKSDLVAVPDLNAVYVESWNGGKTAIVFTNTVDGGKPHPMDPRNVLRQAADYAKSRGYAPVVGAEVEFFLVRGVPPAPADSGVYFDGYLHGDSYAAVEEILGHLEASGIGLSKTHHEVAPGQYEVNIPAGDPVQVADQILVFKIMAKAVAKRRGLTATFMPKPFWGVNGSGMHVHVSFWKDGVNLFASRGEPTQELKWAVAGVLENALRNSAFVAPTVNSYKRLVPHHEAPTRVVWGLGNRSVMVRIPYYGGRINRLEYRHPDPSANPYLAFAVIILSALAGIEKKREPPPPVAEVAYELEEARETPPNLGEALKMARDGTPLPGQFLEAYLRLKEREWEEYITAEGSWETTWNKITKWEYEKYLEEA

SEQ ID NO: 58017 - protein, 138 aa, Coprinopsis cinerea okayama7#130
MARTKQTARKSTGGKAPRKQLAAKSSARKTAAAAAGGVKKPHRFRPGTVALREIRRYQKSTELLIRKLPFQRLVREIAQDFKTDLRFQSSAVMALQEAAEAYLVSLFEDTNLAAIHAKRVTIQPKDLALARRLRGERS

SEQ ID NO: 58018 - protein, 286 aa, Oryza sativa (japonica cultivar-group)
MALVVICGQPCSGKSAAAACLAAALCSSTSDLTVRIIDESSLHLGRNDSYKDMVVEKNLRGVLRSEVDRSVSRDSIIVVDSLNNIKGYRYELWCLARASGIRYCVLFCDTEVDHCREWNTKRQEKGEPTYDNNMYRSYWVIMEGGRLWQVRAEEEYCGGRVAGDRRERFDDLVSRFEKPDRRNRWDSPLFELFPSRDGVMESSPVIAEAVSYLTKKVDSKTRDVKVLQPTIATQTARTTEANSLYEMDKATQEVINAIVEAQSCGLGLPVNKISLGPDLPTISFTV

SEQ ID NO: 58019 - protein, 177 aa, Oryza sativa
TRLATGKRILSLVALSLNLDAEFFDCPLAFLRLLHYPGEINESDDGNYGASAHSDYGILTLLATDGIPGLQICKEKDRHPQLWEDVHHIDGALIINIGDLLERWTNCVFRSTLHRVVAVGKERYSVAFFLDPDPDFVVQCLESCCSEACPPRFPPIKSGDYLEERLSSIYKKEKLAT

SEQ ID NO: 58020 - protein, 435 aa, Capsicum annuum
MAGQTVIVSGLNPAAILQSTIGGAPPSTAAAAAENGDTTRKVVPLSKDALQDFMVSIITQKLQGEKKPFYVLDLGEVVSLMDQWNVALPNVRPFYAVKCNPEPSFLSMLAAMGSNFVCASRAEIEYVLSLGISPERIVFANPCKPESDIIFAEKVGVNLTTYDSEDEVYKIKKHHPKCELLLRIKPMNDGNARCPMGPKYGALPEEIEPLLRIAQASRLTVSGVSFHIGSGDADSNAYLGAIAAAKQVFETAAKFGMSKMNVLDIGGGFTSGHQFTTAATAVKSALQQHFSNEPELTIIAEPGRFFAETAFTLATTIIGKRVRGDLREYWINDGLYGSMNCVLYDHATVTATPLACMSNRVNLNCSGSKMFPSTIFGPTCDALDTVLRDYHVPELQVNDWVIFPNMGAYTKAAGSNFNGFNTSAIVTHLAYAYPS

SEQ ID NO: 58021 - protein, 348 aa, Magnetospirillum magnetotacticum MS-1
KRDPARRRPCVEQDFYAAHAVDAVRGSATRIDPAGRSVTLEDGRTISGDALLIATGSRAVLPDFPGADLDGVVTLRSLDDAVVLSERAQKAARIVVVGGGFIGLEAAAFLTKRGRAVTVLAREEWPLAKRFGEAVARGLKRFHEGKGVGFRQGEVGRIVGDGTVAGIELKDGGRLDADLVLIGAGAAPESGMIDGVEPREDGGLAVGSDLALAPQVWIAGDIAAFPEHGSGSRARIEHWRLAQQHGMHVARAILGEAKPFRDAPFFWSNQGEKRLDYGGYAPGFDRIVMRGNPDELDFIAFYVKEDRAVAACSIGRNAEFTAFLHLLGEGRLPSPADLDRGVELTGLL

SEQ ID NO: 58022 - protein, 313 aa, Zea mays
  misc_feature (280)..(280): Xaa can be any naturally occurring amino acid
  unsure (1)..(313): unsure at all Xaa locations
VGGDTSIEEYIIGPATEAADDLVTDGDKEQITLYGPEEGQSWIARPSKGPSMLGSVLSLASRHGSMVNQSVPLMDPIVTLFGSVHENMPQAGGSMRSTLFPNFGSMFSVTDQHAKNEQWDEENLHRDDEEYASDGAGGDYEDNLHSPLLSRQATGAEGKDIVHHGHRGSALSMRRQSLLGEGGDGVSSTDIGGGWQLAWKWSEKEGENGRKEGGFKRVYLHQEGVPGSRRGSIVSLPGGGDVLEGSEFVHAAALVSQSALFSKGLAEPRMSDAAMVHPSXLGISIHLDQFSHYLTNASLHWLCHAAYGSFRKK

SEQ ID NO: 58023 - protein, 483 aa, Synechococcus sp. WH 8102
MIEQAVADLWLPIAVLIMRASWVSPRKGQANVSQMHYARQGVVTEEMAYVAKRENLPESLVMEEVARGRMIIPANINHTGLEPMAIGIASKCKVNANIGASPNASDAAEEVNKLKLAVKYGADTVMDLSTGGVNLDEVRTAIIDASPVPIGTVPVYQALESVHGSIEKLDEDDFLHIIEKHCQQGVDYQTIHAGLLIEHLPKVKGRLTGIVSRGGGILAQWMLYHHRQNPLYTRFDDICEIFKRYDCTFSLGDSLRPGCQHDASDAAQLAELKTLGELTRRAWKHDVQVMVEGPGHVPLDQIEFNVKKQMEECNEAPFYVLGPLVTDIAPGYDHITSAIGAAMAGWHGTAMLCYVTPKEHLGLPNAEDVREGLIAYKIAAHAADIARHRPGARDRDDELSRARYNFDWNKQFELSLDPERAKEYHDETLPADIYKQAEFCSMCGPKHCPMQTKITEEDIEGLEKVLEARGAAELTPVKLDKAD

SEQ ID NO: 58024 - protein, 669 aa, Synechococcus sp. WH 8102
MVAAPASLDTLCINSIRMLAVDAINKSKSGHPGLPMGCAPMGYALWDKFLKHNPKNPKWFNRDRFVLSAGHGCMLLYALLHLTGYDSVSIDDIKQFRQWGSKTPGHPETFETPGVEVTTGPLGAGISNAVGLAIAESHLAAKFNKPGATLVDHYTYVVMGDGCNQEGIASEACSLAGHLKLGKLIAFYDDNHITIDGRTDVSFTEDVLKRYEAYGWHVQHVADGNTDVDAIAKAIEAAKAVTDKPSIIKVTTTIGYGSPNKGDTAGVHGAPLGEDETVLTRQQLGWEYGPFEVPQEAYDQFRQAIERGASLEAEWNQTLATYRTQFPAEAAEFERMLRGELPEGWDKDLPTAGPDEKGLATRKHSQICLGALGPNLPELIGGSADLTHSNYTDIKGETGSYQPETPEKRYLHFGVREHAMAAILNGIAYHDSGLIPYGGTFLVFADYMRGSMRLSALSELGVIYVLTHDSIGVGEDGPTHQPIETIPSLRAMPGMLVFRPGDANETSGAYKLAIQNRKRPSALCLSRQGMANQANSSIDKVAKGGYVLEDCDGTPELILIGTGTELDLCVQAAKQLTEAGKKVRVVSMPCVELFDEQSDAYKEKVLPNAVRKRMVVEAAESFGWHRFIGLDGDSVTMNRFGASAPGGTCLKEFGFTVENLVAKASALLA

SEQ ID NO: 58025 - protein, 1137 aa, Oryza sativa (japonica cultivar-group)
MSSSRSNNRATCSRSSSARSKHSARVVAQTPMDAQLHAEFEGSQRHFDYSSSVGAANRSGATTSNVSAYLQNMQRGRFVQPFGCLLAVHPETFALLAYSENAAEMLDLTPHAVPTIDQREALAVGTDVRTLFRSHSFVALQKAATFGDVNLLNPILVHARTSGKPFYAIMHRIDVGLVIDLEPVNPVDLPVTATGAIKSYKLAARAIARLQSLPSGNLSLLCDVLVREVSELTGYDRVMAYKFHEDEHGEVIAECKRSDLEPYLGLHYPATDIPQASRFLFMKNKVRMICDCSATPVKIIQDDSLTQPISICGSTLRAPHGCHAQYMASMGSVASLVMSVTINEDEDDDGDTGSDQQPKGRKLWGLMVCHHTSPRFVPFPLRYACEFLLQVFGIQINKEVELAAQAKERHILRTQTLLCDMLLRDAPVGIFTQSPNVMDLVKCDGAALYYQNQLWVLGSTPSEAEIKNIVAWLQEYHDGSTGLSTDSLVEAGYPGAAALGDVVCGMAAIKISSKDFIFWFRSHTAKEIKWGGAKHEPIDADDNGRKMHPRSSFKAFLEVVKWRSVPWEDVEMDAIHSLQLILRGSLQDEDANKNNNAKSIVTAPSDDMKKIQGLLELRTVTNEMVRLIETATAPILAVDITGSINGWNNKAAELTGLPVMEAIGKPLVDLVIDDSVEVVKQILNSALQGIEEQNLQIKLKTFNHQENNGPVILMVNACCSRDLSEKVVGVCFVAQDMTGQNIIMDKYTRIQGDYVAIVKNPSELIPPIFMINDLGSCLEWNEAMQKITGIKREDAVDKLLIGEVFTHHEYGCRVKDHGTLTKLSILMNTVISGQDPEKLLFGFFNTDGKYIESLMTATKRTDAEGKITGALCFLHVASPELQHALQVQKMSEQAAMNSFKELTYIRQELRNPLNGMQFTRNLLEPSDLTEEQRKLLASNVLCQEQLKKILHDTDLESIEQCYTEMSTVDFNLEEALNTVLMQAMPQSKEKQISIDRDWPAEVSCMHLCGDNLRLQQVLADFLACMLQFTQPAEGPIVLQVIPRMENIGSGMQIAHLEFRLVHPAPGVPEALIQEMFRHSPGASREGLGLYISQKLVKTMSGTVQYLRESESSSFIVLVEFPVAQLSTKRCKASTSKF

SEQ ID NO: 58026 - protein, 227 aa, Kluyveromyces lactis NRRL Y-1140
MSEFINENPDILDETLLPSRKEDITNELFGDALGKITHERKRQLLQIGSVDSPVLKNIGLLDKLLNQQLSLDETVPDLTDIETATESDENTEEEEEEDPIDAQEIYDLIAHISDPEHPLTLGQLAVVNLADIEVHDTNGKDKMAEVIVRITPTITHCSLATLIGLGIRVRLERSLSPRFRITILLKKGTHQSENQVNKQLNDKERVAAACENDQLLGVVSKMLSTCK

SEQ ID NO: 58027 - protein, 459 aa, Aspergillus nidulans FGSC A4
MSNLPVEPEFEQAYKELASTLENSTLFEQHPEYRRALQVVSVPERVIQFRVVWENDKGEVQINRGYRVQFNSALGPYKGGLRFHPSVNLSILKFLGFEQIFKNALTGLNMGGGKGGSDFDPKGKSDSEIRRFCTAFMTELCKHIGADTDVPAGDIGVTGREVGFLFGQYRRIRNQWEGVLTGKGGSWGGSLIRPEATGYGVVYYVEHMIKHVTGGKESFAGKRVAISGSGNVAQYAALKVIELGGSVVSLSDSKGSLIVKDESASFTPEEIALIADLKVARKQLSELATSSAFAGKFTYIPDARPWTNIPGKFEVALPSATQNEVSGEEAEHLIKSGVRYIAEGSNMGCTQAAIDIFEAHRNANPGDAIWYAPGKAANAGGVAVSGLEMAQNSARLSWTSEEVDARLKGIMEDCFKNGLETAQKFATPAKGVLPSLVTGSNIAGFTKVAEAMKDQGDWW

SEQ ID NO: 58028 - protein, 344 aa, Pseudomonas fluorescens PfO-1
MSDPLTLNQRFVLASRPVGAPTPENFRLEREALPDLEDGQVLLKTLYLSLDPYMRGRMSDAPSYAAPVQIGEVMTGGAVSRVEQSRHPKFHPGDLVVGATGWQSHSISDGRNIIPIPSGLPSPSMALGVLGMPGMTAYMGLMDIGQPKEGETLVVAAASGAVGSVVGQVAKIKGLRAVGVAGGAEKCKYVVEELGFDACIDHKAPDFAEQLAKACPDGIDIYYENVGGHVFDAVVPLLNSKARIPLCGLIAGYNASEAPKGPDRLPALQRTLLTKRVRIQGFIVFDDYGDRQPEFISAMVPWVRDGKVKFREDVVEGLEQAPQAFIGLLEGRNFGKLVVKVAQD

SEQ ID NO: 58029 - protein, 182 aa, Pseudomonas fluorescens PfO-1
MVFDSFDIKSLIRPVIDFPKPGVIFRDITPLFQSPKALRLVMDSFAHRYVEADFTHIGAMDARGFLIGSVLAYQLNKPLVLFRKQGKLPADVLAEGYATEYGEAFLEVHADSLCEGDSVVMFDDLIATGGTLIAAANLIRRMGARVHEAAAIIDLPELGGSQRLEDMGIPTFCLTQFALTDK

SEQ ID NO: 58030 - protein, 411 aa, Nicotiana tabacum
MNALAATNRNFKLAARLLGLDSKLEKSLLIPFREIKVECTIPKDDGSLASFVGFRVQHDNARGPMKGGIRYHPEVDPDEVNALAQLMTWKTAVANIPYGGAKGGIGCSPSDLSNSELERLTRVFTQKIHDLIGIHTDVPAPDMGTNPQTMAWILDEYSKFHGYSPAVVTGKPIDLGGSLGRDAATGRGVLFVTEALVKEHGKSIAGQRFVIQGFGNVGSWAAKLINEQGGKIVAVSDITGAIKNENGLNIASLLKHVKENRGVKGFNDARPIDPHSILVEDCDVLIPAALGGVINRDNANDIKAKYIIEAANHPTDPEADEILAKKGVVILPDIYANSGGVTVSYFEWVQNIQGFMWDEDKVNAELKTYMTRGFKDVKDMCKTHNCDLRMGAFTLGVNRVARATVLRGWEA

SEQ ID NO: 58031 - protein, 104 aa, Nicotiana tabacum
PLMAEKLGGDGLIGELCKGFQLLMDKDKRVITFESLKKNSALLGLQDLSDDDLKSMLKEGDFDGDGALNQMEFCVLMFRLSPELMEQSQFLLDEALNQDSEFSF

SEQ ID NO: 58032 - protein, 1455 aa, Coprinopsis cinerea okayama7#130
MSVEAVARIAYLSSEVVVDSQLSGPSTSSFSETYRSLEKVAAHKPRVLPTPYGADPGSTLLRYPSDLTTFTAFASSPVVTRLLLHLAEISTRPVVLHLAVQDDLSDVLLLRSAVPFFILSQTPQEAHDNALLSARLARVEQKAVIHAFFSSSSNDHPPVDEIPEDKIFPFLLAKKHPSSPGSPVGHLNGINGINGVNGIANGHVNGHVNGQSAKDDPITTQLVKAYESAALDTLSLVRRPKRALSVRGASDPHTVLFLVGKGDFAPTIEGVSFVTLSLLNPLPASRLSNAIPDSATNVIVLEQVHKWTTKWTPLYLDLVSAIQSHKPDQSVRVYNGILGDLDNVSVPDVLKLIQRAPASGTERLQLGPISTSSPSATTPHIPKHEAAYTRILEHLFSDRLEIANSPALVATQGDIATTPEFALGRVRGQLDARNELVSAVQGLLQDSSLDNDLHSLLSKWVLAKDDGVKSRQLGDQIVAKLEATSPPNPLAQRVLALRQHLPAVSRWIVGSDAWSYDLGSSGLHHAIASKLNVNILILDTLPYTARNSGDPHRRKQDVGLYAMNHGDVYVASVAVFSSYAQVLQAIAEADRFEGPSVVLAYLPYHSEDSSAIDVLKETKLAVDAGYWPLYRWDPSKDAKGLEPFSLDSEAIKKDLQQFLDRQNHLSQLTRSTPAIAAEVVSSLGETIREARKKRAQQSYNDLVSALDAPPLLILYASDGGAAEKKAKRLANRAKARGLSTTITPLDSSSLEALKEEEYVVFVCSTAGQGEPPQNGRNFFKALNAASSRGESILPNLKYTVFGMGDSHYWPRPEDAHYYNKPGKELDARLEKLGAERVADIGLGDDQDADGSETGYKIWEPKLWKALGVDNIDVDEAEPEPITNEHIKAASGYLRGTIAEGLEDTTTGALAPSDTQLTKFHGIYQQDDRDIRDERQAQGVEPAYSFMIRVRMPGGVCTPKQWLQMDQISDEHANGTFKITTRATFQFHGVIKRHLKPAIQDINRVLLDTLAACGDVNRNVICSSIPTLSKLHRQVFEFSKELSDHLIPRTTAYHEIWLDKKLVAGDAVKDFEPIYGEFYLPRKFKIAVAVPPTNDVDVFANDLGFIAIVGDDGELQGFNVTIGGGMGVTHGNKKTYPRAGSLLGFCTPEQGKHVAEKVMIVQRDHGNRVDRKNARLKYTLDRLGLDRYRDEVEKHLGYKLQPVRPFTFDRNIDDFGWHTGEDGRHHFTMFIENGRILDEPGKDYKTGLREIAKIHKGNFRLTANQHVLVSDIADEDLPAIKAVLKKYNLDNLNYSGLRLASSACVAFPTCGLAMAESERYLPVLIDKVEKICEEAGLRHDEIVMRMTGCPNGCARPYLGEVAFVGKAPGSYLMLLGGGYYGQRLNKIYRESVTEPEILAILGPMIKRYALERHEGERFGDWTIRAGYISAVTEGKDWYEGMGGEGEWREVAAGASA

SEQ ID NO: 58033 - protein, 193 aa, Arabidopsis thaliana
MGGPGSSPCASCKLLRRRCAKDCIFAPYFPPDDPHKFAIVHKVFGASNVSKMLQELPVHQRADAVNSLVFEANARVRDPVYGCVGAISYLQNQVSQLQMQLAVAQAEILCIQMQNEPTLQSHHQVLELDQDHKALLLNNNNINNCNTNNNNNNFGYAMSSGQFNSNFASPSSIMQMQMQMQMQDPLKQESLWT

SEQ ID NO: 58034 - protein, 101 aa, Parvularcula bermudensis HTCC2503
MLARIYRPSRTAMQSGKRKTELWVLEFEGRSPRKTDPLMGWTSSADTLGQVKMTFDTKEAAIAYAKEQRLPYQVLEKPDQAPVPKSYADNFAFRRRTPWTH

SEQ ID NO: 58035 - protein, 374 aa, Magnetospirillum magnetotacticum MS-1
RHRLLHHAHANHFRYRIGEMTGLDRERRVIQLAASLDSEGREVTPMRTVPYDTLIMAVGSTTNDFGTPGVAEHAIALDTKEQAVRFHQRLVNGMLRAHTQEGPVRPGQLHVTVIGAGATGTELAAELHRTTREVASTGLDRIDPAKDLKITLIEAADRILPAVPQRLSAEVMGLLTKIGVEVRLKARVTEVRADGVQLADGGFIPSELVVWAAGVKGPAFLKDLGGLESTRNNQLVVLPTLQTTRDPDIFAMGDCAYLVDEGSGTPIPPRAQAAHQQASHLYGQIANKLAGKPLKPFRYRDFGSLVSLGEYTAVGNLMGFIQGKNMFIAGLFARLMYRSLYKMHETAVNGWWKTSLDALARALTRRTEPRVKLH

SEQ ID NO: 58036 - protein, 546 aa, Oryza sativa
VGKSTQTLASALANPSARRRRRWVAVVVCRPPMSSNLAASRRSSSSSSVAAAAAAKRPAVGEGGGGGGGKAAAGAAAAKKRVALSNISNVAAAAGGGGGGGPPGKAGNAKLNLAASAAPVKKGSLASGRNVGTNRASAVKSASAKPAPAISRHESATQKESVLPPKVPSIVPTAALAPVTVPCSSFVSPMHSGDSVSVDETMSTCDSMKSPEFEYIDNGDSSSVLGSLQRRANENLRISEDRDVEETKWKKDAPSPMEIDQICDVDNNYEDPQLCATLASDIYMHLREAETRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDEVLEMEASVLNYLKFEVTAPTAKCFLRRFVRVAQVSDEDPALHLEFLANYVAELSLLEYNLLSYPPSLVAASAIFLAKFILQPTKHPWNSTLAHYTQYKSSELSDCVKALHRLFSVGPGSNLPAIREKYTQHKYKFVAKKPCPPSIPTEFFRDATC

SEQ ID NO: 58037 - protein, 300 aa, Zea mays
MSKAAAASLPPPPPEVAHLVEQLQRHHLAPDASLLSSSAHSDLLQAREEVAAERALYLEALAVYAEAVAMVEEYHAAAGAGKKLNCSPQVYESLEHRLAVAEAAQRLRLPLLSQDGEVHEQEIEKLSTYSRSSFDSTLTSATPSSSSISTSYNNYSSSASAVTVAAPHWSGSSDAVEPGVGGVPDRFLGITSDYLYQVQQEQPAMSVDMVDYQRTLAREIEARLEAKCDALADLFAMDERDSSSLSQISSARLPERVKLIIEEIEKEEAHLLEDLASMDRKFAEHYNVLEQILAVLIQFV

SEQ ID NO: 58038 - protein, 167 aa, Amorphophallus albus
GTADAVRQFIWVFEDPRNKNIEHVLILSGDQLYRMDYMDLVQRHMDTRADITVSCVPVDDSRASDFGLMKIDKVGRIVHFSEKPKGSVLDAMKVDTTIPGLSPYEAKNFPYIASMGVYAFRTEILLNLLRWRYPTSNDFGSEIIPSAVNEYNVQAYLFKDYWEDIGT

SEQ ID NO: 58039 - protein, 391 aa, Streptomyces avermitilis MA-4680
MSRLKTDRAYDIVLFGATGFVGTLTAEYLAAHAPEGLRWAIAGRSARRLEQVRERLGGASEIGILQADVADPGSLRDIARNARVVATTVGPYLNYGEELVAACADAGTDYADLTGEPEFVDLTYVRHDARARETGARLVHACGFDSIPHDLGAYFTVRQLPEGVPLTVDGYVRSQAMFSGGTFASALNQFARGPQMLAAARDRRRHEPRVVGRRVQAPLGAPRFAKEVGAWALPLPTIDSQIVQRSARVLERYGPDFRYRHYAAVEQLPFAAGGVAAVSALFAAAQLPPARRWLSGRLKPGDGPSAEKRAKSWFSVRFVGEGGGQRVYTEVAGGDPGYDETAKMLAESALSLALDDLPHTSGQVTTAVAMGDALIDRLRAAGITFRVAAKR

SEQ ID NO: 58040 - protein, 165 aa, Amorphophallus albus
GTADAVRQYLWLFEEHNVMEFLVLAGDHLYRMDYERFIQAHRETDADITVAALPMDEKRATAFGLMKIDEEGRIIEFAEKPKGEQLKAMKVDTTILGLDDERAREMPYIASMGIYVVSKDIMLELLREKFPGANDFGSEVMPGATSIGMRVQAYLYDGYWEDIGT

SEQ ID NO: 58041 - protein, 359 aa, Triticum aestivum
MSLGYAEKLSYREDVGTVGMPEKFDSPKLLQGKIEELAVMVQKSKHLVVFTGAGISTSSGIPDFRGPKGVWTLQRAGKGVPDASLPFHRAAPTLTHMALVELERAGLLKFVISQNVDSLHLRSGFPREKLAELHGNSSKEVCPCCKTEYLRDFEIETIGLKDTPRRCTDKNCGARLKDTVLDWEDALPPEEMNSAEEQCRAADLVLCLGTSLQITPACNMPLLSIKNGGKVAIVNLQATPKDKKASLVIHGLVDKVIAGVMCILSLRIPPYIRTDFIQLLLRHTVKKKCVRWTLRVTSVHGMRAPLSFLRSIEVSFPDRSDMKPVVLMEQPFSLQRETSMTSIFSMLLTLKFSDGCGNH

SEQ ID NO: 58042 - protein, 113 aa, Olea europaea
LSKKPKEQIVDIDAADVNNDLAAVEYVEEIYKYNKSVENESRVNYYIDSRPEINEKMRAILIDWLIQVHHKFELSPETLYLTINIVDRYLATKTTLRKELQLLGISAMLIASK

SEQ ID NO: 58043 - protein, 609 aa, Arabidopsis thaliana
MMNCFPCFTSQKSRNAPCTTNETNDDNVEHDEFRPPVVATTKRTEEREPAEQQPPVKTFNFRELATATKNFRQECLLGEGGFGRVYKGTLQSTGQLVAVKQLDKHGLHGNKEFLAEVLSLAKLEHPNLVKLIGYCADGDQRLLVFEYVSGGSLQDHLYEQKPGQKPMDWITRMKIAFGAAQGLDYLHDKVTPAVIYRDLKASNILLDAEFYPKLCDFGLHNLEPGTGDSLFLSSRVMDTYGYSAPEYTRGDDLTVKSDVYSFGVVLLELITGRRAIDTTKPNDEQNLVAWAQPIFKDPKRYPDMADPLLRKNFSERGLNQAVAITSMCLQEEPTARPLISDVMVALSFLSMSTEDGIPATVPMESFRDKSNKSSSSSDSEDEEEEKEQKAEKEEESTSKKRQEQEETATDSDDESDSNSEKDQEEEQSQLEKARESSSSSSDSGSERRSIDETNATAQSLKISYSNYSSEEEDNEKLSSKSSCKSNEESTFSRYDSGRDHDDSSRNTSMRINSLAHDDKEEDEEENHETRSYSDHDDSPRNTSMRINSLSHDDDEEEEEENHQTRLEHIHSSKSEDQSVYSDDDAGESGESSLHRIEAKEEEHISSDHD

SEQ ID NO: 58044 - protein, 116 aa, Oryza sativa
  misc_feature (7)..(7): Xaa can be any naturally occurring amino acid
  misc_feature (29)..(29): Xaa can be any naturally occurring amino acid
  unsure (1)..(116): unsure at all Xaa locations
AECIWPXILMPAAGKKIYSSHDRSQMRHXVTDALSHEKEAVEIFEFRQQALKAIYMSVLQDEGRRAFWSVNGPRILQVGYEVEEDPKVMEAYQLIGSLLVGKGDDEQDQEQGGQRP

SEQ ID NO: 58045 - protein, 403 aa, Mycobacterium sp. RP1
MTTPRHVAVVGGSLAGLRSAEQLRALGHTGPITVFSAERHLPYNRPPLSKEALGEFESATAEELAGRLAFRRRASIADVDIRLATPVATADLGAHRLTLDSGDEQAYDALVIATGLRPRRLVAPGPARGRHVLRTVEDCVGLRAALRPRSRAVVIGGGFIGCEVAGTLRTLGHHVTVVEPAGPPMQRVLGSDLAAAVQGHLTARGIEFVIGTGVVSFTGDDAVTGVELATGETLSADIVVEAIGSTCNVEWLYGQGLDLSDGVLTDNRLAVAGVADTVAVGDLARFPNPLFDDVPRRVEHWSIPGDTANRAAATLVGPHDNDAPFAPVPAFWSNQLDLRLQSYGSPALADAVHLEEGSVDDLTGGVILTYHRDHRHVGTVAANLSPARLRELRSAFTAVQLPA

SEQ ID NO: 58046 - protein, 114 aa, Nicotiana tabacum
SRKSNFNDFLPLMAEKLGGDGLIGELCKGFQLLMDKDKRVITFESLKKNSALLGLQDLSDDGLKSMLKEGDFDGDGALNQMEFCVLMFRLSPELMEQSQFLLDEALNQDSEFSF

SEQ ID NO: 58047 - protein, 221 aa, Dunaliella tertiolecta
MFRNSAVSALRLGAIAFRRVDPTKVPNAMCRAYTQQNTGNSSSSAGKWAWTAGILGAGLLSSNHAFAAGPSTKERSFIAIKPDGVHRGMISNIISRFEQKGYKLVGIKVIVPGMDLAKAHYAEHEGKPFFNKLTSFLTSGPVVAMVWEGKEVIKYGRTMIGATNPLASAPGTIRGDFCVDMGRNMIHGSDGPESAQREIALWFQPSEIAEYESATQSWVYE

SEQ ID NO: 58048 - protein, 632 aa, Candidatus Kuenenia stuttgartiensis
MKVVILAGGKGTRMGSLSQNIPKPMINIANKPILQYQIEIAKRFNLTDIILLTGYKGEVVEDYFGNGENWGVNISCYRETIPLGTAGAVKEVEDYLHDDFLVFYGDVIMDIDLKSVIRYHMKRKPIATLVVHPNDHPYDSDLIEVNNEGKVITFHSKPHKQDIFIRNLVNAALYILSPRIMNFLPKGTYSDFGKDIFPKLVNDGEIIYAYNTPEYIKDIGTLERLEEVERDIVSGKLYRLNKKNKRKAIFLDRDGVLNYEIDLLRTPEELELLPDVPNAIKKINTSEYLSVVVTNQPVVAKGLASEKDIYQIHSKLDTVLGRNRAFLDRIYYCPHHPEKGFHGERIEYKIHCDCRKPNTGMINQAVYDLNIDLDESFIIGDRTVDILTGINAGLKTILVRTGYAGDDGVFQCEPDFIFSNLKESTEFIIDCYDALVNKAKDILSGISINNKRNIIILIAGLSRSGKSTFSKIISTILNKKGIHNTHLNLDNWLVGIQERKDWMAVSERYKYNEIVKDIATLLEGKEIKVNKYNVKTRNIDEHQKSIILKEGEALIIDGVVGLDIEFLRKIADIKIYVEINETMRRKRFFDFYMFKGLTEEEIKKLYVKRQDDEIPIVIQTKNYADYIIPMEK

SEQ ID NO: 58049 - protein, 633 aa, Oryza sativa (japonica cultivar-group)
MGCAPMGHILYDEVMRYNPKNPYWFNRDRFILSAGHGCMLQYALLHLAGYDAVLEEDLKQFRQWGSKTPGHPENFETPGVEVTTGPLGQGIANAVGLALAEKHLAARFNKPDSEIVDHYTYCILGDGCQMEGISNEACSLAGHWGLGKLIAFYDDNHISIDGDTEIAFTEDVSARFEALGWHTIWVKNGNDGYDEIRAAIKEAKAVTDKPTLIKVTTTIGFGSPNKANSYSVHGSALGTKEVEATRENLGWPYEPFFVPEDVKSHWSRHVPQGAAFEADWNAKFAEYEKKYPEDAATLKSIVSGELPAGWADALPKYTPESPADATRNLSQQCLNALAKVVPGLLGGSADLASSNMTLLKMFGDFQKDTPEERNVRFGVREHGMGAICNGIALHSPGLIPYCATFFVFTDYMRAAMRISALCEAGVIYVMTHDSIGLGEDGPTHQPIEHLVSFRAMPNILMLRPADGNETAGAYKIAVLNRKRPSVLALSRQKLAQLPGTSIEGVEKGGYIVSDNSTGNKPDFIVMSTGSELEIVAKAADELRKEGKTVRVVSFVCWELFDEQSAEYKESVLPEAVTARVSLEAGSTLGWQKYVGSKGKAIGIDKFGASAPAGKIYQEYGITAENVIATAKSL

SEQ ID NO: 58050 - protein, 321 aa, Oceanicola granulosus HTCC2516
MPLAPDSLGPTVAVGEILVEIVATTVGTGFTAPQPLMGPYPSGAPAIFIDQCGRIGGAAAMVGAVGDDDFGRMTLQRLRADGVDVSAVATVPDWPTGSAFVRYRDDGSRDFVFNIATSAAARFGWSDAAAQLMARAGHLHVMGSALSMPAAVEVIARAVDIVAARGGTLSLDPNLRKELALDAATEARFADLVTRADLLLPSGEELELAAGVRGEAAAVAALFARGVGEIVLKRGANGATAFLPDGSRVEAPAFAVTELDPTGAGDCFGGAYVACRRLGMPLETALAYASAAGARNVTVRGPMEGAGTRAQFDDFIRETQP

SEQ ID NO: 58051 - protein, 284 aa, Synechococcus sp. WH 8102
MPMTLTQQTAPYAHWEYVHPETGDRLRIIPERGGIVSEWRCGEREVLYFDQERYADPAKSIRGGIPVLFPICGNLPGDLLQVKGVDHTLKQHGFARNLPWQLQLLDDQSGVRLSLSSTDDTLAAYPFVFVVEMEVRPVAMALEISTTIHNRSDQPMPFSFGLHPYFNVSDLAQTRLTGLAERCMNHLEMADAATDEQLSRLPEGVDFLCRPAGDVTLIDDVSGAQLQLQHQEPMDLTVVWTEPPRKMVCLEPWTGPRQSLVSGDRKLVLEPGTQQTVACRYAVS

SEQ ID NO: 58052 - protein, 165 aa, Oryza sativa
ALVEDNNAVAVSFSEEQEALVLKSWAILKKDSANIALRFLLKIFEVAPSASQMFSFLRNSDVPLEKNPKLKTHAMSVFVMTCEAAAQLRKAGKVTVRDTTLKRLGATHLKYGVGDAHFEVVKFALLDTIKEEVPADMWSPAMKSAWSEAYDHLVAAIKQEMKPAE

SEQ ID NO: 58053 - protein, 165 aa, Oryza sativa
ALVEDNNAVAVSFSEEQEALVLKSWAILKKDSANIALRFWLKIFEVAPSASQMFSFLRNSDVPLEKNPKLKTHAMSVFVMTCEAAAQLRKAGKVTVRDTTLKRLGATHLKYGVGDAHFEVVKFALLDTIKEEVPADMWSPAMKSAWSEAYDHLVAAIKQEMKPAE

SEQ ID NO: 58054 - protein, 542 aa, Agrobacterium tumefaciens str. C58
MIKTIKTTPYQDQKPGTSGLRKKVPVFAQENYAENFIQSIFDALEGFEGQTLVIGGDGRYYNREVIQKAIKMAAAAGFGKVLVGQGGILSTPAASNVIRKYKAFGGIVLSASHNPGGPTEDFGIKYNIGNGGPAPEKITDAIYARSKVIDSYKISDAADIDLDKIGSFKVDELTVDVIDPVADYAALMEELFDFGAIRSLIAGGFKVVVDSMSAVTGPYAVEILEKRLGAPKGSVRNATPLPDFGGHHPDPNLVHAKELYDDVMSPEGPDFGAASDGDGDRNMVVGKGMFVTPSDSLAIIAANAKLAPGYAAGISGIARSMPTSAAADRVAEKLGLGMYETPTGWKFFGNLMDAGKVTICGEESFGTGSNHVREKDGLWAVLYWLNIVAARKESVKDIVTKHWAEYGRNYYSRHDYEEVDSDAANTLVAILREKLATLPGTSYGNLKVAAADDFAYHDPVDQSVSKNQGIRILFEGGSRIVLRLSGTGTAGATLRLYVERYEPDAARHGIETQSALADLISVADTIAGIKAHTGRSEPTVIT

SEQ ID NO: 58055 - protein, 337 aa, Xerophyta viscosa
MAPEIVSKRAANYAGKQVAAPRNAYVTFLAGAGDYVKGVVGLAKGLRKVGSAYPLVVAVLPDVPDEHRKLLVSQGCIVRQIEPVYPPENQTQFAMAYYVINYSKLRIWEFVEYSKMIYLDADIQVYDNIDHLFDLPGGRFYAVMDCFCEKTWSHTPQYKIGYCQQCPNKVTWPAELGQPPALYFNAGMFVHEPSLATAEKLLATLKVAPTTPFAEQDYLNMFFKDIYRPIPLTYNLVLAMLWRHPENVELDKVMVVHYCAAGSKPWRYTGKEENMDREDIKMLVKKWWDIYNDDSLDYKGPAATMDLEPEAPGLKQLKLAALSEAGEVRYTKAPSAA

SEQ ID NO: 58056 - protein, 798 aa, Coccidioides immitis RS
MALPDCFVLFSRCQNGDRTFCLFAVLLVLSVILVSLVVCRSRIPLSSSDTIQTSTADKACATRRHTGMTSHNPEKQRVLHNQHARSLRDKLRPWTTPVKLLIYFSVLFIALAIALSLFLTDPGEAEEDTDGREEAARSLKDVDHVIIFMQENRSWNTYFGTMAGTRGFQDPNVQVNPDGLPVWFQKVDSDQSTDTKTLLPWHLGYLGGNWSEAIQCMAAGSNGYRANQAALNYGLNNQWVTDNTPWSWGYLKRDDIPVQFALAEEWTVADMYQQSQITSTNPNRVMLVSGSINAPGSPQSPDEGGVYLDNTETPGCEKPNVNCYPLKWKTIFELYEDAGVSWQVYQGEDNFDDNPLAWFEQYQNARPGTPLADKGMAFLGLDKFYKDAAKGTLPQISFIVGPRELSEHAPYSPKDGAWLQEKVVEAVTKSPKYGKSVLMISFDESGGWGDHVPPYHSPTDTPGEWIDDYLGVFGRIFTGPGFRVPFYIISPWTRGGRVLTEHSDHTSQILFIEEWLTAKGIENIKSPEVVPWRREHMSNLVNAFDFENARTQTILFRICLRHVELTLYFQPNLSLPNLPKAELPHRDESGNWDGSAYCESLYPETRPPVPYDSQPDRMPTDLVEEGYKECIGTLTEGRFLVFSTTEQSRLLLHSNPDDLTTTDATNADPDSDSDPDPDLDYNSLYRNSDARWVLHYYNNNSTSSTDVNTTAINQDPPYLLSSGNRRVWLGEEGKLVPRRDAVAIDIDFVRGEGEDKGRGYYIKYHDRDDGYISVNEDGGVRVGEEKTKFKVLSVTYHD

SEQ ID NO: 58057 - protein, 1322 aa, Aspergillus nidulans FGSC A4
MVSRSNEGPEAPHPASRTPGAPAKGRLTRLGSSPSKRDDKAKDDRMGKTSAKDVAELKDYIKLADLPKSELRVIMLEIDLLKNLDHPNIVKYQGFVKSAETLNIILEYCENGSLHSIAKNFGRFPETLVGVYMSQVLHGLLYLHDQGVIHRDIKGANILTTKEGLVKLADFGVASRTTGLSESSVVGTPYWMAPEVIELSGATTASDIWSLGCTVIELLEGKPPYYNLQPMPALFRIVNDDHPPLPQGASPAVKDFLMQCFQKDPNLRVSARKLLKHPWIVNARRSDSVVPKKSTEYEEAVKSVQEWNEALRSPESNALRRGTRNENQNPPSLRLDTRHTPTKVTLPSPVSRIVADKFSSPSSGEEDNWDDDFATAISPSALQLPHLRPHDNFGGMLSSEKLKAFASLDGTVLKSDESFEESDDPFKGSLLAGEHDPLKTIRPPPSQQANSGTSQSQNGPYGAHMRRGPPLNTAITPVYGGQMLQNSSSPIRQQRPPLFYKENSVEDYSDLISANEDVLDRKISAFQESDEHKDLADTGRSREVIRYQSSYEQEDTPRIGRQISVKRYRGTVEIQQFAENEHDEDFSDILGVDGVTLDKAESDDGSNKSTLMLNTKLSNNSWLGDLDDEDDPFALLEEGLDETDLEANIARDKHARLRSQVEGLVGSLKTSQDEEVLGDISEQLLAVFCDFPETKNIIISAHGMLPILEILDLCRRRDITLCLLKIVNAIIYDDYEIQENLCFVGGIPIINEFAAKKYPREIRLEAAAFVQQMYQTSTLTLQMFVSAGGLNVLVEFLEDDYEDERDLVLVGVNGIWSVFELQGSTPKNDFCRILSRSSVLDPLSLVLSRVLDEEGELAEVVEGRIANIFFIFSQAENHVKEMVSERTVLHSTDDGLGVLKELKRMTPAHQITMLKFIKNLSMLSTTLDSLQNSNAIDVLTDLLRSTIKRPHFREVSNQILNTIYNMCRLNKSRQEDAALNGIVPLLQKIVKTERPLKEFALPILCDMAHSGKVGRRELWRNKGLAFYISLLSDPYWQVTALDAIFIWLQEETAKVEEHLLENRYDQPSFTDAIVRCLTLSKANAFENILEPLQKLLRLSPPIASTLARPDLFSRLGQKLHHSKAAVRLNLLRIISSICDSSEQQGGLLASYGLLDSIRELEHDPAILVRDMAGKLIQSSERNDSYGLCKLKPNVRRGSTSATSPGLLANQSAPVTPQLSRQNQSKGYYDSRETQRRPRSAISGSALALRPGSRDGPTPGIVGGANGSAGASRNRIARGVSNRLSHIELLPNDDDRIPSSITRRSSVLPRRRRLTQFEAERGS

SEQ ID NO: 58058 - protein, 637 aa, Aspergillus nidulans FGSC A4
MSGMRVALRTPLRALGDPASVLQYTASPYAPRELATWNSYKPPRYWLFSSLRFNKATFPQHNFRTPFSTKTLYRFETQQRAGGQGRQSQNSQSRNKWIGYGIIGGTIVVGGVVVSDDIRHIYHAAARTGRVVGTLAVCINDYRVTLKQETCTPEERNEAIRACHKRCADRTLHVLERNGSIFIKLGQHLSSMGYLLPLEWTTTFIPLQDKCPVSSVESIEQMFVKDTGKRIDELFTTFEPTPIGAASLAQVHIGTLKETGEKVAVKVQHPALAEWAPLDLALTRFTFSMLKRFFPEYDLEWLSKEMDLSLPQELDFRMEAQNAKRASEYFKKNSNAPLVIPKVLWAQKRILVMEFISGSRPDDLEYLDKNHIDRDEVSAALAHIFNEMIFGDNAPLHCDPHGGNIAIRKNPNRSRHNFDIILYDHGLYRDIPRETRRNYAKLWLSVIEADEARMREYSRKVAGVTDEQFPLFASAITGRDYTVLTKKNITSLRTEAEKESITGALGEGLLQQLVELLGQVPRIMLLILKTNDLTRSLDENLHTRQGPVRTFLILARYATRTVFEEQMDTINESEFQFLEQPDRDNMYLSGLYLMRNTFDLVPLWLAHLKSTPPANPSRQLQQNHLSITTFFIDQHHD

SEQ ID NO: 58059 - protein, 132 aa, Nicotiana tabacum
LKIVKEGGRRNIFRNMFNVNEGEKLLKASQCYLYTAAGPIAGILFISTEKIAFCSERPIAVPFPSGGILRTPYKVVIPVKKIKRAYASVNENKPSQKYIEIVTEDNFEFWFMGFVRYEKAFLNLQEAISMSN

SEQ ID NO: 58060 - protein, 350 aa, Oceanicola granulosus HTCC2516
MKALVLEQKDELSLRDFPAIDHAEQTLGPRDVRIKLHTVGICGSDVHYYTHGRIGPFVVEAPMILGHEASGTVIEVGDEVATLAVGDRVCMEPGIPDPNSRATRLGMYNVDPAVRFWATPPVHGILRPTCVHPEAFTFRLPDTVSFAEAAMVEPLAVGVHAATKARVKPGDVGVVLGAGPIGLVTALSALAAGCARVYVTDIAEPKLEIAAALSPAIVPVRAEGDALVSRVHADTDGWGADVVFEATGSPGAAAGVFAPLAPGGCVVMIGGQPEPISYDAGAAMVREARVENIFRYAHAFPRCVAMLGSGAIDVKPLITRTFGFDESVEAFEIAASAPPSDVKMQIELPQ

SEQ ID NO: 58061 - protein, 209 aa, Zea mays
MIAAVNRVPAGWGEDEMSVLPRHTKVVVTGNNRTKSVLVGLHGVVKKAVGLGGWHWLVLTNGIEVKLQRNALSVIEPPTGNEDDDKFDCENMQWNSSDMASDDALSPKPQRSRSRQHRGFHRKSISRSMSCDSHSKTSVSSSSRAHTKVDLSKLELTALLRYWRHFNLDACPNPSREQLVDAVQRHFTAQVIVGFVQAAKRLKTTMKVA

SEQ ID NO: 58062 - protein, 320 aa, Oryza sativa (japonica cultivar-group)
MSEETHVEAYSLPMQNEDLHTSTNGAKGRAKRSSNFNRKEDIQLCISWQSISSDPIIGNEQPGKAYWQRIAEHYHANRDFESDRNTFSLEHRWGNIQKEVSKFQGCYEQIERRHPSGIPHQELVLEAEALYSSNAPKNRAFQFNHCWLKLRNSPKFQTLKSHKRPRSRKSSTPIESAGEEDEEGDDARKSTTPDLSQPSAKKRPMGRKEAKEKLKNGGEDGPYKEAMKDLLDAKEKEAKVKEERWKETKEIQEHKLLFAERKLVWDQEQKIMFCDVSTLEPDVRTYVLAMRAQIAASKVAALNGGFDGSSGFGGEFGGGN

SEQ ID NO: 58063 - protein, 421 aa, Vibrio parahaemolyticus RIMD 2210633
MRFIMSVNFADLGIEQQLVETLNNMNIVTPTPVQEKSIPHVLEGKDLLAAAQTGTGKTAAFGLPIIQAVQQKKRNGTPHALILVPTRELAQQVFDNLTQYAEHTDLRIVCVYGGTSIGVQKNKLEEGADILIATPGRLLDHLFNGNVNISKTGVLVLDEADRMLDMGFWPDLQRILRRLPNDKQIMLFSATFEKRIKTIAYKLMDSPVEVEVSPANTTAETVKQMVYPVDKKRKRELLAYLIGSRNWQQVLVFTKTKQGSDELAKELKLDGIKAVSINGDKSQGARQRALDEFKQGKVRALIATDVAARGLDIQELEQVVNFDMPFKAEDYVHRIGRTGRAGKSGLAVSLMSRDEEYLLRAIETLLDQRLPQEWLEGFEPSLIEEVEPERDGGGRRKSRSSEKRKLKAKLAIHKNRGKHRK

SEQ ID NO: 58064 - protein, 501 aa, Glycine max
KGCLMAEEFQARICGENWWSSTTIDSTRSTVLFPLSSSSSSSSISSSPCSVAANNYDAGNYSTRGTSDMDLKATKCCAEETNNSLVSDTTYLGFVDAHKPHKSESAASGSGGMLTDSTLQMMGFGLTSSSENWNQPLLFRCNGRAESNFHSLIQEETGIDSSNSQIHRDWIPKSFSSDGGKQQIDDNNFKPLLLNQQEFSLDDHSLSSLTTAGLSSNRGFPNGSASSYGNPSTLQSLYDPNYNPHPQHSLFTNRPMSYSSKACYGTPCTELPTLSKASTFFKPTTTTIAKQQHPNIGLHFSNNTPFWNASAEALHDIRVGTFASTQSQYQRPTFDDEEKPNFPITLLNRLNSEEILELASMMTKKNVCEPALKRPRIETSSPLPTFKVRKEKLGDRVTALQQLVSPFGKTDTASVLHEAIEYIKFLHDQVNVLSTSYMKNGAPIQHQQGCDDLKDSEGPQQDLKSKGLCLVPISSTFPVATEATSADQLWTPTFRSGALLR

SEQ ID NO: 58065 - protein, 323 aa, Symbiobacterium thermophilum IAM 14863
MPKIRKIGVLTSGGDAPGMNAAVRAAVRRGISLGAEVVGVRRGYAGLIAGEFVDLGVSSVGDIIHRGGTFLQTARSDHFLTPEGQAQALAKAREAGIEGLVVIGGDGSFRGALRLTELGLPAVGVPATIDNDIYGTDLTIGFDTAVNTCLDAIRKIRDTATSHERTFVLEVMGRHSGWIALAAGLAGGAESILLPERPMPMEEVVTRLKRGVERGKRHTLIIVAEGVGSGFEVGRQIREMTGYDTRVMVLGHIQRGGSPTALDAMLASRMGAKAAEVLLEEGRGGLFIGVENEQMVTRPLEQVLGRRKEIPDELVDLAEILAI

SEQ ID NO: 58066 - protein, 129 aa, Desulfotalea psychrophila LSv54
MAVQQRKVISTKDAPNALGPYSQAVKTDSMVFVSGQLGLDPVTGEIVAGDVQTETRQVMTNLGAILSAAGSNFELVVKATVFVANLTDFAKINAVYAEFFGEEAPARACVEVAHLPKNARVEIDLIALV

SEQ ID NO: 58067 - protein, 973 aa, Kluyveromyces lactis NRRL Y-1140
MVDSSKRALPAEDYSSEDEDAFDIAGDIALNADSEDSDISDDDNDNIGFQAEVQDVIEFSSDEEEKEKKPKKQNKKAKVKAGPIVDSKFPSLELSDDEKKATNESDDDLNDYFNTTADAAAKHKKGSFASFGLSKLVLINISKKGFRQPTPIQRKTIPLILQKRDIVGMARTGSGKTAAFVLPMIEKLKTHSAKIGVRAVILSPSRELAIQTHRVFKEFSKGSDLRSILLTGGDSLEDQFGMMMGNPDVVIATPGRFLHLKVEMNLDLKSVEYVVFDEADRLFEMGFQEQLNELLVAFPTNRQTLLFSATLPSSLVDFAKAGLSNPVLVRLDAETKISENLEMLFISIKKDEREANLLYLLQEAIKMPVATESQIKKLKQQNDADSDSDDSEDEKKKKAKKAKKSKRRLPNANEMPSEKATIVFVPTRHHVEYVTQLLKNCGYLVSYIYGALNQHARKQQLYNFRAGLTSILVVTDVAARGVDIPLLANVINYSLPGSSKIFIHRVGRTARAGNRGWAFSIVSENELPYLLDLELFLGKKILLTPMYESSCQILRKKAESEGNNNFTDPKVSYTTRMVLGACPRSEIDGMGDLYSNMIKSDFELNTVKGVALKAEKLYFRTRTPASAESMKRSKEILRSGWDEQNIYFGKNAEKEKLDFLAKLQHRNNKETVFEFARNPDDEMSVLMKRRRRQIAPIQRKAKERQELLEKERMIGLRHSIEDEILKGEDNEVGYSVPDEVLKEFEDADVLLEEQENIKKKQKKTFRDPTFYLSHFAPTSDIQDKQLQISSGFTNDASNAAFDLANDDKVQVHKQTATVKWDKKRKKYVNTQGLDNKKYIIGESGQKIPASFRSGKFQDWSKARKIAPLKVGARESTIPSNLLADPTSPSERTVGGKFKHKTQKAPKLPDKHRDDYAFQKKKVEAALERGVRVKGYNGPGMKQEIKSVDEIRKLREIKEKKRSKNARPTKRRKH

SEQ ID NO: 58068 - protein, 332 aa, Escherichia coli
  misc_feature (1)..(1): Xaa can be any naturally occurring amino acid
  misc_feature (109)..(109): Xaa can be any naturally occurring amino acid
  misc_feature (166)..(166): Xaa can be any naturally occurring amino acid
  misc_feature (194)..(194): Xaa can be any naturally occurring amino acid
  misc_feature (279)..(279): Xaa can be any naturally occurring amino acid
  misc_feature (318)..(318): Xaa can be any naturally occurring amino acid
  unsure (1)..(332): unsure at all Xaa locations
XKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLXDPLDGSSNIDVNVSVGTIFSIYRRVTPVGTPVTEEDFLQPGNKQVAAGYVVYGSSTXLVYTTGCGVHAFTYDPSLGVFCLCQERXRFPEKGKTYSINEGNYIKFPNGVKKYIKFCQEEDKSTNRPYTSRYIGSLVADFHRNLLKGGIYLYPSTASHPDGKLRLLYECNPXAFLAEQAGGKASDGKERILDIIPETLHQRRSFFVGNDHXVEDVERFIREFPDA

SEQ ID NO: 58069 - protein, 228 aa, Pseudomonas fluorescens PfO-1
MALQIGFLLFPQVQQLDLTGPYDVLASLPDVQVHLVWKDLVPVTSSTGLQLKPTTTFEDCPVLDVICVPGGAGVGPLMEDEQTLDFIRSQAAQARYVTSVCTGSLVLGAAGLLQGKRATTHWAYHDLLPTLGAIPVKDRVVRDGNLFTGGGITAGIDFALTLAQELVGVDTAQLVQLQLEYAPAPPFDSGSPDTAPSTVVDEARKRAAPSLKLRTEITERAAAKLNLR

SEQ ID NO: 58070 - protein, 174 aa, Glycine max
  misc_feature (37)..(37): Xaa can be any naturally occurring amino acid
  misc_feature (86)..(86): Xaa can be any naturally occurring amino acid
  misc_feature (143)..(143): Xaa can be any naturally occurring amino acid
  unsure (1)..(174): unsure at all Xaa locations
MVPSVISSPAETTVNRAGAGMADPLTALKSMDGCPTXNTLIDFTSFASNGGRAQNMQAWPPVDNKKYETLYYLPDLDPAQPAKDGXYLLRTGWTPRLELELEHGFWCREHNRPPEHYDGRYWTMWKLPIMTYTDAYHASKDLXEANTAYPNGFIRIIRFNTVRQVHHMNLIDYK

SEQ ID NO: 58071 - protein, 393 aa, Arabidopsis thaliana
MTKRKQQDTKENLTLTVFESNKRCSNSGGEYFDRIPADLVIKILSKLSAKSMAKCRCVCKLLSSIIRQPNYNQLFPIKYPDPPRFIFTFLGGGMLFSYTSTQPENPDENSSLVATAHHHTDIPRDFSQILSSVHGLVCYHRKIKNDTVFVIYNPITGQYVTLPILEAHATINYFAIGYDPINKRFKVLCVTSVHHGTGEEFDSQHQVLTFETGRRNLFWRKIQCRRHYYTHRYHKGICIKGVLYYAATSMKPMLGPMIVCFDVRSEKFGFITWKPPSLINYKGKLGSINSNDNDLVLWVLEHGQERKWSKHIYVKPLQWPEFNGIDVNFLVTSKGEAVFCPNHYDPQVPFYLYYYNLEENIVVRVRVEVPESQGSKRVLFHAVPNYLENMKLT

SEQ ID NO: 58072 - protein, 379 aa, Candidatus Desulfococcus oleovorans Hxd3
MISKRARQITPFLVMDVLEKADEMERQGIDVVHLEVGEPDFDIPLCVKTAVEKALADGRTYYTHSLGDIRLRQAICDHYKNRYGVTVTPSRVIVTSGTSPAMMMAFAALLDPGDEVIISDPHYACYPNFITFAGGQPVTVPVYEADGFQYSPEAIAAAMTERTKAIFINSPSNPTGTLLSRERMAAIARFEPYIISDEVYHGLVYEGREHSILEFTDNAFVLNGFSKLYAMTGLRLGYLIVPEPFVRTVQILHQNFMISANSVVQFAGIAALEQAGDDVARMKAIYNERRLYMIRRLRELGFTIPVEPTGAFYLFVNAGHLSSDSYSLAFDILEKARVGVAPGIDFGKNGEGFLRFSYANSLENIAEGLNRLEPYLERR

SEQ ID NO: 58073 - protein, 586 aa, Oryza sativa (japonica cultivar-group)
MERVLKSARESGSLNLSNRSLREVPKEVYNNLDTGAQDEKWWEGVDLQKLILAHNNLEVLREDLRNLSSLVVLNISHNNISSLPAAIGDLPLLKSLDVSSNQINAFPEEIGFATALVKVDCSNNCLTDLPVSLARCLELSELNASNNTISVLPDELAGCSKLFRLNLEGNKLVTLSDKMFMSWTMLTEMNAAKNLLTAIPDGIGALSKLIRLDLHQNKITLIPPSIKDCSSLAEFYMGNNLLTSIPEDIGMLSNLGILDLHSNQLKEYPVGACRLKLSFLDLSNNSLSGLPAELGTMTTLRKLLLTGNPMRTLRSSLVSGPTTALLKYLRSRLSSDEGASGSGSTPTKDDQIAAARRLSLSSKELDLSGLGVTSVPPAAWETNDVMKLDLSKNSIEDLPNELSLCSSLQSLILSNNKIKRWPGTVFSSLASLSLLKLDNNPLAEILATDLEALSKLEVLDLSGSASSLPEPSAVSKLPHLKELYLRRMKLHGFPDSLLGLKLLRILDLSQNYLTSVPEGIKDLTSLIELDLSDNNITTLPPELGLLEPNLQVLKLDGNPLRSIRRTLLERGTKAILKYLKEKLPAE

SEQ ID NO: 58074 - protein, 368 aa, Marsilea quadrifolia
QTAASRPLSVKATATEIPSKVHKSSSKNVVRIGINGFGRIGRLCLRVALARDDIEVVAVNDPFIDTKYMAYMFKYDSTHGIYKDEIKAVDESTLQIGGQRVKVFGKRDPSEIPWGSAGADFVVESSGVFTTIEKASSHLKGGAKKVIISAPSADAPMFVMGVNEETYKPDMQIVSNASCTTNCLAPLAKVVDQEFGIVEGLMTTVHATTATQKTVDGPSGKDWRGGRGAAQNIIPSSTGAAKAVGKVLPQLNGKLTGMAFRVPTPNVSVVDLTCRLEKGASYDDVKAAVKAASEGSMKGILGYTEDDVVSTDFVGDSRSSIFDAKAGIALNKNFIKMVTWYDNEWGYSNRVVDLISHIAAVVAANKGN

SEQ ID NO: 58075 - protein, 514 aa, Arabidopsis thaliana; identical to SEQ ID NO: 1158

SEQ ID NO: 58076 - protein, 219 aa, Haemophilus somnus 129PT
MDQLSMKKMAAQAALQYVKPDSIIGVGSGSTVNCFIEVLGTIKETIKGAVAASKASEELLLRQGIEVFSANDVSGLDIYVDGADEINPQKMMIKGGGAALTREKIVAALAKKFICIVDSSKQVDVLGSTFALPIEVIPMARSQVARKLVALGGSPEYRENVVTDNGNVILDVYNFKIMNPIEMEKELNNVAGVVTNGIFALRSADIVIVGTPEGTKIIE

SEQ ID NO: 58077 - protein, 505 aa, Helianthus tuberosus
MEIPYLLTTTLLLLFTTLYLLLRRRSSTLPPTIFPSLPIIGHLYLLKPPLYRTLAKLSAKHGQILRLQLGFRRVLIVSSPSAAEECFTKNDIVFANRPKMLFGKIIGVNYTSLAWSPYGDNWRNLRRIASIEILSIHRLNEFHDIRVEETRLLIQKLLSACNSGSSQVTMKFSFYELTLNVMMRMISGKRYFGGDNPELEEEGKRFRDMLDETFVLAGASNVGDYLPVLSWLGVKGLEKKLIKLQEKRDVFFQGLIDQLRKSKGTEDVNKKKTMIELLLSLQETEPEYYTDAMIRSFVLVLLAAGSDTSAGTMEWVMSLLLNHPQVLKKAQNEIDSVIGKNCLVDESDIPNLPYLRCIINETLRLYPAGPLLVPHEASSDCVVGGYNVPRGTILIVNQWAIHHDPKVWDEPETFKPERFEGLEGTRDGFKLLPFGSGRRSCPGEGLAVRMLGMTLGSIIQCFDWERTSEELVDMTEGPGLTMPKAIPLVAKCKPRVEMTNLLSEL

SEQ ID NO: 58078 - protein, 788 aa, Oceanicola granulosus HTCC2516
MSDETRHLKIIEQRLLWLSHWMIHHANHVRPKVDGIKTGGHQASSASMVSIMTALYFSALRPADRVAVKPHAAPVFHAMQYLMGRQSRGKMEAFRGYGGVQSYPSRTKDSDDVDFSTGSVGLGVGITALAALVQDFITAKDWGRDVVPGRMVALVGDAEMDEGNVYEVLQEGWKNGLRNTWWIIDYNRQSLDGIVREGLFERIEKIFDAFGWDVVRIKHGALQRAAFAEPGGARLRAWIDACPNAEYSALTYRGGAVWRARLMEELGDQGDVTALIERRSDAELAALMENLGGNCVETMAETFAAIDHDRPTCFLAYTIKGWGTPIAGHKDNHGGLMTKAQMAEWQAHMGVPEGAEWEPLAAVEDRPALEAFLATVPFFAEGPRRHADAGLAVPGIAAPTEREISTQAAFGKILDALARGDSPLAARIMTTSPDVTGTTGLGAWVNRRKLFARDALPDAFIEHRIPSTAKWNFAPEGQHLELGIAEMNLFLLLGAAGLAHSLWGKRIIPIGTLYDPFVHRGLDALNYACYQDARFLVAGTPSGVTLAPEGGAHQSIGTPLTGMAQDGLASFEPAFADELAVILEWAFGYLQRDGEGDPDERTWLRDETGGSVYLRLTTKPLEQPGRRADDAFRQGAIDGAYWLRPPGPNCAVVIAYQGAVADEAIAAAGIAGEHRKDIGVLAVTSADRLNAGWTAAQRARARGMAGARSHIERLLGALPPGCSLVTVLDGHPATLGWLGSVAGHRTIAHGVEHFGQTGTIGDLYRHFGIDRDTLVASVSRLTDGVRFG

SEQ ID NO: 58079 - protein, 520 aa, Helianthus tuberosus
MEIPYLLTVVLLLLTTLYLLLFTTLLLLFTTLYLLLRRRRSSTLPPTIFPYLPIIGHLYLLKPPLYRTLAKLSAKHGPILRLQLGFRRVLIVSSPSAAEECFTKNDIVFANRPKMLFGKIIGVNYTSLAWSPYGDNWRNLRRIASIEILSIHRLNEFHDIRVEETRLLIQKLLSACNSGSSQVTMKFSFYELTLNVMMRMISGKRYFGGDNPELEEEGKRFRDMLDETFVLAGASNVGDYLPVLSWLGVKGLEKKLIKLQEKRDVFFQGLIDQLRKSKGTEDVNKKKTMIELLLSLQETEPEYYTDAMIRSFVLVLLAAGSDTSAGTMEWVMSLLLNHPQVLKKAQNEIDSVIGKNCLVDESDIPNLPYLRCIINETLRLYPAGPLLVPHEASSDCVVGGYNVPRGTILIVNQWAIHHDPKVWDEPETFKPERFEGLEGTRDGFKLLPFGSGRRSCPGEGLAVRMLGMTLGSIIQCFDWERTSEELVDMTEGPGLTMPKAIPLVAKCKPRVEMTNLLSEL

SEQ ID NO: 58080 - protein, 129 aa, Haemophilus somnus 129PT
MTKIIHTEKAPAAIGPYVQAVDLGNLVLTSGQIPVNPATGEIPADITAQARQSLENIKAILAQAGLAVADIVKTTVFVKDLNQFATVNAEYERFFVENNHPNFPARSCVEVARLPKDVGIEIEAIAVRQ

SEQ ID NO: 58081 - protein, 279 aa, Vibrio parahaemolyticus RIMD 2210633
MKLETVDYLADDAAQQFVASLRETGFGVLKNHPIPQELVESIYKNWHEFFCSEEKNDFQFNVETQDGYFPPSVSEVAKGHKVKDIKEYFHVYPWGQIPEQLKAEILEYYERANAFAQELLGWVEEYAPKDVQEKFSIALSEMINNSDKTLLRVLHYPPMTGEEEPGAIRAAAHEDINLLTVLPAANEPGLQVMSKDGEWIDVPCDFGNLIINIGDMLQEASGGYFPSTTHRVINPTGARQEKSRISLPLFLHPKPDTVLSERYTAHSYLMERLRELGVI

SEQ ID NO: 58082 - protein, 599 aa, Bdellovibrio bacteriovorus
MDPKYIRNFSIIAHIDHGKSTLADGLLSATGSLSDREKKDQFLDNMELERERGITIKAQTVCLDFKSKDGNMYQINLIDTPGHVDFSYEVSRSLAACEGAILVVDAAQGVEAQTLANVYLAMENNLEIIPVLNKIDLPSADPEGVAKQIEDTVGLDCTGIIHASAKEKIGITDILEAIVEKVPPPKADRSLTPRALIFDSWFDAYQGVVVLVRMVDGVIKKGDKIKFMATDRDYEVLRMGKYKPFPLMQDVLEAGEVGFIVCGIKDIRDVQVGDTVTSAKHPATQPLAGFQRIKPMVFAGIFPVVASEYENLKDALDKLCLNDSSLTFEVEKSAALGFGYRCGFLGLLHMEIVQERLEREFNLDLITTAPTVVYRITKTDGTEMMLENPSGMPVETQIAKFEEPYVKVTLHTPTDYIGGILKLCEDKRGIQQKMEYVTDKKVIIEYKLPMNEMVMDFYDRLKSISKGYASLEYEFVGFEESDLVKLDILINGEAIDALSLIVHRSKAQNRGRLLAEKMKELIPRQMYQVAIQAAIGAKIIARETLGAIRKDVTAKCYGGDISRKRKLLEKQKEGKKRMKAIGHVEVPQEAFLAILKVED

SEQ ID NO: 58083 - protein, 388 aa, Rhodospirillum rubrum ATCC 11170
MPVAESSAPAMTKRDFYEVLGVSKGASNDEIKKSYRTLAMRYHPDRNPNDAEAEANFREVNTAYEVLKDEQKRAAYDRFGHAAFEQAGAGRGAGDFGFGAGFADIFDEMFGEFMGGGRRGGSTAMRGADLRYNMEISLEEAFAGKKTTVHVPTSVSCESCRGSGSKGGAAPDGCPTCHGSGRVRAQQGFFTIERTCPTCHGQGKVIRDPCPDCAGSGRQRREKTLEVTIPAGVEEGTRIRLAGEGEAGLRGAPSGDLYIFLTIAPHRIFLRDGANIACKVPIPMTTAALGGTIEVPTIDGGRAAVTIPQGTQTGNQFRLRSKGMSVLRSASRGDMFVHAVVETPVNLTKRQEELLREFEEAGDKDTAHSPESSSFFKKVKEFWEDIAG

SEQ ID NO: 58084 - protein, 56 aa, Glycine max
KRFGMKLKIKKLVGKNSHNIIEAPFKVFAGAFGKATEYDPGPGGIIPSSKGVLSGS

SEQ ID NO: 58085 - protein, 448 aa, Methanocaldococcus jannaschii
MRAIIIGSGAAGLTTASTIRKYNKDMEIVVITKEKEIAYSPCAIPYVIEGAIKSFDDIIMHTPEDYKRERNIDILTETTVIDVDSKNNKIKCVDKDGNEFEMNYDYLVLATGAEPFIPPIEGKDLDGVFKVRTIEDGRAILKYIEENGCKKVAVVGAGAIGLEMAYGLKCRGLDVLVVEMAPQVLPRFLDPDMAEIVQKYLEKEGIKVMLSKPLEKIVGKEKVEAVYVDGKLYDVDMVIMATGVRPNIELAKKAGCKIGKFAIEVNEKMQTSIPNIYAVGDCVEVIDFITGEKTLSPFGTAAVRQGKVAGKNIAGVEAKFYPVLNSAVSKIGDLEIGGTGLTAFSANLKRIPIVIGRAKALTRARYYPGGKEIEIKMIFNEDGKVVGCQIVGGERVAERIDAMSIAIFKKVSAEELANMEFCYAPPVSMVHEPLSLAAEDALKKLSNK

SEQ ID NO: 58086 - protein, 449 aa, Schizosaccharomyces pombe 972h-
MPGDVEGCQHLKLKPADVENYQKICTQIFSCHFVPRRCSTCKRINKRSIRCLSCHSVGCLWGHHGEEHAMEHTHMIGVDVKNGHTYCFGCQDYVYQTELETLRFKIKNIKAWQSDHKRLPEKYNQMVCLEAYRKYPPVCATAGLRGIQNLGATCFMSVILQSILHNPLVRNLFFSGFHTSTDCKRPTCMTCAIDDMFSSIYNSKNKSTFYGPTAVLNLMWKLSKSLCGYSQQDGHEFFVYLLDQMHTESGGGTSMPCTCPIHRIFSGSLKNVVTCLDCKKERVAVDPLMDISLDINEPTLQGCLERFVSKEKVQYSCHSCGSKNAIKQLVFDKLPPTICMQLKRFEQNNFAMSTKIDKQVSYPAFLRMRYNFNQDDVDYQLYSVVCHKGTLDTGHYIAYTYYQNQWFLLDDTTIVEVKESEVLNSQAYLLFYHERQILYSDEMTVKTEN

SEQ ID NO: 58087 - protein, 444 aa, Schizosaccharomyces pombe 972h-
MPEGAGRPWNLTELEEEKLKTMWSYLFKLFGITLLERTESWYTVKTHLSDDSSSSSSHRLSSVSYAKSRTRLELTSSSHGSDTRSFNDKTKNVHLERVEKIASEWDPEGLRVCFWDAVNCDDPDGLLLRFLRARKWNVEAALEMFMKTVHWRSREMNVGEIVCNADHLDKDDDFVRQLRIGKCFIFGEDKHNRPVCYIRARLHKVGDVSPESVERLTVWVMETARLILKPPIETATVVFDMTDFSMSNMDYGPLKFMIKCFEAHYPECLGECIVHKAPWLFQGVWSIIKSWLDPVVVSKVKFTRNYRDLQQYINPDNILKEFGGPNPWRYTYPEPCQNEAEALKNVEARKSLRAKKDAIAKQYEEVTMDWILNNGDMAEVKQKRRKLASQLIDAYWNLDKYIRARSVYDRMGLIAPQTSHTLLLSQPTNGDVKESMVEVTSSAT

SEQ ID NO: 58088 - protein, 490 aa, Escherichia coli O157:H7 EDL933
MSRMAEQQLYIHGGYTSATSGRTFETINPANGNVLATVQAAGREDVDRAVKSAQQGQKIWAAMTAMERSRILRRAVDILRERNDELAKLETLDTGKAYSETSTVDIVTGADVLEYYAGLIPSLEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVASGKKVMANSAASSLKEVTMELGGKSPLIVFDDADLDLAADIAMMANFFSSGQVCTNGTRVFVPAKCNAAFEQKILARVERIRAGDVFDPQTNFGPLVSFPHRDNVLRYIAKGKEEGARVLCGGDVLKGDGLDNGAWVAPTVFTDCSDEMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 58089 - protein, 380 aa, Kineococcus radiotolerans SRS30216
MKAVVYQGPKDVVVKEVPDARVEEPTDAVVRITTTNICGSDLHMYEGRTSVEEGKVLGHENTGVVEAVGSGVSRVKVGDRVSVPFNIACGSCRNCVHGWTSFCLRMNPTEGMDGAAYGYANMGPYDGGQAEFLRVPHADFNLLDLPAGTEHENDFTMLSDIFPTGWHGVELSGMVPGDDVAVFGAGPVGLMAAHSALIKGASRVFVVDKAPDRLRLAASIGAVPVDFSAGDPVEQITEQTRGRGVDRGVEAVGYQAHDPSGEEHPELVLDNLVKVVRATGGIGVVGVYMPEDPGAANEGAKQGRIGWDYGTFFTKGQSMGTGQAPVMRYNRQLRDLIVAGRATPGFIVSHELPLEQAPEGYRNFDDRVEGWTKVLLHPGS

SEQ ID NO: 58090 - protein, 702 aa, Desulfotalea psychrophila LSv54
MRHILFDLEIYRAQMQRILGVKEENDVFWRALDFAVDAHDDQWRKSGDAYILHPCYVAKILAGEMDITHPEILAAALLHDTIEDVEEVTAEVVGELFGSYVQAIVEGCTKVTHVSDNKQLNSKRTHRKIFSGAALRPEVMLVKLADRLHNLRTLQAMPKRKRQRIADETLDIYAPLATVFGLFCMKREMYNLALLYKFPKQGVKLKGYVRNIGNEPIVTKIAEALRESASELDLDCDVNIRIKDLWAYYDTNSHILLKQIDTPVEILILVDEPSSCYHALGVVNQTFPPIPRTIRDFISNPKPTGYQGLHARTIIEGRKYLVKIRTKEMALQGQRGIFRDWSSKTGKQGKFVQEIQEMFDIIGTDDSFSYRDVIAASGKKEVYTYTPNGDLICLPVNSTVLDFAFRVHTHIGLSCLGALIRSEKVGPAHVLRDGDMVRVIHSDEPIRFEQENLAACKTPRARSELAKGFRARRRKVTTIVGATILRQEMLRYGLPIDLLTSPNIDICLKRFSIDCLDDLHALIGEGRLHLHTIISAIKEDLFDGISPLVDPTGAFNSIEITTLDPVSVKLSSCCKPNPTAKDNFALLTPHGLSVHHKRCKTLEKLNFRRDDAVNITWRTRQTNVRKPQIISIPRASSAEVMSALSNAPIFMKIHEVKLVSVRHEVPEPAWQITFKVENLFELHRVQRYLQKTSLIYQSVFKV

SEQ ID NO: 58091 - protein, 248 aa, Mycoplasma pulmonis UAB CTIP
MKKLLIIGNWKMNKTYDEARDFINAFSNAYALNGAKISENIEYGIAPSFTNMSLFNKELLEKTNINLVAQNINENRSGAFTGEISAQMLKSINAKYVIVGHSERRQNYRETNKIVNQKAKAAIENGLIPIICVGESLEEYEAGKTKAVIKKQIKQSLEALDLSKIVVAYEPIWAIGTGKVATAEVAQQICKFIRSITSKDLIIQYGGSVSPSNIENLMKQEDIDGALVGGASLEVDSFFELITFNALK

SEQ ID NO: 58092 - protein, 365 aa, Pinus sylvestris
CQSARTLQPVRATATEAPPRVQRSSGKERTKIGINGFGRIGRLVLRVALSKEDIEVVAINDPFIDAKYMAYMFKYDSTHGVYKGSLKIVDDTTLEIDGHRITVNSKRDPSEIPWGNYGAEYVVESSGAFTTTEKASAHLKGGAKKVVISAPSADRPMFVVGVNEGSYKPEMSIVSNASCTTNCLAPLAKVVNEEFGIAEALMTTVHATTATQKTVDGPSMKDWRGGRGAGQNIIPSSTGAAKAVGKVLPELNGKLTGMAFRVPTPNVSVVDLTCRLEKPASYDDIKAAMKAASEGSLKGILGYTDEDVVSNDFVGDARSSIFDAKAGIALSSTFVKLVSWYDNEWGYSNRVVDLISHMALVASRK

SEQ ID NO: 58093 - protein, 519 aa, Magnaporthe grisea 70-15
MGVQDFANLFLGGRFSGSVTTAAMLLFLVVVLVVSGVRSIRSISARRRFIAENNCKPAPAWPQKDPILALDFILKGLANFKQKKFLDGWTKYYEDLGPTFTTKSAGMLYINTIDPENIKTVLATRFRDFSLAERVEIMGPLLGRGIFVTDGDEWAHSRALLRPNFAKEQVADLGMIDRHFSDLMALLRPHAADGTTVALQPLLMRMTMDTATEFLFGQSTRTLSVEQADSAGNAFSRAFQFSLNEMAHLFRLGPFRILRRQSRELKDSHDICRAYVDGFVDEAWAWKQGGKTDGRTNFLRDLVESTDNKQKVRDELLNILIAGRDTVASVLGSLFRVLAQRPEIWAKVRAEVAQFEGELPRYDQLRDLKYAKYCINEALRLWPAVPLNGRLAVRDTVLPRGGGPNGDEPVYVPKGSLVNYSVYSMHRRTDFYGADAEEFRPERWEGKIQGWQYLPFNGGPRICLGQQYALTEMLVVLVRFAQEFSHIESRESTPWQEELHLTVQPANGVQVALTAANTA

SEQ ID NO: 58094 - protein, 521 aa, Oryza sativa (japonica cultivar-group)
MGNSLPVESKFTFEEENDRIKYVVSSMQGWGEKMEDAHAAILNLDDATSTSFFGVYDGHGGAEVALYCAKQFHIELCNHEDYHNDLINALDNVFLSMDENLQQSDAWRELVIPHDNGCMYFLKAGVCAKPFPQATYTGPAYEGSTACVVVIRGNQMIVGHVGDSRCVLSRQGGLAIDLSFDHKPCTRTESERERVQNAGGRSLGLRCEQVMGNYVVKEQWVLGDFGGGVTISRSIGDFAFKKNKDLDREKQMLVCDPDILADDITDDMEFLVIASQGLWSCVDSADVVSYIHDRLSVEGAELRVICEEVVEFGLASGENTTVILVQFKPGAFQYQLVDPAGFGTAVSNIASTSAAPAGASDTSDEGVMADSCATADTSGSARAESGELVPTPSANNTVTDEVDPTGTVAADDKVDPNSSANADADDGAPKPSLGAVIESDEVALDATATGHQVAVRQQEEFDPKKCWICGKGYKKILLEPSSARARNPLLAHAKTCESEDKKAKKKITKYMMKANVTNQYH

SEQ ID NO: 58095 - protein, 602 aa, Clostridium tetani
MTSERQKRVRNFSIIAHIDHGKSTLADRLLEETGTLTQREMDEQTLDTMDLEKERGITIKSQAARLIYKRDDEKEYILNLIDTPGHVDFNYEVSRSLAACEGAILVVDATQGIQAQTLANCYLALEHNLEIVPVINKIDLPSARPEEVKREIEDIIGIDASDAPLISAKTGLNIKDVLEAVVEKVPYPKGEEEEPLKALIFDSYYDAYKGVVCYVRVKEGTIKPGTEIKLMATGRKYEVTETGVFVPEYMKIDGLEAGDVGYITASIKNVRDARVGDTITEAKRPATEALEGYRPAIPMVFSGIYPVDGAKYGELKEALEKLQINDAALSFEPETSIALGFGFRCGFLGLLHMDIIQERIEREFNLDIITTAPSVIYKVTKTNKETIDVTNPTNLPEESEIAYMEEPIVECSIITPSDYVGPIMELCQNRRGVFKDMQYIETTRVVLNYDIPLNEIIYDFFDALKSRSRGYASLDYELKGYTQSKLVKLDILLNGDNVDALSMIVPEERAYSRGRQMAEKLKEIIPRQMFEVPIQAAVGSKVIARETVRALRKDVLAKCYGGDISRKKKLLEKQKEGKKRMRQIGSVEIPQEAFMSVLKTEE

SEQ ID NO: 58096 - protein, 285 aa, Aspergillus oryzae
MLYLVGLGLADETDITVKGLEVVKRAERVYLEAYTSILLVNKEKLEAFYGRPVIEADREKVESGSDEILAGADKTDVAFLVVGDPFGATTHTDLVLRARELGIESKVIPNASIMSGIGCTGLQLYNFGQTVSMVFFTENWKPSSYYDKIKENISLGLHTLVLLDIKVKEQSYENMARGRLIYEPPRYMTVAQCASQMLETEEERKEGVYGPDSLAVGAARVGAPDQKLVVGTLKELAEVEMGAPLHSLVLLGRRAHDLEKDYIREFAVDKATFDASWQKGYGATS

SEQ ID NO: 58097 - protein, 216 aa, Brassica napus
MRKEILPPVTTTTVKFLEKKPLVATLLALSLVMIIWNLPPYYHNLISTAARPCSAASPISLTTTTTTTTILSSTENSTASLAASTPSDPNKRVFKPFGNAAALFVLMGAYRGGPTTFAVVGLASKPIHVFGKPWFKCEWLSTNGTSLRAKAVKILPDWGYGRVYTVVVVNCTFPSNPNADNSGGKLMLNAYYNESPKLFERFTTLEETAGFYDESR

SEQ ID NO: 58098 - protein, 169 aa, Schizosaccharomyces pombe 972h-
MSSSNPRGIPPAQFFEFKELSMEEAQGHLEKFQEAIAKYKFMETSVVRRVASLDDKIPDIRKTLQSVQFLKERQGDSFTVTYELNDTLNAKAEVEAKDNVYLWLGANVMLEYTVEEAEALLTQKLNSAEETLKACKEDLEFLRAQVTTMEVNTARVYNYTVLLRKKTKM

SEQ ID NO: 58099 - protein, 1116 aa, Schizosaccharomyces pombe 972h-
MAADIGSQSSGSLEERFEQSLHLQNVDKQDWSLNSVLQFLKLYKFNKEWEDVFIKSRIEMDLFINLADQSKAEEFAFKNKLSKESAIQLSSCIRKTLLAPSSTRVPSKNSSYETLTYSAKDSSDDVFTETNSGFRSSNQNSSLKSFQSVPDSNVNVFGGFGGSVVDNNELLSTGKNSHQTTSLNLEGSPINLHAYKGTVTSIINDDSRNINKKTLSKQPVSEHKEKQTSFLRRFRVPGFSRDKDKTKDCPSSNSNPFHLASSNVKTLDASLDQGEWVPRIHRLESQIGLISKKKSFVLATMDDMKFTVVDITNVQNATQLRKLIAKSMYLDISIDQFDLFLTEVGGAQYIEILDDRKLDIARLYSDEFGTIKFFVKPSQNEESGMDSDTYLSFGTKSSSTYKADDDSIYHRKEDFKKQPSYPVLTSDFEITDAGPNLSLSGHQPDNKYYKGFSSAPNLAVVPELPSRRFRGFEKIRGAKGEMATKILDATEAQSEKNKFTVCRPHKKVTLKMPLNSGSSAPQSPSSNTSASVLTRNFVAHRDPPPPPTETSSLRRKNTLTRRPSIRHARSSPYIDTGHNEASKFSHTSFDPKASSKSSNSLKESVEALSEIPFEDAPALDESDLSGDPFWAIQPKQSSSQVPKENHHNIQSKLSINTEAATDLKANELSSPKTPEYCRGDDRSISLSPLSYRLRKSKHIRESPPSSKVINSGNWEVRPSADDLYEDVDRFFPRYDLDKVLVVDQSRMVSSPSKVSIRPKMKSVRLLAREASEARKEIRHNARRNKSGNLLRRSSTKLWGSRIVELKPDTTITSGSVVSQNATFKWMKGELIGNGTYGKVFLAMNINTGELIAVKQVEIPQTINGRHDQLRKDIVDSINAEISMIADLDHLNIVQYLGFEKTETDISIFLEYVSGGSIGRCLRNYGPFEEQLVRFVSRQVLYGLSYLHSKGIIHRDLKADNLLIDFDGVCKISDFGISKHSDNVYDNDANLSMQGSIFWMAPEVIHNDHQGYSAKVDVWSLGCVVLEMLAGRRPWSTDEAIQAMFKLGTEKKAPPIPSELVSQVSPEAIQFLNACFTVNADVRPTAEELLNHPFMKCDEEFNFKDTNLYDMLCKRKS

SEQ ID NO: 58100 - protein, 380 aa, Dimocarpus longan
MSSTVGQVIRCKAAVAWEPGKPLVIQEVEVAPPQAMEVRLKILFTSLCHTDVYFWEAKGQTPLFPRIFGHEAGGIVESVGEGVTDLKPGDQVLPVFTGECKECRHCKSEESNMCDLLRINTDRGVMLNDGKSRFSINGQPIYHFVGTSTFSEYTVVHVGCLAKINPAAPLDKVCVLSCGISTGLGATLNVAKPKKGSTVAIFGLGAVGLAAAERARIAGASRIIGIDLNPMRFDEAKKFGVTEFVNPKDYDKPVQEVIAEMTDGGVDRSVECTGNINAMISAFECVHDGWGVAVLVGVPNKDDAFKTHPMNVLNEKTLKGTFFGNYKPRSDLPSVVEKYMNKELELEKFITHEVPFSEINKAFEYMLGGVGLRCIIRMDA

SEQ ID NO: 58101 - protein, 361 aa, Desulfotalea psychrophila LSv54
MKKIAISTGGGDAPGLNAVIYAVVHACYRKGWEVYGSRNGYAGFLDLEEMIQLRPRDVEGIYAIGGTIIGSTNKGNPFANPVKNLAGETQVIDISDKILRNFKRMNFDCHIAIGGDGSMEIAHQFAEKGMPVIGVPKTIDNDLEETDRTFGFDTAVSTATEALDKLHSTAKSHDRVMVVEVMGRDSGWIALYSGISGGADIILIPEVPFDMDKVCEKITDNDLRGKDYSIVVVAEGAQALNGQRFIKGGLEPGRQEVILGGVGEWVATEIQRRTDKDTRSLVLGHLQRGGSPTTFDRLLALRFGAAAVRLVEQETFDHMVALKNSEMKAVPIADAIRARKKVDLTSDKVQTARDIGICLGD

SEQ ID NO: 58102 - protein, 204 aa, Ashbya gossypii ATCC 10895
MNTIINFQEGSAQALSEHSIFPDVLVSTAENGPSGHLVVEYPGESTAVTLGNVMPVEATQTVPNLMLITTEPGIVREGDLFTLAMTDPDAPSRSDHKWSEYCHFLETNITLGSDDGVSHVVLKGTPQVEHMGPAPPAGTGAHRYVWLLFRQPGRLELSEEEVTRLQSRVNWGYTEKRPPVGVGEFAGEKNLELMAVNFFYAENK

SEQ ID NO: 58103 - protein, 505 aa, Mycoplasma pulmonis UAB CTIP
MENKKNKKVILVVIDGLGLRKEKIGNAFELAKTPFFDKMFKEFPWSFIQASGKFVGLPEGQMGNSEVGHLNIGAGQIVYTGLSLINKDLEEKNFINNKAFLEVIEDVKKNNSTLHLMGLVSPGGVHSLEDHLFEIIDVAYQKGLKKVSVHVFGDGRDVAPRSIKSSFEKLEKITNKYNYDIASISGRFYSMDRDKIFERTEKAYEALLGNSNSKFDNWSEFLNKQYSQEISDEFFIPSINASKNVNFVKDGDSIIFFNFRPDRARQLTHLLIGSSLYDFKPKKPVKINKFCSMMKYEGIETLIAFEEMEIKNPIGKVAEKAGLKQLRLAETQKYAHVTYFMDGGVDIEYKNSKRIMVESQKVRSYADHPEMSAKGITDELIKNAKDFDLTILNYANPDMVGHTGVLTSTIKAVEILDYELSRLVDFAQKNNITVFITADHGNAEVTEDDKGNPQTKHTSNPVMLITSDKNLKLKDGKLANISPTILDYLDIEKHEDMNEESLIIK

SEQ ID NO: 58104 - protein, 548 aa, Triticum aestivum
MGNQNGTPGNDYYNRFPREHPASRYADGIEDDSYSDLKKSDKPWPDADSFRPTAAGILRQGLDPTSISVLGRQTADLREHYILGRKLGQGQFGTTYLCTEISTGCDFACKTILKRKLITKVDVEDVRREIQTMHHLSGHKNVVSIKDVYEDVQAVHIVMELLPGGELFDRIQGNGRYSEMKAAEITRIVVSIVAMCHSLGVMHRDLKPENFLLLDKDDDLSIKAIDFGLSIYFKPGQVFSELVGSPFYVAPEVLHKRYGPESDVWSAGVILYVLLSGVPPFWADTQKGIFDAVLKGHLDLESDPWPKISDSVKDLIRKMLCNCPSERLKAHVVLRHPWICQNGMATDGVLDPSVISRLKRFSAMNNLQKLALRVIAERLSEEEIAGLRELFKTVDIKNRGVITFGELRKGLTRYGNELVDTEICDIMEAADTDTDVTINYEEFIAATMPLNKIEREEHLKAAFTYFDKDGSGYITVDKLQRACAEYNMEGTLLEEIILEADRNNDGQIDYAEFVAMMLGNANGGNIGLGRPTMETSLNVTLRDAPQVH

SEQ ID NO: 58105 - protein, 1142 aa, Ashbya gossypii ATCC 10895
MGDKNNNVTSLRGDRIGPWKLGETLGAGSTGKVLLAQNTETGQIAAVKVISKSVFNAQGSTFVGSNDPDVLPYGIEREIIIMKLLNHPNVLRLYDVWETAQDLYMVLEYVEKGELFNLLVQRGPLPENEAVRFFRQIIIGISYCHALGIVHRDLKPENLLLDHKFNIKLADFGMAALESKDKLLETSCGSPHYAAPEIVSGLPYHGFESDVWSCGVILYALLTGRLPFDEEDGNIRNLLLKVQSGKYEIPGEDEISPEARDLIVQILTVEPEQRIKTREILKHPLLQKYPSIKDSKSIRNLPREDTYLNPLDHNDGTIDQAILQNLVVLWHGRDKNEITMKLKEPGANLEKTFYALLHRFKFENEQQQLKQQQIAKRISSTSSSPQQNIVKSSSRRSINNILSTPKKKRSSAINVSSAHKRPVSIQKLNDCGTLNPTSPSKKRSLSNRKLSAVLAGSNSSSPSRKRMSVGQDAPPVPTAVLRDYNKRASRASKRLSFLPSKRGSITTKIIATYAKLSEDNDWEYIDREAKRTSSDFATLIDNIFEHEKYEQIRREKEELERKVREAKEREERERRARAEAERRKREEEERRRRREVEELIRQRELQKSLEEQVARLKAEVAATKQEKRISLAQEQHVRSISEPMERKGTRPSKRDSFLALQNNINSLLKRRTLSLETRPISRLDPGIRLSEENTILEDDLECNEDRLRVEKNILETIRRSKFLGSQYDIDKELQRVRREKLEKVNMRKSQDRKLEPGLHSRQEQRFVSDGTTVTSSHEDSESIILPKNVTAIGVLKDEESEPRKLSEVKIPQFTRRSKHFSASSKRLSVLSMYSTKVSYTNLADYLNNDVQLKSLQPSAPTSIKIPQEPEFMFESAGQENRYQAAAPTDTYLERPKVGVEGDHEPGEPVELIELDDSEDRSKQYSEEDIAKVKLPILPPLDHLNKPNGLGIYQAPAPPKEPLGQPVMKSMIPDDIKIKCVPNQLSPRRRATERAPEKKLTKTVPERVIAAETFPPPNTKKKPSFFKKFSREKMHSDCDVQLDTTVGDSKMFRALNKLLNGWTSYGLKEVRSMPASYTITGKLSSDNILSLRSTAFEIVILSVADTGSSVKFTKKSGSKKTFTRLVNEIEKILEKESVLVLAS

SEQ ID NO: 58106 - protein, 561 aa, Kineococcus radiotolerans SRS30216
MNAGPVDPTTTAAWSSLSEHRSATTPDLRGWFAADPARARDLTLDVADLHVDLSKNLVTADTVALLLQLAEQTGVLARRDAMLAGEHVNVTEDRAVLHTALRRPAGASPALEVDGQDVDGDVQAELAKVFTFADAVRSGEWRGVTGKAITTVVNIGIGGSDLGPVMAYEALKPSVRAGLECRFVSNIDPTDVAETTKDLDPETTLFIVASKTFGTLETLTNARLARAWLWRGLAAAGVLADSDEARQEAVAKHFVAVSTALDKVAAFGIDPANAFGFWDWVGGRYSVDSAIGTSLAVAIGPEAFREFLAGFHAVDEHFRTTAPERNVPLLMGLLNVWYVNFLDAHTHAVLPYSQYLHRFPAYLQQLTMESNGKSVRYDGEPVTTHTGEVFWGEPGTNGQHAFYQLIHQGTRIVPSDFIAFATPAHPLVDGDADVHALFMANFFAQTKALAFGKTAEEVRAEGTAEDVVAARVFSGNRPTTSIMAPSLTPAVLGQLIALYEHVTFVEGAVWGIDSFDQWGVELGKKLALEIAPALTGDTAALEAQDPSTGALIRYYLEHRRD

SEQ ID NO: 58107 - protein, 294 aa, Magnaporthe grisea 70-15
MTPPQSIATPAPANEGHAIVLRISTPPIIGSNAFASWPSSDITTLEEWEAHQASLPASTLQIIYFHAPWAPPCAQMATVLKTLSSEYPVTDPLATSWVSLDAEDLSDVSETYDVTAVPFVVLSRGGKVLESISGNSAQRVRTAIETHTSSSGPGASSAGAPVAASDEAAKAEGAPQDPEKQKEELFKRLADLVKAAPVMLFMKGTPSAPQCGFSRQLVALLRENSVKYGFFNILADDEVRQGLKEFADWPTYPQLWMDGELVGGLDIVKEEIGNDPDFFKAYSVKASTDAAGTS

SEQ ID NO: 58108 - protein, 501 aa, Oryza sativa (japonica cultivar-group)
MATWILGWLLWLPVFLISLYLVDILAHSCRRLPPGPRPLPFIGSLHLLGDQPHRSLAGLAKKYGPLMSLRLGAVTTVVVSSPEVAREFVQKHDAVFADRSIPDSIGDHTKNSVIWLNPGPRWRALRRIMATELFSPHQLDALQQLRQEKVAELVDHVARLAREGAAVDVGRVAFATSLNLLSRTIFSRDLTSLDDRGASREFKQVITDIMEAAGSPNLSDFYPAIAAVDLQGWRRRCARLFTQLHRLFDDEMDHRKLHSRHGGPGENGKEKDDFLEVLLRLGARDDDIAGLDGDTLRSLFIDLFAAGSDTSSSTIEWAMVELLKNTLSMGKACDELAQVVGSRRRIEESEIGQLPYLQAVIKETLRLHPPVPLLPHRAKMAMQIMGYTIPNGTKILINVWAIGRDKNIWTEPEKFMPERFLDRTIDFRGGDLELIPFGAGRRICPGMPLAIWMVHVVLASLLIHFKWRLPVEVERNGIDMTEKFGLTLVKAIPLCALATPT

SEQ ID NO: 58109 - protein, 117 aa, Mycoplasma pulmonis UAB CTIP
MKNKLLQLVEQNQIRKDLPNFNTGDNVKVHLRIKEENKERIQIFEGLVIAKDGPGKGLSQSFKVRKISSGIGVEKDFPLNSPIISAIEVIRRNKVRRKKLYYIRNKSGKSARLKEKK

SEQ ID NO: 58110 - protein, 252 aa, Streptococcus pyogenes MGAS8232
MSRKPIIAGNWKMNKNPQEAKAFVEAVASKLPSTDLVDVAVAAPAVDLVTTIEAAKDSVLKVAAQNCYFENTGAFTGETSPKVLAEMGADYVVIGHSERRDYFHETDEDINKKAKAIFANGLTPIICCGESLETYEAGKAAEFVGAQVSAALAGLSAEQVASLVLAYEPIWAIGTGKSATQDDAQNMCKAVRDVVAADFGQEVADKVRVQYGGSVKPENVKDYMACPDVDGALVGGASLEADSFLALLDFLN
